United States Patent 12,569,549 (FLAVIVIRUS VACCINE) - sequence listing, part 71

SEQ ID NO: 24358 - RNA, 9879 nt, synthetic construct
  misc_feature 1..9879: note = derived and/or modified CDS sequence (opt11) from DENV-1__FJ898387__SS-prME
  source 1..9879: mol_type = other RNA
agcgtgaccatgcttctcatgctgatgcctaccgccctcgctttccacctcacaacccgcggcggggagcctcacatgatcgtgtcaaagcaggaacggggtaaaagcctgctgttcaagaccagcgccggggtgaatatgtgcactctgatagctatggacctcggcgagttctgcgaggacacgatgacctataagtgtccccgcataaccgaggccgagcccgacgacgtggactgctggtgcaacgcaactgacacttgggttacctacggtacctgcagccagaccggtgagcacagaagggacaagcggtccgtggccctggcgccccacgtaggcctcgggcttgagacgcgcaccgagacctggatgagctccgaaggcgcctggaagcagatccagagagtggagacgtgggccctgcgccatcccgggttcacagtgattgcactattcctggcgcatgctatcggtaccagcatcacacagaaggggatcatattcatcctgctaatgctggtaacaccctccatggccatgcggtgcgtcggtatcggaagccgcgacttcgtggaaggcctttcaggggccacttgggtggacgtcgtgctcgagcatggaagctgtgtcaccacaatggcgaaggacaagcccacgcttgacatcgagcttcttaagacggaagtcaccaaccccgcggtgctgcggaaactgtgcatcgaggcaaagatctcgaataccacaacggatagccgctgcccgacccaaggcgaagccaccctggtagaggaacaggacgccaacttcgtgtgtcggcgcaccttcgtggaccgcgggtgggggaacggctgcggactattcggcaaggggtccctgataacatgtgccaagttcaaatgcgtgaccaagctcgagggtaaaactgtccagtacgaaaatctgaagtattcggtgatagtgaccgtccatacgggtgaccaacaccaggttggaaacgagtccaccgagcacggcaccacagccactatcacgccccaggcgcccagcaccgaaatccagttaactgactacggagcccttaccctggactgcagcccccgtacgggcctggacttcaacgagatggtcctgttgaccatgaaggagaagagttggctggtgcataagcagtggttcctcgacctcccgctaccctggacaagcggggccagcacgagccaggagacatggaacagaaaggaccttctggtgaccttcaagaccgcgcacgcaaaaaagcaggaagtggtggtgctcggctcccaagaaggcgccatgcacaccgcactcacaggggctacggagatccaaacctccggtactactaccatattcgctgggcacttgaagtgccgcctgaagatggacaagctcaccctgaagggcatgtcctacgtgatgtgtacgggaagctttaaattagaaaaagaggtggcggagacccagcacggaaccgtgctcgtccagattaagtacgaaggcaccgatgccccctgcaagatccccttctcgacccaggacgagaaaggagtgacccagaacggacggctgatcaccgccaaccctatcgtgaccgacaaggaaaagcccgtcaacatcgaggccgagccgccgttcggcgagagctacatagtgatcggcgcgggcgagaaggccttgaagttgtcctggttcaagaaagggtcatccatcgggaaaatgttcgaagcgaccgcccgtggggcaagacgcatggctatcctaggtgatactgcatgggacttcggctctatcggcggtgttttcacctccgtggggaaactggtgcaccaaatctttggcacggcctacggggtactgttcagcggcgtcagctggactatgaagatcgggattggcgttctcctgacttggttaggcctcaacagccgttccacaagcttatccatgacttgcatcgccgtggggctggtgacattatacctgggggtgatggtgcaagcggacagtggatgcgtgatcaactggaagggccgggaacttaagtgcggttcgggcatttttgtgacgaacgaggtccacacctggaccgaacagtacaaattccaagccgacagccccaagcgtctcagcgccgccatcggtaaagcgtgggaggagggtgtgtgcgggatccggtccgcaacccgcctggagaacatcatgtggaagcagatcagcaatgaactgaaccatattctcttggagaacgatatgaagttcaccgtggttgtcggcgacgtggctgggatccttgcccaggggaagaagatgattagacctcagccgatggaatacaaatactcttggaaatcgtggggtaaagccaaaataatcggtgccgacgtgcaaaacactacctttataatcgacgggccaaacaccccggaatgtcccgacgaccagagggcatggaatatatgggaggtcgaggactatggtttcgggatcttcaccacgaatatttggctgaagctgcgggactcctacacgcaggtctgcgaccaccggctgatgagcgccgccatcaaggactccaaggccgtgcatgctgacatgggctattggatcgaatccgagaaaaatgagacctggaagctcgcgcgggctagcttcatcgaagtcaaaacctgcatctggccaaagagtcacacgctgtggtcgaacggcgtactggagagcgaaatgattataccaaagatctacgggggcccgatcagccaacataactaccgcccgggttacttcacccagaccgcgggcccgtggcacttaggtaagctagagctggacttcgacctgtgtgagggcacaacggtggttgttgacgagcattgtggcaaccgcggaccctccctgagaaccaccaccgtgacgggcaagataatacacgagtggtgttgccggagctgcaccttaccgccactgagattcaagggggaggacggctgctggtacgggatggagatacggcccgtaaaggaaaaggaggagaatctggtcaagagcatggtaagtgcgggctccggcgaggtagactcgttctccctggggttgctctgcattagcatcatgatcgaggaggttatgcgctcccggtggagccggaagatgctgatgaccggcacgctcgccgtgttcttcctgctcatcatgggtcaattgacgtggaacgacctgatccggctgtgcatcatggtcggcgcgaacgccagcgatcgcatggggatgggaacaacctacctcgccctaatggcaacgtttaagatgcgtcccatgttcgccgtgggtctcctgttccgtcgccttacaagccgggaggtactcctcctgaccatcggtctctctcttgtagcgagcgtagagcttcccaattccttagaggagctcggggacgggctggccatgggcatcatgattctgaaactccttacggacttccagagccaccagctctgggctaccctcctatcgcttacgttcatcaaaaccactttctccctccattacgcctggaagaccatggcgatggtgctatccattgtaagcctcttcccactctgtctcagtacgacgagccagaagacaacctggctgcccgtgctcctcggctcgcttggctgtaagccgttaacgatgttcctgatagccgagaacaagatctggggcaggaagtcgtggcccctgaacgagggaataatggccgtcggcattgtgtcgatacttctgagttcactgctcaagaatgacgtgcccctggcaggtcctctgatagccggcggtatgcttattgcgtgctacgtcatctccggaagcagtgctgacctaagcctggagaaagccgccgaggtgagttgggaagaggaggctgaacactccggtgccagccataatatcctcgtggaggtccaggatgatgggacgatgaagattaaagacgaagagcgggatgacaccctgaccatactgctcaaagccactctgctggctgtcagcggcgtctaccccctttctatccccgcaacgcttttcgtctggtacttctggcagaagaagaaacagcgaagcggggtgctgtgggatacgccaagcccgcctgaagtcgagcgggccgtcctagacgatggaatttaccgcatcatgcagcggggcttactgggacggagccaggtgggtgtgggggtgttccaagaaaacgtgttccatacgatgtggcacgtgacccggggagcggtgttgatgtatcagggcaagagactcgagccctcctgggcgtcagttaagaaggatctgatctcctacggcggcggatggagactgcaggggagctggaacacaggggaagaagtgcaggtcatcgccgtggagcccggcaagaatcccaagaacgtccagaccgcccctgggaccttcaagacctcggagggcgaggtcggggcaatcgctctggacttcaaacccgggacgagcgggagcccaatcgtgaaccgggagggcaagatcgtggggctgtacggtaacggtgttgtgaccacctccggaacctatgtgagcgccatcgcacaggccaaggcgtcccaggaaggacccctacctgagatcgaggacgaggtattccggaagcgcaaccttacgattatggaccttcaccccgggagcggaaagacacggcgctacctgcccgctatcgtcagggaggcaataaaaaggaaattacgaaccctgatcttggcccccacccgggtggtggcctccgagatggcggaagcactaaagggaatgcccattcgataccaaactaccgccgtcaagagcgagcacaccggcaaggagatcgtagatctgatgtgccacgctactttcactatgcggctcctctcccccgtcagggtacccaactacaacatgatcattatggacgaggcccacttcaccgacccaagctccatcgctgcccgagggtacatcagtacccgcgtggggatgggagaggccgccgcgatcttcatgacggcaacgccgcctggctccgtcgaggcattcccccaaagcaacgccgtgatacaagatgaggagcgggacatcccggagcgttcgtggaactccggatatgagtggatcaccgacttccccggtaagactgtgtggttcgtaccatccatcaagtccggcaacgacatcgccaactgtctgcggaagaacgggaaacgggttattcagctgtcccgcaagacctttgatacggaataccagaagactaagaacaacgactgggactacgtggtcactaccgatatcagcgaaatgggagcgaatttccgcgccgaccgggtgatagatccgagacgctgcttgaaacccgtgatcctgaaggacggccccgaaagggtcatactggccggtcctatgcccgtaaccgtagcctcggctgcgcagcggcgcgggaggatcggccgcaaccacaacaaggagggagaccagtacatctatatgggccaacccttgaacaatgacgaggaccatgcccattggacagaggctaagatgcttcttgacaacatcaacacgccggagggcataatccccgctctcttcgagccggagcgagagaagtccgccgctatcgacggggagtataggcttcgcggtgaggccagaaaaaccttcgtggaactgatgcgccgcggggacctcccggtgtggctctcgtacaaggttgcgagtgaggggtttcagtactcggaccgcaggtggtgctttgacggcgaacgcaacaaccaagtactggaagagaatatggacgtggagatttggacgaaggagggggagcgtaagaagctcaggccgcgctggctggatgcccgcacctattccgatccactggcactccgggaattcaaagaattcgcggccggccgccgctcagtctccggggacctgattctggagatcggaaaactgccacagcacctgacgcagcgggctcagaacgccctagacaatctagtgatgcttcataacagcgagcaaggagggagagcctaccgccacgcgatggaggagctccctgataccatcgagactctcatgcttctggccctcatcgccgtactgaccgggggtgttaccttgttcttcctcagtggccgggggctgggcaaaaccagcatcggcctgctctgcgtcatggcgtcatcagtgcttctgtggatggcttccgtcgagccccactggatcgccgccagcatcatcctggaatttttcctcatggtcctgctcatccccgagcctgaccgtcaacgcactccgcaagacaaccaactggcctacgtcgtcatcggactactcttcatgatcctcactgtggccgcgaacgagatgggcctactcgagaccactaaaaaagacctggggataggtcacgttgccgtggagaaccaccaccacgcggccatgctggatgtcgacctccaccccgcctcagcgtggacgttatacgccgttgccacgaccatcatcacccccatgatgcgccacaccatcgagaacaccacagccaacataagcttgaccgcgatcgcgaaccaggccgccattctcatggggctggataaaggatggccgatcagcaagatggatatcggcgtccccctgctcgccctggggtgttattctcaagtaaacccccttacgctcacggcggccgtcctaatgcttgtcgcgcactatgctatcataggccccggcctacaggccaaggcgacccgtgaggcccagaaacggaccgccgccggaatcatgaaaaacccgacggtagatgggatagtagccatagacctggaccccgttgtttacgacacgaaattcgagaagcagctgggacagataatgttgttaatcctatgcacctcccagatcctcctcatgcgaaccacatgggcgctatgcgaaagcattacgctcgctaccggccccctgaccactctctgggaaggatcacccgggaaattctggaacactaccatagccgtgtccatggcgaacatatttagggggagctaccttgctggcgctggcctggcgttctccctgatgaaatccctgggcggtggtcgccggggcaccggggcccaaggtgagaccctgggcgagaagtggaaacgccagctgaatcagttgagtaagagcgaatttaacacgtacaagcggtccggaatcatggaggtcgaccgcagcgaagcgaaagaaggactgaagcgcggggaaactacgaaacacgcggtgtcccgaggcactgcaaagctgcgatggttcgtggagcgcaacctcgtcaagccggaggggaaggtcatagacctgggatgcggccgcggcgggtggagctactattgcgccgggctgaagaaggtgaccgaggtcaagggctacacgaaaggcgggcccgggcatgaagagcccatcccgatggccacatacgggtggaatctagttaagcttcattccgggaaggatgttttcttcatacctcctgagaagtgcgacacgctcctatgtgatatcggggagagctcccccaacccgacgatagaggagggccgcacccttcgtgtcctgaaaatggtggaaccatggctgagggggaaccagttctgcatcaagatcctcaatccgtatatgccaagcgtcgtcgaaactttagagcaaatgcagcgcaaacatggcggcatgctcgtgcgcaaccccttaagtcggaatagcacgcacgagatgtattgggtatcctgcgggaccggaaatatcgtcagcgctgtgaatatgacctcccgcatgctgctgaacaggtttaccatggcgcataggaagcctacctacgagcgagacgtggatctaggagccggcacccgacacgtcgctgtggagcccgaagtagccaacctggatattatcggccagcgcatagagaacatcaagcacgaacacaagtctacgtggcactatgatgaggacaacccctacaagacctgggcctaccatggctcctacgaggtaaaacccagcggctcagcgagcagcatggtaaacggtgtagtcaaactcctcaccaaaccatgggatgtaatccccatggtcacccagatcgccatgacggacaccacccctttcggccagcaacgggtcttcaaggagaaggtggatacccggactccaaaggccaagcggggcaccgcccagatcatggaggtcacagccaaatggctctggggcttcttaagtcgcaacaagaaacctcggatctgcacccgtgaagaattcacaagaaaggtgcgctccaacgcggccatcggagccgtattcgtcgacgagaatcagtggaactccgccaaggaggctgtggaggatgaacgcttctgggacctcgtgcatcgcgagcgggagttgcacaagcaagggaagtgcgcgacctgcgtatacaacatgatgggtaagcgcgagaagaaattaggggagttcggcaaggccaagggtagcagggccatctggtacatgtggctcggcgctcgattcctggaatttgaggcactaggattcatgaatgaggaccattggttcagccgtgagaacagcctctccggggtcgagggggaagggctgcacaagctgggctacatcctccgcgatatcagcaagattccgggcggcaacatgtatgcggatgacaccgccggctgggatacgcggattacggaagatgacttgcagaacgaggccaagataacggacataatggagcccgagcacgccttgctcgcgaagagcatcttcaagctgacctatcagaacaaggttgtgcgtgtccagcggccggcaaaaaacggcaccgtgatggacgtgatcagccgaagagatcagcggggctcaggccaagtcggaacgtacggcctcaacaccttcaccaacatggaggcgcagctcatccgccaaatggaatctgagggtatttttagccctagcgaactcgagactcccaacctggcggggcgggtgttggactggctcgagaagcacggagtagaacgcctgaagcgcatggccatctccggcgacgactgcgtggtcaagccgatcgacgatcgtttcgcgacggctttaaccgcactgaacgacatgggaaaggtacgcaaggacatcccgcagtgggagccctctaaggggtggaatgactggcagcaggtcccattctgcagccaccacttccaccagctcataatgaaggatggtcgagagatcgtggtgccctgccgcaaccaggacgagctggttggacgcgcacgggtatcccagggagccggttggtcgctgcgagagaccgcttgcctgggcaaatcctacgctcaaatgtggcagctcatgtatttccaccgccgcgacttgcgcctagctgctaacgccatctgctctgcggtaccggtcgactgggtgcccacttccaggacgacctggagcatccacgcgcatcaccagtggatgaccaccgaggatatgctctccgtctggaacagggtgtggatcgaggagaacccatggatggaagacaagacgcacatttcctcttggggcgacgtgccctacctcggaaagcgggaggaccagtggtgtggaagcctgatcgggcttaccgctagggccacttgggcgaccaacatccaggtggcaattaaccaggtgcgccgcctgataggcaatgagaactacctggactatatgacctctatgaagcgctttaagaatgaatccgacccggagggtgccctgtggtga

SEQ ID NO: 24359 - RNA, 9879 nt, synthetic construct
  misc_feature 1..9879: note = derived and/or modified CDS sequence (opt11) from DENV-1__FJ898389__SS-prME
  source 1..9879: mol_type = other RNA
tccgtcacgatgttgctaatgcttatgccgacggcactagcctttcacctcacgacacgcggaggggaaccacacatgatcgtcacgaaacaggaaagaggaaaatccctactattcaaaacctccgccggggtgaacatgtgcaccctgattgcaatggatctcggcgaactatgcgaagacacaatgacctataaatgcccgagaatcactgaggcggaaccagatgatgtagattgctggtgtaacgccacagacacatgggtaacgtacgggacctgcagccaaaccggagaacaccggagggacaaacgaagcgtcgctctcgccccacatgtaggcctagggctagaaacgcgtacggagacgtggatgtcctccgaaggcgcatggaagcagatccaaagggtcgaaacgtgggcgctacgccacccaggttttacagtaattgcactattcctagcacacgccatcggaacctctatcacccaaaaaggcataatttttatcctcctcatgcttgtaactccaagtatggcaatgcgttgcgtcggcatcggcagtcgcgacttcgtcgagggtctgtctggggctacctgggttgacgtggtgctagagcacggatcatgcgtcacgacgatggcgaaagataaacctaccctggacatagaactactaaagactgaagtcacaaacccagctgttcttcgcaaactatgcatcgaagcgaagatatctaacacgacaacagacagccgatgcccaacccaaggcgaggctacactcatggaagaacaagacgcgaacttcgtatgccgcagaaccttcgtcgaccggggttggggcaatggctgtggactattcggaaaggggagcctgataacctgcgccaaattcaaatgcgttacaaaacttgagggcaagatagttcaatacgaaaatctcaaatactcagtaatcgtgaccgttcacacgggcgaccaacaccaggtgggcaacgaaagcactgaacacggcacgaccgcaaccatcacaccgcaagcccccacgtcggaaattcaactaacagactacggcgccctcaccctagattgctcaccacggacgggtctggattttaacgagatggtactcctcacaatgaaagaaaagtcctggctagtccataaacaatggttcctagacctaccgctaccctggacgagcggcgcctccacgagccaggaaacatggaaccgtcaagatctcctagtgacattcaagaccgcacatgctaagaaacaagaagtcgtagtactaggctcccaagagggggcgatgcatactgcactcacaggagcgacagagatccaaacgtctggcaccacgacaatttttgcagggcacttaaagtgcagactcaagatggacaaattgactttaaagggaatgagttacgtaatgtgcaccgggagctttaaacttgaaaaagaggtagcggaaacacaacacgggacggtcctcgtccagataaaatatgaaggaaccgacgcgccatgcaaaatacctttcagtactcaagacgaaaagggcgtaactcaaaatggaaggctgatcacggcaaaccctatcgtcacagacaaggagaagcccgtgaacatcgaagcagagccacctttcggagaaagttacatagttataggggccggcgagaaggccttgaaactctcgtggttcaagaaaggctcatctattggcaaaatgttcgaagctacagcacgaggagcaagacggatggccatcctgggggacacggcgtgggactttgggagcattggaggggtgtttacatcagtcggtaagctagtacatcaaatatttggaaccgcgtacggcgtcctcttttcaggagtctcgtggacgatgaagatcgggatcggtgttctgttaacgtggctagggttaaactccaggagtactagcctctcaatgacttgtattgctgtaggattagtgaccttatacctgggtgttatggttcaggcggatagcggctgtgtaatcaactggaaaggccgagagctgaagtgtggcagcggaatctttgtaaccaacgaagtgcacacgtggaccgaacaatataagtttcaagcagactcacccaagcggctaagcgccgcgatcgggaaggcctgggaagagggggtatgtgggattcgctcggccacaagactagaaaacatcatgtggaaacaaataagtaacgaactaaatcacatattactggagaatgatatgaagttcaccgtggtagttggggacgtagtcgggattctagcacaaggcaaaaagatgataagacctcaaccgatggaacataaatattcgtggaaaagctggggaaaagccaaaataataggggctgatgtgcaaaacacgacattcatcattgacggtccgaacactccagaatgccccgatgaccaaagagcttggaatatctgggaggtggaggactacggcttcggcatattcacaacaaatatctggctcaaactcagggacagttacacccaggtttgtgaccaccgcctcatgagcgccgccatcaaagatagtaaagccgtccacgccgacatgggctattggattgagagcgagaagaacgaaacctggaaacttgcacgtgcaagttttatcgaagtcaaaacatgcatatggcccaagagccacacactgtggtcaaacggagtcctggaatcggaaatgataattccaaagatatacggaggcccaataagtcaacataactatcgaccaggatacttcacccagacggccggaccctggcatctgggaaaactggagctagatttcgatctatgcgaaggaacaacagtcgtcgtggatgaacactgtggcaaccgtggtccatcactccgcacaaccacagtcacgggaaagatcatacacgagtggtgctgccggtcatgcaccctcccgccccttcggttcaaaggcgaggacggatgctggtacggcatggagatcagaccggtaaaagaaaaagaagaaaacctcgtgaaaagtatggtcagcgctggatcaggcgaagtcgacagtttcagtctcggcctgctgtgtatctccatcatgatagaggaagtcatgcggtcacgctggagtaggaaaatgctcatgaccggcacactcgcagtattcctatttttaattatgggccagttaacatggaacgacctgatacgcctatgtatcatggtgggggcaaacgccagtgacagaatgggcatgggaacaacctacctagccttaatggcaactttcaaaatgagaccaatgttcgcggtaggattgctattcagacggctgaccagtcgagaagtcctcttgctaacaattggactaagcctagtagcatcagtcgagctaccaaattcgctggaagaactgggggatggcttagcaatgggaatcatgatactgaaactgctgacagacttccaatcgcaccagttgtgggccaccctcttgtcattaacattcatcaaaactaccttaagcctgcattacgcatggaagaccatggcaatggtgctaagcatagtaagcctcttcccactatgcctttccaccacatcgcaaaagaccacctggcttccagtactgctcggttcgttcgggtgcaaacccctcgcaatgtttttaatagccgagaacaagatttggggacgcaaatcctggccactaaatgagggaatcatggcagtaggagtagttagtatattgctgagcagcttgctcaaaaacgatgtaccgctggctggcccactgatagcaggaggtatgttaatagcgtgctacgtcatcagcggcagcagcgcggacctatctctagagaaggctgccgaagtctcgtgggaagaggaagctgagcactctggggcctcacacaacatcctagtggaagtgcaggacgacggaacgatgaagataaaagacgaggaacgcgacgacaccttaaccatcctcctcaaggctacgcttctagcagtaagtggcgtgtacccactatcgatcccggcgaccttgtttgtgtggtacttctggcaaaagaagaaacaacgttccggggtattatgggacacaccgtcacccccggaggtagaaagggcggtgctagacgacggcatataccgaataatgcaacggggcctgttaggacgctcccaagtaggggtgggcgtcttccaagaaaacgtgttccacacaatgtggcacgtcacacgcggggccgtcctaatgtaccaaggcaaacgactagaaccaagttgggctagtgtcaagaaagaccttattagctacggcgggggctggaggctccagggcagctggaataccggggaggaggtacaggttatagccgtagaaccaggcaaaaatcccaaaaatgttcaaaccgcgccgggaaccttcaaaacccccgaaggtgaagtgggggcgatcgcgctcgacttcaaaccgggcacttcagggtcgcctatcgtaaatagggaagggaaaatcgtaggattgtacggtaacggagttgtaaccacatcaggcacttacgtttctgcaatcgcccaagcaaaggcttctcaagaaggaccacttccggaaatcgaggacgaagttttccgaaagagaaatctaactatcatggaccttcacccgggctccggcaagacacgccgatacctgcctgcgatcgttagagaagccataaagcgaaaactacgcacactgatactcgcccctacgcgagtggtagcaagtgagatggcagaggcactgaaaggtatgcccatacgctaccaaaccacagccgtcaaaagcgaacacacaggcaaagagatcgtcgatttgatgtgccacgcaaccttcacgatgcgcctgctttcaccggtgagagtgccaaattacaacatgatcatcatggacgaagcacatttcacggacccattcagtatagccgcaagaggatacataagcacacgggtcggaatgggcgaggctgcagcgatcttcatgaccgccaccccacctggatcagtagaggctttccctcagtcaaatgcggtcatccaagacgaagaacgagatatccctgaaaggagctggaacagtggctacgaatggatcactgatttccccggcaaaacagtctggttcgtaccgtccatcaaaagcggcaatgacattgcgaactgcctgcgcaagaacggaaaaagagtaatacaactgagtaggaagacgttcgatacagaataccaaaagactaaaaataacgactgggattatgtggtgacaactgacataagtgaaatgggagcaaactttcgcgcggatcgagtgatagacccgcgcagatgtcttaaaccggttatcctaaaagatggacctgaacgggtaatactggccgggcctatgcccgtcactgtcgcatccgccgcccaacgccgcggccgaatcggacgaaaccataacaaggagggcgaccaatatatatacatgggccaaccgctaaacaacgatgaggaccacgcacactggacggaggcgaaaatgttgctggacaatatcaacaccccagaagggatcatcccagcactcttcgaaccagaacgcgagaaaagcgcagctatcgacggcgaatacaggctgcggggagaggcaaggaagacattcgtggagctcatgcgacgcggcgatctcccggtatggcttagctataaggtagcatcagaaggcttccaatatagcgacagacgatggtgcttcgacggagagcggaacaaccaggtgctagaggagaatatggacgtggaaatctggacgaaagagggagaacggaagaaactccggcccagatggctagacgctaggacctactccgatccgctagcgttacgcgaatttaaggaatttgcagcaggacgcaggagcgtatcgggagatctaattcttgaaataggcaaactcccccaacaccttactcagcgggcccaaaatgcactggataacctcgtgatgctgcacaacagcgaacagggaggcagggcgtaccggcatgccatggaagaattacccgacacgatcgaaacacttatgcttcttgcacttattgcagtactgacgggcggagtcacattgtttttcctatccggcagggggctgggtaaaaccagcatagggttactgtgcgtgatggctagcagtgtacttctatggatggcctcagtagagcctcactggatagccgccagcataatccttgagttctttctcatggtcctactaataccagaaccagacagacagcgaacacctcaagataaccaactagcgtacgtcgtcataggacttttattcatgatactaacagtagcggccaatgaaatgggcctactagaaacaaccaagaaggatttgggcatagggcacgtcgcagtcgaaaaccaccaccatgcaaccatgttagacgtagacctacacccagcctcggcatggacactctacgccgtggccacaactatcataacaccaatgatgcgacacaccatagaaaacacgacagcgaacattagcctaacagctatagcgaaccaggccgcgatcctcatggggctggacaagggctggccaatatccaagatggatataggcgttcccctactggcgctcggctgctacagccaagtcaatcccctcaccctaactgcggccgtgttgatgctagtggcgcattacgccataataggaccaggcctccaagctaaggcaacacgagaagcccagaaacgcaccgccgcaggaatcatgaagaatccaacagtggatgggattgtagcgatcgacctcgacccggtagtctacgacgcgaagttcgagaaacagctgggtcaaataatgcttctaattctatgcacgagccaaatcctcctaatgcgtacgacatgggcgctctgcgaaagtataacgctcgctacgggacccctaacaacgctctgggaaggtagcccgggtaagttctggaatacaacaatagccgtgagcatggccaacatcttcaggggctcatacctcgcaggcgcgggattagccttctcgttaatgaagtcgctcggaggcggacgccgcggaacaggggcacagggcgaaacactaggcgaaaagtggaaaaggcagctcaatcaacttagcaagtccgagttcaatatatataaacgatcagggatcatggaagtcgacagaagtgaagccaaagaaggactaaagcggggcgaaacaactagacacgccgtatcacgcggaacagccaaactccgatggttcgtggaacgtaacctcgtcaagcccgaaggcaaggtaatcgacctaggatgtggccgaggagggtggagctactactgcgcgggtctgaagaaggtcacagaagttaaaggctatacgaaagggggccccggccatgaggagcctatccctatggctacatatgggtggaacctcgtcaagctccactcaggcaaagacgtcttcttcacacccccggaaaagtgcgacaccttactctgcgatatcggtgagagctccccaaaccccacgatcgaagagggccgtaccctccgggtactaaaaatggtcgagccatggctcaggggcaaccagttctgcattaaaatattaaatccatacatgccaagcgtcgtcgaaaccctggaacagatgcaaagaaagcatggcggaatgctcgtgcgaaaccctctttctcgtaactccacccacgagatgtactgggtaagctgtggaacagggaacatagtttccgccgtcaatatgacgtcgagaatgctccttaacagattcacaatggcccaccgtaaaccaacctacgagcgggacgtagaccttggtgcgggcactcgtcacgtcgcggtcgagccggaggtggcaaacctggacatcattggccaacgaattgaaaatatcaagcacgagcataaaagcacctggcactacgacgaggacaacccatacaaaacgtgggcctaccacggcagttacgaggtaaagccaagcggctcagcgagtagcatggtaaacggagtggtgaagctcctaacaaagccatgggacgtcattccgatggtgacccaaattgcgatgacagacaccacaccgtttggccaacaacgtgtgtttaaagaaaaggtagatacccgcaccccgaaagcgaagcgagggacagctcaaataatggaagtgacagcacgttggctctggggattcctttcgcgcaacaagaaaccacggatatgtacaagagaggaatttacacgcaaagtgcgatcaaacgccgcaatcggcgccgtcttcgtcgacgaaaaccaatggaacagcgcaaaagaagccgtcgaggacgagagattctgggacctcgtacagaaggaaagagaactacacaaacagggtaagtgtgcaacctgcgtgtataacatgatgggcaagcgagagaagaaactcggagagttcggaaaagctaaaggaagccgagccatatggtacatgtggctcggcgctcggtttttagagtttgaagccctagggtttatgaacgaagaccactggttcagtcgtgaaaactcgctctccggagtggagggagaaggactacacaaactaggatacatcctacgcgacataagcaagatccctggaggcaacatgtacgcagacgataccgcaggctgggacacaagaataactgaggacgacttgcagaacgaagccaaaatcaccgatatcatggagccggagcacgcgcttctggccacctcaatcttcaagctgacttaccagaacaaagtagtccgagtacaacgaccggccaagaacggcacggtgatggacgtgataagcaggcgtgaccagcgaggatcgggccaggtcgggacatatggccttaatacctttacaaatatggaggcacagctgattagacaaatggaatcagagggcatcttcctacccagtgaactagaaaccccaaaccttgctgaacgcgtactagattggctagagaagtacggagtcgagagattaaaacgaatggcaataagcggcgacgactgtgtcgtcaaacccattgacgatcgattcgcaaccgcgctcacagcgctaaatgacatgggtaaagtacgcaaagacataccccaatgggaacccagtaaaggatggaacgattggcaacaagtacccttctgtagccaccatttccaccaactaattatgaaagacggtcgggagatcgttgtcccgtgccggaatcaggacgagctggtgggtagagccagggtctcacaaggggccggatggagcctaagagagacagcatgcctaggcaagagctacgcacaaatgtggcagctaatgtatttccacagacgggatctccgcttagccgcgaacgcaatatgttcagccgtgccagttgactgggtaccgaccagtcgcacgacatggagcatacacgcacaccatcagtggatgaccacagaagacatgctctcagtgtggaacagggtatggatcgaggagaatccttggatggaagacaagacccacgtcagcagctggggagacgtcccatatctcggtaaacgcgaagaccagtggtgtgggtccttaataggattgacagcgcgggccacctgggctagcaatattcaagtcgcgatcaaccaagtgaggagactcataggcaacgaaaactatttggactacatgacgtcgatgaaacggttcaagaatgaaggagaccccgaaggagccctatggtag

SEQ ID NO: 24360 - RNA, 9879 nt, synthetic construct
  misc_feature 1..9879: note = derived and/or modified CDS sequence (opt11) from DENV-1__FJ898390__SS-prME
  source 1..9879: mol_type = other RNA
agcgtaaccatgctgctcatgctcatgcctaccgccctggccttccacctcaccacacggggcggggaaccccatatgatcgtgaccaagcaagagcgggggaaatcactgctgtttaagacatcagcgggcgtgaacatgtgcacactcatcgccatggacctgggagagctgtgcgaggacaccatgacctacaaatgccctcggatcactgaggcagagccggacgacgtggactgctggtgcaacgccacagacacctgggtgacctacgggacgtgctcgcaaacgggagagcaccgacgcgataagcgcagcgtagcccttgcgccacatgtaggcctcgggcttgagaccaggaccgaaacctggatgtctagcgagggcgcctggaagcaaatccaacgggtcgagacgtgggccctccgtcaccccggcttcaccgtaatagccctgttcctggcgcatgctatcggcacctccataacccagaaaggcatcatattcatactcctgatgctggtgacccccagcatggccatgcggtgtgtcggcatcggcagtcgcgacttcgtggaggggctctcgggcgccacgtgggtggacgtagtgctggagcacgggtcatgcgtgaccaccatggccaaggacaagccaacgctggacatcgagctactaaagaccgaggtcacgaaccccgcggtactgcgtaaactttgtatcgaggccaagatctcaaatacgaccaccgatagtcgctgccccacgcagggcgaggccacccttatggaggagcaggatgccaatttcgtgtgccgacgcacctttgttgacaggggttggggtaacgggtgcgggctgttcggtaaggggagcctcatcacttgcgccaaattcaagtgtgtgaccaagctggaggggaagatagttcagtatgagaacctcaagtactccgtgatcgttaccgtccacactggcgaccagcaccaggtcgggaacgagagcactgagcatggcacaacagccactatcacgccccaggcacccacctccgagatccagctcacagactatggggccctgaccctcgactgcagccctcgcacggggctcgacttcaacgagatggtactcctaaccatgaaggaaaagtcctggcttgtccacaaacagtggtttttggacctgcctctcccgtggaccagcggggcctccacctcgcaggagacgtggaaccggcaggacttattagtcacctttaaaacagctcacgcgaagaagcaagaggtggtcgtgctcggaagccaggagggcgccatgcacaccgcgctcacgggagccaccgagatacagacctccgggacgacgaccatattcgccgggcacctcaagtgccgcctcaagatggacaaactgaccctaaagggcatgtcctatgtgatgtgcaccgggtccttcaagctcgagaaggaggtagcggagacgcagcatggcaccgttctggtgcagattaagtacgagggcacggacgccccctgtaagatccccttctctactcaggacgaaaagggcgtgacacaaaatggccggctgataacggccaatccgatcgtgacggacaaggagaagcccgtgaacatcgaagccgagccgcccttcggcgagtcctacatcgtcatcggggtaggagagaaggcattaaagctcagttggttcaagaaagggtccagcatcggcaagatgtttgaagccaccgcccgcggtgcacggcgcatggccattctgggggacactgcgtgggacttcggatcgattggaggagtgtttactagcgtcgggaagctggtgcaccagatctttggtaccgcctacggggttctattctcaggagtaagctggaccatgaagataggtatcggcgtgctgctgacgtggctcgggctcaactcccgcagcaccagtctctcgatgacatgcatcgccgtggggctcgtgaccctgtatctgggggttatggttcaggcagacagtgggtgtgtcatcaactggaaaggcagagagctcaagtgcgggagcggtatattcgtgacgaacgaggtacacacatggaccgagcagtacaagttccaggccgacagccctaagcgcctgtcggctgccatcgggaaggcctgggaggagggggtctgcggcatccgatccgctacccgccttgagaacattatgtggaaacagatctccaatgagctcaaccacatcctgctggagaacgacatgaagtttacagtggtagtgggggacgtggtagggattctagcccaggggaagaagatgatccggccccagccgatggagcacaagtactcctggaaatcctggggcaaagccaagatcataggtgccgatgtccagaatacgactttcatcatcgacgggcctaacaccccggaatgcccggacgaccagcgggcctggaacatctgggaggtcgaagactacggatttgggatcttcaccacaaacatctggctgaagcttagagacagttacacccaggtatgcgatcatcgccttatgtccgctgcgattaaggacagtaaggccgttcacgccgacatgggctattggatcgagtccgagaagaacgagacgtggaagttagcccgggccagctttatcgaggtgaagacttgcatctggcccaaatcccacacactgtggagcaacggggtgctcgagtccgagatgatcattcccaagatctacgggggcccgatcagccagcacaactacagacccggctacttcacccagaccgcgggcccctggcatctggggaaattagagctggactttgacctatgtgaaggcaccacggtggtggtggatgaacattgcggcaatcgagggccgtcccttaggaccaccaccgtcacaggtaagatcatccacgagtggtgctgtcggagctgcaccctgccgcccctccgcttcaaaggcgaggacggctgttggtatgggatggagatccggcccgttaaggaaaaggaggagaacctcgttaaatccatggttagcgccggcagcggcgaagtcgactccttcagcctcggtctgctgtgtatctccatcatgatcgaggaggtgatgcgcagccggtggagtcgcaagatgctcatgactggcacactggctgtcttcttactgctgataatgggccagttaacgtggaacgacctaatccgactgtgcataatggtcggcgccaatgccagcgaccgcatggggatgggcaccacatacctggcgctcatggccaccttcaagatgcgccccatgttcgctgtagggctgctgtttcgccgcctcacgtcccgcgaagtgttactgctcaccatagggctgagcttagtggcgtccgtcgagctgccgaatagcctggaggagctgggcgacgggctcgccatgggcatcatgatacttaaactgttaacggatttccagagccaccagctgtgggcgacccttctctctctgacttttatcaagaccaccctgtcgctccactatgcctggaagaccatggccatggtgctgtccatagtgtctctattccccctctgtctgagcacgacctcccagaagaccacctggctgccagtcctgttgggttcgcttggctgcaagccgcttaccatgttcctgatcgcggaaaataaaatctggggccgcaagtcctggccgctgaacgaaggtatcatggctgtgggtgtcgtcagcatcttgctgagctccctgctcaaaaacgacgtgcccctggccgggccgttaatcgccggcggcatgctcattgcctgctacgtcataagcgggtcctccgcggacctctccctggagaaggccgctgaggtatcatgggaggaggaggcggagcactccggagcaagtcacaacatcttagtggaggtgcaggatgacgggaccatgaagataaaggacgaggagcgggacgacaccttgaccatcttgctcaaggccaccctactcgcagtctccggcgtgtatccgttgagcatcccggcgacgctgttcgtgtggtacttctggcagaagaaaaagcaacgctccggtgtcctgtgggacacccccagcccgcccgaggtcgaaagagcagtgttagatgacgggatatacaggatcatgcaacggggcctcctagggcgatctcaagtcggagtgggagttttccaggagaacgtattccacacaatgtggcatgttacccggggcgccgtgttgatgtaccagggaaagcgtttggagcccagttgggcctccgttaagaaggatctgatcagctacggcggcggatggcgactacagggctcctggaatacgggggaggaggtccaggtaatcgcggtcgagccaggtaaaaacccgaagaacgtgcagaccgcgcctggaacctttaagacccccgagggagaggtgggcgccatcgcactcgacttcaagcctgggaccagcggttcccccatcgttaaccgcgaaggcaagatcgtgggcctgtacggcaacggggtggttacgaccagcggcacatacgtgagcgctatcgcccaggcaaaggcgtcccaagagggaccgctgcccgaaatcgaggacgaggtgttccgtaaacgcaacctcacgatcatggatcttcacccaggcagcggtaaaacccgccgctacctgccggctatcgtgcgggaggccatcaagcgcaaactccgtacgctgatccttgcccccaccagagttgtggcatctgaaatggcagaggccctaaagggcatgccgatccggtaccagacgaccgctgtgaagagcgagcacaccggcaaggagatcgtagacctgatgtgccacgcaaccttcacgatgcgtttactctcccccgtgagggtcccgaactacaacatgatcattatggacgaggcccacttcaccgaccccagctccatcgccgccagaggttacatatcgacacgagttggcatgggggaagccgctgccatcttcatgactgccacccctcccggatccgtggaggcctttccgcagagcaatgcggtcattcaggatgaagagagagacattcccgagcggtcttggaacagcggctatgagtggatcaccgacttcccggggaagaccgtgtggttcgtgccgtccatcaagagcggcaatgacatagccaattgcctgagaaaaaacgggaagcgagtgatccagctgtccagaaagacctttgacacggagtaccagaaaaccaaaaacaacgactgggactacgtggtcaccaccgacatcagcgagatgggcgccaactttcgcgccgaccgggtcatcgatcctcgccggtgtctcaagccggtcatcctgaaagacgggcccgagagggtcatcctggcaggccccatgccggtgacggtggcctccgccgcccagcgacgcgggcggatcggacgcaaccacaacaaggagggggaccagtacatctatatgggtcagcccctcaacaacgacgaggaccacgcgcactggaccgaggcgaagatgcttctggataacatcaatacccccgaagggatcatccccgccctgttcgaaccggagcgtgagaaatcggctgccatcgacggggagtaccgcttacgcggcgaggcacggaagaccttcgtcgagctgatgcgccggggggacctccccgtgtggctgtcctataaagtggcgtctgaaggcttccagtatagcgaccgccgttggtgcttcgatggcgaacgcaataaccaggtcctcgaggagaacatggacgtcgagatctggacgaaggagggggagcggaagaagttacgcccacgatggcttgatgcccgcacctatagcgacccccttgccctcagggagttcaaggagttcgccgctggccgccggagcgtgtccggagacctgatactggagataggaaagctcccgcaacacctgacccagcgcgcgcagaacgccttggacaacctcgtgatgcttcacaactctgagcagggcgggcgggcctaccgccacgccatggaagagctgcccgacactatcgagacgctcatgctgctcgcgttgatcgccgttctaaccggcggggtaaccctgttcttcctctccggtcggggcctgggcaaaaccagcatcggcttgctctgcgtcatggcatccagcgtgctgctgtggatggcgtccgtggagccccactggatcgcagcgagcatcatccttgagttcttcctgatggttctgctcatccctgaaccagaccggcaacggacgccccaagacaaccagctggcctacgtcgtcatagggctactcttcatgatcctgacggtcgccgccaacgaaatgggcctgcttgagaccaccaagaaggatctgggaatcggccacgtagctgtagagaaccaccaccacgcaaccatgctggatgtcgaccttcaccccgccagcgcctggacgctgtacgccgtagctaccaccatcatcaccccgatgatgaggcacaccatagagaacacgaccgcgaacataagcctgaccgctatcgctaaccaggcagccatcctcatgggcctggacaagggctggcccatttccaagatggacatcggcgtccccttactggcgttgggatgctattcgcaggtcaatcccttgacattaaccgccgctgtgttaatgctggtggcccactacgcgattatcggccccggcctccaggccaaagccacacgggaagcgcaaaagaggaccgccgcaggcataatgaagaaccccacggttgacgggatcgtggccatcgacctggaccccgtagtctacgacgcgaagttcgagaagcaactgggccagatcatgttactgatcttatgcaccagtcaaattctcttaatgcgcaccacctgggccctgtgcgagagtatcacgctcgctaccggccccctgaccaccctgtgggaggggagtccgggcaagttctggaacacgaccatagcggtgagcatggccaatatattcagagggtcttacctcgctggtgcagggctggccttcagcctgatgaagtccctcgggggcgggaggaggggcactggggcgcaaggagaaaccctgggcgagaaatggaagcgccaactgaaccaactctccaagagcgagtttaacatctacaagcgtagcgggatcatggaggtggacaggagtgaagccaaggaaggcctgaagcgcggagagacgaccagacacgccgtcagccggggcacagcgaagctgcgttggttcgtggagcggaatctggtgaaacccgaggggaaagtcatcgatctgggctgcggccgcggcggctggagctactactgcgcggggctgaagaaagtaacagaggtgaaaggctacacgaaaggcgggcccggccatgaggagcccatcccgatggccacctatgggtggaatctggtaaagctgcactccgggaaggacgtgttctttactccaccagagaagtgtgacaccctactgtgcgacatcggagagagttcccccaatccaactattgaggaaggccggaccctccgagtgctgaagatggtagagccctggctgcgggggaaccagttctgcatcaagatcctcaacccctacatgccatccgtcgtggagaccctcgagcagatgcagcgcaagcacggcggcatgctggtgcggaatcctctcagtaggaacagcacacacgaaatgtattgggtgtcctgcggaaccggcaacatcgtgtcagccgtcaacatgacgtcccggatgctcctgaatcgcttcacaatggcccaccgaaaacccacctacgaacgggacgtcgacctcggggccggcacccgccacgtagcggtagaacccgaggtggcgaacctggacataatcggccaacggatcgagaacatcaagcatgaacacaagagcacgtggcactacgacgaggacaacccgtataaaacctgggcataccacggctcatacgaggtcaagccgagtggctcggccagcagcatggtaaacggggttgtcaagttgctcaccaagccctgggacgtgatccccatggtaacccagattgcgatgacggacacaacgcccttcggacagcagcgcgtctttaaggagaaggtagacacccggaccccgaaagcgaagcgcgggactgcacagatcatggaagttaccgcccggtggctctggggattcctttcccgcaataagaagcccaggatctgcacccgcgaggagttcacccggaaagtccgaagcaacgcggcaatcggcgccgttttcgtcgacgaaaaccagtggaactccgcaaaggaggccgtagaggacgagcgattctgggacctcgtccagaaagagcgcgagcttcacaagcaggggaaatgcgccacctgcgtctataacatgatgggcaagcgggagaagaagcttggcgagttcggcaaggctaagggcagcagagccatctggtatatgtggctcggcgcccggttcctggagttcgaggcgctgggctttatgaatgaggaccactggttctcccgcgagaacagcttgtccggggtcgaaggcgaggggcttcacaagctcggctacatcctccgtgacatcagcaagattccaggaggcaacatgtatgccgacgacaccgccggctgggacacccggatcacggaggacgaccttcagaatgaggccaagataaccgacatcatggagcccgagcacgcgctactcgccacgtccatcttcaagttaacttaccagaacaaggtggtgcgggtccagcgacccgccaagaatgggacagtgatggatgtaatttcccgcagggaccagcgaggcagcgggcaagtcggcacctacggactgaacacctttaccaacatggaggcgcaactgatccggcaaatggagtcggagggtatcttcctgccgtctgagctggagacgccgaacctcgccgagcgcgtgctggattggctggaaaagcacggagtagagcggctcaagcgcatggccatcagcggggatgattgcgtggtgaagccgatcgacgaccggtttgccaccgcactgaccgcgctgaacgacatgggaaaggtgcgcaaggacatcccccagtgggagccttccaaaggatggaacgactggcaacaggttccattctgcagccatcacttccaccagctaattatgaaagacggccgggagatcgtggtgccttgcagaaaccaggacgagctggtcggtcgggctagagtatcccagggggccggctggagtctgcgggagaccgcatgcctcgggaagtcctacgcgcagatgtggcagctgatgtacttccacagacgggacctgcgcctcgcagccaacgccatctgcagtgccgtccccgtcgactgggtgcccacgagccggacgacctggtccatccacgcacatcaccaatggatgaccacggaggacatgctgagcgtgtggaacagggtctggatcgaggagaacccctggatggaggacaaaacccacgttagtagctggggggacgtgccctacctggggaagcgggaggaccagtggtgtggttccctcatcggcctgaccgcccgagccacctgggctagcaacatccaggtcgcaatcaaccaagtgcgacggctgatcggaaatgaaaattatctagactacatgacctcgatgaaacgcttcaagaacgagggggaccctgagggagcactgtggtga

SEQ ID NO: 24361 - RNA, 9879 nt, synthetic construct
  misc_feature 1..9879: note = derived and/or modified CDS sequence (opt11) from DENV-1__FJ898391__SS-prME
  source 1..9879: mol_type = other RNA
tctgtcacgatgctcctcatgcttatgccgaccgcgctagcattccacctaaccacgagaggaggtgaaccgcacatgatcgttagcaaacaagaacggggaaaatccctattatttaaaaccagcgcgggagtaaacatgtgcacactcattgcaatggatctgggagagttctgcgaagatacgatgacctacaaatgcccgcgcatcacggaagcagaaccagacgatgtcgactgctggtgcaacgcgacagatacatgggtgacatacggaacgtgcagccaaaccggagaacacagacgagacaaacgaagcgtggctcttgcaccccacgttggcttgggcctggaaacacgcacagaaacctggatgagcagcgaaggagcgtggaaacaaattcaacgtgtggaaacgtgggcactcagacacccgggattcaccgtgatcgccctgttccttgcgcatgctattggaacctctataacccaaaaaggcatcatcttcatactgctgatgctcgtaacgcccagcatggccatgcgctgcgtgggaattggcagcagggatttcgtagaaggcctctcgggagccacatgggtcgacgttgttctggaacatggaagctgcgtaacaaccatggcaaaagacaaaccgacgctcgacatcgaactgctaaaaaccgaagtgacaaaccccgcggtactacgcaaactatgcatcgaagccaaaattagcaataccacaacggactcacgatgtcctacacaaggcgaagcaaccctcgtggaggagcaagacgcaaacttcgtttgcagacgcaccttcgtggacagaggatggggaaacggttgcgggctgttcggaaaaggatcacttatcacatgcgccaaattcaaatgtgtaaccaaactagaggggaaaaccgtacagtatgaaaacctcaaatacagtgtcatcgtaaccgtacacacaggagaccagcaccaagtaggcaacgaatccacggaacacggaacgacggccacaatcacaccccaagccccgagcacggagatacagttaaccgactacggcgcactaaccctcgactgcagcccaagaacgggactagatttcaatgaaatggtacttctaaccatgaaagagaaaagctggctagtgcataaacaatggttcctagacctgcccctgccctggacctcaggcgcatcgaccagccaagaaacgtggaaccgtaaagatctgttagtcacattcaaaactgcccacgcgaagaaacaggaagtcgtagtcttagggtcccaggagggggcaatgcacaccgcgcttacaggcgcaactgaaatccagacatctggcaccaccacaattttcgccgggcatctgaaatgccgcctaaaaatggacaaactaacactaaaaggaatgtcctatgtcatgtgcacgggcagcttcaaactcgagaaagaggtagccgagacccaacacggcaccgtccttgtacaaataaaatatgaaggtaccgatgctccctgcaaaatacccttttctacacaggacgagaaaggggttacacagaatgggcggctgataactgcaaacccaatagtaaccgacaaagagaaacccgtgaatatagaggcagagccgcccttcggcgagagttatatcgtaatcggcgcgggcgaaaaagccctgaaactctcctggttcaaaaagggaagctcaatcggcaaaatgttcgaagctacagcacgcggagcgcgcaggatggcaatactcggagacactgcctgggactttgggagtatcggaggcgtcttcacctcagtcggaaaactcgttcatcaaatcttcgggacggcatacggagtcttgttctcaggcgtctcatggaccatgaaaataggaatcggggtcctcctcacctggctgggactaaacagcagaagcacttcactgagcatgacgtgcatagcagtcggccttgtaaccctctacctcggcgtaatggttcaagcggactccggatgcgtcatcaactggaagggaagggaactcaaatgcggatccggaatctttgtgacgaacgaagtacacacctggaccgagcaatacaagttccaagccgactcgcctaaaaggctgagcgcagcaataggaaaagcctgggaggaaggtgtgtgcgggatcagaagcgccacacggctcgaaaacatcatgtggaaacagatatccaatgagttaaaccatatactcctcgaaaacgatatgaagttcacagtggtagttggcgatgtggcggggatattagcacagggtaagaaaatgatcagaccccagccaatggagtacaagtactcctggaaatcatggggcaaggctaaaataataggggccgacgtgcagaatactacgttcataatagatgggcccaacacccccgaatgcccggatgaccagcgagcgtggaacatatgggaagtcgaggactacggattcggaatattcacaacaaacatttggctcaagttgcgggactcatacacacaggtttgcgatcaccgattgatgagcgcagccatcaaggactcgaaagccgtgcacgccgacatgggatactggatcgagtctgagaaaaatgagacgtggaaactagccagagcctcctttatcgaagtgaaaacatgcatctggcccaagtcccacaccctctggtcaaatggggtactggaaagcgaaatgataattccaaaaatatacggcggacctataagccaacacaactaccgacccggatatttcacgcagacggccgggccgtggcacttgggaaaactcgaactagacttcgacctatgcgaaggaaccacagtcgtagttgacgaacattgtggaaatcgtggtcccagcctacggaccactacggtcacagggaagatcatccacgaatggtgctgtagatcctgtaccttgccccctctaagattcaaaggtgaagacggctgctggtacgggatggaaataaggccagtgaaagagaaggaggaaaacctcgttaagagcatggtgagtgccggatctggcgaagtagacagcttctcgctaggactactatgcatctctatcatgatagaagaggtaatgcgaagtcgatggagccggaaaatgcttatgaccggaacgctcgcagtgttcttcctgctaataatgggccaactcacctggaacgacctaatccggctctgcataatggtaggcgcgaacgcaagcgataggatgggtatgggaacaacatacctggcactaatggccacgttcaaaatgcgcccaatgtttgctgtcggcttgctattccgacgactaacgtcgagggaagtgctactacttaccatcgggctcagcttagtagcttcagtcgaactgccgaactccctggaagaactaggtgatggtctagcaatggggatcatgattctcaaactgctcacagacttccaatcgcaccagctttgggccaccctcctgtcactaacattcattaaaaccacattcagtctccactatgcctggaaaaccatggcaatggtcctctccatcgtgtccctatttccattatgcctaagcacgacgagccagaaaacgacctggctaccggttctattgggatccctcggctgtaaaccgttaacgatgttcctgatcgcagaaaataaaatatggggaaggaagtcatggcccctcaatgaaggaatcatggcggtaggcattgtgtccattcttctatcttcactccttaaaaatgatgtgcccttagccggtcccctgatcgcaggcggtatgctcatagcgtgttacgtgattagcggttcctcggcagatctatctttagagaaagcggcagaagtaagctgggaagaggaagccgagcatagcggtgccagccataacatactggtggaggtccaagacgacggaacaatgaaaatcaaagatgaggagagggatgacacactaaccatactgctgaaagccaccctcctggcggtatccggcgtctaccccctatctataccggcaacactcttcgtctggtacttctggcagaagaagaaacagagaagcggagttctgtgggacacacccagcccaccggaagtcgagagagcagtcctagacgacggtatttatcgcataatgcaacgagggctattaggcaggtcccaagtcggcgtcggagtcttccaagaaaatgtattccacaccatgtggcatgtaacacgcggcgcggtcctgatgtaccaaggaaagcgcctcgagccaagctgggcctcagtaaagaaagaccttatcagctacggaggtggatggagactccaagggagttggaacacgggagaggaggtacaagtgatcgccgtagagcccggtaaaaaccccaaaaacgtccagacagcccccggcacattcaaaacgagtgaaggcgaggtgggcgcgatcgcactagacttcaaacccggtacaagcgggagcccgatagtaaatcgagaaggtaagatcgtagggctttatggaaacggagtcgtaacgacgtcgggaacctatgtatccgccatagcccaggccaaagcaagccaggagggaccactgcccgaaatcgaggatgaggtcttccgcaaaagaaacctaaccattatggacttgcacccaggaagcggcaaaactcggagatacctaccagccatcgtgcgtgaagccataaagcggaaactaaggactttaatcttggcccccacacgggtggtcgccagcgaaatggccgaagcactgaagggcatgccaatcaggtaccaaacaactgcggtgaaatccgaacatactggaaaagagatagtcgatctcatgtgccacgccacctttaccatgcgcctcttgtcgcctgtgcgagtcccgaattataacatgatcattatggacgaagctcacttcacagacccctccagcatcgcggcgcgaggatatatatccacacgcgtgggcatgggagaagcggccgccattttcatgacagcaaccccacccggcagcgtggaggcattcccgcagagtaacgccgtcatacaggatgaagaaagagacattcctgaacgcagctggaactccggttacgaatggatcacagacttccccgggaagacagtctggtttgtacctagcataaaatcaggcaacgacatagccaattgcttacggaagaacggcaagcgcgtgattcagctgagccgaaagacctttgacacggaataccaaaagacgaaaaacaatgactgggattacgttgtaacaaccgacatctcagaaatgggcgcaaacttcagggcggacagagtaatcgacccgcgacgatgcctgaagcccgtcatcttaaaggacggccccgagagagtcatattagcgggcccgatgcctgtgacggtagcttcagcagcacagaggcgcgggcgcattggaagaaaccacaacaaagagggggatcaatacatctacatgggccagccgctgaataacgacgaagatcacgctcactggaccgaagcgaagatgctactggacaatataaacacaccggagggcatcattcctgccctattcgaacccgagcgggagaaaagcgcggcgatcgacggggaatatcgtctgcgcggggaagcccgcaaaacattcgtagaactaatgcgccggggcgacttaccagtatggctaagctacaaagtagcaagcgaagggttccaatactcagatcgtcggtggtgcttcgatggtgagagaaacaaccaagtgctagaggagaacatggacgtagagatatggaccaaggagggagaacgaaagaaactgaggccccgctggctggacgcacgcacatactccgatccccttgccttgcgagagttcaaagagttcgccgcgggcaggcgtagcgtatctggagacttaatcctagagattggaaaactaccccaacacctaacacagagggcacaaaacgcattggacaacctagtaatgttgcacaatagcgaacaagggggtagggcttaccgtcacgccatggaagaattgccggatactattgagaccctcatgctcctagcactaattgccgtcctgaccggaggggtcaccctattcttcctatcggggcgtggtctcggaaagacgtcaatagggctcctgtgcgtaatggcgagttctgtactactatggatggccagcgtggagccacattggatagccgcgtcgataatcctagagtttttcctgatggttctcctcataccggaacctgacagacagagaacgccacaagacaatcaattagcgtatgtagtcataggcctactcttcatgatcttgactgtggcagccaacgagatgggtcttctcgagaccaccaagaaagatctggggatcggacatgtcgcagtggaaaaccaccaccatgccgcaatgctggacgtagacctacatccagctagtgcatggactctgtacgcagtagcaaccaccatcatcacgcctatgatgcgacacaccattgagaacaccacagccaatatttccctaacggcaatcgcaaaccaggccgctatcctaatgggactcgacaaagggtggccaatctctaagatggacataggcgtaccattgttagctctaggatgctatagccaagtcaaccctttgactttaaccgcggctgtcctgatgctagtggcccactacgccataatcggtcctggcctgcaagcaaaggctacccgcgaagcacagaaaagaaccgccgccggcatcatgaaaaacccaaccgtggatggaatagttgccatagacctagaccctgtcgtatatgacgccaaattcgagaaacaattaggacaaatcatgcttctaatactgtgcacaagccaaattctcctaatgcgaacaacatgggcgctttgtgaatccatcacacttgcgaccgggcctttaacgactctctgggaaggaagccccggcaagttctggaatacaacaattgcagtctcaatggccaacattttcaggggatcatacctagcaggcgccggactggcattttcattaatgaaaagcctaggcggaggacgtagagggacgggcgctcaaggagagaccctgggtgagaaatggaaacgccaactaaaccaactaagcaagtccgagttcaacacatacaagcgaagtggaatcatggaagtagaccgatctgaggcaaaagaaggcttgaaacgtggggaaactaccaagcacgcagtttcgcgcggtactgccaagctgcgctggttcgtcgaacggaacctagtcaagccagaagggaaggtcatagacctgggctgcggcagagggggatggtcatactattgcgccggcctcaagaaagtgacagaggtgaaagggtacactaaaggcggccccgggcacgaggaacctattcccatggcaacctatggatggaatcttgtgaaactacacagcggaaaagatgttttcttcataccacccgagaaatgcgacacactgctgtgtgacataggcgaatcgagcccaaaccctacaatcgaggaaggacgtaccttgcgcgtcctcaagatggtggagccctggctacgggggaaccaattctgtataaaaatactcaatccatacatgccctctgtggtagaaacacttgaacaaatgcaacgcaagcacggaggaatgctcgtcaggaaccctctatctcgaaactctacacatgaaatgtattgggtatcctgcgggaccggtaacattgtcagcgcggtgaatatgacgtccagaatgctcctcaaccgcttcaccatggcacacaggaagcctacgtacgaaagagacgtcgacctcggcgccggaaccaggcacgttgccgtcgaacccgaggtagcgaacttggacataatcggacaacgaattgagaatattaagcacgagcataaatcaacatggcactacgacgaagataatccgtataagacctgggcctaccacggaagctacgaagtaaaaccctccggctccgcgagttccatggtcaatggggtcgttaagctccttacaaaaccctgggacgttatcccaatggtaactcaaatagccatgaccgacacaacccctttcggacaacaaagagtattcaaagaaaaagtggacacccggacacccaaggccaagcgggggactgctcaaataatggaggtgaccgctaaatggctgtggggatttctatcaagaaacaagaaaccacggatctgcaccagggaagagtttacaaggaaagtaagaagtaatgccgccattggggccgtattcgtcgacgaaaatcaatggaacagcgccaaagaagctgttgaggacgaaaggttttgggacctagtacaccgcgagagagagctgcacaagcagggcaaatgtgcaacgtgtgtctataacatgatggggaagagagagaagaaactcggtgagttcggcaaagcaaaagggagccgggcaatatggtacatgtggctaggggcccgcttcctcgagttcgaagccctcggctttatgaatgaagatcactggttctccagggaaaactctctaagcggcgttgaaggcgagggactccacaagttagggtacatccttcgggatatcagcaagatccctgggggtaacatgtacgccgacgacacggcaggatgggatacaaggataaccgaagacgatttacagaacgaagcgaaaataacagacatcatggaaccagaacacgcgctgctcgcgaaatcgatctttaaactaacctatcaaaataaggtagtaagagttcagcgtccagccaaaaatgggaccgtcatggacgtaatcagtcgccgagaccaaagaggctcgggccaagtcggaacatacggccttaatactttcacaaacatggaagctcagctaatccggcagatggaaagcgaaggtatattttccccgagcgaacttgaaacccccaatttagcagggagagtacttgactggctggagaaacacggggtagagcgactaaaaaggatggcaatttcgggcgacgattgtgtcgtgaaacctatcgatgatcggttcgccacagccttgactgcgctcaatgacatgggcaaggtcagaaaggatataccccagtgggaaccatcaaaaggatggaacgactggcaacaagttccattctgttcacatcacttccaccagttaataatgaaagatgggcgtgagatcgtcgtgccatgcagaaaccaagatgaactcgttggccgtgccagggtttcccaaggagccggctggagtctacgagaaacagcgtgtctaggcaagtcgtatgcgcagatgtggcagctcatgtatttccaccgtcgagacctaagactggcagcaaacgccatatgtagcgcggtccccgtggactgggtgcccacatcgcggaccacctggtcaatacacgcacaccaccaatggatgaccacggaagacatgctttcagtatggaatcgcgtatggattgaagaaaacccgtggatggaagacaagacccacatctcgagttggggcgacgtaccgtatctgggcaagcgagaagaccaatggtgcggcagcctcataggtctcaccgccagggcaacatgggcgactaacattcaggtagccataaaccaggtccgccgattaatcggtaacgagaactatctagactacatgacctcgatgaaacgttttaagaacgaatcggaccccgaaggggcgctatggtaa

SEQ ID NO: 24362 - RNA, 9879 nt, synthetic construct
  misc_feature 1..9879: note = derived and/or modified CDS sequence (opt11) from DENV-1__FJ898392__SS-prME
  source 1..9879: mol_type = other RNA
agtgtgaccatgctgttgatgctgatgcccacagccctggccttccacctcacgactcggggcggcgaaccccatatgatcgtgacaaagcaggagaggggtaagagcctgctgttcaagaccagcgcgggagtgaacatgtgtaccctcatcgccatggacctcggcgaactctgcgaggacactatgacctacaagtgcccccgcatcacggaagccgagcccgacgacgtggactgttggtgcaacgccaccgatacgtgggttacctacggcacctgctcacagactggcgagcaccggcgcgacaagcgctctgtggccctcgcgcctcacgtaggcctggggctggaaactaggaccgagacctggatgtcatccgagggcgcctggaagcagatccagcgtgtggagacatgggccctccgccaccccgggttcactgtgatcgccctgttcctggcgcacgcgatcgggacctctatcacccagaaggggatcatattcatcctcctgatgctggttacgccctctatggccatgcggtgcgttggcattggatctagggacttcgtggagggcctctcgggcgcgacgtgggtcgacgtcgtgctggagcacggatcctgcgtgaccaccatggccaaagacaagccgacgctggacatcgagctcctgaagaccgaggtcaccaaccctgcggtacttaggaagctatgcatcgaggccaagatcagcaacaccacgaccgactcccgctgccccacacagggcgaggccactctgatggaggagcaggacgccaacttcgtttgcagacgtactttcgtcgaccgaggctggggaaacggctgtggtctgtttggtaaggggtcactcatcacatgcgcaaagttcaaatgcgtgaccaagcttgagggcaagatcgtccagtacgagaatctgaagtactcagttatcgtgacggtacacacaggcgatcagcaccaggtcgggaatgagagcacggagcatggcaccaccgcaaccatcacgccccaggccccaacctccgaaatccagctcaccgactacggggccctgacactggattgcagtccccgcacgggcctcgactttaacgagatggtgctgctgacaatgaaggagaagtcttggctcgtccataagcagtggttcctggacctcccgctcccctggacaagcggggccagcacctcccaggaaacatggaaccggcaggatctgctggtgacattcaagaccgcccacgcgaagaagcaagaggtggtcgtgcttggcagccaggaaggcgccatgcatacagcactgacgggcgccaccgagatccagacctctggcaccaccaccatcttcgctgggcacttaaaatgcaggttgaagatggataaactgaccctgaagggcatgagctacgtgatgtgcactgggtcatttaagctggaaaaggaggttgcggagacgcagcacggtaccgtcctggttcagatcaagtacgagggcaccgacgccccctgcaagattcccttcagcactcaggacgagaagggggtgacccagaacggccggttaatcaccgccaacccgatcgtgaccgataaagaaaagcccgtgaacatcgaggctgaaccgcccttcggtgagtcctacatcgtcatcggcgcgggggagaaggcactgaaattaagctggttcaaaaagggctccagcatcggaaagatgttcgaggccaccgcccgcggggcccggcgcatggcgattttaggcgacacggcctgggacttcgggtccattggcggcgtattcaccagcgtcgggaagctggtccaccagatcttcggcaccgcctacggcgtcctgttttccggggtaagctggacaatgaaaatcggcataggcgttctgctgacgtggctcggcctgaactcccgctcaacctccctgtcaatgacatgtatcgccgtgggactcgtgaccctgtacctgggagtgatggtgcaggccgacagcggatgcgtgattaactggaagggacgggaactcaaatgcgggagcggtatcttcgttacgaatgaagtgcacacctggacggagcagtacaagtttcaggctgactcaccgaagcgcctgagtgccgccatcgggaaggcctgggaggagggggtgtgcggcatccggagcgctacacgactagagaatattatgtggaagcagataagcaatgagctgaatcacatcctgctggagaacgggatgaagttcaccgtcgtggtgggagatgtggtggggatcttagcgcagggcaagaagatgattaggccccagcccatggagcacaaatactcatggaagtcttggggcaaggccaagatcatcggcgccgatgtgcagaacacgactttcattatcgacggccccaatactcccgagtgtccagacgaccagcgggcatggaacatctgggaggtcgaggactacgggttcggcatatttaccacgaacatctggctaaagctgcgggacagctacacccaagtatgcgaccatcgccttatgtccgccgccatcaaagacagcaaggccgtgcacgccgacatgggttactggatcgagtcagagaagaacgagacctggaagctggcccgagcgtcgttcatcgaggtcaaaacttgcatctggcccaagtctcacacactgtggtctaacggggtgctagagtcagaaatgattatacccaagatttacggcggaccgatcagccagcacaactaccgccccggctacttcacccaaaccgcgggaccctggcatctgggtaagctggagctcgacttcgacctgtgcgagggcaccacggttgtcgtggacgagcattgcggaaatcggggcccgtccctgcgcacaacaaccgttacggggaagattatccacgagtggtgttgcagaagctgcacactgcccccactccgcttcaagggcgaggacgggtgctggtacggaatggagatacggcccgtcaaagagaaggaggagaacttggtgaagtccatggtgagcgccggcagcggggaagtcgacagctttagccttggcttgctgtgtacaagcatcatgatcgaggaggtgatgcgcagccggtggtcccgcaaaatgctcatgacggggacgctggcagtgttcctcctcctgattatgggccagctcacctggaacgacctcatccgcctttgtatcatggtcggggccaatgcgagcgaccgtatgggaatgggcaccacctacctggccctcatggcgacgttcaagatgcgaccgatgttcgccgtggggctgctattccggcgcctgacctctagggaggtactgcttctcaccatcgggctaagcttagtcgcctccgtggagttacccaacagcctggaggagctgggggacggccttgcgatgggcataatgattctgaaactgctcaccgactttcagagtcaccagctgtgggccaccctgctatcactgactttcatcaagaccacactctccctccactacgcctggaagacgatggcgatggtgctgtcgatcgtgtcgttgtttcccctctgtctaagcaccacctcccagaagacgacgtggctgcccgtgctcctggggagcctaggctgtaagccgctcaccatgtttctgatcgcggagaacaagatctgggggagaaagtcttggccgctaaacgagggcatcatggccgtgggggtggtgtcgattctcctgagctccctgttaaagaatgacgtacctctggccggccccctgatcgccggggggatgctcatcgcctgctacgtgatcagcggctcctccgcggatctgtcgctggagaaagccgccgaggtgagctgggaggaggaggccgagcactccggggccagccacaacatcctcgtcgaagtgcaggatgacggcaccatgaagatcaaggatgaggagagagacgacaccctgacaatactgctcaaggccaccctgctcgcggtatccggggtctacccactgagcatcccggccaccctgttcgtatggtacttctggcaaaagaagaagcagcgctccggcgtgctgtgggacacccccagtccgcccgaggtcgagcgggcggtgctggacgatggtatctaccgcattatgcagcgtgggcttctgggccgctcccaggtgggggtcggcgtcttccaggaaaacgtgtttcatacaatgtggcacgtcacgcgcggtgccgtgctaatgtaccaaggcaagcgcctcgaacccagctgggcttctgtgaagaaggatttgatctcgtatggtgggggctggcggctgcaggggtcctggaacaccggagaggaggtccaggtgatagcagtggagcccgggaaaaacccgaaaaatgtccaaaccgccccaggcaccttcaagacacccgagggcgaggtgggggccatcgccctagacttcaagcctggaaccagcgggtcccccatcgtgaaccgcgaaggtaaaatcgtcggcctatacgggaacggtgtggtgacaaccagcggcacgtatgtcagcgcgatcgcccaggctaaggcctcccaggagggaccgctgcccgagatcgaagatgaagtgttccggaagagaaacctcaccataatggacctgcatcccgggagcgggaagacccgacgctacctgccggcgatcgtacgggaggcaatcaagcgcaagctccggaccctgatcctggcccccacgcgagtcgtggcctccgagatggccgaagcgctgaaaggcatgcccatacgctatcaaaccacagccgttaaatcagagcataccgggaaagaaattgtcgacctaatgtgccatgctacgttcaccatgcggctgctctcccccgtgcgcgttccaaactacaacatgatcatcatggacgaagcccacttcaccgaccccagttccatagctgcgcggggctacatctcaacacgtgtgggcatgggggaagcggccgctatcttcatgacggccacgccacccgggtccgtggaggcattcccgcagagcaacgctgtgatccaggacgaggagcgggacatccccgagcgatcctggaacagcggctacgagtggatcactgacttccctggcaagacagtctggttcgtgccctccatcaagagcggtaacgacatcgccaactgcttgcggaaaaatggcaaacgcgtgatacagctgtcccggaagacgttcgataccgaataccagaaaaccaagaacaacgactgggattacgtggttaccacggatatctccgagatgggggccaactttcgcgcggaccgggtgattgacccgcgccggtgcctcaagcccgtcatcctgaaagacggccccgagcgcgtgatcctggccgggcccatgccggtgaccgtcgcctccgctgcacaacgccgcggccgcattggccgcaaccataacaaggagggggaccagtatatatatatgggccagcccctcaacaacgacgaggaccatgcgcactggaccgaagccaagatgctgttggacaacataaacactcccgaggggatcatccccgcgctcttcgaacctgagcgggaaaagagtgccgcaatcgacggggagtaccgcctgagaggggaggcgcgcaagacgttcgtggagctgatgcgtcggggcgacctacccgtgtggctgtcatacaaagtggcaagcgaaggcttccagtatagcgatcgccggtggtgtttcgatggggagcgcaacaaccaggtgttagaggagaacatggacgtcgagatctggaccaaggaaggcgagagaaagaagctacgccccaggtggctggacgcgcgcacctattccgatcccctggccctccgggagttcaaagaatttgccgcggggcgccggagcgtgtccggcgacctgatcctggagatcggcaaacttccgcagcacctgacgcagcgggcccagaacgccctggataaccttgtgatgctccacaactctgagcagggcgggcgggcctaccgccacgcgatggaggagctgcccgacacgatcgagaccttgatgctgctggccctcatcgcggtgctgaccggcggcgtgaccctgtttttcctctccggacgtggcctgggcaagaccagcatcgggctactctgcgtgatggcctccagtgtcctgctgtggatggcttccgtggagccccattggatagcggcctccatcatcctagagttctttctgatggtactcctcatccccgagcccgaccgccagcggacgccccaggacaatcagctggcttacgtcgtgatcggactcctcttcatcatcctaaccgttgccgccaacgagatgggtctgctagagaccacgaaaaaggacctaggcatcggtcatgtcgcggtggagaaccaccaccacgctacgatgctggacgtggacctccatcccgcttccgcctggactctgtacgccgtcgctaccaccatcatcactccgatgatgcggcacaccatcgagaacaccaccgccaacatcagcctgacggccatcgccaaccaggccgcgatcctcatgggcctagacaagggctggccgatctccaagatggacataggggtgcccctgctcgcactgggctgctacagccaggtgaaccccctgaccctcaccgccgctgtcctgatgctggttgcgcattacgccataatcggtccgggcctccaggccaaggccacacgggaagcacagaagagaaccgcggccggaatcatgaagaaccccaccgttgatggcatcgtcgccatcgacctggatccagtggtttacgacgccaaattcgagaagcagctgggccagatcatgctcctgatcctttgcacctcccagatcctcctgatgcgcacaacctgggccctgtgtgagagcatcactctagcaacaggtcccctgaccacgctttgggagggctccccggggaagttctggaataccactattgccgtcagcatggccaacattttcagaggatcctacctcgcgggcgccgggctggcattcagcctcatgaagtccttaggggggggtcgccggggaaccggcgcccagggggagacgttaggggagaaatggaagcgccagcttaaccagttgtcgaagtcggagttcaacatctataagaggtccggcatcatggaagtggatagatccgaggccaaagagggcctgaagcggggcgaaaccacccgccatgcagtgtccaggggcaccgcgaagctgcgctggttcgtcgagcgtaacctggtgaagcccgaaggcaaggtgatagacttggggtgcgggcgcggtggttggagctactactgcgcaggcttaaagaaggtcacggaggtaaagggatataccaagggcggccctggccacgaggagcccatcccaatggcgacgtatggctggaacctggtaaagctccactcagggaaggacgtcttcttcacgccacccgaaaagtgcgacacgctgctgtgcgatataggtgagagctcccccaacccgactattgaggaggggcggaccctcagggtgctgaagatggtggagccctggctgcggggcaatcagttttgcattaagatcctcaatccctacatgccgagtgttgtggagaccctggagcagatgcagaggaagcacggtggtatgctcgtgcggaacccactctcacgcaacagcacccatgaaatgtactgggtctcatgcggcaccgggaacattgtgagcgccgtgaacatgacgtcccggatgctactgaaccgctttacaatggcccatcgtaagcccacttacgagcgggatgtcgacctcggcgccggcacgcgccacgtggccgtggagcccgaggttgcgaacttagacattatcgggcagcggatagagaacatcaagcacgagcacaaaagcacctggcactacgacgaggacaacccatacaagacgtgggcctaccacggctcctacgaggtaaagccgagcgggtctgccagcagcatggtcaacggagtggtgaagctgctcaccaagccctgggacgtcatccccatggtgacgcaaatcgcgatgactgacaccaccccctttgggcagcagcgcgtctttaaggagaaggtcgacacgcggactccgaaggccaagaggggcacagcccaaatcatggaagtaaccgcccggtggctgtggggcttcctgtcccgcaacaagaaaccccggatctgcacgcgcgaagagttcacaaggaaggtgcgcagcaatgccgctatcggggccgtcttcgtggacgagaatcagtggaactccgcaaaagaggccgtcgaagatgaacggttctgggatctcgtgcagaaggagcgcgaactgcacaagcagggcaagtgcgcgacctgcgtgtacaacatgatggggaagcgtgagaaaaagctgggcgagttcgggaaggccaagggctcacgtgcgatctggtacatgtggctcggtgctcggtttctagagttcgaggccctggggttcatgaacgaggaccattggttctcccgggagaacagcctaagcggagtggagggggaggggctgcacaagctggggtacatcctccgggacatcagcaagatccccggtggcaacatgtacgcggacgacaccgccgggtgggacacgcgcataaccgaggacgatttacagaacgaggccaagatcaccgacatcatggagccggaacatgccctactcgccacatcgatcttcaagctgacgtaccaaaataaggtcgtgcgggtgcagaggcccgctaagaacggcaccgtaatggacgtgatcagccgccgggaccagcgtggctccggtcaggtgggaacttatggtctgaacacttttacgaacatggaggcccagctcatccggcaaatggagagcgagggcatctttctacccagtgagctcgagactcctaacctcgccgagcgcgtacttgattggctggaaaagtatggcgtggagcggctcaagcgcatggccatcagcggtgacgattgcgtggtcaagccgatcgacgaccggttcgctaccgcgctgaccgccctgaacgacatggggaaggtgagaaaagacattccccagtgggagccctccaagggctggaacgactggcagcaggtccccttctgcagccatcacttccaccaattgatcatgaaggacggccgggagatcgttgtgccctgccgcaaccaagatgaactggtagggcgggcccgagtttcccagggtgccgggtggagtttgcgagagacggcctgcctaggcaagagctacgctcagatgtggcaactgatgtacttccatcgccgggatctgcgcctcgccgcgaacgccatctgctccgcggtgccagtggactgggttccaacaagccggaccacctggtccattcatgcccaccaccaatggatgacaaccgaggacatgcttagcgtatggaaccgcgtctggatcgaggagaacccctggatggaggataagacccacgtctcctcatggggcgacgtgccgtacctgggcaagcgggaggaccaatggtgcggctccttgatcgggttgaccgcccgcgccacctgggcctctaacatccaggtggcaataaaccaggtccgcagactgatcggcaacgagaattacctcgactacatgacttccatgaagaggtttaagaacgaaggcgaccccgagggggccctgtggtga

SEQ ID NO: 24363 - RNA, 9879 nt, synthetic construct
  misc_feature 1..9879: note = derived and/or modified CDS sequence (opt11) from DENV-1__FJ898393__SS-prME
  source 1..9879: mol_type = other RNA
agtgttaccatgcttctcatgctgatgcccaccgccctggccttccacctaacgacccgcggcggggagcctcacatgatcgtgaccaagcaggagaggggcaagagcctgctattcaagaccagcgcgggggtgaatatgtgcacgctcatcgccatggacctaggcgagttatgcgaagatacgatgacttacaaatgcccccggatcaccgaggcggagcccgacgacgtcgactgttggtgcaacgccaccgacacgtgggtgacctacgggacatgcagccagacgggcgagcatcggcgcgataagcggtcagtcgccctcgctccccacgtcgggctggggttggagacccgcaccgagacctggatgtccagcgagggcgcgtggaagcaaattcagagggtagaaacttgggcccttcgtcatcctgggttcacagtgattgccctgttcttagcgcacgcgataggcaccagtatcactcagaaggggatcatctttatcctgctgatgctggtgacccccagcatggctatgcggtgcgtcggcatcggctcccgcgacttcgtagaggggctaagcggcgccacctgggtggacgtcgtgctggagcacggttcctgtgtgaccaccatggccaaggacaagcccacgcttgacatcgagctcctgaagactgaggtaaccaaccccgcggtgcttcggaagttgtgtatagaggccaaaatctccaataccacgacggactcccgctgccccacccagggcgaagccaccctgatggaggaacaggacgctaacttcgtgtgccggcgcacgttcgtcgaccgcggctggggcaacggctgcgggctgttcggcaaggggagtctcattacctgcgccaagttcaagtgtgtgaccaagctggagggcaagatagtacaatacgagaacctgaagtacagcgtcatcgtgaccgtacacacgggcgaccagcaccaggtcgggaacgagtctaccgagcacggcaccaccgcaaccatcacgccccaggcccccacgtccgagatccagctcaccgactacggagccttgaccctggactgtagcccccgcacgggactcgacttcaatgagatggtcttactgaccatgaaggagaagtcctggctcgtccacaaacagtggtttctggacttgccgctcccctggaccagcggggcgagcacctcccaggaaacgtggaacaggcaggatctactggtgaccttcaagacagcccacgcgaagaagcaagaggtggtcgtcctcggaagccaggagggggccatgcacaccgccctgacgggggccacggagatccagacctccggcaccacgaccatcttcgccgggcacctgaagtgccgcctcaagatggataagctgaccctgaagggcatgagctacgtgatgtgcaccgggtccttcaagctggagaaggaggtggccgagacgcagcatgggacggtgctggtacagatcaagtacgagggtaccgacgccccttgcaagatccccttctcgacccaagacgagaaaggtgtgacgcagaacggccggcttatcaccgccaacccgatcgtcactgacaaggagaagcccgtcaacatcgaggccgagccgcccttcggagagtcctacatcgttatcggggccggcgagaaggccctgaagctcagctggttcaagaaggggtccagcatcggcaaaatgttcgaggccaccgcccgcggggcccggcgcatggcgattctgggtgacacagcctgggacttcgggtccgtgggtggtgtgtttaccagcgtcgggaagctggtgcatcagatcttcggcactgcctacggagtcctgttttccggggtcagctggaccatgaagatcggtatcggcgtgctgctgacgtggctcggcctcaactccaggagcacctccctgagcatgacctgtatcgccgtggggctcgtcactctgtacctgggtgtgatggtgcaagccgactccgggtgcgtaatcaactggaagggccgggagctcaagtgcggaagcggcatcttcgtgaccaacgaggtgcacacctggaccgagcagtacaagttccaagcggacagcccgaaacgcctttccgccgccatcggccgggcctgggaggaaggggtctgcggcatccgctccgccacccggctggagaacatcatgtggaagcagatctccaacgagctcaaccacatcttgctggaaaacgacatgaagttcaccgtggtcgtcggggacgtggtgggcattttggcgcaggggaagaagatgatccgccctcagcccatggaacacaagtattcttggaagagctggggtaaggccaagatcatcggtgccgacgtacagaatacgaccttcatcatagacgggccgaataccccggaatgccccgacgaccagcgggcctggaacatctgggaagtggaggactacggctttggaattttcaccacgaacatctggctgaaactgcgcgatagctacacccaggtgtgtgaccacagattgatgtccgcggccatcaaggacagcaaggccgtccacgccgacatggggtactggatagagtccgagaagaacgaaacctggaagctagcccgcgcgagcttcattgaggtgaagacctgcatctggcccaagtcccacactttatggagcaacggcgtgctcgagtccgagatgatcataccgaagatctacggggggccgatctcgcagcacaattaccgccccgggtactttacccagaccgccggaccctggcacttgggaaagctggagctcgacttcgatctgtgcgaggggaccacggtcgtggtggacgaacactgcggcaaccgtgggccgtctttacggacgactaccgtcactggcaagatcatccacgagtggtgctgccgcagctgtacccttccgcccttgcgattcaagggcgaggatggctgctggtacggaatggagatccgccccgttaaggaaaaggaggagaatctggtgaagtccatggtctcggccggcagcggggaggttgactccttcagcctcggcctactgtgcatctcaatcatgatagaggaggtgatgcggagccgctggtcccggaagatgctcatgacgggcaccctggcggtctttctgctgctgatcatggggcaactgacatggaacgacctcattcgcctgtgcatcatggtcggcgccaacgcgagcgaccgcatggggatgggaaccacctacctggcacttatggccaccttcaagatgcggccgatgttcgccgtcggccttttatttcgccggttaacgtccagggaggtactgctgctcaccatcgggctgtcgctagtggccagtgtcgagcttccaaacagcctggaggagctgggcgacgggctcgcgatgggcatcatgatcttgaagctgctcaccgatttccagtctcaccagctgtgggcaaccctgctcagcctgacgttcatcaagaccaccctatccctccactacgcttggaagaccatggccatggtgttaagcatcgcgtctcttttccctctgtgcctatctacgacctcccaaaagacaacctggctgcccgtgttactgggcagcttagggtgcaagccgctgacgatgttccttatcacagagaccaagatctggggccgtaagtcctggcccctgaatgagggtatcatggccgtcggcgtggtgtccatcctcctgagctcccttctcaagaacgacgtccccctcgcggggcccctgatcgccggcggcatgctcatcgcctgctacgtgatcagcgggagcagcgcggacctgtccctggagaaggccgccgaggtgtcatgggaggaggaggccgagcactcgggcgccagccacaacatcctcgtcgtggttcaggacgacgggaccatgaagataaaggacgaggagcgcgacgataccttaacgatactgctgaaggccacgctgctggccgtctccggcgtgtacccgctcagtatccccgccacactgttcgtgtggtacttctggcagaagaaaaagcagcggtccggggtcctgtgggacacccccagcccgcccgaagttgagcgcgcagtgctggacgacggcatctaccgtatcatgcagcgcggcctcctggggcggtcccaggtcggcgtgggggtgtttcaggagaacgtcttccacacaatgtggcacgtgaccagaggggccgtgctgatgtaccagggtaaacggctcgagcccagctgggcgtccgtcaagaaggacctgatcagctacggcggcggttggcgcctgcagggctcctggaacacgggcgaggaggtccaagtgatcgccgtcgaacccggaaagaatcccaaaaacgtgcagaccgctccggggactttcaaaacccccgaaggggaggtgggcgccatcgccctcgacttcaagcccggaacctccggctcccccatcgtcaaccgggaggggaagatcgtgggtctgtacggcaacggggttgtcaccacgagcggcacctacgttagcgcgatcgcccaggccaaggcctcccaggaggggccgctgccagaaatcgaggacgaggtattccgcaagcggaaccttaccataatggacctgcatcccggcagcgggaagacgcgacggtacctgccagcgattgtccgcgaggccatcaaacggaagctccgcacgttgatcctggccccaacccgcgtggtcgcgagtgagatggccgaggcgctcaagggcatgcccatccggtaccaaaccacggcggtcaagtccgagcacacgggaaaggaaatagtggacctgatgtgccacgccaccttcaccatgcgcctgctctcccccgtgcgcgtcccgaactataacatgatcatcatggacgaggcccattttaccgacccgagctccattgctgctagggggtacatcagcacacgagtgggaatgggggaggccgccgccatcttcatgaccgccacgccgcctggctccgttgaggcgttcccgcagagcaatgccgtcatacaggacgaggagagagatattcccgagagatcctggaacagcgggtacgagtggatcaccgacttccccggcaagactgtgtggttcgtgccctccatcaagagcggcaacgacatagccaactgcctgcgtaagaacgggaagcgggtcattcagctgtcccgcaagaccttcgacactgagtaccaaaagaccaagaacaacgattgggactacgtggtcaccaccgacatcagcgagatgggcgccaacttccgggcggaccgcgtaattgacccgcggcgatgtctcaagcccgtgatcctgaaggacgggcccgagcgggtaatcctggccggcccaatgccagtgacggtcgcgtccgcagcccagagacgggggcgcatcggccggaaccacaacaaagagggagaccagtacatttacatgggtcaacccctcaataacgacgaggaccacgcgcactggaccgaggccaagatgctgcttgacaatatcaatacgcccgagggcataatccccgccctcttcgagccagagcgcgagaagtccgccgccatcgacggggagtaccgcctgagaggtgaggcgaggaagacgttcgtagagctgatgcgtcgcggtgacctccccgtgtggctgtcctacaaggtggccagtgaaggcttccagtactcggaccggcgctggtgcttcgacggcgagcggaacaaccaggtcctggaggaaaacatggacgtggaaatctggaccaaagagggggaacgcaagaagctgcggccccgctggctggacgctcggacatactccgaccccctggcactccgcgagttcaaggagttcgccgcgggccgtcggtccgtgtccggggacctaatcctggagatcggcaagctcccgcagcacctgacgcagcgtgcccagaacgccctggacaacctcgtgatgctgcacaacagcgaacaggggggcagagcttaccggcacgctatggaggagctgcccgacactatcgagaccctcatgctgctggccctcatcgccgtgctgaccggcggggtgaccctgttcttcctctccggccgcgggcttggcaagacgagcatcggcctgctctgcgtcatggcctccagcgtgctgctgtggatggcctccgtggagccccactggattgcggcgagcatcatcttagagttcttcctgatggtactgctcatccccgaaccggaccggcagcgcacgccccaggataaccagctggcctacgtggtcatcgggttactcttcatgatactgaccgtcgccgccaacgaaatgggcctcctcgagaccactaagaaggacctggggataggccacgtggcggtggagaaccaccaccacgcgaccatgctggacgtcgacctccaccccgcatccgcctggaccctgtacgccgtggctaccacgatcattaccccgatgatgcggcacaccatcgagaacaccacggccaatatcagcctgaccgctatagccaaccaggccgcgatcctgatgggtctggacaagggctggcccatctccaagatggacatcggtgtgcccttgctcgccctggggtgctacagccaagttaaccccctgacactcaccgccgccgtactgatgctggtcgcgcattacgccattattggccctgggctgcaggccaaagccacaagagaggctcaaaagcgcaccgcggccggcatcatgaaaaaccccaccgtcgatgggatagtcgccatagatctggaccccgtggtctacgacgctaagttcgaaaagcagctgggccaaatcatgctcctgatcctgtgcacctcccagatcctcctgatgcgcacgacctgggccctctgtgagagcatcaccctcgcgaccggccccctgacgaccctgtgggaggggtccccgggcaagttctggaacaccaccatagccgtaagcatggccaacatcttccgcggatcctacctagctggcgccggcctggcgttcagcctgatgaaatccctcgggggcgggcggcgcggaacaggggcccaaggcgaaacccttggcgagaagtggaagcggcagctgaaccagctctccaaaagcgagtttaacatctacaagcgctccgggatcatggaggtggaccgtagcgaggccaaagagggcttgaaacgtggggagaccacacgtcacgccgtctcccgcggcacggcgaaactgcgttggtttgtggagcgcaacctggtgaagcccgaagggaaagtcatcgacctcggctgcggccgcggcgggtggagctactattgcgccgggctgaagaaggtcaccgaggtcaaggggtacacaaagggcgggcccggccacgaggagcccatccccatggcaacctacgggtggaacctagtcaagctacactccggcaaggacgtttttttcacgccgcccgagaagtgcgacaccctgctgtgcgacatcggggagtcctcccccaatccgaccatcgaggagggccgcaccctccgggtcctcaagatggtcgagccttggctgcgcgggaatcaattttgcatcaagatactcaatccctatatgcccagcgtggtagagactttagagcagatgcagcggaagcacggcggcatgctggtaaggaacccgctctcccggaactcgacgcacgagatgtactgggtgtcctgcgggaccggcaacatcgtcagcgccgtcaacatgacctcgcgcatgctgctaaaccgcttcaccatggcgcatcggaaacccacgtacgaacgcgacgtggacctcggtgcaggcacgagacatgttgccgtcgaacccgaggttgccaacttagacatcatcggccagcggatcgagaacatcaagcacgagcataagagcacctggcactatgacgaagacaatccctataaaacctgggcctaccacgggtcttacgaggttaagccgagcggctccgccagctcaatggtgaacggggtagtaaagctcctcacgaagccctgggacgtgattcccatggtgacccaaatcgcgatgaccgacacaacaccttttggccagcagcgggtctttaaagaaaaggtggacacccgaacaccgaaagccaaacgggggaccgcgcagattatggaggtgacggcgcgctggctgtggggcttcctgtcacgtaacaaaaagccccgcatctgcacccgggaggagttcacccgcaaggtccggagcaacgcggcgatcggcgccgtgttcgtcgacgagaatcagtggaattccgccaaggaggctgtagaggacgagcgcttctgggacctcgtgcagaaggagcgggagctgcacaagcaggggaaatgcgcgacctgcgtgtacaacatgatgggcaagcgcgagaagaagctgggggaattcggcaaggccaaggggagccgcgctatctggtacatgtggttgggcgcccgctttctggagttcgaggccctcgggttcatgaacgaagaccactggttctcccgggagaacagcctctccggggtcgagggtgaggggctgcacaagctgggctacatcctccgcgatatcagcaagattcctggcggcaacatgtacgcggatgacacggccggctgggacacccggatcaccgaggacgacctgcaaaacgaggccaagattaccgacatcatggaaccggagcacgccctgctagcgacgtccatcttcaaactgacctaccaaaacaaagtggtgcgcgtccagcgccccgcgaagaacggaaccgtgatggacgttatcagtcggagggaccagcggggctctgggcaggtcgggacctacggcctcaacacgttcaccaacatggaggcacagctcatccgccagatggagtccgaggggatcttcctaccaagtgagttggagaccccgaacctcgccgagcgggtgttagactggctggagaagtacggcgtggagcggctgaaacggatggccatcagcggagacgactgcgtcgtgaagccgatcgatgaccgcttcgctaccgcgctgacggcactgaacgacatgggcaaggtgcggaaggacatcccccagtgggagccctccaaggggtggaatgattggcagcaggtccccttctgctcacaccatttccaccaactcatcatgaaggatggccgcgagattgtggtgccgtgccggaatcaggacgaactggtcggcagagcaagagtaagccagggggccggctggagcctgcgtgagacggcctgcctcggcaaaagctacgcgcagatgtggcaactgatgtatttccaccgacgcgacctgcggctcgccgccaatgccatctgctccgcggtgccggtcgactgggtgcctactagccgtaccacgtggtccatccacgcccatcaccagtggatgaccacggaagacatgctgtcggtgtggaacagggtctggatcgaagaaaacccctggatggaggacaagacccacgtgtcctcttggggcgacgtgccttacctggggaagcgcgaggaccagtggtgcggctcactcatcggcctgacggcccgcgccacttgggccagtaatatccaggtcgctatcaaccaagtgcggcgcctgatcggaaacgagaactacctcgactacatgacctccatgaagcggttcaagaacgagggcgatcccgagggggccctgtggtga

SEQ ID NO: 24364 - RNA, 9879 nt, synthetic construct
  misc_feature 1..9879: note = derived and/or modified CDS sequence (opt11) from DENV-1__FJ898394__SS-prME
  source 1..9879: mol_type = other RNA
agcgtgaccatgctgttaatgttgatgcccacagcgctggcctttcacctcaccacccgggggggtgagccgcatatgatcgtgaccaaacaggagagaggcaagtccttgctcttcaagacgagcgccggggtaaatatgtgcaccctcatcgccatggatctaggcgagttgtgtgaggataccatgacctataagtgccccaggatcactgaggcagagcccgatgacgtggactgttggtgtaatgccaccgacacgtgggtaacttacggtacatgtagccagaccggcgaacatagacgcgacaagcggagcgtggccttggcgccccatgttggcctggggctggagacgagaacagagacctggatgagttccgaaggtgcctggaagcagatccagcgggtggagacctgggcccttaggcatccggggttcaccgtgatcgccttattcctggcacacgcaatcggcacttccatcacacagaaggggatcatattcatcctcctgatgttagtgacgcccagcatggcaatgagatgcgtaggcatcggatctcgcgacttcgtagaggggctctcgggcgcaacctgggtggatgtcgtgctggaacatggctcctgcgtgaccaccatggccaaggacaagccaacgctggacatagaactcctgaagaccgaggtaaccaaccccgcggtgctgcggaagctttgcatcgaggccaaaatctccaacaccacaacagattctcgctgcccgacgcagggcgaggctactctgatggaggaacaggacgccaacttcgtgtgtcggcgcacgtttgtcgacagaggctgggggaacggatgtgggctgttcggcaaaggttcactcattacgtgcgccaagttcaagtgcgtgaccaagttagagggcaaaatcgtgcagtacgagaacctgaagtactcagtcatcgtgaccgtgcacaccggcgatcagcatcaggtcggaaacgagtctacggagcatggcaccacagctacgataacgccccaagcccccacatccgagatccaactcaccgattacggcgccctgaccctggattgcagccctcgcacgggactcgacttcaacgagatggtcctgctgaccatgaaggaaaagtcctggttagtccataagcagtggtttctggatctgccattaccctggacaagcggggcatcaacgccacaggaaacttggaaccggcaggatcttttggtaacctttaagaccgcccacgcgaagaagcaagaggtggtcgtactaggctcccaagagggcgctatgcacactgctctgaccggtgccacggagatccagacctcgggcaccacgaccatattcgctgggcacctgaagtgccggctcaagatggacaaacttacccttaagggcatgtcgtacgtcatgtgcaccggttcattcaagctcgagaaggaggtcgcggagacgcagcacggcaccgttctggtgcagatcaaatacgagggcaccgacgcaccctgcaagattccattcagtacgcaagacgagaagggggtgacccagaacggccggctgataaccgcaaaccccatcgtaacggacaaagagaagcccgtaaacatcgaggccgagcctcccttcggcgagtcgtatatagtgatcggcgcgggggagaaagccctaaaactctcctggttcaagaaagggagctccataggcaagatgttcgaagctacggcacgcggagcccggcgcatggcaatcttaggcgacacggcctgggactttggcagcataggcggcgtgttcacctccgtgggtaaattggtccaccagatctttggcaccgcttacggggttctgttttcgggcgtatcctggaccatgaagatcggaattggcgtcttattgacgtggctcggcctgaactcacgctcgaccagcctgagcatgacttgtatcgccgtggggctcgttacactgtatctgggcgtcatggtgcaggcggactcgggatgcgtgatcaactggaagggccgcgagcttaagtgtggaagcggcatcttcgtcacgaacgaggtccacacctggacagagcagtacaaattccaggccgatagccctaagcggctctccgcagcgatcggcaaggcctgggaggagggggtctgcggcatccggtccgcgacacgcctggagaacatcatgtggaaacagatcagcaacgaattgaaccacatcctgctggagaacgacatgaagttcaccgtcgtggtcggggacgtggtgggcatattggcacaggggaagaagatgataagacctcagccaatggagcacaaatattcatggaagtcctggggcaaggcgaaaatcatcggcgccgatgtgcaaaatacgacatttatcatcgatgggccaaacacccccgaatgcccggacgatcagcgagcatggaatatctgggaggtggaggactacggcttcggtatattcactaccaacatttggctgaagctgcgggattcctacacacaagtgtgtgatcatcgattaatgagtgctgctatcaaagacagcaaggccgtgcacgccgacatgggctactggatcgagagcgaaaagaacgagacctggaaattagcccgggcgtcattcattgaggtcaagacctgcatctggccaaagtcacacacgctgtggtccaacggtgtgttagagagcgagatgattataccgaagatctacggcggacccatatcccagcataattatcgccccggttacttcacacagaccgcaggaccatggcacctgggtaagctagagctcgacttcgacttatgtgagggcaccactgtagtcgtggacgagcactgtggcaatcgggggccctcactgcgcacgaccaccgttacaggcaagattattcatgagtggtgctgtcggtcctgtaccctgcctcctttacggtttaagggtgaggacgggtgctggtacggaatggagatacggccagtcaaggagaaggaggagaacctggtcaagtcaatggtgagcgccgggagcggcgaggtcgacagcttttccctcgggctactgtgcatctcgataatgattgaagaagttatgagaagccggtggagccgcaagatgctcatgaccgggactctggcggtgtttctgctcctgattatggggcagctgacgtggaacgacctaatcagattatgcataatggtcggggccaacgttagcgaccgcatggggatgggcaccacctatctggctctcatggccacattcaaaatgaggcccatgttcgcggtgggactgttgttccggcgtttgaccagtcgggaggtcctgcttctcaccatcgggctgtccctggtggccagcgtcgagctccctaactcccttgaagagcttggcgacgggcttgcgatggggatcatgatcctgaaactgctcactgactttcagagccatcaactgtgggccacgctgctctccttgacgtttatcaagaccacattgagcctccactacgcctggaagaccatggctatggtactgtccatagtgtcgttattcccactctgcttatccacgacaagccagaagaccacctggctacccgtgctcctaggctccctcgggtgcaagccattgacgatgttccttatcgccgagaataagatctggggtcgcaagtcctggcccctgaacgaggggatcatggctgtgggcgtcgtctccatactgctcagctcattgctcaaaaacgacgtgcccctggcggggccgctaatcgcaggcggtatgctcatcgcatgctacgtgatctcggggagctcggccgacctgagcttagagaaggcggccgaagtctcctgggaggaggaagccgagcacagcggcgcgtcccacaatatacttgtggaggtgcaggacgacggtaccatgaagatcaaggacgaggagcgggatgacaccctgactatattactaaaggccacactcctggcggttagcggcgtctatcccttatccatccccgctaccctcttcgtgtggtacttctggcaaaagaagaagcaacgcagcggggtcttgtgggacaccccctccccacccgaagtggagcgtgcagtactcgacgacggtatctaccgcatcatgcaacggggccttctggggcggagccaggtcggcgtaggggtgtttcaggagaatgtgttccacactatgtggcacgtgacccgtggcgccgtattgatgtaccagggcaagcggctcgagccctcttgggcgagcgtcaagaaggatctaatctcctacggcggtgggtggcggttacaaggcagctggaacacgggtgaggaggtccaggtcatagccgtcgagcccggcaagaacccgaaaaacgtgcagacagctccagggaccttcaagacacccgagggcgaggttggcgcgatcgcactggacttcaagcccggtacatccggcagcccgatcgtcaaccgggaagggaaaatagtgggcctctatggtaacggggttgtcactacctccggcacctacgtgagcgccatcgcgcaggccaaagcgagccaggaagggccgcttcccgaaatcgaggacgaggtttttcggaagcgaaacctcacgatcatggacctgcacccgggctccggaaagacacgccgctatcttcccgccatcgtcagagaggcgataaagcgcaagctccggaccctgatcttagccccaacccgcgtggtggccagcgagatggccgaggccctcaagggcatgccaatccgataccagacaactgccgttaagtccgagcacaccggcaaggagatcgtagacctgatgtgccacgccacattcaccatgcggctgctcagcccggtacgtgtccccaactacaacatgataataatggacgaggcccacttcaccgacccctcgagcatcgcagcccgggggtatatctcaacccgcgtgggcatgggggaggcagcggccatcttcatgaccgcaacgccccctggctccgtggaagccttcccccaatccaatgccgtcatccaagacgaggaacgagacattcctgagagatcctggaactccggctacgaatggattaccgactttccgggcaagacagtgtggtttgtgccgagcatcaagagcggcaacgatatcgccaactgcctgaggaagaacggtaagcgcgtcatccagctttcgcgcaagacattcgataccgagtaccagaagaccaagaacaacgactgggattatgtggtgaccaccgacatcagcgagatgggcgctaactttagagcagatcgggtaatcgatcctaggaggtgcctcaagcccgtgatcttgaaggacggtcctgagcgcgtgatcctggcgggcccgatgccggtgacggtggcctcagccgcccagaggcgcgggcggatcggccggaatcacaacaaggagggcgatcagtacatctatatggggcagcccctcaacaacgacgaggaccacgcccactggaccgaggcaaaaatgctgctggataatatcaatacccccgagggcattatccccgccctctttgagcccgagcgggagaagtctgccgccatcgacggggagtatcgcctgcgcggggaagcccggaaaaccttcgtcgaacttatgcgccgcggggacctccccgtgtggctttcatacaaggtagcgtccgaggggttccagtatagcgaccgccgctggtgcttcgacggcgagagaaacaaccaggtcctggaagaaaacatggacgtagaaatatggaccaaggagggggagcggaaaaagttacgcccgcgttggctagacgctcgcacttacagcgatcctctggcactccgggaattcaaagagttcgccgccggccgccgatccgtaagcggggacctgatcctagagatcggcaaattgccacagcacctgacccaacgcgcgcagaacgccttggacaacctcgtcatgttgcataactccgaacaaggggggcgggcttaccgccacgccatggaggaattgcctgacaccatcgagactctaatgctgttggcactcatcgctgtcctgaccggcggggtaaccctcttctttctcagcgggcgggggcttgggaaaacgtcaatcggtctgctgtgcgtcatggccagctccgttctcctgtggatggctagcgtggagccgcactggatcgccgcgtccatcatcctcgaattcttcctgatggtgctgctgatacctgaacccgatcgtcaacggacgcctcaagacaaccagctggcctacgtagttatagggctcctgttcatgatactgacagtcgcagccaacgagatgggccttctcgagacaaccaagaaggatctgggaattgggcatgtggcagtcgaaaaccatcaccacgcgaccatgctggacgtggacctccatccagcctcagcttggacgctctacgccgtggccaccaccatcatcaccccgatgatgaggcacacaattgagaacacgaccgcgaacatctcactgaccgcaattgccaaccaagccgccatactaatggggttggacaaggggtggcccatcagcaaaatggacatcggcgtgcccctgctcgcgctcgggtgctactcccaggtcaacccacttaccctcaccgccgccgtgttaatgttggtagcccactatgcgatcattggccccggcctccaggctaaagccacacgggaagctcagaagagaactgcggcgggcatcatgaagaaccccacggtcgatgggatcgtagccattgacctggatcccgtggtgtatgacgcgaagttcgagaagcagcttggccagatcatgttgttaattctgtgcaccagtcaaatactcctgatgcgcaccacctgggccctgtgcgagtccattacactggccacagggccgctgaccacattatgggagggctcccctggcaaattctggaacacgaccatagcggtgagcatggccaacatcttcagggggtcatacctcgccggagccggcttggccttctcgttaatgaagtcactcgggggcgggcgccggggcacgggcgcgcagggggagaccctgggtgagaaatggaaaagacagctaaaccaactgagcaagtccgagttcaacatctacaagcggagcggcataatggaggtagataggtccgaggccaaggaaggtctgaaacgcggggagacgacccgtcacgcagtgtctcggggcacggccaagctgagatggttcgtggagcggaacctggtaaaacctgagggaaaggtcatcgacctcgggtgtggccgcggtggctggagttattattgcgcgggactaaagaaggtgaccgaggttaaaggctacacaaagggaggacccggccacgaagagccgatccccatggccacctacgggtggaatctagtcaaactgcatagcggcaaggacgtgtttttcacgccgcccgaaaagtgcgacaccctgctgtgtgacattggggaatcctccccgaaccccactatcgaggagggccggaccctgcgtgtgctgaaaatggtcgaaccctggcttcgggggaaccagttctgcataaaaatcctcaatccctatatgccgtccgtggtggagaccctggagcaaatgcagcgcaagcacggaggaatgctagtccggaatcccctaagccgcaactcaacgcacgagatgtactgggtgagctgcggaaccggcaacatcgtatccgccgtcaacatgacgtctcggatgctgctgaaccgattcactatgactcaccgcaagcccacttacgagcgagatgtagacctgggggcagggacgaggcacgtcgctgtcgaacccgaggttgctaacctagacatcatcggacaacggatcgagaacatcaagcatgagcacaagtccacctggcactacgacgaggacaatccatataagacctgggcatatcatggaagctacgaagtcaagccgtccggcagcgccagcagcatggttaacggggtggtcaaactgctaacaaagccctgggacgtgatccccatggtgacgcagatcgccatgaccgacaccactccgttcggccaacaaagggtcttcaaggagaaggtggacacgcgcaccccgaaggcaaagcgcgggaccgcgcagatcatggaagtcaccgcccggtggctgtggggctttctgagcagaaataagaaaccgcggatttgcacccgcgaagagttcacccggaaggttcgctctaacgcagccatcggcgctgtgttcgtggacgagaaccagtggaattcagcgaaggaagccgtcgaggacgagcggttctgggacttagtgcagaaggagcgcgaattgcacaaacaggggaagtgcgcgacctgcgtgtacaacatgatgggcaagcgggagaagaagctaggggagtttggcaaagcgaagggatccagagcgatttggtatatgtggctcggggccaggtttctagagttcgaagccctgggcttcatgaacgaggaccattggttcagccgcgagaattcgctcagcggggtcgagggggagggtctgcacaagctaggctacattctccgtgacatatccaagataccgggtgggaacatgtacgccgacgataccgccgggtgggatacacgtattacggaggacgaccttcagaacgaggccaaaatcaccgacataatggagcccgagcacgccctgctagcaaccagcatctttaaactaacgtaccagaacaaggtcgtgcgcgtccaacgccccgctaagaacgggacagtaatggacgtgatctctcggcgggaccagcgcggcagcgggcaggtcggcacctatggcttaaataccttcacgaacatggaggcacagctcatacggcagatggagtccgagggtattttcctgcctagcgagctggaaaccccgaatctcgctgagcgcgttcttgactggttagagaagcatggcgtggagcggctcaagcgcatggccatttccggggacgactgcgtcgtgaagcccatcgacgaccggttcgccaccgccctgaccgcactaaacgacatgggcaaggtgcgcaaggacatcccccagtgggagccctcaaaagggtggaacgattggcagcaggtcccgttttgctcgcaccacttccaccagctcattatgaaggacggccgggaaatcgtggtcccttgccgcaaccaggacgagctggtggggcgggcgcgagttagccagggggccggctggtctctgcgggaaacggcttgcctcggcaagagctacgcccagatgtggcagctgatgtattttcaccgccgggacctacgattagccgccaacgcgatatgctcagccgtgccagtggactgggtgccgacgtcccgaaccacctggagcatacacgcgcaccaccagtggatgactaccgaagacatgctatctgtatggaaccgtgtatggatagaggagaacccatggatggaagacaaaacgcacgtgagcagttggggggacgtgccctacctggggaaacgggaggatcaatggtgcggctccctcatcggcctgaccgcgagggccacctgggcatcaaacattcaggtcgccatcaatcaggttaggagacttatcgggaatgagaattacctcgactacatgactagcatgaagcggttcaagaacgagggcgacccagagggggccctgtggtaa

SEQ ID NO: 24365 - RNA, 9879 nt, synthetic construct
  misc_feature 1..9879: note = derived and/or modified CDS sequence (opt11) from DENV-1__GQ199838__SS-prME
  source 1..9879: mol_type = other RNA
agcgtgaccatgctgttaatgctgatgcccaccgcccttgcctttcacctcacgacccgtggaggcgagccccacatgatagtgaccaaacaggagcggggcaagagcctgctgtttaagacctcagcgggggtgaacatgtgcaccctcatcgccatggaccttggggaactgtgcgaagacaccatgacctataagtgcccccgaataactgaagccgaacccgacgacgtggactgctggtgcaatgccaccgacacctgggtcacctacgggacctgctcccagactggggagcaccggcgagacaagcggagcgtggcgctcgcaccccatgttggcctgggtctggaaactcgcacggagacgtggatgtccagcgagggcgcctggaagcagatccagcgggtcgagacgtgggcactgcgccaccccggattcacggttatcgcgctgttcctcgcacacgctatcggcacgagcatcacccaaaaagggatcatattcattctcctgatgctggtgacgcccagcatggcaatgcggtgcgtgggcataggctcacgcgacttcgtggaagggttatcaggcgccacctgggtggatgtcgtgctggagcacgggtcgtgcgtgaccaccatggccaaggacaagcccacgctggacatagaactcctgaaaaccgaggtcaccaatcccgcagtgctgcgtaagctctgcatagaggccaaaatatcgaacaccacgaccgactcccgctgccccactcagggagaggccacgctgatggaggaacaggacgccaacttcgtgtgccgacggacgctggtcgaccggggctggggtaatggctgcgggctgttcgggaaggggagcctgatcacgtgcgccaaatttaaatgcgtgaccaagttggagggcaaaatcgttcaatatgagaacctcaaatacagtgtcatcgtgacagtacatacgggcgaccagcatcaagtggggaacgagagcaccgagcacgggaccaccgctactattacaccccaagcgcccacctccgagatccagttaaccgactatggggctctgaccctcgactgcagtccccgaacgggcctggacttcaatgagatggtgcttctgaccatgaaggagaagtcctggctggtccacaagcagtggttcctggatctcccactgccgtggaccagcggggccagcaccagtcaagaaacgtggaacaggcaggacttactggtgaccttcaaaaccgctcacgcaaagaagcaagaggtggtcgttctgggctcacaagagggcgccatgcacacagccctgacgggtgccactgaaatccagacctccggcacgacgacgatattcgcaggccatctcaagtgtcgcctgaagatggacaagctgaccctaaagggcatgagctacgtcatgtgtaccgggtctttcaagctggagaaggaggtggcggagacgcaacatggcaccgtattagtgcagattaagtacgagggcaccgacgccccgtgcaagatccccttcagcactcaggatgagaaaggcgtaactcaaaacggccggctgatcacggcaaatccaatcgtgacagacaaggagaagcccgtaaatatagaggccgagccgccctttggagagtcctacatcgtcatcggcgcgggcgaaaaggccctcaagctaagttggttcaagaaagggtcaagcataggaaagatgttcgaggcgaccgcacgaggggcccgccgaatggcgatcctgggcgacacagcatgggactttggtagcatcggcggcgttttcacaagcgttgggaagctcgtccatcaaatattcggcactgcatatggggtgctgttcagcggcgtgagctggaccatgaagatcgggattggcgtcctgctcacgtggctgggcctaaattcccgcagtacgtcactctccatgacctgcatcgcggtggggctggtgaccctctacttaggcgttatggtgcaggcggactccgggtgcgtaatcaactggaagggccgggagcttaaatgtgggagcggcatctttgtcactaacgaggtgcacacctggactgaacagtacaagttccaggcggacagcccgaagcgcctatctgccgcaatcggcaaagcctgggaggagggggtgtgcggtatccggagtgcgacccgacttgagaatatcatgtggaaacagatctcgaatgaactgaaccacatcctgctcgagaatgggatgaagttcacagtcgtggtgggcgacgtagtgggaatcctggctcagggcaaaaagatgatccgaccccagcccatggagcacaaatacagttggaagtcgtggggcaaggccaagatcatcggcgcagacgtccaaaacactacgttcataatagatggcccgaacactcctgagtgccccgacgaccagcgcgcctggaacatctgggaggtcgaggactacggcttcggcatcttcaccacgaatatctggctgaagctcagggacagctacacacaggtgtgtgaccaccgccttatgtctgctgctatcaaggacagtaaggccgtgcacgccgacatggggtactggatcgagtccgagaagaacgagacctggaagctggcccgcgcgagtttcattgaagtcaagacctgcatctggcccaagtcccacacgctctggtcgaacggggtactggagtccgagatgatcatacccaagatctacggcgggccgatcagccagcataactaccgccccggttacttcacccagaccgccgggccctggcacctgggcaaacttgagttggatttcgatctgtgtgagggaaccaccgtggtagtagacgagcactgcgggaacagaggaccgtccctccgcaccaccacagtgacaggaaaaatcatccacgagtggtgctgtagatcatgcaccctgccacccctgcgcttcaagggcgaggacggctgctggtacgggatggagatccggcccgttaaagaaaaagaggagaacttagtgaagtccatggtgtccgcgggcagcggggaggtcgattcattctccctcggcttgctctgcacctcgataatgattgaggaagttatgcgctcccggtggtccaggaagatgttaatgactggtactttggccgtgttcttactcctcatcatgggccagctcacctggaacgatctaatccgtctctgcatcatggtcggggcaaatgcgtcagaccgcatgggcatgggtacaacgtacttagccctgatggccactttcaagatgcgccctatgttcgccgtgggcctattattccggcgccttacctcaagggaagttttactcctgaccatcggcctgtctctcgtcgcctccgtggagctccccaattctctagaggagttaggggacggactggccatgggcatcatgatcctgaagttgctgaccgatttccagtcgcaccagttatgggccacgctcctcagcctgaccttcatcaagaccaccctttccctgcattacgcttggaagacgatggccatggtcctgagcatcgtgtccctctttcccctgtgcctgagcaccaccagtcagaaaaccacttggctccccgtgttacttggaagcctcggctgcaagcctctgaccatgttcttgatcgcggagaataagatctgggggcgcaaatcctggcccttgaacgaaggcatcatggccgtgggggtggtgtccatcctgctaagctcattactgaagaacgacgtcccccttgccgggccgctcatcgcgggcgggatgctgatcgcctgctacgtcatctcaggctcctcagcggatctctcccttgaaaaagccgcggaggtgagctgggaggaagaggccgaacactcaggagccagccacaatatactcgtcgaggtacaggatgacggcacgatgaagatcaaggacgaggagcgggatgacaccttgaccatcctcctgaaggcgacgctactcgcggtgtccggggtgtaccctctctctatccccgccaccctgttcgtgtggtatttttggcaaaagaagaaacagcgctccggtgtgctgtgggacacccctagtccacccgaggtcgagcgcgcggtactcgacgatggcatctacagaatcatgcagcggggtctgctgggcaggtcccaggtgggagtcggcgttttccaggagaacgtgttccatacaatgtggcacgtcacgagaggggccgtgctcatgtaccaaggcaagcgcctggagcccagctgggcgtccgttaagaaagatctgatcagctatggcgggggctggaggctacagggctcctggaacaccggcgaggaggtccaagttatcgccgtcgagcccggcaagaaccccaaaaacgtccagacggcgcccggcaccttcaagacgccagaaggcgaggtaggggccatcgccctggacttcaagccgggcaccagtgggtcccccatcgtgaaccgcgagggcaagatcgtcgggctgtacgggaacggcgtggtcaccaccagcgggacgtacgtcagcgctatcgcccaggccaaggccagccaggagggaccgttacccgaaatcgaggacgaggtgttccggaagcggaatctcactatcatggatttgcacccgggctcgggcaagaccagacgctacctgccggctatcgtgcgggaggccatcaagcgcaagctgcggaccctgatcctggccccgacgagggtcgttgctagcgagatggccgaagcgctaaagggaatgcccatccgatatcagaccaccgccgtcaagtccgagcatacgggtaaggagatcgtcgacctgatgtgtcatgcaacgttcaccatgcggttactgtcaccagtgcgtgtaccgaactacaacatgatcatcatggacgaggcccacttcaccgaccccagctccatcgccgcccggggctacatcagcacccgcgtcggaatgggcgaggccgctgccatattcatgaccgccacgccgcctgggtccgtggaggcgttcccgcagagcaacgcagtaatccaggacgaggagcgggacatcccagaacgctcctggaactcggggtatgagtggatcaccgactttcccggtaagaccgtttggttcgtcccttccatcaagagcggcaacgacatcgcaaactgtttgcgtaaaaacggcaaacgagtgatacagttatcccggaagacgtttgacactgagtaccaaaagactaagaacaacgactgggattacgtagttaccacggacattagcgagatgggggccaacttccgcgcggaccgggtgatcgacccccgccggtgcctgaagcccgtcatcttgaaggatggccccgaacgggtgatactcgccgggccaatgcccgttaccgtggcctccgccgcccagcggcgaggccggatcggacgtaatcacaacaaagagggggaccagtacatctacatgggccagcccctgaacaacgacgaggaccacgctcattggaccgaggccaagatgctgctcgacaacatcaacacgccggaaggaatcatccccgcccttttcgagccggaacgggagaagtccgccgcaatcgatggcgagtaccgcctgagaggggaagcgcggaagacattcgtagagttaatgcgccggggcgacctgcccgtctggctgagttacaaggtggcgagcgagggattccagtactctgacaggcgctggtgcttcgacggagagcgcaacaaccaagttctcgaggagaacatggacgttgaaatatggaccaaggagggcgaacggaagaagttacgccccaggtggctggacgcccgcacctactccgaccccctcgccctgcgggagtttaaggagttcgccgcggggcgcaggagcgtctccggcgacctgatactcgagatcggcaaacttccgcagcaccttacccagcgcgcccagaacgccctcgacaatctggtgatgctgcacaactctgagcagggcggccgggcttaccgccacgctatggaagagttgcccgacacgatcgagacactgatgctgctcgcgctgatcgcggtcctgaccggcggggtgaccctcttcttcctgtccgggagaggcctgggcaaaacgtcgatagggctcctgtgcgttatggcttccagcgtcctgttatggatggcctccgtggagccccactggatcgcggccagcatcatcctagagttctttcttatggttctcctgatcccggagcctgatcgacagcggacgcctcaagacaaccaactggcctacgtcgttattggcctcctgttcatcatcctgactgttgccgccaacgagatggggttgcttgagaccaccaagaaggacctggggatcgggcacgtcgccgtagagaaccaccaccacgccactatgctcgacgtggacctgcaccccgcctcagcctggaccctgtacgccgttgcgaccaccatcatcacgccgatgatgcgccataccatcgagaacaccaccgccaatatttctcttacagccatcgccaaccaggccgctatcctgatggggctagataagggctggcctatatccaagatggatatcggagtgcccctcctggccctaggatgctacagtcaggtgaacccgctcaccttaaccgccgccgtcttgatgctcgtcgcccactacgcaatcatagggcccggcctgcaggccaaggccacccgggaggcacagaaacgcaccgccgccgggatcatgaagaaccccaccgtggatggaattgtcgccattgacttggatcccgtcgtgtacgacgccaaatttgagaagcagctaggacaaatcatgcttctgatcctctgcacctcccaaatcctgttaatgaggactacctgggccctctgcgagagcatcacccttgctaccgggccactaaccacgctctgggaggggtccccggggaagttctggaacaccaccatagctgtcagcatggccaacatctttcggggctcctaccttgccggtgcagggcttgcgttcagcctcatgaagtccctaggaggagggagacgagggacaggcgcgcaaggcgagacgctgggcgaaaagtggaagcgccaactcaatcagttgtccaaaagcgagttcaacatctacaaacggtccggaatcatggaggtggaccggagcgaggccaaagaagggttaaagcgcggcgagaccacccgccacgcagtgtcccggggtacagcgaagctgcgttggtttgttgagcggaacctcgttaagcccgagggaaaagtaatcgacttgggctgcgggcgcggcggatggagctattactgcgctggcttaaagaaggtcactgaggtcaaggggtacactaagggcggccccgggcacgaggagcccattccgatggccacctacggctggaatctcgtgaaacttcattccggcaaagacgtattctttaccccgcccgagaaatgcgacacgctcctctgcgacatcggggaaagctcccccaatccgacaatcgaagaaggtcgaaccttgcgcgtgctgaagatggtggagccctggctacgggggaaccaattctgcataaaaatactcaacccgtacatgccgagcgtggtcgaaaccctggagcagatgcagagaaagcatggcggcatgttagtgcggaacccgctgagccgcaatagcacccacgagatgtactgggtctcgtgcggtacggggaacatcgtgagcgctgtgaacatgacgtcccggatgctgttaaaccgcttcacaatggcccaccgcaagcccacttatgaacgggatgtggacctgggcgcgggaacgcgccacgtggccgtggagccagaggtcgccaacctggacatcatcggtcagcgtatcgagaacatcaaacatgagcacaaaagcacctggcactacgacgaggacaacccctacaagacctgggcctaccacggttcttacgaggtgaagccatctggatccgccagcagcatggtcaacggcgtggtgaagctcctgaccaagccatgggacgtaattcccatggtgacgcaaatagcgatgaccgataccaccccattcgggcagcagagagtgtttaaggagaaggttgacacgcggacaccgaaggctaagcgaggcaccgcccagattatggaggtgaccgctcgttggctgtggggtttcctctcccgcaacaaaaagccccggatatgcacgagggaagagttcacccgcaaggtgcgcagcaacgctgcgatcggggccgtgttcgtggatgaaaaccagtggaactccgccaaggaggccgttgaggacgagagattctgggatctggttcagaaggagcgcgagctccacaagcagggcaagtgcgctacctgcgtctacaacatgatggggaagcgcgaaaagaaactcggcgagttcgggaaagccaaaggcagcagagccatctggtacatgtggctcggagcacggttcctggagttcgaagccctcgggttcatgaacgaggaccactggttctcgcgtgagaacagcctgtccggcgttgagggggagggactgcacaagctcgggtacatcctgcgggacatcagcaagatccccgggggcaacatgtatgcggacgacactgccggctgggacacgcgcatcaccgaggacgacctccaaaacgaggctaagattacggacataatggagccggagcacgccttgttggccacgtccatattcaagttaacttaccagaataaggtcgtacgggttcagcgacccgcgaagaacggcaccgtcatggacgttataagtcgtcgtgaccagcgcggctccggacaagttggcacctacgggctcaacacgtttacgaacatggaagcccagttgatccggcaaatggagagcgagggcatattcctgccctctgaactcgagaccccgaacctggccgagcgtgtcctggactggctggagaagtacggggtggagagattgaagcgcatggccatcagcggcgatgactgcgtcgtgaaaccgatcgacgaccggttcgccacagcgctgaccgcattaaacgacatggggaaggtgcgcaaagacatcccccagtgggaaccctcaaagggctggaacgactggcagcaggtccccttctgcagccaccattttcatcagctgattatgaaagacggcagggagatcgttgtgccctgcagaaaccaggacgagctggtggggcgggcccgcgttagccagggcgccgggtggagcctcagagagacagcttgcttgggcaaatcgtacgcgcagatgtggcagctgatgtactttcaccgccgggatttgaggctggcagccaacgccatctgctccgcagtgcccgttgactgggtcccaaccagccggaccacctggtcgattcacgcacatcaccagtggatgacgaccgaagacatgctgagcgtgtggaaccgcgtttggatagaggagaacccctggatggaggacaagactcacgtctcctcatggggtgacgtgccttacctcggcaagcgggaggatcagtggtgcggcagtctgatcgggttaaccgcccgcgccacctgggcctccaacatccaggtggcgatcaaccaggtacgccggctgataggcaacgaaaattatctggactatatgacaagcatgaagagattcaaaaacgagggggaccccgagggcgccctatggtga

SEQ ID NO: 24366 - RNA, 9879 nt, synthetic construct
  misc_feature 1..9879: note = derived and/or modified CDS sequence (opt11) from DENV-1__FJ898396__SS-prME
  source 1..9879: mol_type = other RNA
tcggtaaccatgcttttgatgttgatgcccaccgccctggccttccatttgacaacgcggggcggggagccgcacatgatcgttacgaaacaggagcgtggcaagagcctgcttttcaagaccagcgcgggggttaacatgtgtaccctcattgccatggacttgggtgaactgtgcgaggacaccatgacttacaagtgcccgcggatcacagaggccgaacccgatgacgtagactgctggtgcaacgccaccgacacctgggtgacttacgggacctgcagccaaactggggagcacagacgcgacaaacggagtgtggccctcgcaccccacgtaggcctggggctggagacccgcaccgagacctggatgtccagcgagggcgcgtggaagcagatccagcgggtcgagacgtgggcgctccgccatcccgggttcacagtcatcgccctgtttctggcccacgccatcggcacctccatcacccagaaggggatcatcttcatcctcctgatgctggtcactcccagcatggccatgcggtgtgtcgggatcggctcccgcgactttgtggaggggttaagcggcgccacatgggtggacgtcgtgctggagcacgggtcctgcgtgaccaccatggccaaggacaagcccacgctggacatcgagctgctgaagaccgaggtcacgaaccccgcggtcctgaggaagctctgcatcgaggccaaaattagcaacacaactaccgactcccgctgccccacccagggcgaggccaccctgatggaggaacaggacgctaatttcgtttgccggcgtacgtttgtcgatcggggctgggggaacggctgcggtctgttcggcaaggggagcctcatcacgtgcgcaaagttcaaatgcgttaccaagctggagggcaaaatcgtgcagtatgagaacctgaagtactcagtcattgtgaccgtgcacacgggcgatcagcaccaagtcgggaacgagagtaccgagcacggtaccaccgcgaccatcacgccccaggcccccactagcgagatccagctaaccgactacggggctctgaccctggactgcagcccccgaactggccttgatttcaacgagatggtcctgttaaccatgaaggagaagtcttggttggtgcataagcagtggttcctggatctgccgctcccgtggaccagcggggctagcacatcgcaagagacttggaaccggcaggacctgctggtgaccttcaagaccgcccacgcgaagaagcaggaggtggtcgtgttgggcagccaggagggcgccatgcacactgccctgactggggccaccgagatccagaccagtggtaccacgacgatttttgccggtcatctgaagtgccgcttaaagatggacaagctgactctgaagggtatgtcgtacgtgatgtgcaccgggtccttcaagttggaaaaggaggtcgcggagacgcagcacggaaccgtgctagtgcaaataaagtacgagggaaccgacgccccctgcaagatccccttcagcacccaggacgagaaaggcgtcacacagaacgggagactgatcacggccaatcctatcgtgaccgataaagaaaagcccgtgaacatcgaggccgagccgcccttcggggaatcctacatcgtcatcggcgcgggcgagaaggcccttaagctcagctggtttaagaaggggtccagtatcggcaagatgttcgaggccaccgcccggggtgcccgccgcatggcgatcctgggcgacacggcctgggacttcgggtccgtcggcggggtttttaccagcgtcgggaagctggtccaccagatcttcggcactgcctacggggtcctgttctccggggtctcgtggacgatgaagatagggatcggcgtgctgctgacttggctcgggctgaactcccgtagcacctccctgtcgatgacatgcatcgccgtcggactcgtaaccctgtacctgggcgttatggtgcaggccgactccgggtgcgttatcaactggaagggccgggaactgaagtgcgggtcaggcatcttcgtgacgaacgaggtgcatacttggaccgagcagtacaagttccaagcggacagcccgaagcgcctgtccgccgccatcggcaaggcctgggaggagggggtctgcggcattcggagcgccacccgcctggagaacatcatgtggaagcagatcagcaacgaactcaatcacatccttctggagaatgacatgaagttcaccgtggtggtcggggacgtggtgggcatcctcgcgcagggtaagaaaatgattagaccccagcccatggagcacaagtacagctggaaatcctggggaaaggcgaagatcattggcgccgacgtccagaacactacgtttatcattgatgggcctaacaccccggaatgcccagacgaccagcgcgcctggaacatctgggaggtggaggactacggatttggtatcttcaccacgaacatctggttgaagttacgggacagctacacccaggtttgcgatcatcgcctcatgagcgcggccatcaaggacagcaaggccgtccatgccgacatgggctattggatcgagtcagaaaagaacgagacctggaaactggccagggcgagcttcatcgaggtgaagacctgcatctggcctaagtcccacacgctgtggagcaatggcgtgctcgagagtgagatgattatccccaaaatctacggtggccctatcagccagcacaactaccgccccgggtacttcacccagaccgcaggcccctggcacctgggaaaactggagctcgacttcgacctgtgtgagggcaccacggtcgtggtggacgaacattgcggcaatcggggtccgagcctacggacaaccaccgtcacgggcaagataatccacgagtggtgctgccggagctgcacccttccgcctctccgcttcaagggggaggatgggtgctggtacgggatggaaattcggcccgtgaaggagaaggaggagaacctggtgaaaagtatggtctcggccggctcaggcgaagtggacagcttcagccttgggctgttatgcatctccatcatgatcgaggaggtgatgcgcagccgttggtcccgcaagatgctcatgactggcaccctggccgtattcctacttcttatcatgggccagttgacgtggaacgacctcatccggttgtgcattatggtgggcgccaacgcgagcgaccgcatggggatgggcaccacttacctggccctcatggccaccttcaagatgagaccgatgttcgccgtggggctgctgttccgacgcctaacttcccgagaggtgctgctgctcactatcgggctgagcttagtggcttccgtcgagctccccaacagcctggaggagctgggcgacgggcttgcgatgggcatcatgatcctcaagttgctcactgacttccagtcccatcagctgtgggctactctgctcagcctgacttttatcaagaccaccctgtccctccactacgcctggaagaccatggccatggttctgtctatcgcgtccttgttcccgctctgtctgagcactacctcccagaaaaccacctggctccctgtcctcctgggcagcttagggtgcaagccgctcacaatgttcctgatcactgagaccaagatatggggccgcaagtcctggcccctgaatgaggggatcatggccgtcggcgtggtgagcatcctcctgagctccctgctcaagaacgatgttcccctggccgggcccctgatcgccggcggcatgctcattgcctgctacgtgatctcagggtcctccgctgacctgtccctggagaaggcagccgaggtgagctgggaggaggaagccgagcactccggcgcctcgcacaatatcctcgtcgtggtgcaggacgacggaacaatgaagatcaaggacgaagagcgggacgataccctgacgatcctgctcaaggcgacgctgttagcagtttccggcgtgtacccgctctcaatccccgccaccctgttcgtgtggtacttctggcagaagaagaagcaacgttccggggttctgtgggacacccccagtccgcccgaggtagagcgggcagtgctggacgacggcatataccgcatcatgcaacggggcttgctggggcgctcgcaggtcggcgtgggggtgttccaggagaacgttttccacaccatgtggcatgtgacccgaggcgcagtgctaatgtaccaggggaagcgcctggaacccagctgggcgagcgtaaagaaggacctgatcagctacggcggcgggtggcggttgcaggggtcctggaacaccggggaggaagtccaggtgatcgccgtcgaacccggcaagaatcccaagaatgtacaaaccgcacccgggacgttcaagacccccgagggcgaggtgggcgccatcgccctcgacttcaagccggggaccagcgggtcccccatcgtcaatcgcgaggggaaaatcgtgggtctttacggcaacggagtggtcaccacgagcggcacctatgtgagcgcgatcgcgcaggccaaagcctcccaggaagggccgctgcccgagatcgaggacgaggtgttccggaagcgcaaccttaccatcatggacctgcacccaggcagcgggaagacccggcgctacctgccagcgatcgtccgggaggctatcaagagaaaactccgaacgctgatcctggcccctacccgcgtagtggcctccgagatggccgaggcgctgaagggtatgcccatccgctaccaaaccacggccgtcaaaagcgagcacacgggcaaggagatcgtagatctgatgtgccacgccaccttcaccatgcggctgttatcccccgtgcgcgtcccgaactacaacatgataatcatggatgaggcccattttaccgaccccagctccatcgcggcgcgggggtacattagcacgcgggtgggcatgggggaggcagccgccatcttcatgaccgccacgcctcccgggtccgtggaggcgttcccgcagagcaacgccgtaatccaagacgaagagcgggatatccccgagcgatcctggaacagcggatatgagtggattaccgatttcccaggaaaaactgtgtggttcgtgccctccataaagagtggaaatgacattgccaactgcctgaggaagaacgggaagcgcgtcatccagctgagtcggaagaccttcgatactgaataccagaagaccaagaacaacgactgggactacgttgtcacgaccgacatcagcgagatgggcgctaacttccgcgccgaccgggtcatcgatccgcgccggtgcctcaagcccgtgatcctgaaagatgggccggagcgcgtaatactggccggcccaatgccggtgaccgtggcttccgccgcccagcggcgcgggcgcatcggacgcaatcacaacaaggaaggcgatcagtacatctacatgggccagcccctcaacaacgacgaggaccacgcccactggaccgaggccaagatgctgctggacaacatcaacacgcccgagggcatcatccccgccctcttcgagcctgagagagagaagagcgccgccatcgacggggaataccgcctacgcggcgaggcgcggaagaccttcgtggaattgatgcgccgcggtgacctcccggtgtggttatcctacaaggtagccagcgagggcttccagtacagcgaccgcaggtggtgcttcgacggcgaacgcaacaaccaagttctggaggagaacatggatgtggagatctggaccaaggagggtgagcggaagaagctccgtccgcgttggctggacgcccgcacctactccgaccccctggccctgcgggagttcaaagaattcgccgcgggccgccggagcgtgtccggggacttaattctggaaatcggcaaactcccgcagcacctgacgcagcgtgcccagaacgccctagacaaccttgtaatgctacacaacagcgaacagggcgggcgggcctaccgccacgcaatggaggaactgccagacaccatcgagaccttgatgctgctagcgctcatcgccgtactcaccggcggggtgactctgttctttctgtcgggccggggcctgggaaagacgagcatcgggctgctctgcgtaatggcctccagcgtgctgctgtggatggcctccgtggagccccattggatcgcggccagtatcaccctcgagttcttcctgatggtcctgttaatccccgagccggaccggcagaggacaccccaggacaaccaattggcctatgttgttatcgggctcttgttcatgatcttaaccgttgctgccaacgagatgggccttctcgagactactaaaaaggacctggggataggccacgtggcggtagagaaccaccaccatgcaaccatgctagacgtcgacctccatcccgcctccgcctggacactgtacgccgtggcgacgaccatcatcacaccgatgatgcgccacaccatcgagaacacaaccgccaacatcagcctgaccgctatagccaatcaggccgcgatcctcatgggattagacaagggctggccgatctccaaaatggatattggcgtgccgttgctcgccctggggtgctacagccaggtcaaccccctgaccctcacggccgccgtgctgatgctggtggcccactacgccataatcggcccggggctccaagccaaggcaactcgggaggcccagaagcgcactgcggccggcatcatgaaaaaccccaccgtcgacgggatcgttgccatcgacctggatcccgtggtctatgacgctaaattcgagaagcagctgggacaaatcatgctgctgattttatgcacatcccaaatcctcctgatgcgcaccacctgggccctgtgcgagtctataaccctcgcgacgggccccctgactactctgtgggaggggtcccccggcaaattctggaacactacgattgccgtgagcatggccaacatcttccgagggtcatacctcgcaggcgccggcctggcgtttagcctgatgaagtccctcgggggcggtcggcggggcaccggggcccagggtgaaaccctgggagagaagtggaaacgccagctgaaccagctctccaagagcgagttcaacatctacaagagatccgggatcatggaggtggaccgcagcgaggcgaaggagggcctgaaacgaggagagaccactaggcatgccgtttcccggggtactgcgaaacttcgctggttcgtggagcgcaacctggtgaagcccgaggggaaggtgattgacttagggtgcggcagagggggctggagctactactgcgccgggctgaagaaggtgaccgaggtgaaaggatacacaaagggcgggcccggccacgaggagcccatcccgatggcgacctatgggtggaacctggtcaagctccacagcggcaaggatgtgttttttacgccgcctgagaagtgcgacaccctgctgtgcgatattggggagtcgtcccccaatccgaccatcgaggagggccggacgcttcgcgtgctaaagatggtcgaaccctggctgcgggggaatcagttctgcataaagatcctcaacccctacatgccctcagtggtggagacactggagcaaatgcaacgcaagcacggcggcatgctggtcagaaacccgttatcacgcaacagcacacatgaaatgtactgggtgtcctgcggtacaggcaatatcgtgagtgccgtcaacatgaccagtcggatgctgctgaaccgctttacgatggcccaccgcaagcccacctacgagcgggacgtggacctcggggccggtacccgccacgtggccgtcgagcccgaggtggccaacctggacatcataggccaacggatcgagaacatcaagcacgagcacaagagcacctggcactacgacgaagacaacccctacaagacgtgggcctatcacgggtcctacgaggtcaagccgagcggatccgcctcaagcatggtgaacggggtggtcaaactgttaaccaagccctgggacgtaatccccatggttacccagatcgcgatgacggacacgacccccttcggccagcagcgtgtcttcaaggagaaggttgatacccgaaccccgaaggccaagcgcgggacggctcagatcatggaagtaaccgcccggtggctgtggggctttctgtcccgcaacaaaaagccccggatctgtacccgcgaagagttcacccggaaggtccggagcaacgccgcgatcggcgccgtcttcgtggacgagaaccagtggaactccgcgaaggaagcggtagaggacgagcggttctgggacctcgtccagaaggagcgcgagctgcacaaacagggcaagtgcgcgacgtgcgtgtacaacatgatgggcaagcgggagaaaaagctgggggaattcggcaaggccaaggggagccgcgccatatggtacatgtggctcggcgcccggttcctggagttcgaggccctgggcttcatgaatgaagaccactggttctcccgcgagaactccctctctggggtcgagggcgaggggctgcataagctcggctacatcctccgggacatcagcaagattcccgggggcaacatgtacgcggacgacaccgctggctgggacacccgcatcaccgaggacgaccttcagaacgaagccaagatcacggatatcatggagccggagcacgccctgctcgccacctccatcttcaagctgacctaccagaacaaggtcgtgcgggtccagcgcccagcgaagaacgggaccgttatggacgtgattagccgccgggaccagcgcggctccggtcaggtcggcacatacgggctgaacaccttcacaaacatggaagcccagctcattcggcaaatggagagcgaggggatcttcctgccctccgagctagagacccccaacttggccgagcgggtgctggactggctggagaagtacggcgttgagcggctcaagcgcatggctatcagcggggacgactgtgtcgtgaagccaatcgacgaccggttcgccaccgcgctgaccgccctgaacgacatgggtaaggtccgcaaggacatacctcagtgggagccctccaagggatggaatgattggcagcaggtccccttctgcagtcaccacttccaccagctcataatgaaggacggcagggagatcgtggtgccttgccgcaaccaggacgagctggtcggccgggcgcgcgtatcccagggggccggctggagcctgcgggagaccgcctgcctcggcaagagctacgcgcagatgtggcagctgatgtacttccaccgccgggacctacgcctcgctgccaatgccatctgctccgcggtgcccgtcgactgggtgcccaccagccggaccacgtggtccattcacgctcaccaccagtggatgaccaccgaggacatgctcagtgtgtggaaccgcgtatggatcgaggaaaacccatggatggaggacaagacccacgtgtcgagctggggcgacgtgccgtatctgggaaagcgggaagaccagtggtgcggctccttgatcggcctgacggctcgcgcgacctgggccagcaacatccaggtcgcgatcaaccaggttagacgcctgatcgggaacgagaattacctcgactacatgacctctatgaagcgcttcaagaatgagggggacccggagggggctctgtggtga

SEQ ID NO: 24367 - RNA, 9879 nt, synthetic construct
  misc_feature 1..9879: note = derived and/or modified CDS sequence (opt11) from DENV-1__GQ199839__SS-prME
  source 1..9879: mol_type = other RNA
agcgtgaccatgctgctcatgctgatgccaaccgccctggcctttcatcttaccacccggggcggtgagccgcacatgattgtcaccaagcaggagcggggcaagtcactgctgtttaaaaccagcgcgggggtgaacatgtgcaccctcattgcgatggacctgggcgaactgtgtgaggacaccatgacatacaaatgtcctcggatcaccgaggccgagcccgacgatgtggactgctggtgtaacgctaccgacacttgggttacctacggaacttgcagccggacgggcgagcaccgccgggacaaacgctctgtggccctcgcaccccatgtgggcctggggctggagacccggaccgagacctggatgtcgagcgagggcgcctggaagcagatccaacgcgttgaaacgtgggccttacgacatccagggttcaccgttatcgccctgttcctggcgcacgccatcggcacctccatcacccaaaaggggataattttcatcctcctaatgctagtaactccctcaatggccatgcgctgtgtaggcattggctcccgggacttcgtggaggggctcagcggcgcgacctgggtggacgtcgtgctcgagcacgggtcctgtgtgaccaccatggccaaggataagcccactctggacatcgagctgctaaagacagaggtcactaaccccgcggtgttacgcaagctctgcattgaggccaagataagtaacacaacgaccgacagcagatgccccacccagggcgaggcgacgctgatggaggagcaggacgcgaactttgtatgccgccgcacattcgtggaccgcggctggggcaacggctgcgggctgttcggcaaggggagtctcattacgtgtgctaagttcaagtgcgttaccaagctggagggtaagatcgtgcagtacgagaacttgaagtactcggtcatcgtgacggttcatacgggcgaccagcaccaagtcggtaacgagagcaccgagcacggcaccacggcgaccatcaccccacaggcccccaccagcgagattcaacttaccgactacggggccctgaccctggactgctctccccggacgggactcgacttcaacgagatggtactgctgaccatgaaggaaaagtcctggttagtccacaagcaatggttcctggacttgccgctcccctggacgagcggggcaagcactagccaggagacgtggaaccgccaggacctgctggtcaccttcaagaccgctcatgcgaagaagcaggaagtggtagtgttgggttcccaggagggggccatgcacactgccctgaccggggccaccgagatacagacctcaggcacaacgacaatattcgcagggcacctaaagtgccggctcaaaatggacaagttgacgctgaaaggcatgagctacgtgatgtgcaccggttcctttaagctcgagaaagaagtcgcagagacccagcacggcaccgtgctggtgcagatcaagtacgaggggaccgacgccccgtgcaagatccccttctcaacccaggacgagaagggggtcacgcaaaacggcaggctgatcaccgccaacccgatcgttacggacaaagagaagcccgtaaacattgaggcagagccgcctttcggggagagctatatcgtcataggcgcaggcgagaaggccctgaagttatcttggttcaagaagggcagtagcataggcaagatgttcgaagccaccgcccgcggagcgcgccgcatggcgatactgggcgatacggcctgggacttcgggtccatcggcggcgtgttcacctctgtcgggaaactggtccaccagatttttggcacagcctacggagtcttattctccggcgtgagctggaccatgaagataggaatcggcgtcctgctcacgtggctaggcctgaactcgcggagcaccagcctgtcgatgacctgtatcgctgtggggttggtgaccctgtacctgggcgtcatggtgcaggccgactccggctgcgttatcaactggaaggggcgcgagctcaagtgcgggagcggcatcttcgtcacgaacgaggtgcatacctggaccgagcagtataagttccaggcggacagcccgaagcggttgtcggccgccattggcaaagcctgggaggagggggtgtgcggcatccggagcgccacccggctggagaacatcatgtggaaacagatctccaacgaactcaaccatatccttctggagaacgggctcaagtttaccgtcgtggtgggagacgtcgtggggatccttgcccaaggcaagaaaatgattcgaccacagcccatggagcacaagtacagctggaagtcctggggcaaggccaaaatcatcggggccgacgtgcagaacacaaccttcatcatcgacggtcccaacactccggaatgtccggatgaccagcgtgcgtggaacatctgggaagtggaggattacggattcggcatcttcacgacgaacatctggctgaagctacgcgatagctacacccaggtttgcgaccaccggctgatgtccgccgccatcaaggacagcaaagccgttcacgccgacatgggctactggattgaatccgagaagaacgagacttggaaactagcccgtgcgtctttcatcgaggtcaaaacctgcatatggcctaagtcccacacgctctggagcaacggtgtattagagtccgagatgatcatccctaagatttacggcgggccgatcagccagcacaactaccggcctggctacttcacccagacagctgggccctggcacctgggcaagctcgagctggactttgacctgtgtgaaggcaccacggtggttgtggacgagcattgcggtaaccgcggcccgtccctcaggacgactaccgtaaccggcaaaataatccacgagtggtgctgccgcagctgcaccctgccgccgttgcggttcaagggcgaggacgggtgctggtacggcatggagatcaggcccgtcaaggagaaggaagagaacctcgtcaagtcgatggttagcgccggcagcggagaggttgactccttctccctgggcttactctgcacctccatcatgatagaagaagtgatgcggagccgctggtcccggaagatgctgatgactggaaccctagccgttttccttctgttgatcatgggacagctcacctggaacgacctgatccgtctctgcatcatggtcggggctaacgcgagcgatagaatgggcatgggcaccacctacctagccctgatggccacgttcaagatgcggccgatgttcgccgtagggctcctgttccgccgcctgaccagtcgcgaggttctgttactgaccatcgggctgtccctcgtcgcctccgtggagctgcccaacagcctggaggagctcggggacggcctggcaatgggcattatgatcctgaagctcctgaccgactttcagtcccaccagctgtgggccacgctcctgagccttacgttcatcaagaccacactctccctacactacgcttggaagacgatggccatggtcctgagcatagtgtcgttgttccccctgtgcctgtcgaccacctcccagaaaaccacttggctccccgtactgcttgggagcctcggctgtaaaccgctgaccatgttcttaatcgcggagaacaagatctggggtcggaagtcttggcccctcaacgagggcatcatggcagtcggggttgtgagcatcctactgagctcgctcctgaaaaacgacgtacccctggccgggcccctcatagccggcgggatgctcattgcctgctacgtgattagcgggagcagcgcggacctgtccctcgagaaggccgccgaagtgagctgggaggaggaggccgagcactcaggggccagtcacaacatcttcgtcgaggtgcaggatgacggcaccatgaaaattaaggacgaagagcgcgacgacaccctgaccatcttgctcaaggcgacactgctggctgtgtcgggggtttatcctctgagcattcccgccacgctgttcgtgtggtacttctggcagaagaagaaacagcggtccggcgtgctgtgggacacccccagcccgcctgaagtcgaaagagccgccctggatgacggcatctaccggattatgcagcgcgggttactcggccggtcccaggtgggggttggtgtcttccaggagaacgtgttccacaccatgtggcacgtgacgcgtggggccgttctgatgtaccagggcaagcggctcgagcccagctgggcctccgtcaagaaggacctaatcagctacggcgggggctggcgcctgcaggggtcctggaataccggcgaagaggtgcaagtcatagccgttgagcccgggaagaaccccaagaatgtgcagaccgcccccggcaccttcaagacgcccgaaggtgaggtcggcgccatcgccctcgacttcaagccgggcaccagcggctctcccatcgtgaaccgagagggtaaaatcgtgggcctgtacgggaatggtgttgtgaccacctcggggacctacgtgtctgctattgcacagaccaaggcctcccaggagggcccgcttcccgagatcgaggacgaagtttttcgcaagcggaatctcaccatcatggacctgcaccccggcagcgggaagacacgtcggtacctgccggcaatcgtgagagaggccatcaaaaggaagctccgcacgctcatcctggcgcccacccgcgtagtcgcatccgagatggctgaggcgctgaagggcatgcctattcggtaccagaccacggccgtcaagagtgagcacacgggaaaggagatcgtggacctgatgtgccacgccaccttcacaatgcgcctgctatcccccgtccgggttccaaactacaatatgattatcatggacgaggcccacttcaccgacccctcctccatcgcagcgagaggctacattagcacgcgggtggggatgggcgaggccgccgccatttttatgacggccacgcctcccggttccgtcgaggcttttccgcaaagcaacgccgtgatccaagacgaggagcgagacatccccgagcggtcgtggaactccggctacgagtggatcaccgacttccccggcaagacggtctggtttgtcccctccatcaagagtgggaacgatatcgctaattgcctccgtaagaacggtaagcgggtcatccagctatccaggaagaccttcgacaccgagtaccaaaagaccaagaacaacgactgggactacgtggtcacgacagacatcagcgagatgggggccaactttcgggcggaccgcgttatagacccgagacgctgcctcaagcccgtcatcctcaaggacggacccgagcgggtcatcctggccgggcccatgccggtaaccgtcgcctccgccgctcagcgccgcggccgcattggccggaaccacaacaaagagggggaccagtacatctatatgggccagcccctcaacaatgacgaggaccacgcacactggaccgaggccaagatgctgctagataacatcaacacgccggagggcatcatccctgcccttttcgagcccgagcgtgagaagtctgcagccatcgacggcgagtaccgcctgcgcggggaggcgcggaagaccttcgtggagcttatgcggcgcggcgacctccctgtttggctgtcctataaggtcgccagcgaaggcttccagtatagcgacagacgctggtgcttcgacggggagcgcaacaatcaggtgctggaggaaaacatggacgtggagatttggaccaaggagggtgagcgcaagaaactccggccccggtggctggacgcacgcacttactccgaccccctcgccctacgcgagttcaaggaattcgccgctggtcggcgcagcgtgtccggcgacctgatcctggaaatcggtaagcttccgcaacacctgacgcaacgggcccagaacgcgttagacaacctcgttatgttacataatagcgagcagggcgggcgcgcctaccggcacgcgatggaggagctgccagacaccatcgagaccctcatgctgctggccctcatcgcagtgttgaccgggggggtcaccttgttctttctctccgggcgcggcctgggcaaaacgagcattgggctgctgtgcgtaatggcctccagcgtgctgctgtggatggcctctgtcgagccacactggattgcggccagcatcattctcgagttcttcctgatggtattgctcatcccagaaccggaccgccaacgcacgccccaggacaaccagcttgcctacgtggttatcggcctactcttcatcatcctaaccgtggccgccaacgagatggggctgctcgagacgacgaagaaggacttaggtatcgggcacgtagcggttgagaaccaccatcacgcgaccatgctggatgtggacctccaccccgcctccgcctggaccctgtacgcggtcgcgaccacgatcatcacccccatgatgcgccacaccattgagaacacgacggctaatatctccctgaccgccatcgcaaaccaagccgcgatcctgatggggttggacaaaggctggccgatctcgaaaatggacattggggtccccttgctcgctttaggctgctatagccaagtgaaccccttgaccctcaccgccgccgtgctgatgctggtcgctcattatgctatcatcgggccggggctccaggccaaagccacgagagaagcgcagaagcgcactgcggccgggataatgaaaaatccaaccgtggacggcattgtggccatcgatttagaccccgttgtgtacgacgcgaagttcgagaagcagctgggccagatcatgctgctgatcctatgcacctcccaaatcctcttaatgcggacgacttgggccctgtgcgagtctatcacgctagctacggggcccctcacgacactctgggagggctcccccgggaagttctggaacaccaccatcgccgtgagcatggccaatatcttccgcggttcgtacctcgccggcgcagggctggcgttctcactaatgaagtccctcggcggtggtcggcgcgggacgggcgcccaaggcgagaccctaggagagaagtggaagcgccagttgaaccagctctccaagagcgagtttaacatctataagcgctccggcatcatggaggtcgatcggagcgaagccaaggaggggctgaagcgcggcgagaccacccgacacgctgtgtcccgcggaactgcaaagctgcggtggttcgttgagcgcaacctggtcaagccggagggtaaggtaatagacctcggctgcgggcggggtgggtggtcatactactgcgcaggactgaaaaaagtgaccgaggtcaaggggtacacaaaaggtggccccgggcacgaggagcccatcccgatggccacatacggctggaacctggtgaagctccattccgggaaggacgtgttcttcacgccgcccgaaaagtgcgacaccctgctgtgcgacatcggcgagagctcccccaacccaacaatcgaggaggggcggaccctccgggtcttaaagatggtggagccttggctccgcggcaatcagttttgcataaagattctcaatccctacatgcccagcgtggtagagacactcgagcagatgcagcggaagcacggcgggatgctcgtgcgtaatccactctcgcggaacagcacccacgagatgtactgggtgtcctgcggcaccgggaacattgtcagcgccgtgaatatgacctcccggatgctgcttaaccgcttcaccatggcccaccggaagcccacgtacgagcgcgacgtggacctcggcgccggcacccggcacgtggctgtggagcccgaagtggccaacctggatatcatcggtcaacgtatcgagaacatcaagcacgagcataagagcacctggcactacgacgaagacaacccctacaagacatgggcttaccatggctcctacgaggtcaaaccatccgggagtgcgagctccatggtcaacggcgtcgtgaagctgcttacgaaaccctgggatgtgattcccatggtcacgcagatcgcgatgaccgataccacgcccttcgggcagcaacgggtgttcaaggagaaggttgacacccgcacccccaaagccaagcggggaaccgcccagataatggaagtcacggcccgctggctgtgggggtttttgtcccggaacaagaagccccgcatatgcacccgggaggaatttactcgcaaagtgcggagcaacgcggcgatcggggctgtgttcgtcgacgagaaccagtggaactccgccaaggaggccgtagaagacgagcgcttctgggacctcgtgcagaaggagcgggagctgcacaagcagggaaagtgcgcgacttgtgtctacaacatgatggggaagcgcgaaaaaaagctgggcgaattcggaaaagccaagggcagccgagccatctggtacatgtggctaggcgcccggttcctggagttcgaggccctggggttcatgaacgaggatcactggttctcacgggagaacagcttgtccggcgtcgaaggagaagggctgcacaagctggggtacatcttacgcgatattagtaagatacccggtggcaacatgtacgcggacgacacggcagggtgggacacccggatcaccgaagacgatctccagaacgaggcgaagatcactgacatcatggagcctgaacatgccctgcttgcaacatccattttcaaactgacctaccagaataaggtggtccgcgtacagaggcccgcgaaaaacggcaccgtgatggacgtcattagccggcgagaccagcggggttctggccaggttggaacgtacgggctgaatacgttcaccaacatggaggcccagttgatccgccaaatggaaagcgagggaatatttctgccttcagagctggagacccccaacctcgcagagcgcgtgctggattggctggaaaagtacggggtcgagcgcctcaaacggatggccatcagcggagacgactgcgtggtgaagcctatcgatgatcgattcgccaccgcgttgactgcattaaacgacatggggaaggtcaggaaagacatcccgcagtgggagccctccaaaggttggaatgattggcagcaggtaccgttctgtagccaccacttccatcagctcatcatgaaagatggccgcgagatcgtcgtcccgtgccggaatcaggacgaactggtggggcgcgcccgggtgtcccagggggctgggtggagcctgagagagaccgcgtgtctcggcaagagctacgcgcagatgtggcagctgatgtacttccatcggagagacctgcggctcgccgccaacgcgatctgctccgcggtcccggtggattgggtgcccaccagccgcaccacgtggtccattcatgctcaccaccagtggatgactaccgaggacatgctcagcgtgtggaatagagtgtggatcgaggaaaatccctggatggaggataaaactcacgtgtccagctggggggacgtcccgtacctgggaaagcgcgaggaccagtggtgcggctccctcatcggcctaacggccagagccacgtgggccagcaacattcaggtggccatcaatcaggtacggcggctgatcggcaacgagaactacctcgactacatgacctccatgaagcggtttaagaacgaaggggaccccgagggcgcactgtggtga

SEQ ID NO: 24368 - RNA, 9879 nt, synthetic construct
  misc_feature 1..9879: note = derived and/or modified CDS sequence (opt11) from DENV-1__FJ898397__SS-prME
  source 1..9879: mol_type = other RNA
agcgtgacgatgctgctcatgctcatgcccaccgccctggccttccacctcaccatccggggcggggagccccatatgattgtgagcaagcaggagcggggcaagagcctgctattcaaaacctctgccggggtgaatatgtgcaccctcatcgccatggaccttggggagttctgcgaagatactatgacctacaagtgcccccgcatcaccgaggccgagcccgacgacgtggactgctggtgcaacgccaccgatacatgggtaacctacggaacctgcagccagaccggcgagcaccggagggataagcggagtgtggctctggctcctcacgtgggccttgggctggagacaaggacggagacctggatgagctcggagggcgcctggaagcaaatccagagagtggagacctgggccctgaggcacccggggttcaccgtgatcgccctcttcctggcgcacgccatcggaactagcatcacccagaaggggatcatctttatcctgcttatgctggtgactccctccatggccatgcgctgcgtcggcatcggcagccgcgacttcgtggagggactgagtggcgccacgtgggtagacgtcgtgctcgagcacgggagttgcgtgacgaccatggctaaagacaagcccaccctggacattgaactgctcaaaaccgaggtcacgaatcccgcggtgctgcggaaactttgcatcgaggcaaagatctccaacaccaccactgacagccgctgccccacgcagggggaggccacactcgtcgaggagcaggacgccaatttcgtctgccggcgcacgttcgtggatcggggctgggggaacggctgtgggttatttggcaaggggtcccttattacgtgcgccaagttcaagtgcgtgacgaagctcgagggcaagatcgtccagtatgagaacctgaagtatagcgtgatcgtgaccgtccacaccggcgatcagcaccaggtgggtaatgaaagcactgagcacgggacgaccgcgaccatcactccccaggccccctcgaccgaaatccagctgacggactacggggccctcaccctggattgcagcccgcggacaggcttagacttcaacgagatggtcctcctgactatgaaagagaagtcctggctggtgcacaagcagtggttcctcgacctgcctctgccctggacgtccggtgcctccacaagccaagagacttggaatcggaaggacctcttggtgaccttcaagacggcccatgcgaaaaagcaggaggtcgtcgtgctgggttcccaggagggcgccatgcatacagcccttacaggggccaccgaaatccagacgagcggcaccacgaccatcttcgccgggcaccttaagtgccgcctaaagatggacaagctcacgctcaagggcatgtcctatgtcatgtgcaccggcagcttcaaattagagaaggaagtggcggagacccagcatggcacagttcttgttcagatcaagtacgaaggtacggacgccccctgcaagatcccgttctccactcaggacgagaaaggagtgacacagaatggtcgtctcatcaccgcgaaccctatcgtgacggacaaagagaagcccgtgaacatcgaggccgagccgccgttcggagagagctacatcgtgattggcgcgggcgagaaagcactgaaactatcctggttcaagaagggcagctcgataggtaagatgttcgaggccactgcccgcggggcccggcgcatggctatactcggcgacaccgcgtgggacttcgggagcattggcggcgtgttcacctccgtcggaaagctggtgcaccagatctttggcacagcctacggggtactgttctctggcgtctcttggacgatgaaaatagggatcggggtgctcctgacatggctgggcttaaactcgcgctctactagcctgtccatgacgtgtattgctgtagggctagtaacattatatctgggcgtgatggttcaggccgatagcggttgcgtcatcaattggaagggccgggagctgaagtgcggatcaggcatcttcgtgaccaatgaggtgcacacttggacggagcagtataagtttcaggccgactccccgaaacgcctctctgccgccatcgggaaggcctgggaggagggggtctgcggtatccggtccgcgaccagactggagaatatcatgtggaaacagatcagcaacgagctaaaccacatcctcttagaaaatgacatgaagttcaccgtggtggtcggggacgtggccggcatcttggcccaggggaagaagatgatccggccccaacccatggagtacaagtattcctggaaatcgtggggcaaagccaagatcattggtgccgacgtgcagaacaccaccttcatcatcgacgggcccaatacgccggagtgccccgacgaccaacgtgcgtggaacatctgggaggtagaagactatgggttcgggatcttcactaccaacatatggctcaaactgcgggattcatacacccaggtttgcgatcaccgcctgatgagcgcagccattaaagactcaaaagccgttcacgcggacatgggctactggatagagagcgagaagaacgaaacgtggaagctcgcgcgggcgtctttcatcgaggtcaagacctgcatatggcccaagagccataccctatggtccaacggagtgctggaatctgagatgattatccccaaaatctacggtgggccgatctcccagcacaactaccgtcccgggtacttcacccagacggccggtccctggcacctcggaaaactagagctagacttcgacctctgtgagggcacgaccgtggtagtggacgagcactgtggcaaccgggggccgtctctgcgtaccacaaccgttaccggcaaaataatccatgagtggtgctgtcggtcctgcactctgccgcccctgcgcttcaagggggaggacggctgctggtacggcatggagatccggcccgtaaaggaaaaggaggaaaaccttgtcaagagcatggtgagcgctggctccggtgaggtagactccttctccctggggcttctgtgcatcagcataatgattgaggaagttatgcgatcccggtggagccgcaagatgctgatgacgggcaccctcgcggtgttcttcctactgataatgggtcagctcacctggaacgatctgatacggctgtgcataatggtcggcgcgaacgcctccgaccgcatgggtatgggtaccacgtatcttgcactgatggccactttcaagatgcgcccgatgttcgccgtggggctcctgttccggcgcctgacgagcagggaggtactgctactaaccatcgggctgtcgctcgtcgcgagcgtggagctgccgaactcactggaggaactcggcgatggtctggccatgggaataatgattctgaagctactgacggatttccagtcacaccagttgtgggccaccctcctgtccctcaccttcatcaagactacgttcagtctacactacgcctggaagaccatggcgatggtcctgtccatcgtaagcctctttcccctctgcctgtccactacttcgcagaaaacgacctggctgcccgtgctcctgggctccctggggtgtaagccgctcaccatgttcctgattgccgagaacaagatctggggccggaaatcgtggccccttaatgagggaatcatggccgtcggcatcgtgtcgatcctcctgagttcattactcaagaacgacgtgccattagccgggcccctgatcgctggcggcatgctcatcgcgtgctacgttatctccgggagttccgccgaccttagcctggagaaggctgcagaggtttcctgggaggaggaagccgagcactcgggcgcctcccacaacatcttagtcgaggtccaagatgacggtaccatgaagatcaaggacgaggagcgcgacgacactctgaccatcttgctcaaggccaccttactggccgttagcggcgtgtacccattgtccatccccgccactctgtttgtctggtacttctggcagaagaaaaagcagcgaagcggggtgctgtgggacacgcccagcccgcccgaggtggagcgggcagtcctcgacgatgggatctaccgaatcatgcaacggggcctgctggggcgcagccaggtgggcgtgggagtcttccaggagaacgtgttccacaccatgtggcacgtgacacggggcgcggtcctgatgtaccaggggaagcgcctagagccatcctgggccagcgtgaagaaagacctgatctcctatggcggtgggtggcggctgcagggtagctggaacaccggcgaggaagtgcaagtaatagccgtcgaacccggcaagaaccccaaaaacgtgcagaccgccccggggaccttcaagacttccgagggagaggtcggggccatcgcgctcgatttcaagcccggcaccagcggcagccccatcgttaaccgcgaaggaaagatcgtgggcctgtacggaaacggggtcgtgaccacgtccggcacttacgtgtctgccatcgcccaggccaaggcgtcccaggaaggacccctaccggagatagaggacgaggtctttcggaagcgcaatctcaccattatggacctgcatcccggctctgggaagactcggcgctacctccccgccatagtgcgggaagctatcaagcgcaagctacggacgctgatcttggctccgaccagggtagtcgcatcggagatggctgaggccctcaagggtatgcccatccgctaccaaactactgccgtcaagagcgagcacacgggcaaggagatcgtagacctgatgtgtcacgccaccttcaccatgcggctgctctcccccgtccgtgtgcccaattataacatgatcattatggacgaagcccacttcaccgaccctagctccatcgcagcaagggggtacatcagcacccgcgtgggcatgggggaggccgccgccatcttcatgaccgcgacgccacccggttccgtcgaggcgttcccccaaagcaacgccgtgatccaggacgaggagcgggacatcccggaaagatcctggaacagcggttacgagtggatcaccgacttccccggcaaaacggtgtggttcgtcccgtccattaagtccggcaacgatatagccaactgcttaaggaagaacgggaagagagtgattcaactgtcacggaagacctttgacaccgagtaccagaagaccaagaataatgactgggattacgtcgtcacgaccgacatcagcgagatgggggcgaactttcgcgcagaccgcgtcatcgatccccgccggtgcttgaagccagtgatcctgaaagacggaccagagagggtcatcctggcgggccccatgcccgtgaccgtcgcgtccgccgcccaacggcgcggtcgcatcggaagaaaccataacaaggaaggcgaccaatacatctacatggggcagcctctcaacaatgacgaggaccacgcccactggaccgaagccaagatgctgctggacaacatcaacacgcccgagggcatcattcccgccctgttcgagccagagagagagaagtccgctgcgattgacggggagtatcgactgcgcggagaggcgcgaaagaccttcgtggagctgatgcgccggggcgatctaccggtgtggttaagctacaaggtcgccagtgaaggcttccagtacagcgaccgccggtggtgcttcgacggcgaacgcaacaatcaggtgctcgaagagaacatggacgtggagatctggacaaaggagggtgagcggaagaagctccgcccccggtggctggacgcgcgcacctactccgacccgcttgcactccgggagttcaaagagttcgcggccggccgcaggagcgtctccggtgacctgatcctcgagatcggtaagctcccccaacacctgacccagcgcgcccaaaacgcattagacaacctcgtaatgctgcacaacagcgagcagggcggccgggcgtaccgccacgccatggaggagctgcctgacaccattgagaccctcatgttactggccctcatcgccgtgctgaccggtggggtcaccctgttcttcctttctggcaggggcctcggcaagaccagcatcggcctgttgtgcgtaatggcctccagcgtcctgctatggatggcgtccgtcgagccccactggatcgctgccagcatcatcctcgagttcttcctgatggtgctccttataccagaaccggaccgccaacgaacgccgcaggacaaccagctggcctacgtggtcatcgggctcttgttcatgatcctgaccgtggccgcgaacgagatgggcctgctcgagaccacaaagaaggacctggggatcggccacgtggcagtcgagaaccaccaccacgccgctatgctggacgtggacctacaccccgcatccgcttggaccttatacgccgtggccactaccattatcactccaatgatgcgccacaccatcgaaaacaccaccgccaacatcagcctcacggccatcgccaaccaggcggccatactcatggggctagacaaaggttggccaatctccaaaatggacatcggcgtccccctgctagccctcgggtgctacagtcaagtgaaccccttaaccctcaccgccgctgttttaatgctggtcgcccactacgccatcatcggccccggactccaggccaaggccacgcgggaggcccagaagaggacggccgccggaatcatgaagaaccccaccgtggacgggattgtggccattgatctagatcccgtcgtgtacgacgcaaagtttgagaagcaactgggtcagatcatgctcctgatcctgtgcaccagccagatcctcttgatgcgtaccacatgggccctgtgcgaatcaatcaccctcgccaccggccccctgaccacgctgtgggaggggtcccccgggaagttctggaacacaaccatcgccgtaagcatggccaacatctttcgagggtcatacctagcaggcgccggccttgcgttctcgctgatgaaatccctcgggggcgggcgtcggggcaccggggctcaaggcgaaacgctgggcgagaagtggaagcgacaactgaaccagctctcaaagagcgagttcaacacttacaagcggtccggtatcatggaagtcgaccgcagcgaggcaaaggagggcctgaagcgaggggaaaccactaagcacgcggtaagcaggggcacggcaaagctccggtggttcgtcgagcgtaatttagtgaagccggaagggaaggtgatagacctgggctgcggccgcggcgggtggagctactactgtgccggtctcaagaaagtgacagaggtcaaagggtacaccaagggcgggcccggccacgaggagccaatccctatggccacgtacgggtggaacctggtgaagttgcactccggcaaggatgtgttcttcataccacccgagaagtgcgacacgctgctgtgcgacatcggggaaagcagccctaaccccaccatcgaggagggccgaaccctccgggttctgaagatggtggagccatggctgcgagggaaccagttttgcatcaagatcctcaacccgtatatgccctcggtagtcgagacgctcgagcagatgcaacgaaagcacggcggcatgctggtccgcaaccccctctcccggaactctacgcacgagatgtactgggtgagttgcgggaccggtaacatcgtctcagccgtaaacatgacctcccgcatgctgctcaaccggtttaccatggcacaccgaaagcccacctacgaacgcgacgtggatttgggcgccggcacgcgccacgtcgccgtagagcccgaggttgccaacttggacattatcggccagcgcatcgagaatatcaagcacgagcacaagagcacctggcactacgacgaggataacccatataaaacttgggcgtaccacgggagctacgaggtcaaacccagcggcagcgcttccagtatggtgaacggggtcgtgaagctcttgaccaagccgtgggatgttatccccatggtcacacagatcgccatgaccgacaccaccccattcggccaacagcgcgtattcaaggagaaggtagatacgagaacgcccaaggcgaagcgggggacagctcagataatggaagtgaccgcgaaatggctatggggtttcctgagtcgcaacaagaagccaagaatctgcacgcgcgaggagttcactaggaaggtccgcagcaacgccgccatcggcgccgtgttcgtcgacgagaaccagtggaactctgctaaagaggccgtagaggacgagcggttctgggacctagtgcatcgcgagcgggagctgcacaagcaggggaaatgcgcgacctgcgtctataacatgatgggcaagcgcgagaagaagctgggtgagttcgggaaagccaagggtagccgggccatctggtacatgtggctaggcgcgcgcttcctcgagttcgaggccctgggcttcatgaacgaggatcattggttctcccgggaaaacagcctctctggggtggagggtgagggactgcacaagctggggtacatccttcgagacatctcaaagatccccggcggcaatatgtacgcggacgacaccgccggctgggacactagaatcaccgaggacgacctacagaatgaggccaaaatcaccgacatcatggagcccgagcatgccctgctggccacctccatcttcaagctgacttaccagaataaggtggtcagagtgcagcggccggccaagaacgggaccgtaatggacgtgatcagccgccgcgaccaaaggggttctggccaagtgggcacatacggccttaatacattcacgaacatggaagcccaactcattagacagatggagagcgaggggatcttctcccccagtgagctggagacccccaacctggccggcagagtcctcgattggctggaaaaacatggggtcgaacgcttgaaacggatggccatcagtggcgacgactgcgtggtcaaacccatagacgaccgcttcgccaccgcccttactgccttgaatgacatggggaaagtacggaaggacattccccagtgggaacccagcaagggctggaacgactggcagcaggtcccgttttgctcccaccacttccaccaacttatcatgaaggacggccgcgagatagtggtcccttgccgtaaccaggacgaactcgtcgggcgcgcccgggtgtcccagggcgcggggtggagtctacgcgagactgcttgcttaggcaagtcctacgcccaaatgtggcaattaatgtacttccaccgacgggatctgcgcctggccgctaacgctatctgtagcgccgtgccggtagactgggtgcccacctcccgcaccacatggagcatccacgcccaccaccagtggatgacgaccgaagacatgctcagcgtctggaaccgggtgtggattgaggagaacccctggatggaggacaagacccacatttcctcctggggcgatgtaccctaccttggaaaacgcgaggaccagtggtgcggcagcttgatcgggctcacggcccgggcgacgtgggccaccaacatacaggtagctattaatcaggtacgccgcctgatcggaaacgagaactacttagactatatgacctcgatgaagcggttcaagaacgagagcgatcccgagggggcactctggtga

SEQ ID NO: 24369 - RNA, 9879 nt, synthetic construct
  misc_feature 1..9879: note = derived and/or modified CDS sequence (opt11) from DENV-1__FJ898398__SS-prME
  source 1..9879: mol_type = other RNA
agcgtcaccatgctgctgatgctgatgcccaccgctctggcattccacctcacgacgcggggcggggaaccccatatgatcgtgtctaagcaggaacgagggaagtcactgctgttcaagacctccgccggcgtgaacatgtgcacgctcatcgctatggacctgggcgagttctgtgaagacacgatgacctacaagtgccccaggatcaccgaagccgagcccgatgacgtggactgctggtgcaatgcaacggatacctgggtcacgtacggaacctgcagccagaccggcgagcacaggcgggacaagcggagcgtggccctggcgccccacgtcggcctcgggctggagacgcgcaccgagacctggatgagttcggagggcgcatggaagcagatccaacgggtggaaacatgggccctgcgccaccccggattcacggtgatcgctctcttcctggctcacgcaatcggcacctctatcactcagaaggggatcatcttcatcctgctcatgctggtgaccccctccatggccatgcggtgtgtcggaataggctcacgcgacttcgtggagggactttcgggagccacgtgggtggatgtcgtgcttgagcacgggagctgcgtgaccaccatggctaaggacaagccaaccctggacattgagctgctcaagacggaggtaactaatcccgcggtcctacggaagctgtgcatcgaggccaagatctcgaacaccaccacggacagccgctgccctacccagggtgaagcgacactcgtggaggaacaggacgccaacttcgtgtgccggcgaaccttcgtcgaccggggctgggggaacggctgtggactgttcggcaaggggtcgctgatcacgtgcgccaagttcaagtgcgtgaccaagctcgagggcaaaatcgtgcagtacgagaacctgaaatacagcgtgatagtcaccgtccataccggcgatcagcaccaggtggggaacgagagcacggagcacggcaccaccgcgaccatcacgccccaagcccccagcacggagattcaactgaccgactacggtgcccttaccctggactgtagcccgcggaccggcctggacttcaacgagatggtcctcctgacgatgaaagagaagtcctggttggtgcacaagcagtggttcctagacctccccctgccatggaccagcggggcgagcaccagccaggagacctggaaccggcaggacctccttgttacgttcaaaaccgcccatgcgaagaagcaggaggtcgtggtgcttggctcccaggagggcgccatgcataccgctctcaccggggcaactgagatccagaccagcgggacaaccacgatcttcgccgggcatctgaagtgcaggctgaagatggacaagttaaccctcaaagggatgtcctacgtcatgtgcaccggttccttcaagctggagaaagaggtggcggaaacccagcacggcacggtgctcgtacagatcaagtacgagggcaccgacgccccctgcaagatccccttctccacccaggacgagaaaggcgtgacccagaacggccggctgatcacggccaacccaatcgtcacagacaaagagaagccggttaacatcgaggctgagccgccattcggagagagctacatcgtgatcggagcgggcgagaaggccctgaaactttcctggttcaagaaagggagctccatcggcaagatgttcgaggccaccgcccgcggagcccgtcgcatggcgatactcggcgacaccgcctgggacttcgggagcatcggaggcgtgttcacatcggtcgggaaacttgtgcaccagatcttcggcactgcctacggggtgctctttagcggcgtctcctggaccatgaagatagggattggcgtgctcttgacctggctgggcctgaacagccgctcaactagcctgagtatgacgtgcatcgccgtggggctggtcaccctctacctgggcgtcatggtgcaggccgatagcggatgcgtcatcaactggaagggccgggagctgaaatgcggcagcggtatattcgtgacgaatgaggtgcacacgtggaccgagcagtacaaattccaagcggactctccgaagcgcctcagcgccgcaatcggcaaggcctgggaggaaggggtctgtggcattcggtctgccacacgcctggagaacataatgtggaagcagatttcgaacgagctgaaccacatcttgctggagaacgacatgaagctgaccgtggtggtcggagacgtggcgggcatcctcgcccaagggaagaagatgatacggccccaacccatggagtacaagtactcctggaagatctggggcaaggccaagatcataggagccgacgtgcagaacaccacgttcatcatcgacggacccaacaccccggagtgtcccgacgaccagcgcgcgtggaatatctgggaggtcgaggactacggatttgggatcttcaccactaacatctggctaaagttacgtgactcttatactcaggtgtgcgatcaccgcctcatgtccgcggcaatcaaggacagcaaggccgtgcacgccgacatgggctactggatcgaatccgaaaagaatgagacttggaaactggcgcgggccagcttcatcgaggtcaagacctgcatctggcctaagtcccacaccctctggagcaacggcgtgctcgagtccgagatgataattcccaagatctatggagggccgatcagccagcacaactaccgcccaggatacttcacgcagaccgccggcccctggcacctggggaagctggagctcgacttcgacctgtgcgaaggcaccaccgtggtcgtggatgaacactgcggcaaccgggggccgtccctgcgcacaactaccgtgacgggcaagatcatccatgagtggtgctgtcggagctgcacgctgccgcccctccgcttcaagggggaggacggctgttggtacggcatggagattcggccggtcaaggaaaaggaggagaacctggtgaagtccatggtgagcgccggcagcggcgaagtcgactcgtttagcctcgggctactgtgcatctccatcatgatcgaggaggtgatgcgcagccgctggtcccgcaagatgttgatgactggcaccctggctgtgtttttcctgctcatcatggggcaactcacctggaatgatctgatccgcctctgtatcatggtcggcgcgaacgccagcgaccgtatgggcatgggcaccacctacctggccctgatggccacctttaagatgcgcccgatgttcgccgtcggcctcctgttccggcgcctgacctcccgggaggttctcctgctgacgatcgggctctcactcgttgcgtctgttgaactgccgaacagcctcgaggagctgggggacggtctggctatgggcataatgattctcaaactgctgactgacttccagtcccaccagctctgggctaccctgctgagcctaaccttcatccgcacgaccttctccctgcactacgcatggaaaactatggcgatggtcctgagcatcgtatccctattccccctatgcctgagcaccacgtcccagaagaccacctggctcccggtcctgctgggaagcctcgggtgcaagcctctgaccatgtttctaatcgccgagaacaagatttggggtcggaagtcctggcccttgaacgaggggatcatggccgtcggcatagttagcatccttctgagttccttactgaagaacgatgtgcccctggccggccctttaatcgccggcggaatgcttatcgcgtgctacgtcatcagcgggtccagcgccgacctgtccttagagaaggccgccgaagtctcctgggaggaggaggctgagcactccggggcgtcccacaacatcctggtggaggtccaggacgatgggacgatgaagatcaaagacgaggagcgcgacgacaccctgaccatcttgctgaaggccaccctgctcgctgtgtccggcgtgtaccccctgagcatccccgctaccctgttcgtgtggtacttctggcaaaagaagaagcagcggtccggggtgctttgggacacccccagtccgcccgaagtggagcgcgccgtcctggatgacggaatctaccgtattatgcagcgcggcctgctggggagaagtcaggtgggtgttggggtcttccaggagaacgtgttccacactatgtggcacgtgacccgcggcgcggttctcatgtaccaggggaaacggctggaacccagctgggcttcggtgaagaaggacctgatctcgtacggcggcgggtggagactccagggctcctggaacaccggggaggaagtccaggtcatcgccgtggagcccggcaagaatcccaagaacgtacagacggcgcccgggacctttaagacctctgagggcgaggtcggcgccatcgccctggattttaagcccgggaccagcggaagccccatcgtgaaccgggaggggaagatcgtcggtctgtacggcaacggggtggtgacgaccagcggcacatacgtgtccgccatcgcccaggccaaggcaagccaggaggggcccctcccggagatcgaggacgaggtcttccgtaaacggaacctaaccatcatggacctgcatcccggctccgggaaaacgcgccggtacttacccgccatcgtgcgagaggccatcaagcggcgcctgcgcaccctgatactcgctccgacccgggtggtcgcgagcgagatggcggaggccctgaagggcatgccaatccgctaccagacaacggccgtgaagtccgagcacaccggcaaagagatcgtggacttgatgtgccacgccaccttcaccatgcggctcttaagccccgtccgcgtgcccaactacaacatgatcatcatggacgaggcccacttcacagacccgtccagcatagcggccagggggtacatctctacccgcgtcggcatgggggaggccgccgccatattcatgaccgcgacgccgcccggaagcgtcgaggccttcccccaatccaatgccgtgatccaggatgaggagcgggacatcccggagcgcagctggaactccgggtacgagtggataacggacttccccggtaagaccgtgtggttcgtccccagcatcaagtcaggcaacgacatagccaactgcttgcggaagaacgggaagcgcgtgatccagctcagccgcaagaccttcgacacggagtaccagaagacgaagaataacgactgggactacgtggtgaccaccgacatctccgagatgggcgcgaatttccgcgcggaccgggtgatcgaccccagaaggtgcctgaaaccggtcatacttaaagacgggcccgagcgcgtcatcctcgccggccccatgcccgtgactgtcgcctccgccgcgcaaaggcgcgggcgcatcggtcgcaaccacaacaaagagggcgaccaatacatctacatggggcagcctctgaacaatgacgaggaccatgctcactggacggaagccaagatgctactcgacaacatcaacacccccgagggcatcatcccggccctgttcgagcccgaacgcgagaagtctgccgcgatcgatggagagtaccgcctgcgcggcgaggcccgcaagaccttcgtcgagctcatgcgtcgcggggacctgccggtgtggctgagctataaggtcgccagcgagggattccagtattccgaccgccggtggtgctttgacggcgagcgcaacaaccaggtgcttgaggagtctatggacgtggagatctggaccaaggagggggagcggaagaagctcaggccccggtggctagacgcccgcacctactccgatcccctcgccctgcgggagttcaaggagttcgcggccggccgccggtcagtcagcggggacctgatcctagaaatcggcaagctgccacaacacctgacccagcgcgcccagaacgccctcgacaatttggttatgctgcacaactcagagcagggcggaagggcgtaccgccatgctatggaggagcttccggacaccatcgagaccctgatgctgctcgccctcatcgccgtgctgacgggaggggtcacattgtttttcctgtccggccgggggctcggcaagaccagtatcggccttctgtgtgtgatggccagtagcgtgctgctctggatggcgtccgtcgagccccactggatagccgcctcgatcattctggagttctttctgatggtgctccttatccccgagcctgaccgccagcggaccccgcaggacaaccagctggcctatgtggtaatcgggctcctcttcatgatcctgaccgtggccgcgaatgagatgggtttgttggagacgaccaagaaggacctcggtatcggccacgtggccgtcgagaaccatcaccacgccgccatgctcgacgtagacttacaccccgcctccgcatggacgctgtatgccgtggccacaacgatcataacacccatgatgagacacaccatcgagaataccactgcgaacatcagcctcaccgccatcgcaaaccaagccgccatcctgatggggctggacaaaggctggcctatctccaagatggacatcggcgtgccccttcttgccctggggtgctactctcaggtgaatcctctaaccctgactgcggctgtgctgatgctggtggcccactacgccatcatcggccccgggctccaagccaaggcgacgcgcgaggcccagaagcggaccgccgccggaatcatgaagaacccgaccgtggacggaattgtcgccatcgatttagaccccgtcgtctacgatgcaaagttcgagaaacagctcggccagataatgctgctaatcctctgcacatcccagatcctgctgatgcgaacgacctgggccctctgcgagtcaattaccctggcaacaggccccctgaccacattatgggagggttcccccggcaagttctggaataccaccatcgccgtgagcatggccaacatcttccgcgggagctatctggcgggggccgggctggccttctccctcatgaagtccctcgggggcggacgccgagggacgggggcccagggcgagaccctgggagagaagtggaagaggcagctcaaccagctatccaagtctgagttcaatacctacaagcggtccgggatcatggaggttgaccgtagcgaggccaaggagggcctgaagcgaggggagacgacaaagcacgccgtgtccaggggcaccgccaagctacggtggttcgtggaacgcaaccttgtcaagccggagggtaaggtgatcgacctgggctgcggccgcggcgggtggagctactactgcgccgggctgaagaaggtgacggaagtcaaagggtacaccaagggcgggcccggtcatgaggagcccatacccatggccacgtacgggtggaacctcgtgaagctgcactccggcaaggacgtgttcttcatcccgcctgagaagtgcgataccctgctatgcgacataggggagagctcgcccaaccccaccatcgaggagggccgcaccctgcgcgttctgaagatggtggagccgtggctacgcgggaatcagttttgcatcaagatcctgaacccctatatgcctagcgtagtagagactttagagcaaatgcagagaaaacacggcggcatgctcgtgcgcaacccactgtcccggaacagcacccatgagatgtattgggtttcctgcgggactggcaacatcgtctcggcggtgaacatgacctcccgcatgcttctaaaccgcttcaccatggcccaccggaagcccacttacgagagagacgtggatctgggagccggcactcggcacgtcgccgtcgaacccgaggtggccaatctggatatcatcggccagcgaatcgagaatatcaagcacgagcacaaaagcacctggcattacgacgaggacaacccctataagacctgggcgtaccacgggtcgtacgaggtcaagcccagcggcagtgcctcctctatggtgaatggagtcgtaaaacttctgactaaaccttgggacgtgataccaatggttactcaaatcgccatgaccgacaccacacccttcgggcagcagcgggttttcaaggagaaggtggacacacgcacccccaaggcgaagcggggcaccgcccagatcatggaggtcacagctaagtggctttggggctttctgtcccgcaacaagaagccacggatctgcacccgcgaggagttcacccggaaggtgcgcagcaacgccgccatcggtgccgtgttcgtcgacgagaaccagtggaacagcgcgaaggaggcggtggaggacgagcggttttgggatctggtgcaccgcgagcgggagctgcataagcaggggaagtgcgcgacctgcgtctataacatgatggggaagcgcgagaagaagctgggggagttcggcaaggccaagggaagccgcgccatctggtacatgtggctcggagctcgcttcctggagttcgaggccctcggattcatgaatgaggaccactggttctccagagagaactcactgtctggggtggagggcgaggggttacacaagctcggctatatcctgcgcgacatctcgaaaatccccgggggtaacatgtacgccgacgacacggccggctgggatacccggataactgaggatgacctgcagaacgaggccaagatcaccgacataatggaacccgaacatgcgctcttggccaaatcgatcttcaagttgacgtaccagaacaaggtggtccgcgtgcagcgcccggccaagaacggcaccgtgatggacgtcatcagcagacgcgatcagcggggttccggccaggtgggcacctacggcctgaacaccttcacaaatatggaggcccagctgatcaggcagatggagagcgaggggatcttttcccccagcgagctggagacccccaacctggccggccgggtgctaaattggttggagaagcacggggtagagcgtctcaagcggatggcgatatccggcgatgactgcgtggtgaagcccattgacgaccgcttcgctaccgctctcacggccctgaacgacatggggaaggtccgaaaagacatcccgcagtgggagccatccaagggctggaacgactggcaacaggtgcccttctgcagccaccacttccatcagctcatcatgaaggacggccgcgaaattgtggtgccctgtcggaaccaggacgagctggtggggcgcgcgcgagtgtcccagggggcgggttggagcctgcgcgagacggcctgtctcggcaagtcctacgcccagatgtggcagttgatgtacttccaccggcgcgacttacgactggccgcgaacgccatctgctcggccgtcccggtggactgggtgcctaccagccgtaccacctggagtattcacgcccaccatcagtggatgactacagaggatatgctgtccgtatggaaccgggtgtggatcgaggaaaacccttggatggaggacaagactcacgtgagctcctggggcgacgtgccctacctgggcaagcgagaggaccagtggtgcggcagcctcattgggctgaccgcccgcgcgacctgggccacgaacatccaggtggctatcaaccaggtgcgacgcctactcggcaacgagaattatctggactacatgacctccatgaagcggttcaagaacgaaagcgacccggagggggctctgtggtga

SEQ ID NO: 24370 - RNA, 9879 nt, synthetic construct
  misc_feature 1..9879: note = derived and/or modified CDS sequence (opt11) from DENV-1__FJ898399__SS-prME
  source 1..9879: mol_type = other RNA
agcgtgaccatgctgctcatgctgatgcccaccgctctggccttccacctaaccacccgaggtggggaaccccacatgatcgtgagcaagcaggagcggggcaagagcctactgttcaagaccagcgcgggggtgaacatgtgcaccctgatcgctatggacctgggcgagttctgcgaggacaccatgacctataagtgcccccgcatcaccgaagccgaacccgacgacgtggattgctggtgtaacgccacagacacgtgggttacgtacggaacctgcagccagactggagagcatagacgggacaaacggtccgtggccctggccccgcatgttggcctcggccttgagacaaggactgagacctggatgagcagtgaaggggcctggaagcagatccaaagggtcgagacctgggcattgaggcaccccgggttcaccgtgatagccttgtttcttgcgcacgccattggaaccagcataacccagaaggggatcatctttattctgctcatgctggtgaccccctccatggccatgagatgcgtcggcatcggttctcgcgacttcgtagaggggctgtcaggcgctacttgggtggacgtcgttctcgagcacgggagctgcgtcaccaccatggcaaaggacaagcctaccctggacatcgagctactcaagacggaggtaaccaatcccgcggtgctgcggaagctgtgcatcgaggccaagatcagcaacaccacaacggacagcagatgtccgacacaaggcgaggcgactttagttgaggagcaggacgccaattttgtctgtcgtcgcaccttcgtagacagaggctggggcaacggctgcgggctgttcgggaaggggagcctgatcacgtgcgccaagttcaagtgcgtgaccaagctcgagggcaagatcgtccagtacgagaacctcaagtactctgtgattgtgaccgtccacacgggcgaccaacatcaagtggggaacgagtccacagaacacggcacgaccgccaccatcacgccccaagccccctcgacggagatacagctgaccgactacggggctcttaccctggactgtagcccccggaccgggctggacttcaacgaaatggtcctcttgactatgaaagaaaagtcctggctggtgcacaagcagtggttcctcgacctgcccttgccgtggaccagcggggcctccacaagtcaggagacgtggaaccggaaagacttactggtgacattcaagaccgcccacgcgaagaagcaggaggtcgtggttctaggctcccaagagggcgccatgcacaccgccctcacaggggccaccgagatccagaccagcggcaccaccacgatcttcgcagggcacctgaagtgccgcctgaagatggataagttaaccctaaagggtatgtcctacgttatgtgcaccggtagtttcaagctggagaaggaggtggcggagactcagcacggcacggtgctcgtccagattaagtatgagggcaccgacgccccatgtaagatcccgttttccacccaggacgagaagggggtcacccagaatggccggctgatcacggccaaccccatcgttacggacaaagagaagcccgtcaacatcgaagccgagccgcccttcggtgagagctacatcgtcattggcgcgggcgagaaggccctgaagctgtcctggttcaagaagggaagctccattggcaaaatgtttgaggcgactgctagaggagcccggcgcatggcgattctaggcgacaccgcctgggactttgggtccatcggcggcgtcttcacgtccgtcgggaagctggttcaccaaatattcggaaccgcatacggcgtgcttttctcgggcgtctcttggacgatgaagatcgggatcggtgtcctcctgacctggctgggcctaaatagccgctctacgtcgctgtcaatgacctgcatagccgttggactggttaccctctatctcggcgttatggtgcaggccgacagcggttgcgttatcaattggaagggcagggaactgaagtgcgggtccggcatcttcgtgacaaatgaagtgcacacgtggaccgagcagtacaaattccaggcagactccccgaagcggctctccgccgccatcggcaaagcctgggaggagggggtctgtggcatccgttccgctacacggctggagaacatcatgtggaagcaaatcagcaacgagctgaaccacatcttgctggagaacgacatgaaactgaccgttgtggttggggacgtagcggggatcctaggccagggcaagaagatgattcggccccagcctatggagtacaagtattcctggaagtcctggggaaaggccaagatcatcggagccgacgcacagaacaccaccttcatcatcgatggccccaataccccggagtgccccgatgaccaacgcgcgtggaacatctgggaggtggaggactacgggttcggcatcttcaccaccaacatctggttgaagcttcgggactcctacacgcaggtttgcgaccatcgcttaatgtcggccgccataaaggattccaaggccgtacacgccgacatgggctactggatcgagagcgagaagaatgagacctggaagctggcgcgcgcttccttcattgaggtgaagacctgcatctggcccaaaagccataccctgtggtcaaacggggtcctcgagagcgagatgatcatccccaagatctatggcggcccgatctcacaacataactaccgccccggctacttcacgcagacagctgggccctggcacctgggcaagctggagcttgatttcgacctgtgtgaaggcaccacggtggtggtcgacgaacactgcggtaatagaggcccaagcctccgcacgacgaccgtgacaggcaaaattattcatgagtggtgctgtaggtcatgcacgctgccgcccctccggttcaagggggaggacgggtgctggtacggcatggagatcagacccgtgaaggagaaggaagagaacctggtcaagagcatggtttcggccggctccggggaagtggacagcttctccctaggcctgctgtgcatcagcatcatgatcgaggaggtcatgcgctcccggtggtctcgcaagatgctcatgacggggaccctagcagtgttcttcctgctcatcatgggccaactgacctggaacgacctaatacgcctctgcatcatggtgggggcaaacgcctccgacagaatgggcatgggtacgacatacctggccctgatggccaccttcaaaatgcgcccgatgttcgccgtcgggctcctgttccggcgtcttacttcgcgggaggttctcctgctgacgataggtctctccttagttgcaagcgtcgaattgcccaactcactggaagagcttggggacggcctggccatgggcatcatgattctcaagctgctgaccgacttccagagccaccagctctgggccaccttactctccctcaccttcatcaagacgacgttcagtctgcactacgcctggaagaccatggcgatggtgctctccatcgtgtcactgttccccctttgcctgtccaccacgtctcagaagaccacctggctcccggttcttctagggtctctcggctgcaagccgctgaccatgttcctgatcgcggagaacaagatatgggggaggaagagctggccccttaacgagggcatcatggccgttggaattgtgagcattctgctatccagcctcctgaagaacgacgtgcccctggccggacccctcatcgcgggcggcatgctgatcgcttgctacgtcatctccggcagctccgcggacctgagcctcgagaaagccgctgaggtctcgtgggaggaagaggccgagcacagcggcgcgtcccacaacattctcgtcgaggtgcaggacgacggtacgatgaagatcaaggacgaggagcgggatgacacgttgactatcctcctgaaagcgaccctgctggcagttagcggggtgtacccgctgtccatccctgccactctcttcgtgtggtacttttggcagaagaagaagcagcgcagcggtgtgctctgggacacgcccagcccgccagaggtggaacgtgcagtgctggacgacggtatttaccgcatcatgcaacgggggctgctgggccgcagccaggttggcgttggcgtattccaagagaatgtctttcacaccatgtggcacgtgacccgcggggccgtgctcatgtaccagggcaagcgcctggaaccatcctgggcttcggtaaaaaaagacctgatctcctacggcggaggttggcggctccaggggagctggaacactggagaggaggtccaagtgattgccgttgaacccgggaagaaccccaagaacgtgcagacggcccccggcactttcaagaccagcgagggtgaggtaggggccatcgccctggacttcaaacccggcacctcggggagccccatcgttaatcgcgagggaaagatcgtgggcctttacgggaacggcgtggtcactacctccgggacatatgttagcgccatagcccaggccaaggcctcccaggaagggcccctcccggagatcgaggacgaagtgttccgcaaacgcaacctgaccatcatggaccttcaccccggaagcggcaagacacgccgctacctacccgctattgtccgtgaggccatcaagagaaagttgcggacccttatcctcgcaccgaccagagtggtggcctccgagatggcagaggccctgaagggtatgcccatccgataccagaccacggcagtcaaaagcgagcacaccgggaaggagatcgtagacctgatgtgccacgcaaccttcaccatgcggctcctgtcgcccgtgcgcgtccccaactacaacatgatcatcatggacgaggcccacttcacggatccgtcttccatcgcggctcggggctacataagtacacgcgtggggatgggcgaggccgccgccatcttcatgaccgcgacgcctcccgggtccgtggaggccttcccccagagcaacgccgtgatccaggacgaggagcgggacatcccggagcgctcttggaactcaggctatgagtggatcaccgacttcccaggcaagaccgtgtggtttgtgccatccatcaagagcggtaatgacatcgccaactgcctgcgaaagaacggcaagcgcgtgatccagctatctcggaagaccttcgatacggaataccagaaaacgaagaacaacgattgggattacgtggtgaccacggacatctctgagatgggggcaaacttccgcgcagaccgggtcatcgatccccgccggtgtctgaaacctgtgatcctgaaggacggcccagagagggtcatcctcgcggggcccatgcccgtgacagtggcctctgccgctcagcggcgcggccggatcggcagaaatcacaacaaggagggggaccagtacatatacatgggtcagcccctcaacaatgacgaagaccacgcccactggacggaggccaagatgttgctcgacaacattaacactcccgagggtatcatccccgccctgttcgagccggaacgggagaagtccgctgccatcgacggcgagtatcgcctgcgcggggaagcgcggaagacattcgtcgagctcatgcggcggggtgatttgccggtgtggctgagctacaaggtggcctccgaaggcttccagtacagcgacagacggtggtgcttcgacggtgagcggaacaaccaggtactcgaggagaatatggacgtagagatctggaccaaggagggtgagcggaagaagttgcgccctcggtggctggacgcccggacgtactccgatcccctggccctgcgggagttcaaagagttcgcggccgggcgccggagcgtgtcgggtgatctgatcctcgagataggcaaactgccccagcacctgactcaacgggcccagaacgcgctcgataacctggtgatgctacacaacagcgagcaaggagggcgggcatatcgccacgccatggaggaactcccagacaccatcgagactctgatgctgctcgccctcatcgcggtgctaacggggggcgtcaccctcttcttcctgtccggtcgaggcctgggcaagactagcatagggctcctgtgcgtcatggcctccagcgtgctgttatggatggcgtccgtggaaccccattggatcgctgcgtcaataatcttggagttcttcctgatggttttactgatcccggagcccgaccgccaacggaccccgcaggacaaccagctggcctacgtagtgatcggcctcctgttcatgatcctgaccgtcgccgcgaacgagatggggctgctagagacgacaaaaaaggacctaggcatcggacacgttgccgtggaaaaccaccaccacgcggccatgctcgacgttgacttacaccccgcctctgcatggacgctgtacgccgttgccaccacgataatcacccccatgatgcgccacaccatcgagaacaccacggccaatatcagcctgaccgccatcgcgaaccaagccgcaatcctgatgggccttgataagggctggccgatctcgaagatggacatcggggttccgctcctggccttaggttgctacagccaggtcaaccctcttaccctgaccgcggcggtgctcatgctcgtggcccactacgctatcatcggtcccggcctccaggcaaaggcgacgagggaggctcagaaacggactgccgccgggataatgaagaacccgacagttgacggaatagtggccatagacctggaccccgtcgtctacgatgcgaagttcgagaagcagctcggccagatcatgctgctgattctctgcacctcccagatcctgctgatgcgcacgacctgggccctctgcgagagcataaccctggccaccggaccactgacgaccctttgggaaggctcccctggtaagttctggaacaccaccatcgccgtttccatggccaacatcttccgcggcagctacctggcgggcgccgggcttgccttctccttgatgaagagcctgggcgggggccgccgggggacaggagcacagggcgagaccctgggggaaaagtggaagcggcaattaaaccagctgtcgaagtcagagttcaacacctacaagaggtctggaatcatggaagtggaccgcagcgaggcaaaggagggactgaaacggggggaaaccacgaagcacgccgtctcgcgcggaaccgccaagctacggtggttcgtggagaggaacctggtgaaaccagagggcaaggtcatcgacctgggctgcgggcggggggggtggagctattactgcgcaggcctaaaaaaagtgaccgaggtgaaggggtacaccaagggaggccccgggcacgaggagcccatccccatggcgacatatggctggaatctggttaaactacactccggaaaggacgtgttcttcatcccgcctgagaagtgcgacaccctgctctgcgacatcggcgaaagcagtcctaaccccaccatcgaggagggacgcaccctgcgtgtgttgaaaatggtcgagccgtggctcagaggcaatcaattctgtataaagatactgaatccatacatgccctctgtggtggagacactggagcagatgcaacggcgccatggcggaatgctcgtcaggaaccctctgagccgcaacagcacgcacgagatgtactgggtgtcctgcggcaccggcaacattgtgagcgcggtcaatatgacgtcccggatgctgctgaaccgcttcaccatggcgcatcgcaagccgacgtacgaacgggacgttgacctgggcgcgggcacccgccatgttgccgtcgagcccgaggtggccaacttggacataatcggccagcgcatcgaaaacatcaagcacgaacataagtcgacctggcactatgacgaggataatccctacaaaacctgggcgtaccacggctcctacgaggtgaaaccgtcagggagcgcctcctcgatggtcaacggcgttgtgaagctcttgacgaagccgtgggatgtgatccccatggtgactcaaatcgccatgaccgacaccacgcccttcgggcagcagagagtcttcaaggagaaggtggacacccggacccccaaggcaaagagaggaaccgcgcagataatggaagttaccgcgaagtggctgtggggattcctctcccggaacaaaaagccgcgcatctgcacccgcgaggagttcacccgcaaagtccggagcaacgcagctatcggggccgtgttcgttgacgaaaaccagtggaactccgcgaaggaggcagtcgaggatgaacgtttctgggacctggtgcaccgtgagcgtgagctgcataagcagggcaagtgcgctacttgcgtgtataacatgatggggaaaagagagaagaagctcggcgagttcgggaaggccaagggcagccgcgctatctggtacatgtggctgggcgcacggttcctggaatttgaggctctcgggttcatgaacgaggaccactggttctcccgagagaacagcctgtccggcgtagagggggagggcctgcacaagctcgggtacattctccgggatatcagcaagattcccggtgggaacatgtacgcagatgatacagctggttgggacacccgcatcacggaggacgatctccagaacgaggccaagatcacggacatcatggagccggagcacgcgctcctggctaagtccatcttcaagctgacctaccaaaataaggtggtgcgggtccagcgcccggccaagaatggaaccgtgatggacgtgatctcacgccgggaccagcgcggttccggccaagttggcacttacgggttaaacaccttcactaacatggaggcccagttgatccggcagatggagtcggagggcatcttttcgcccagcgagctggagacccccaacctcgccggacgggtgttagactggctggagaaacacggcgtggagcggctaaagcgaatggcgatctccggggacgactgcgtcgtcaagcccatcgacgaccgcttcgccaccgccctgacagccctgaacgacatgggcaaagtccgcaaggacatcccgcagtgggagcctagcaagggctggaacgactggcaacaggtccccttctgctcccatcatttccaccagcttatcatgaaggacgggagagaaatcgttgtcccatgccgcaatcaggacgaactggtcgggcgggcccgggtttcccagggggcgggctggagcctccgggagaccgcgtgcctcgggaagtcctacgcccaaatgtggcagcttatgtacttccacaggcgggacctgcgcctcgccgcaaatgccatctgcagtgcggtgccagtcgactgggtgcccacctcccggaccacctggagcatccacgcacatcaccagtggatgacaactgaggacatgttgagcgtgtggaaccgtgtctggatcgaggagaacccatggatggaggacaagacccacatcagttcatggggcgatgtgccctatctcggcaagcgggaggatcagtggtgcgggagcttgatcggcctgaccgccagagcgacgtgggccacgaacatccaggtagcaattaaccaggtgaggcggctgatcgggaacgagaactatctcgactacatgacctccatgaagcgcttcaagaacgagagcgatcccgagggtgccctgtggtga

SEQ ID NO: 24371 - RNA, 9879 nt, synthetic construct
  misc_feature 1..9879: note = derived and/or modified CDS sequence (opt11) from DENV-1__FJ898401__SS-prME
  source 1..9879: mol_type = other RNA
agcgttacgatgctgctcatgcttatgcccaccgccctagccttccacctcacgacccggggcggggagccccacatgatcgtgagcaaacaagagcggggcaaaagcctgctatttaagacttccgccggggtaaacatgtgcaccctcatcgccatggacctgggcgagttctgcgaagatacgatgacctacaagtgcccgcgcatcaccgaagcagaaccagacgacgtggactgttggtgcaacgccaccgacacgtgggtgacatatgggacatgctcccagaccggggaacacaggagggacaagcggagtgtggccctggccccccacgtgggcttggggctggagacgcggaccgagacttggatgtctagcgagggcgcctggaaacagatccagcgggtggagacctgggcgcttcgacatcccgggttcacggtgatcgccctctttctggcacacgctatcggcaccagcatcacccagaaggggataattttcattcttctcatgttagtaacccccagcatggccatgcggtgcgtgggcatcgggagccgcgatttcgtcgagggtctgtccggcgccacgtgggtggacgtggttctagagcacgggagctgcgtgacaaccatggccaaggacaagcccacgctagatatagaactgcttaagacggaggttaccaacccggctgtactgaggaagctgtgcatcgaggctaagatctccaacacgaccactgatagccgctgcccgacgcagggcgaggccaccctcgtggaggagcaggacgccaacttcgtctgccggcggaccttcgtggaccgcgggtggggtaatggatgcggactgttcggaaaggggtccctgatcacgtgcgccaaattcaagtgcgtgaccaaattagagggtaagatcgtccagtatgagaacctgaagtacagcgtgatcgtgaccgtgcacaccggcgatcaacaccaggtagggaatgagtccactgagcatggcaccaccgcgaccatcacgccccaggccccgtcaaccgagatccagctgacagactacggcgccctcaccttggactgcagcccccggaccggcctggactttaacgaaatggtcctccttacgatgaaggaaaagtcctggctggtccacaagcagtggttcttggaccttccgctcccctggaccagcggggcgtccaccagccaggagacctggaacagaaaggacctcttggtgacattcaaaaccgcccacgcgaaaaagcaggaggtggtggtgctgggttcccaggaaggcgccatgcacaccgcactcacaggggccaccgagatccagacatctggcaccactacgatcttcgccgggcatctaaagtgccgcctgaaaatggacaaactcaccctgaagggcatgtcctacgtcatgtgcaccggttcttttaagctcgagaaggaggtggcggaaacccaacatggcacggtcctcgtgcagatcaagtacgaaggcactgacgccccctgcaagatacccttcagcacccaggatgaaaagggggttacccagaacggccggctgatcacggccaacccgatcgtcaccgataaggagaagccggtcaacattgaggccgaacctcccttcggggagagctacattgtgatcggcgcaggcgaaaaggccctgaagttgtcatggtttaagaaggggagtagcatcggtaagatgttcgaggctaccgcgcgcggggctagacgcatggcgatactcggggacaccgcctgggatttcgggagcatcggcggcgtgttcacgtccgtggggaaattagtgcaccagatattcggcaccgcctatggggtcctgttctcgggcgtatcctggaccatgaagatcgggatcggtgtactcttaacatggctgggtctcaactcgcgctccacctcactgtctatgacctgtatcgctgttgggctagtcacgttatatctgggcgttatggtgcaggccgatagcggttgcgttatcaactggaaagggcgggagctgaagtgcggatccggcatctttgtgaccaacgaggtgcacacgtggaccgagcaatacaagttccaagcggactcccctaagcgcctgagcgccgcgatcggtaaagcttgggaggagggggtctgcggaatccggtctgccacccggctggagaacatcatgtggaaacaaatcagcaacgagctgaaccacatcctcctggagaacgacatgaagttcaccgtggtcgtcggggacgtagccggtatcttggcgcaggggaagaaaatgatccggccacaaccaatggagtacaagtactcctggaagtcttggggcaaggccaagatcatcggcgcggacgtgcagaacaccactttcataatagacgggcccaacacaccggagtgtcccgacgaccagcgcgcatggaacatctgggaggtcgaagactacggctttgggatcttcactaccaacatctggctaaaattgcgggatagctacacccaggtatgtgaccaccggctgatgagcgccgccattaaggactccaaagccgtgcatgccgacatgggatactggatcgagagcgagaaaaacgaaacctggaagctggcgcgtgcctctttcatcgaggtcaagacctgcatttggcctaaaagccacacgctgtggtccaacggcgttctggaatccgagatgatcatccccaagatctatgggggccccatctcccagcacaattatcgcccaggatacttcacgcagaccgcgggtccctggcatctcgggaaacttgagctggacttcgacctctgtgaggggaccaccgtggtcgtagacgggcattgtggtaatagaggcccttcgttacggacgacaaccgttactgggaagatcatccacgagtggtgctgtcgatcctgcacgctgccgcccctgcgcttcaaaggggaggacgggtgttggtacggcatggagatccggcctgtaaaggagaaggaggagaacctggtcaagtccatggtaagcgccgggtccggggaggtcgacagcttctctctgggtctcctttgcattagcatcatgatcgaggaggtaatgcgctcacggtggagccgcaagatgctgatgaccgggaccctcgccgtgttcttcttgctgatcatgggccaactcacctggaacgacctgatccgcctgtgcatcatggtcggagcgaacgcatctgaccgcatgggcatgggcacaacatatttagccctgatggccacgttcaaaatgcgccctatgttcgccgtagggctcctgttcaggcgtttaacgagccgtgaagtcctgctcctcacgatcggcttgtccttagtagcctctgtagagctgcccaacagtctggaagagctcggggacggcctggccatgggcatcatgatattaaagctactgaccgacttccaaagccaccaactttgggctaccctactatcgctgactttcatcaagacaactttcagcctccactacgcctggaagaccatggcgatggtcctgtccatcgtgagcctgttccccctctgcctgtccacaacgtcacagaagaccacctggctgcccgtgctcctagggtccttaggctgtaagccgctcaccatgtttctgattgccgagaataagatctggggtaggaagagctggcccctgaacgagggcatcatggccgtggggatagtaagcatactcctgtcaagtctgctcaagaacgacgtgcccctggccggcccgctgatcgcgggaggaatgctcatcgcgtgctacgtcatctccggcagctcggctgacctgagcctggaaaaggctgccgaggtgtcctgggagaaagaggcggagcacagcggggcctcacataacatcttagtggaggtccaggacgacgggactatgaaaatcaaggacgaggagcgggacgacaccctgacaatattgctcaaggcaaccctccttgctgtgtccggggtatatccgctctccattccggccacactgttcgtgtggcatttctggcagaagaagaagcagcgctccggcgtgttgtgggatacacccagcccgcccgaggtggaacgggcagtcttagacgacgggatctatcgcattatgcagcgggggctgctgggccgcagccaggtgggggtgggcgtatttcaggagaacgttttccataccatgtggcatgtcacaaggggggccgtactgatgtaccagggcaagcgcctcgaaccgtcctgggcctccgtgaagaaagacctgatctcctacggggggggctggcggctgcaaggttcctggaacaccggcgaggaggtgcaggtaatcgctgtggaacctgggaagaaccctaagaacgttcagacggcccccggcaccttcaagacgtccgagggagaagtcggtgccatcgctctcgacttcaagcccggaacctcaggaagccctatcgttaatcgggagggcaagatagtcggcctatacgggaatggcgtggtgacgacctccggcacctacgtgagcgccatcgcccaagccaaggcatcccaggagggcccactgccggaaatcgaagatgaggtctttagaaagcgcaacctgacaatcatggatctacacccagggagcggcaagacgcgccgctacctgccagccattgttcgcgaggccattaagcggaagcttcgtaccctgatcctggcccctacccgggtggtggctagcgaaatggcggaggccctaaaaggcatgcccatccgctaccagaccactgctgtcaagagcgaacacaccggcaaggagattgtagacctcatgtgccacgccacctttacaatgcgcctgctgtcgcccgtccgcgtacccaactacaacatgatcatcatggacgaggcccacttcactgacccgagcagtatcgccgcccgaggctacatcagcacccgagtgggtatgggcgaagctgcggccatcttcatgactgcgacgccgcccgggagcgtcgaggcatttccccagagcaatgccgtgatccaagacgaagagcgggatatcccggaacgctcatggaatagcggctatgagtggatcacggatttccccggcaagacggtgtggttcgtcccctccatcaagtcggggaacgacatagcaaattgcctgcgtaagaacggcaagcgcgtgatccagctgtcccggaaaacgttcgacaccgagtaccaaaagacgaagaacaacgactgggattacgtggtcaccactgacatcagcgaaatgggggcaaatttccgtgccgacagggtaatagatcctaggagatgcttaaagcctgttatcctcaaggacggccccgagcgagtcatcctggcgggtcctatgccagtgaccgttgcctccgcagcccagcgtcgtggcaggatcggccgtaaccataataaggagggggaccagtatatctacatggggcagccgctcaacaacgacgaggaccacgcccactggacggaggccaagatgttactggataacataaacacccccgaggggatcatccccgccctattcgagccggagcgggagaaaagtgctgcaatcgacggcgagtacaggctgaggggcgaggcacggaagacgttcgtggagcttatgcgacggggcgacctcccggtttggctgtcatacaaggtcgcctccgagggcttccaatacagcgaccgccgctggtgcttcgacggtgagcggaacaatcaggttctggaagagaacatggatgtggagatctggaccaaggagggcgagcggaagaaactccgccctcggtggcttgacgcccgtacctacagtgaccccctggcactcagggagttcaaggagtttgcggcgggccgccggagcgtctccggcgacctgatcctcgagatcggcaaactcccacagcacctgacccagcgcgcccagaacgccctggataacctcgtgatgctacacaacagcgagcagggcgggcgggcgtaccgccatgcgatggaggagctcccggataccatcgagacactcatgctgttagccctcatagctgttctgaccggcggagtcacgttattcttcctctccgggcggggcctgggcaagacctccatcgggttactctgcgtgatggcgtccagcgtgctgctgtggatggcaagcgtcgaaccccactggatcgccgctagcatcatcctcgagttctttctgatggtgctgctgattcccgagcccgaccgccagcggacccctcaggataaccagctggcctacgtggtcatcggcctcctattcatgatcctgaccgtggcagcgaacgagatggggttgctcgagacgactaagaaggacctaggcatcgggcacgtggcagtcgaaaaccaccaccatgccgcgatgctggacgtggacctccaccccgcctccgcctggaccctgtacgccgtagcgaccacgataataacccccatgatgcggcacaccatcgagaacactactgcgaacatctccctgaccgcaatcgctaaccaagccgcgatcctcatgggcctggacaagggctggccgatctcgaagatggatatcggggtccccctgctcgccctgggctgttacagccaggtgaacccactgaccttgaccgcggccgtactgatgctggtcgcccattacgccatcatagggcccggcctccaagccaaggcgacgcgggaggcccagaagcgcacagccgcagggatcatgaagaacccgaccgtggacggcatcgtcgcgatcgacttagatcccgtggtgtacgacgctaagttcgagaagcagctggggcagattatgcttctgatcctgtgcacatcccaaatcctcctgatgcgcacgacctgggccctgtgcgagagcatcacactcgctactggccccctcacgaccctatgggaaggctcgcccggcaagttctggaacaccaccatcgccgtgtcgatggctaacatattccggggcagctacctcgcgggcgccgggctggccttttccttaatgaagtccctcggaggaggccgccggggcacgggcgcgcatggagagacgctaggagagaagtggaagcgccagttaaaccagttgtccaagtccgagttcaacacctacaagcgttctgggatcatggaggtcgaccgcagcgaggctaaggaggggctgaagcgcggcgagaccacgaagcacgccgtgtcccgcgggaccgcgaagctgcgatggttcgtagagcgcaacctggtgaagccggagggcaaggtgatcgacctgggctgcgggcggggcgggtggagctactactgcgccggactgaagaaagtcacagaggtcaaggggtacaccaagggaggcccagggcacgaagagcctattcccatggcaacgtacggatggaacctggtgaaactccactccgggaaagacgtgttcttcatcccgcctgagaagtgtgacaccttgctgtgcgacatcggggagtcatcccccaatcccaccattgaggaggggcgcaccctccgggtccttaagatggtggagccgtggctgcgcggcaaccagttctgcattaagattctcaacccctacatgcctagcgtggtcgaaacgcttgagcagatgcaacgtaagcacggtggcatgctggtacgcaaccccctctctagaaacagcacccatgagatgtattgggtaagttgtggcaccgggaacattgtcagtgcggtgaatatgacatcccgcatgctgctgaaccggtttacaatggcgcatcgcaagccaacgtacgagcgcgatgttgaccttggggctggcacgcggcacgtggccgtggaacccgaggtggcgaatctggacatcatcgggcagcgcattgaaaacatcaagcacgagcacaaatcaacttggcattacgacgaagacaacccctacaagacatgggcgtaccatggctcctacgaagtcaagcccagcgggtcggcctcaagcatggtaaacggcgtcgtcaagctgttgaccaagccttgggacgtgattcccatggtcacccagattgccatgaccgataccactcccttcgggcagcagcgagtgttcaaggagaaggtggatacccggaccccaaaggccaaacggggcaccgcccagattatggaggtcacggcgaagtggttatggggcttcctgtcccgcaacaagaagccgcggatctgtaccagagaggagttcacgcggaaagtgagatcaaatgccgccataggtgccgtctttgtcgacgagaatcagtggaactccgcgaaagaagctgtagaagacgagcggttctgggacttagtgcatcgtgagcgggagctgcacaagcagggcaagtgcgcgacctgcgtgtacaacatgatggggaagcgcgagaagaagctaggagagtttgggaaagccaagggcagccgcgccatctggtacatgtggctcggagcgcgcttcctggagtttgaggccctagggttcatgaacgaggatcactggttcagccgggaaaattccctgagtggcgtcgaaggagagggcctgcacaagctggggtacatactacgcgacataagtaagatccccggaggcaatatgtacgccgatgataccgccgggtgggacaccagaatcactgaggacgacctgcagaatgaagctaagataaccgacatcatggaaccggagcacgcgttactcgctaagtctatcttcaagctgacgtaccagaacaaggtggtccgcgtccagaggccagctaaaaacggcaccgttatggacgtcatttcccggcgcgatcagcggggctccggacaggtgggtacctatgggctcaacactttcacgaatatggaggcccagttgattcgtcaaatggagagcgagggcatcttctccccaagcgagcttgaaacgcccaacttagccggcagagtgctcgactggctggaaaagcatggcgtcgaacggctgaagcggatggcgatctccggggacgactgtgtggtgaagcccatcgacgaccgcttcgccacggccctcaccgccctgaacgacatgggcaaagtccggaaagacatcccgcagtgggagcccagcaagggatggaatgactggcagcaagtccccttctgcagccaccacttccatcagctgattatgaaggacggacgcgagattgtggtcccttgccgcaaccaggacgagcttgttggtcgcgcccgggtgtcgcaaggcgcgggctggagcctgcgcgagacggcgtgcctggggaagtcatacgcacaaatgtggcagctcatgtatttccaccggcgcgacctccggctggccgccaacgccatttgctctgcggtacctgtggattgggtccccacctcacgcaccacctggagcattcatgcccaccaccagtggatgaccaccgaagatatgctctcggtctggaaccgggtgtggatcgaggagaatccctggatggaggacaaaacccacatcagctcctggggggacgtcccatatctgggcaagcgcgaagaccagtggtgcgggagccttatcggcttaactgcccgcgcgacgtgggccacgaatatccaagtcgctatcaaccaggtgcgacgcctgatcggtaacgagaactacctggactacatgacctccatgaagcggttcaagaacgagtctgacccggaaggcgccttgtggtga

SEQ ID NO: 24372 - RNA, 9879 nt, synthetic construct
  misc_feature 1..9879: note = derived and/or modified CDS sequence (opt11) from DENV-1__FJ898402__SS-prME
  source 1..9879: mol_type = other RNA
agcgtgaccatgctgctgatgctgatgcccaccgccctggccttccatctcacgacccggggcggggaaccccacatgatcgtgagcaagcaggagcggggcaagagcctgctgttcaagacctctgcgggggtgaacatgtgcacgctcatcgccatggacctcggggagttttgcgaggacacgatgacctataagtgccctcgcatcaccgaggccgagcccgatgacgtcgactgctggtgcaacgctacagatacctgggtaacatacgggacctgcagccaaacaggcgagcaccgccgggacaagagatccgtggccctggcgcctcacgtaggcctcgggctggagacgcgcaccgaaacatggatgagctccgagggcgcctggaagcagatacagcgagtggagacctgggccctgcgccaccccgggttcacggtgattgccctctttctggcccacgccatcggcaccagcatcacccagaaagggatcatcttcattctgctcatgctggtaacaccctccatggccatgcggtgtgtcggaatcggcagccgcgatttcgtggagggtctatccggcgccacgtgggtggacgtcgtgcttgagcacgggagctgcgtgaccaccatggccaaggacaagcccaccctggacatcgagcttctcaagacggaggtcaccaaccccgccgtgctgcggaagctgtgcatcgaagccaagatctccaataccaccacggacagccgttgcccgacccagggggaggccaccctggtggaggaacaggacgctaacttcgtctgccggcgcacctttgtggatcgggggtgggggaacggatgtgggctgttcggcaaggggtccctgatcacatgcgccaagtttaaatgcgtgaccaagctagagggcaagatagtccagtacgagaacctgaaatacagcgtgatcgtgaccgtccacacgggcgaccagcaccaggtggggaatgagtccacggagcacggcaccaccgcgaccatcacgccacaggccccatccacggagatccagctgaccgactacggggccctgaccctggactgcagcccccggaccggcttggacttcaacgagatggtactgctaacgatgaaagagaagtcctggctggtgcacaagcagtggttcctggacctaccgcttccttggacgagcggggcctccaccagccaggagacctggaaccggaaggatctccttgtgacctttaagaccgcacacgcgaagaagcaggaggttgtggtgctaggctcccaagagggggccatgcacactgccctcaccggagccacggagatccagaccagcggcaccaccacgatcttcgccgggcatctgaagtgccgcctcaagatggacaagctcacactgaagggaatgtcctacgtcatgtgcactggcagcttcaagctggaaaaggaggtcgcagagacccagcatggcacggttctcgtccaaatcaagtacgagggcaccgacgccccatgcaagatccccttctccacccaggacgagaagggggtgacccagaatggcaggctgattaccgccaacccgatcgtaacagacaaggagaagcccgtcaacatcgaggccgagccgcccttcggggagagttatatcgtgatcggagcgggcgagaaggccctgaagctgtcctggttcaagaaggggagctccatcggtaagatgttcgaggccaccgcccgcggggcccgacgcatggcgatcctcggcgacaccgcttgggacttcgggagcattggtggcgttttcacgtcagtcggtaagctcgtgcaccaaatattcggcaccgcctacggggtgctgttctccggcgtctcctggaccatgaagattggtatcggcgtcttgcttacctggctgggcctcaacagccgctccacgagtctgtccatgacctgcatcgccgtggggctggtcaccctctacctgggcgtgatggtgcaggccgacagcgggtgtgtcatcaactggaagggccgggaattaaagtgcggtagcggcatattcgtgaccaacgaggtgcacacatggaccgagcagtacaagtttcaggcggactcaccgaagaggctcagcgctgccatcgggaaggcctgggaagagggggtctgcggcatccggtccgcaacccgacttgagaacatcatgtggaagcagataagcaacgagctgaattacatcttattggagaacgacatgaagttcaccgtggtggtcggagatgtggccggcatcctggcccaagggaagaagatgatccggccccaacccatggagtacaaatactcctggaagtcctggggcaaggccaagatcatcggcgccgacgtgcagaacaccacgttcatcatcgacgggcccaacaccccggagtgccccgatgaccaacgcgcttggaacatctgggaagtagaggactatggttttgggattttcaccaccaacatctggctcaagctgcgagactcctacacacaggtgtgcgaccaccgcctcatgagcgccgccatcaaggatagcaaggccgtgcacgccgatatgggctactggatcgaatcggagaagaatgagacctggaagctcgcgcgtgcctcctttattgaggtcaagacctgcatctggcccaaaagccacaccctgtggtccaacggcgtcctggagagcgagatgatcatccccaagatctacgggggcccgatctcccagcacaactaccgccccgggtactttacccagaccgcaggtccctggcacctcggcaagctggagctggacttcgacctctgcgagggtaccaccgtggtagtcgacgaacactgcggcaaccggggcccgagcttacgcacgaccaccgtaacagggaagatcatacacgaatggtgctgccggtcctgtacccttccgcccctgcgcttcaagggggaagacggctgttggtacggaatggagatccggcccgtgaaagagaaggaggagaacctagtcaagagcatggtgagcgccggctccggcgaggtcgattcgttctccctggggctcctgtgcatctccatcatgattgaagaggtgatgcgctccaggtggagccgcaagatgctgatgacgggaacgctcgcggtgttcttcctgctgatcatgggccaactcacctggaacgacctgatcaggctgtgcatcatggttggcgcgaacgcctccgaccggatgggtatgggcacgacctacctcgccctgatggccactttcaagatgcgccccatgttcgccgtggggctcctcttccggcgcctgaccagccgggaggtgctactcctaacgatcggcttgtccctcgtcgcgagcgtggagctgccgaactccctggaagaactcggcgatgggctggccatgggcattatgatccttaagctcctgacagactttcagtcgcaccaactgtgggcaactctcctttcgctgaccttcatcaaaacgaccttttccctccactacgcctggaagaccatggcgatggtcctgtccatcgtgtctttatttcccctctgcctgagcacaacgagccagaagaccacctggctgccagtgctcctaggctccctggggtgcaagccactcacgatgtttctgatcgccgaaaacaagatctggggacgcaagagttggccactaaacgaagggatcatggccgtcggtatcgttagcatcctccttagcagcctgctaaagaacgacgtgcccctggcggggcccctgatcgccggcggcatgctcatcgcctgctatgtcatatccgggagcagcgccgatctgagcctggaaaaagccgccgaagtgtcctgggaagaggaggccgagcatagcggcgcgtcacacaatatcctcgtggaggtccaggacgacgggacgatgaagatcaaggacgaggagcgggacgacaccctgaccatcctgttgaaggccaccctgctggcggtgagcggcgtgtacccgttatccatccccgccacactcttcgtttggtacttctggcagaaaaagaagcagcgcagcggggtcctctgggacacgcccagcccacccgaggtggagcgggccgtcctcgacgacggcatttaccgcatcatgcagcggggcctgctggggaggagccaagtgggcgtgggggtcttccaggagaacgtcttccacaccatgtggcatgtgaccaggggcgccgtcctgatgtaccaggggaagcgcctcgagccctcctgggctagcgtgaagaaagacctgatctcctacggcggcgggtggcggctgcagggctcttggaataccggggaggaagtgcaggtcatcgcagtggagccgggcaagaaccccaagaacgtgcaaacggccccggggaccttcaagaccagtgagggcgaggtcggggccatcgcgctcgacttcaagcccgggacctcgggcagccccatagtgaatcgcgagggcaagatcgtaggtctgtatgggaatggggtcgtgacgacctccggcacctacgtatcggccatcgcccaggccaaggcgtcccaagaagggcccctgccggaaatcgaggacgaggtattcagaaagcggaacctcaccatcatggacctgcaccccggctcggggaagacgcggcgctacctgcccgccatcgtgcgggaggcaattaaacgcaagctcagaaccttaatcctggcgccgaccagggtggtcgcctccgagatggcggaggcattaaaggggatgcccattcgctaccagacgacagccgtcaagagtgagcacaccggcaaggagatagtggacctgatgtgccacgccaccttcacgatgagactactctcccccgtacgggtgccgaactacaacatgatcattatggacgaggcccactttacagatccgagctccattgcggcgcgtggttacatctcgaccagagtgggcatgggggaggcggccgccatcttcatgaccgcgactccacccgggtccgtcgaggccttcccccagtctaacgccgtgatacaggacgaggagagagacataccggagcgctcctggaactccgggtatgagtggatcacagacttccccggcaagaccgtgtggtttgtcccctccatcaagagcggcaatgatatcgccaactgtctgcggaagaacgggaagagagtgatccagctgtctcggaagacgtttgacaccgagtatcagaagacgaagaacaacgactgggactacgtcgttaccaccgacatcagcgagatgggagcgaacttccgagccgaccgggtgattgacccccgcagatgcctcaagccggtgatcctgaaggacggtcccgagcgcgtaatcctggccggtcccatgcccgtgacggtcgcctccgccgcgcagaggcgcgggcgtatcggccgcaaccacaacaaggagggcgaccagtacatctacatggggcagccgctcaacaacgacgaggaccacgcccactggacggaggccaagatgttgctggataatatcaacaccccggagggcatcatacccgccctcttcgagcccgagagggagaaatccgcggcgatcgacggggaatatcgcttgcgcggcgaggcccggaaaacattcgtggagctgatgcgccgtggggacctcccggtgtggctcagctataaggtggcatccgagggattccagtacagcgacagacggtggtgtttcgacggcgagcgcaacaatcaggtgctggaggagaacatggatgtggagatctggaccaaggaaggggagcggaagaaactcagaccgcggtggctggacgccagaacgtactccgaccccctggcccttagagagttcaaggagttcgccgccggtcgccgatccgtcagtggggatctgatcctggagatcggaaagctccctcagcaccttacccaaagagctcaaaacgctctggacaatctcgtgatgcttcacaattcagaacagggcgggcgggcgtaccgccacgctatggaggagctgccggacacaatcgagaccctcatgctgctggccctcatcgcggttttgacgggtggggtcaccctgttcttcctctccggccgggggctgggcaaaaccagcatcggcctgctttgcgtgatggcttccagcgtgctgctgtggaccgcttcggtcgagccccactggatcgccgccagcatcatcttggagttcttcctgatggtgcttttgatccccgaacctgatcgccagcggaccccgcaggataaccagctagcgtacgtggtcatcgggctcctcttcatgatactgacggtggccgcgaacgagatgggcctgctcgagaccacgaagaaagacttggggatcggccacgtggccgtcgagaaccaccaccacgccgcaatgctagatgtggacctgcaccccgcctccgcttggactctttacgccgtggccacaaccatcattacccccatgatgcgacacaccatagagaatacgacggccaacatcagcttgaccgccatcgctaaccaggccgccatactcatgggtctggataagggatggccgatctccaaaatggatattggcgtccccttactcgccctggggtgctacagccaggtgaaccccctgaccctcactgccgcggtgctgatgctggtcgcccactacgcaatcatcggtccagggctccaggccaaggcgacccgggaggcccagaagcgcacagccgccggtatcatgaagaacccgaccgtggatggcatcgtagccatagacctggacccagtggtctacgacgcgaagttcgagaagcagctgggtcagatcatgctgctaatcctgtgcacgtctcagatccttcttatgcgcaccacctgggccctgtgcgagagcatcacattagccacgggcccgctgaccactctgtgggaggggtcccccggcaagttctggaacaccacgatcgccgtgagcatggccaacatatttcggggatcttatcttgcgggcgcgggcctggccttctcactgatgaagtccctgggtggcggccggcggggcaccggagcccaaggcgagaccctaggcgagaaatggaagcgccaactgaaccagttatcaaaaagcgagttcaacacatacaagcggtccgggatcatggaggtcgaccgcagcgaggcgaaggagggcctgaagcgtggggagacgacgaagcacgccgtgtccagaggcaccgctaaactgcggtggttcgtggagcgcaacctcgttaagccggaagggaaagtgatcgacctgggctgcggccgcggagggtggagctattactgcgccgggctgaagaaggttactgaggtcaaagggtacaccaaaggaggccccggccacgaggagcccattcccatggccacctacgggtggaacctggtgaagctgcattccggcaaagacgtgttctttattccgcccgagaagtgcgacaccctgctatgcgacattggggaatcctcccccaaccccacaatcgaagagggccgcacgctccgggtcctgaagatggtggagccgtggctccgcgggaaccagttttgcatcaagatcctcaacccctacatgcctagcgtggtcgagaccctggaacaaatgcagcggaaacatggcggcatgctggtgcgcaaccccctctcccgcaatagcacccacgagatgtactgggtgtcatgcgggaccggtaacatcgtcagcgccgtgaacatgacctcgcgaatgctccttaatcggttcacgatggcccaccgcaagccgacttacgagcgcgacgtggatctcggggccggcaccaggcatgtcgccgtggagcccgaagtggccaacttagacatcatcggccagcgcatcgagaatatcaagcacgagcacaagagcacctggcactacgacgaagataacccgtacaaaacgtgggcataccacgggtcctacgaggtcaaacccagcggcagcgcctccagcatggtgaacggtgttgtcaagctcctcaccaaaccgtgggacgtgattcccatggtcacccagatcgctatgaccgacacgacaccctttggtcaacagcgggtgttcaaggagaaggtggacacccgaactcccaaggctaaacgggggacggctcaaatcatggaggtcaccgcgaagtggctgtggggcttcctgtcccgaaacaagaagccgcggatctgcacccgagaggagttcacgcggaaggttcgcagcaacgccgccatcggcgccgtgttcgtcgacgagaaccagtggaactccgcgaaagaggccgttgaggacgagcggttttgggacctcgtgcaccgcgaacgggagctgcataagcaggggaaatgcgcaacgtgcgtctacaacatgatgggcaagcgggagaagaagctgggagagttcggcaaggcaaagggcagccgggccatatggtacatgtggctcggggcgcggttcctcgagttcgaggccctgggcttcatgaacgaggaccattggttctcccgggagaactctttatccggggttgagggcgagggcttacacaaacttggttacatcctccgcgacatctcgaaaatccccgggggtaacatgtacgccgacgacaccgcgggctgggacacccggataacggaggacgacctgcagaacgaagccaaaatcaccgacatcatggagcccgaacacgccctgctcgccaagtccatcttcaaattgacctaccaaaataaggtggtccgcgtgcagcggcctgctaagaacgggaccgtgatggacgttattagccgccgcgaccagcggggctccggccaggtgggaacctacggcctgaacactttcacaaacatggaggcccagctcatccgccagatggagagcgaagggatcttctccccgagcgagctggagacccccaacctggccggacgggtgctggactggctggagaagcacggggtcgaacgcctgaagcggatggcgatctcgggcgacgattgtgttgtaaaacccatagacgatcggttcgccactgcgctaactgccctgaacgacatggggaaggtaaggaaggacatcccgcagtgggagcctagcaagggctggaacgactggcagcaggtacccttctgtagccaccactttcaccagctgatcatgaaagacggcagggagatcgttgtgccctgccggaaccaggacgagctcgtggggcgggcacgggtgtcccagggcgcggggtggagcttgcgcgagactgcatgcctgggcaagtcctatgcgcagatgtggcagctcatgtactttcaccggcgcgacttacggctggccgcgaacgccatctgcagcgccgtaccggtggattgggtgcccacctcccgcacgacgtggagcatccacgcccaccaccagtggatgaccacggaagacatgctcagtgtctggaaccgggtgtggatcgaggagaatccttggatggaggataagacccacatcagctcgtggggcgacgtgccctatctgggcaaacgcgaggaccaatggtgcggcagcctgatcgggctcaccgcacgggcgacttgggctacgaacatccaggtcgccattaaccaggttcgccgcctgatcggaaacgagaactacctagactacatgacctccatgaagcggttcaagaacgagtctgaccccgagggggccctctggtga

SEQ ID NO: 24373 - RNA, 9879 nt, synthetic construct
  misc_feature 1..9879: note = derived and/or modified CDS sequence (opt11) from DENV-1__FJ898403__SS-prME
  source 1..9879: mol_type = other RNA
agcgtcaccatgctactcatgctgatgcccaccgctcttgccttccacctcacgaccagaggcggggagcctcacatgatcgtgagcaagcaggagaggggcaagagcttactgttcaagacgagtgccggggtgaacatgtgtaccctcatcgccatggacctgggcgagttctgcgaggatacaatgacctacaagtgcccccgcatcaccgaggccgagcccgacgacgtagactgctggtgcaacgccaccgacacgtgggttacctacggaacctgcagccagaccggtgagcaccggcgggacaagcggtccgtggccctggctccccacgtgggcctagggttagagacgcgcaccgaaacatggatgagctccgagggcgcatggaagcagatacagcgggtggagacctgggccctgcgccaccccgggttcacggttatcgccctcttcttagcgcacgctatcggcaccagcatcacccaaaagggcatcatcttcatcctgctcatgctggtgacgccatccatggctatgcggtgcgtcggcataggtagccgcgacttcgtggaggggctgtccggggccacatgggtggacgtcgtgctcgagcacggatcatgcgtgaccaccatggccaaggacaagcccactctggacatcgagctgctgaagaccgaggtcaccaaccccgcggtactgcggaagctgtgcatcgaggccaagatctccaacaccaccacggacagccgctgtccgacccagggcgaggctacccttgtggaggagcaggacgccaactttgtctgccgccgcaccttcgtagaccggggctggggcaacggctgcggcttgtttggcaaggggtccctgatcacatgcgccaagttcaagtgcgtgaccaagctcgagggcaagatcgtccagtatgagaacctaaagtatagcgtgatcgtgaccgtccacaccggcgatcagcaccaggtcgggaacgagtccacggagcacggcacaaccgcgacaatcacccctcaggctcccagtacggagatccagctgaccgactatggagccctcaccctagactgcagccctcggaccggcttagacttcaacgagatggtcctcctcacgatgaaggaaaaatcctggctggtccacaagcagtggttcctcgatctgccgctgccctggaccagcggggcgtccacctcccaggagacctggaacaggaaggacctcctggtgacgttcaagaccgcccacgcgaagaagcaggaggtcgtggtgctgggctcccaggagggcgcgatgcacaccgccctcaccggcgccaccgagatccagacctcgggcaccaccacaatctttgccgggcacctgaagtgtcgcctgaaaatggacaagctcaccttaaagggcatgtcctacgtcatgtgcaccgggagcttcaagctagagaaggaggtggcggagacccagcacggcacggtgttagtccagatcaagtacgagggcaccgatgccccctgtaagatccccttctccacccaggacgagaagggggtgacccagaatggccggctgatcacggcaaacccgatcgtgaccgacaaggagaagcccgtcaacatcgaggccgagccgcctttcggggagtcatatatagtgatcggcgcgggcgagaaggccctgaagctgtcctggttcaagaaaggaagctccatcggcaagatgttcgaggccaccgcacgcggcgctcggcggatggcgatcctcggcgacaccgcctgggacttcgggagcatcggaggcgtgttcacttccgtcgggaagttagtgcaccagatctttggcaccgcctacggggttcttttcagcggcgtctcctggacgatgaaaatcgggatcggagtgctgctgacctggcttggactcaacagccggagcacgagcctgtcaatgacatgcatcgccgtggggttggtcactctctacttgggagttatggtgcaggcagacagcgggtgtgtcatcaattggaaaggccgggagctgaagtgcgggagcggaatattcgtgacgaacgaggtgcacacatggactgagcaatataagtttcaagcggactcgcctaagcgtctcagcgccgccatcggtaaggcttgggaggagggggtctgcggcatcagatccgccacccgactggagaacatcatgtggaaacagatcagcaatgagctgaaccacatcctgctggagaatgacatgaagttcaccgtagtcgtcggggatgtggcgggcatcctggcccaagggaaaaagatgatcaggccgcagcccatggagtacaagtactcctggaagtcctggggcaaggctaagatcataggcgccgacgtgcagaataccaccttcatcatcgacgggccaaacacccccgagtgccccgacgaccagcgcgcatggaacatttgggaggtggaggactacggcttcggtatcttcaccaccaacatctggcttaagctgcgcgactcctacacccaagtgtgtgaccaccgcctgatgagcgcagccataaaggactccaaggccgtgcacgccgacatgggttactggatcgagtccgagaagaacgagacctggaaactcgcgcgggcatccttcatcgaagttaagacctgcatatggcccaagagccacaccttgtggtccaacggcgtgctggagtccgaaatgatcatccccaaaatttacgggggaccgatctcacaacacaactatcgccctgggtacttcacgcagaccgccggtccttggcacctcgggaagctggaactggatttcgacctctgtgagggcaccaccgtggtcgtcgacgagcactgcggcaaccgtgggccgagcctccgcacgaccaccgtgacgggcaagattatccacgaatggtgctgtcggtcatgcacgctgcctcccctgcgcttcaagggggaggatggctgctggtacgggatggagatccggccagtaaaggagaaggaggagaacctggtcaagtctatggtgtctgccggctccggtgaggtcgacagtttctccctggggctcttgtgtatctccatcatgattgaggaggtgatgcgctcccgctggtcgcgcaagatgctgatgaccggcacactcgccgtcttcttcctgctgatcatggggcagctcacctggaacgatctcatacgactgtgtataatggtcggtgcgaacgcctccgaccggatgggcatgggcacgacctacctagccctgatggccaccttcaaaatgcgcccgatgttcgccgtggggctcctgttccggcgcctaaccagcagagaggtgctgctcctgacgatcgggctatccctcgttgcgtcggtggagctgcccaactcactggaggagttgggcgacgggctggccatgggcatcatgatcctgaagttgctgacggacttccagtcgcaccagctgtgggccaccctcctgtcgttaacgttcatcaagacgaccttcagcctccactacgcctggaagaccatggcgatggtcctgtcaatcgtcagcctgttccctttgtgcctttccaccacgtcgcagaagaccacctggctgcccgtgcttctgggctcactcgggtgcaaaccgctgaccatgttcctcatcgccgagaacaagatctggggccgcaaaagctggccccttaacgaggggatcatggccgtcggcatcgtgagcattctccttagcagcctgctcaagaacgacgtgcccctggccgggcccctgatcgccggcggcatgcttattgcctgctacgtcatatccgggtcctccgccgatctgagcctggagaaagccgcggaggtctcgtgggaggaagaggcggagcacagcggcgcgtcccacaacatcctagtggaggtccaggacgacgggacgatgaagatcaaggacgaggagcgggatgacactctcaccatcctgctcaaggccaccctgctggccgtgagcggcgtgtaccctctctccatccccgctaccctcttcgtctggtacttctggcagaagaagaaacagcgcagcggggtgctgtgggacacgcccagcccgcctgaggtggaacgggcagtcctcgatgatggcatctaccgcatcatgcagcggggcctgctggggcgcagccaggttggcgtgggtgtcttccaagagaacgtgttccacacgatgtggcatgtgacccggggcgcggtcctgatgtaccagggtaagcgccttgaaccctcctgggcaagcgtgaagaaggacctgatctcctacgggggagggtggcggctgcagggcagctggaacaccggggaggaggtccaggtcattgctgtggagcccggcaagaaccccaagaacgtgcagacggcccccgggaccttcaagacctccgagggcgaggttggggccatcgctctcgacttcaaacccgggaccagcggatctcccattgtgaaccgcgaaggaaagatagtcggactgtacggtaacggggtcgtgacgacctcgggcacctacgtgagcgcaatcgctcaagccaaggcttcccaggaggggcccctgccggagatcgaggatgaggtcttcagaaagcgcaacctcaccatcatggacctacaccccggcagcgggaagacgcgccgctacctgcctgccattgtgcgggaagccatcaagcgaaagctcagaaccttaattctggcccccacccgcgtggtggcctccgagatggcggaggcgttgaagggcatgcccatcaggtaccagaccacggccgtcaagagcgagcacaccggaaaggagatcgtggacctgatgtgccacgccaccttcaccatgcggctgctctcccccgttcgcgtacccaattacaacatgatcattatggatgaagctcacttcacggacccgagtagtatcgcggctcgggggtacattagcacccgtgtgggaatgggggaggccgccgccatattcatgaccgcgacgccacccggttccgtcgaagccttccctcagagcaacgccgtgatccaggacgaagagcgtgacataccggagcgctcctggaactctgggtacgagtggatcactgacttcccaggcaagaccgtgtggttcgtcccctccatcaagagtggcaacgacatcgccaactgcctgcgaaagaacgggaagagagtgatccagctgtcccgcaagacttttgacaccgaataccagaagacgaaaaacaacgactgggattacgttgtcaccacggatatcagcgagatgggggcgaatttccgcgccgaccgggtcattgacccccgccggtgccttaagccggtgatcctaaaggacgggcccgagcgcgtcatcctagccggccccatgcccgtgaccgtcgcctccgccgcgcaacggcgcgggcggataggccgcaaccacaacaaggaaggcgaccagtacatctatatggggcagccgctcaataacgatgaggaccacgcccactggacggaagcaaagatgctgttagacaacataaatacccccgagggcatcatccccgctttgttcgagcccgagcgggaaaaatccgccgcgattgacggggaataccgcctgcgaggcgaggcccggaagacctttgtggagctgatgcgcaggggcgatctccccgtgtggctgagctataaggtagcctccgagggcttccagtactcagaccgccggtggtgcttcgacggagagcgcaacaaccaagtgctggaggaaaatatggacgtggagatctggaccaaggagggcgagcggaagaagttacgcccccggtggctggacgcccgcacgtattccgacccactcgctctccgggagtttaaggagttcgcggccggccgccggagcgtctccggggatttaatcctggaaatcggcaagttgccacagcacctgacccagcgcgctcagaacgcactggataatctcgtgatgctgcacaatagtgagcagggcggccgggcgtaccgccacgccatggaggaattaccggataccattgagaccttaatgttactggccctcatcgccgtactaacgggcggtgtcaccctgttctttctctccggccgggggctcggcaaaaccagcattggcctgctctgcgtgatggcctccagcgtgctgctttggatggcgtccgtcgagccccactggatcgccgccagtataattctcgagttcttcctgatggtgctgctcattcccgaacccgacagacagcggaccccacaggacaaccagctggcctacgtggtcatcgggttacttttcatgatcctgaccgtggccgcgaacgagatgggactgctcgaaacgaccaagaaggatctggggatcggccacgtggccgtcgagaaccaccaccacgcagcgatgctggacgtggacctccaccccgcgtccgcgtggaccctctacgccgtggccaccacgatcatcacccccatgatgcgccacaccatcgagaacaccacagcaaacatctctctgactgccatcgcgaaccaggccgccatcctcatggggctggacaagggctggccaatctccaagatggacatcggcgttccgctgctcgccctggggtgctacagccaggtgaaccccctgaccctgaccgcggcagtgttaatgctggtcgcacactacgccatcatcggtcccgggctccaggccaaggcgacgcgggaggcccagaagcgcaccgccgcgggtatcatgaagaacccgaccgtcgacggtatcgtggcgatcgacctggaccccgtcgtgtacgacgcgaaatttgagaagcaactgggccagattatgttgttaatcctctgcacttcccagatcctgctgatgcgcactacgtgggccctgtgcgagagcatcaccctagccaccggccccttaacgaccttgtgggagggatcacctggaaagttctggaataccaccatcgccgtgagcatggccaatatctttcgtgggagctacctcgcgggcgccggcctggccttctccctgatgaagtccctcggaggcggacgacggggcacgggggcccagggggagacactgggcgagaagtggaagcgccagttgaaccagctgtccaagagcgagttcaacacatacaagcgctccgggatcatggaagtagaccgctcagaggccaaggagggcctgaagcgcggggagacaacgaagcatgcggtgtcccggggcacggccaagttgcggtggttcgtggagcgtaacctcgtgaagcccgaggggaaagtgatcgacctggggtgcgggcgtggagggtggtcttactactgcgccgggctgaagaaggtgaccgaggtcaaggggtacacaaagggcgggccgggccacgaggagcccatccccatggccacttacgggtggaacctggtcaagctccacagtggcaaggacgtgttcttcatcccgcctgagaagtgcgacaccctcctctgcgatattggggagagttcccccaaccccaccatcgaggagggccgcaccctccgggtcctgaagatggtggagccgtggctgcgcgggaaccagttctgtatcaagatcctcaacccatacatgccaagcgtggtcgagacgctggaacagatgcagcggaagcacggcggcatgctcgtgcgcaaccccctctcacggaacagcacccacgagatgtactgggtgtcatgcggcaccggcaacatcgtctccgcagtgaacatgacctcccgcatgcttctgaaccggttcacgatggcccaccgaaagccgacctacgagcgcgatgtagacctcggggccggcacccggcacgtcgccgtggagccagaggtggccaacctggacatcatcggccagcgtatcgaaaacatcaagcacgagcataagagcacatggcactacgacgaggataacccttacaagacctgggcataccacgggtcctacgaggtcaagcctagcggcagcgcttccagcatggtaaacggggtcgtgaagctgctcacgaagccgtgggacgttattcccatggttacgcagatcgccatgaccgacaccacgccttttggacaacagcgggtgttcaaggaaaaagtagacacccgtaccccaaaggccaagcgggggaccgcccagattatggaagtcacggcgaagtggctctggggatttctgtccaggaacaagaaaccgaggatctgcacgcgcgaggagttcacacggaaggtgcggagcaacgctgccatcggcgccgtgttcgtcgacgagaaccagtggaactcggcgaaggaggccgtggaggacgagcggttttgggaccttgttcaccgggaacgggagctgcacaagcaagggaagtgcgcgacctgcgtctacaacatgatgggaaagcgcgagaagaagctgggagagtttggcaaggccaaggggagcagagctatctggtatatgtggctcggagcgcgtttcctggaatttgaggctctgggcttcatgaacgaggaccactggttttcacgggagaacagcctcagtggggtggagggcgagggattgcacaaactgggctacatactgagagacatcagcaagatcccggggggtaacatgtacgccgatgacacggccggctgggacacccggatcaccgaggacgacctccagaacgaagcgaagatcacggacattatggagcccgagcacgcgctgcttgcgaagtccatttttaagctgacgtaccagaacaaggtggtccgcgtgcagcggccggcgaagaacgggactgtgatggacgtcatcagccgccgcgaccagagaggctccggccaggtgggcacttatggcctgaataccttcacgaacatggaggcccaactcatccgccaaatggaaagcgaagggatcttctcgcccagcgagctggagacccccaacctggcaggccgggtgttagactggctcgagaagcatggggtcgagcgcctgaagaggatggcgatatctggtgacgactgcgtggtgaagccgatcgacgaccggttcgccacagccctcaccgccctgaacgacatgggcaaggtccggaaggacgtgccgcagtgggaacccagtaaaggatggaacgactggcagcaagtccccttctgtagccaccacttccatcagctaattatgaaggacggacgcgagatcgtcgtgccatgtcggaaccaagatgaactggtggggcgcgcgcgggtctcccagggcgcggggtggtcactgcgcgagacagcctgtctgggcaaatcttacgcccagatgtggcagctcatgtatttccaccggcgcgacctgcggctggccgcgaacgcgatctgcagcgccgtgccggtagactgggtccccacttccagaaccacctggagcatccacgcccatcaccagtggatgacaactgaggacatgttgtccgtgtggaaccgtgtatggatcgaggagaacccgtggatggaggacaagacccacatcagctcctggggagatgtcccctacctgggcaagcgggaggaccagtggtgcggcagcctgatcgggctcaccgcccgggctacgtgggccaccaatatccaggtggccatcaaccaggttcgccgcctgatcggcaacgagaactacctggactacatgacgagtatgaaaaggttcaagaacgagtcggaccccgagggggccctctggtaa

SEQ ID NO: 24374 - RNA, 9879 nt, synthetic construct
  misc_feature 1..9879: note = derived and/or modified CDS sequence (opt11) from DENV-1__FJ898404__SS-prME
  source 1..9879: mol_type = other RNA
tccgtcacgatgctgctcatgctgatgcccaccgctctggccttccacctgaccacccggggcggggaaccacacatgatcgttacaaaacaagaacggggcaaaagcctcctgttcaagacgagcgccggggtgaatatgtgcaccctcatcgccatggacctgggcgagctgtgcgaggataccatgacttacaaatgtccgcggattactgaggccgagcctgatgacgtcgactgctggtgcaacgccaccgatacctgggtgacgtacgggacctgcagccagacgggcgagcaccgtcgagataagagaagcgttgccctggcgccccacgtagggctgggacttgaaacgcgcaccgagacctggatgtccagcgaaggcgcctggaagcagatacagcgggtcgagacgtgggcgctccgccatcccggattcaccgtgatcgcactgttcttggcgcacgcgatcggcacttccataacccagaaggggattatcttcatcctcttaatgctggtgacgccaagcatggcaatgcggtgtgtaggcatcggctcccgagatttcgttgaggggttaagcggggccacctgggtggacgtcgtgctggagcacggttcctgcgtgaccaccatggccaaggacaaacccacgctggacatcgagcttctgaagacggaagtcaccaaccccgcggtgcttcggaagctctgcattgaggctaaaatctcaaacactacaaccgactccagatgccctacccagggcgaggccaccctgatggaagaacaggacgccaattttgtttgtcgtcgcaccttcgtcgaccggggatggggaaacggctgcggactgtttggcaaaggaagcctcatcacgtgtgccaagtttaagtgtgtgaccaagctggagggcaagatcgtacagtacgagaaccttaagtattcagtcatcgttaccgtgcacaccggcgaccagcatcaggtagggaacgagtctaccgagcacggcaccacagctacgatcactccccaagccccgacctccgaaattcaactaaccgactacggtgcgctgaccctggattgctcgccccgaacgggcctggatttcaacgaaatggtcctgctgaccatgaaggagaaatcttggttagtacacaagcagtggttcctggacttgcctctcccatggacctcaggggccagcacatcccaagaaacctggaaccggcaggatctgctggtgaccttcaagacggctcatgcgaagaagcaggaagtggtagtgctcgggtcccaagagggcgcaatgcataccgccctgacgggggcgaccgagatccagacctcgggcaccacgaccattttcgccggacacttaaagtgtcggttaaaaatggataaactgaccctgaaaggcatgagttatgtgatgtgcaccggcagtttcaaactcgagaaggaggtcgccgagacgcagcacggcaccgtcctggtccaaataaagtacgaaggcaccgacgccccctgcaagatccccttctccacccaagatgagaagggggtaacgcagaatggacggctgatcaccgccaatccgatcgtaaccgacaaagagaaacccgtaaacatcgaagcagaaccgcccttcggggagagttacatcgtaatcggcgcgggggagaaggccctcaaactgagctggttcaagaaaggctcaagcatcggcaagatgttcgaggccactgcgcgtggggcacggagaatggcgattttaggggacacagcttgggacttcggttccgtcggtggcgtgtttacgagcgttgggaagctggtgcaccagatcttcgggacggcgtacggggtcttattttccggtgtgagctggactatgaagatcggcatcggcgtgctgctgacgtggctcggtcttaactcccgctcgacctctctcagcatgacctgcatcgccgtcgggttggtaacactttacctgggagtgatggtgcaagctgacagcgggtgcgtcatcaactggaagggacgagagctcaaatgtgggtctggaatattcgtgaccaatgaggtgcacacctggaccgagcagtacaaatttcaggcggacagtccgaagcggctgagtgcggcaatcggcaaagcctgggaagagggggtctgcggtatacgatcagccactcggcttgagaacatcatgtggaagcagatctccaacgagctcaaccacatcctgctggagaatgacatgaagttcaccgtcgtcgtcggggacgtggtgggcatcctagcgcagggtaagaaaatgatccggccccagccgatggaacacaagtactcgtggaagtcctggggcaaagctaagatcatcggcgccgacgtccaaaataccacattcatcatcgacgggcccaacaccccggaatgtccagacgaccaaagagcctggaacatctgggaggtggaggactacggctttggcatcttcaccaccaatatatggttaaaattacgcgacagttacactcaggtgtgcgaccatcgcctcatgtccgcggccatcaaggacagtaaggctgtccacgcagacatgggctattggatagagtcggagaaaaacgagacttggaagctagcccgggcgtctttcatagaggtcaagacctgcatctggccgaagagtcacacgctgtggtccaatggagtgctcgagtccgagatgattatccccaagatctacggtggcccgatcagccagcacaattatcgccccggctatttcactcagaccgccggcccctggcaccttggcaagctggagcttgatttcgacttatgcgagggcactacggtcgtggtggacgagcactgcggtaaccggggacccagtctgcgaaccacgacggttacggggaagatcatccacgagtggtgttgcaggagctgcaccctgccgcccctccgctttaagggcgaggacggctgttggtacgggatggagatccggcccgtgaaggagaaggaggagaacctggtgaaatccatggtaagcgcgggcagcggagaagtggacagcttcagcctcgggctcttgtgtatctccatcatgatcgaggaagtgatgcgcagccggtggtccagaaagatgcttatgaccgggaccctggccgtcttcctgctcctgatcatggggcagctgacgtggaacgacctcatccggctttgcatcatggtgggcgcgaacgcgtccgaccgaatgggtatgggcaccacttaccttgcactcatggccacatttaagatgcgaccgatgttcgccgtgggacttctgttccgacgcttaacgagcagagaggtactactgctcaccatcgggctgagtctggttgcctccgtcgagctccccaactctctggaggagctcggggacgggcttgccatgggcattatgatcctgaagctgctcacagacttccagagccaccagttgtgggccaccctattgtcgttgacattcatcaagaccactctatccctccactatgcttggaagaccatggcgatggtgcttagcatagcgtcgttgttccccctctgcctgagcacaacctctcagaagaccacctggttgcccgtcctattaggtagcctggggtgcaagccactcacgatgttcctgatcaccgagaccaagatctggggacgcaagagctggccgctcaacgaggggattatggccgttggcgtggtgtctatactcctgtctagtctgttaaagaacgatgttcccttagccgggcctctgattgccggcggcatgttgattgcctgctacgtgatctcaggcagcagcgcggacctgtccctggaaaaggccgctgaggtgagctgggaggaggaggccgagcacagtggggcttcgcacaacatcctagtcgttgtgcaggacgacgggacgatgaagatcaaagacgaggagcgggacgacacccttacgatcctgctcaaagcgaccttactggccgtctccggtgtgtatccccttagcataccggctaccctgtttgtgtggtatttttggcagaagaaaaagcaaaggtctggcgtcctttgggacacgccctcgccgccagaggtagagcgggctgtgctggacgacggcatctaccgcatcatgcagaggggcctcctggggcgcagtcaggtcggcgttggggtcttccaggagaacgtctttcatacgatgtggcacgtgacccggggcgcagtgctgatgtaccagggcaagcgactcgagcccagctgggcgtccgtgaagaaggacctgattagctacgggggcggatggcggttgcagggcagttggaacaccggagaggaggtccaagtgatcgcggtcgaaccaggtaaaaatccgaaaaacgtgcaaaccgctcccgggacattcaagacgcccgagggcgaagtgggcgctattgccctcgacttcaagcccggcacatccggctcccccattgtcaaccgtgaaggaaagatcgtgggcctttacggcaatggagtagtcacgacgtccggcacctacgtttccgcgatagcccaggctaaggcctcccaggaggggccgctgcccgagattgaggacgaagttttcagaaagcgcaatctcaccatcatggacctgcaccccggctctgggaagacacgtcgctacctgccggcgattgtccgggaggcaatcaagcgcaagttgcggactttaatcctggcgcccacccgcgtagtagccagcgagatggccgaggcactcaagggcatgccaatccgctatcagactaccgccgtcaaatcggagcacacgggcaaggagatcgtagaccttatgtgccacgccaccttcacaatgagactgctttctcccgtgcgggttccgaactacaacatgattattatggacgaggcccacttcactgatcccagctccatcgctgctcgcggctatatcagcacgcgcgttggcatgggggaggctgcggccatcttcatgaccgccacccctcccggatccgtcgaagcgttcccgcaaagcaacgccgtaatccaggacgaggagcgggacatccccgagaggtcctggaacagcgggtacgagtggatcaccgatttccccggtaagacggtgtggttcgttcccagtattaagtccggcaacgacatcgcaaactgcctgcggaagaacggtaagagagtcatccagctctcccgtaagaccttcgataccgagtatcagaagaccaagaacaatgactgggactacgtggttacgacggacatcagcgagatgggcgccaactttcgcgcggaccgcgtcatagatccgcgtcgttgtctcaagcctgttatcctgaaagacgggcccgagcgcgtcatcctcgcaggccccatgccggtgacggtggcctccgccgcccaacgcagagggagaatcggccgcaaccacaataaggagggggaccagtacatctatatgggacagcccctcaataacgacgaggaccacgcgcactggaccgaggccaagatgctgctggacaacatcaacacgcccgagggcatcatccccgccctcttcgagccagaacgggagaagagtgccgccatcgacggtgagtaccgcctccgaggtgaggcgcgcaagacgttcgtcgagctaatgcggcgcggtgacctccccgtttggctgtcgtacaaggtggccagcgaaggcttccagtacagcgaccgcagatggtgctttgacggtgagcgcaataaccaagtcctggaggagaacatggatgtagagatctggaccaaggagggggagaggaagaagctccgcccccgttggctggacgcacgcacttactccgaccccctcgcactccgggagttcaaagagttcgcagcgggccgtcggagcgtgtcaggtgacctgatcctggaaatcggtaaacttcctcagcatctgacgcaacgcgcgcagaatgccctggacaatctcgtcatgcttcacaacagcgagcagggcggtagagcctaccgccacgcgatggaggagcttcccgacaccatcgagacactcatgctcctggcactcattgccgtgctgacgggcggggtgaccctgttctttcttagcggccggggactcggcaagacgtccatcggcctgctttgcgtcatggcaagcagcgtactgctgtggatggccagcgttgagccccactggatcgcggccagtatcattcttgagttcttcctcatggtcctgctcatcccggaaccggaccgccagcggacgccccaggacaaccagctcgcatacgtggtgataggtctcctatttatgattcttacggtcgctgccaatgagatgggcctgctagagactacgaagaaggacctggggatcggacatgtggcggtggagaaccaccaccacgccaccatgcttgacgtggacttacaccccgcctccgcttggaccctatacgccgtggcaaccacaatcatcaccccgatgatgcgccacaccatcgagaacaccacggccaacatcagcctgacagccatagctaaccaggccgcgattctcatggggttagacaagggctggcccatttcgaagatggatatcggcgtgccactactcgcacttgggtgctacagccaggttaaccccctgaccctgacagccgcagtgttaatgctggtggcgcactacgccatcatcggcccggggctccaggccaaggcgacgcgggaagcccagaagcgcacggccgccggcattatgaagaaccctaccgtcgatgggatagttgctatcgacctggacccggtagtctatgatgccaagtttgagaagcagctgggacagatcatgttactgatcctgtgcacctcccagatactcttaatgagaacgacctgggctttatgcgaatcgatcaccctcgcgaccggacccctgacgacactgtgggagggctcgcccggcaagttctggaatactaccatagcagtttctatggccaacatctttcgggggagctacctcgccggcgccggcctggctttctctctgatgaaatccctagggggcgggcggcggggcacgggtgcccagggcgaaaccctcggcgagaagtggaagcgccaactcaaccaactctccaagagcgaatttaacatctataaacggtccggcataatggaagtcgaccgcagtgaggccaaggagggccttaagcgcggcgaaaccacccgccacgccgtttcacggggcacggctaagctgcgctggttcgtggaaagaaacctggtgaagcccgagggaaaggtcatcgacctcggctgcggtcgtggaggctggagctactactgcgccgggctgaagaaggtgacggaggttaaaggctacacaaagggcgggcccggccatgaggaacccatccccatggccacctacggttggaatcttgttaaactgcacagcggcaaagacgttttcttcacgccgcccgagaaatgcgacacccttctatgcgacatcggggagagctcccctaatccgaccatcgaagaaggtcggaccctgcgtgtgctgaagatggtcgagccctggctccggggtaaccaattctgcattaagatcctcaacccatacatgcccagcgtggtcgagacgctggagcagatgcagcgcaaacacggcggtatgcttgtcaggaatccgctctcccgcaacagcacgcacgaaatgtactgggtgagctgcgggaccggcaacatagtgtctgcagtcaacatgacctccaggatgctgctgaatcgcttcacgatggcccaccgcaaacccacgtacgagagggatgtggatctcggggcgggcacccgccacgtggccgtcgaaccagaggtagccaacctggacatcataggccagcgtatcgaaaacatcaagcacgagcacaagagcacctggcactacgatgaggacaacccctataagacgtgggcgtaccatgggtcttacgaggtgaaacctagcggttctgcctctagcatggtgaacggggtcgtcaagctgctcaccaagccctgggacgtgatcccaatggtgacccagatcgccatgacagacaccacaccgttcggccagcagcgcgtcttcaaggaaaaagtagacaccagaaccccgaaggccaagcgcggaaccgcccaaatcatggaggtaacggctcggtggttgtggggcttcctgtccaggaataagaagccccggatatgcactagagaggagttcacccgaaaggtgcgctcgaacgccgcgatcggagccgtgttcgtggacgagaaccaatggaactccgccaaggaagccgttgaggacgagcggttctgggacctggtacagaaggagcgtgagcttcacaaacaagggaaatgcgctacctgtgtgtacaacatgatgggcaagcgggaaaagaaactgggcgagtttggaaaggctaaagggagccgcgccatatggtacatgtggttgggcgcccggtttctggagttcgaggccctgggcttcatgaacgaagatcactggtttagtcgcgaaaattctttgtccggggtcgagggtgagggactgcataagctgggctacatccttcgtgacattagcaaaatccccgggggcaacatgtacgctgatgatacggccggttgggacacgcgtatcaccgaggatgatctgcagaatgaggccaagataactgacataatggagccggaacacgccttgctcgctacgagcatcttcaagctgacctaccaaaacaaggtggtgcgagtccagcgcccagcgaagaacgggactgttatggacgtgataagccgacgcgaccaacgtggctccgggcaggtcggcacgtacggcctgaacacgttcaccaacatggaagcccagctcatacggcagatggagtccgagggaatcttcctcccctcagagctggagactcccaatttggccgagcgcgttctggattggttggagaaatacggggtggagcgcctaaagagaatggccatcagcggggacgactgtgtcgtgaaaccgatcgacgaccgcttcgcaacggcgctaaccgccctgaatgatatgggcaaagtccggaaggatattccacagtgggagccctccaaagggtggaatgactggcaacaggtccccttttgcagccatcacttccatcagctcataatgaaggacggtagggaaatcgtggtcccatgccgcaaccaagacgagctggtcggccgcgcacgcgtgtctcagggagccggttggtcgttacgggagaccgcttgcctcggaaaatcgtacgcgcagatgtggcagctcatgtacttccaccgacgggatctgcgcctcgccgccaacgccatctgctccgccgtccccgtagactgggtgcccacctcccggaccacgtggtctatccacgcacaccaccagtggatgaccaccgaggatatgcttagcgtctggaaccgtgtctggatagaagagaatccttggatggaagacaagacccacgtctccagctggggcgacgtgccgtacttagggaagcgggaagaccaatggtgtggctctctaatcggccttactgcacgtgccacctgggcgtctaacatccaggtagcaataaaccaggtacgccggctgatcgggaacgagaattaccttgactatatgacctccatgaagcgcttcaaaaacgagggcgaccccgaaggggccctttggtaa

SEQ ID NO: 24375 - RNA, 9879 nt, synthetic construct
  misc_feature 1..9879: note = derived and/or modified CDS sequence (opt11) from DENV-1__GQ199840__SS-prME
  source 1..9879: mol_type = other RNA
agcgtgaccatgctgctcatgttgatgcccaccgccctagccttccacctcacgacccggggcggggagccccatatgattgtgagcaaacaggagcgggggaagagcctgctgttcaaaaccagtgccggggtgaacatgtgcaccctcatcgccatggacctgggcgagttttgcgaggacaccatgacctacaagtgccccaggatcacagaggcggagcccgacgacgttgactgctggtgcaacgcgactgacacgtgggtcacctatgggacctgcagccagaccggcgagcaccggcgggacaagcgctccgtggccctggcgccccacgtgggccttgggctagagacacgcactgagacatggatgtcatccgagggcgcctggaagcagatccagcgggtcgagacctgggccctgcgccatccgggcttcacggtgatcgccctcttcctggcgcacgcgatcggcacctccatcacccaaaagggaatcatcttcatcctgctcatgctggtgacgccctccatggcaatgcggtgcgtcggcatcggatcccgcgacttcgtcgaggggctcagcggcgccacatgggtggacgttgtgctcgagcacgggtcctgcgtgacaaccatggccaaagacaagccaaccctggacatcgagctgctcaaaacggaagtcaccaacccagctgtactacggaagctttgcatagaagccaagataagcaataccacaacagactcgcgctgtccgacccagggagaagccaccctcgtagaagagcaggacgccaatttcgtctgccggcgcaccttcgtagaccgcggctgggggaacggttgtgggctgttcggtaaggggtccctgataacgtgcgccaagttcaagtgcgttaccaaactcgagggcaagatcgtccagtacgagaacctgaagtacagcgtgatcgtgaccgtccacaccggcgaccagcaccaggtggggaacgaatccacggagcatggcacgaccgcgaccatcacgccccaggcccccagcacagagatccagttgaccgactacggggccctcaccctggactgctcgccccggacggggctggacttcaacgagatggtcctcctgacgatgaaggagaagagttggctggttcacaagcagtggttcctcgacctgccgctgccctggacaagcggcgcctccaccagccaggagacgtggaaccggcaggacctcctggtgacattcaagactgcccacgcaaagaagcaggaggtggttgtgttaggctcccaggagggcgccatgcacaccgcgctcaccggcgccacggagatccagacaagcggaaccaccacgattttcgccgggcacttaaagtgtcgcctgaagatggacaagcttaccctgaagggcatgtcctacgtcatgtgcaccgggagcttcaagctggagaaggaggtggcggagacccagcacggcacggtcctcgtccagatcaaatatgagggcacagacgctccatgcaagatccccttctccacccaggacgagaagggggtgacccaaaacggccggttgatcactgccaacccgatcgtaaccgacaaggagaagcccgtcaatatcgaggccgagccgcccttcggtgagtcgtacatcgtgatcggcgcgggcgaaaaggcccttaagctgtcctggttcaagaaggggagctccatcggcaagatgtttgaggccaccgcgagaggggcccggcgcatggcgatcctcggcgataccgcgtgggacttcggaagcatcggcggcgtgttcacgtccgtaggtaaactggttcaccaaatcttcggcaccgcctacggtgtgctgttctcaggcgtcagctggaccatgaaaatcgggatcggcgtgctcctgacctggcttggcttaaacagccgctcgacgagcctgtccatgacgtgtatcgctgtgggcctggtcacgttatacctgggcgtgatggtacaggccgacagcgggtgcgtcatcaactggaaaggccgggagctcaagtgcgggagcggcatattcgtgaccaacgaagtgcacacatggaccgagcagtacaagttccaggcggactcgccaaaacgcctctcggccgccattggcaaggcctgggaggagggtgtctgcggcatccggagtgccacccgcctggagaacatcatgtggaaacaaatcagcaacgagctgaaccacatcttactggagaacgacatgaagttcaccgtagtggtcggtgacgtggccggcatcttggcccaggggaagaagatgatccggcctcaacctatggaatataagtactcctggaagtcgtggggcaaggccaagatcatcggcgccgacgtccagaacaccacgttcatcatcgatgggccgaacacaccggaatgccccgacgaccagcgcgcgtggaatatctgggaggtcgaggactacggcttcggtatcttcacgaccaacatctggctaaagctgcgggactcctatacccaggtgtgcgaccaccgcttaatgtctgccgccatcaaggactccaaggccgtgcacgccgacatgggatactggatcgagtcggagaagaacgagacctggaagctcgcgcgggcatccttcatcgaggtcaagacctgcatctggcccaagagccacaccctgtggtccaacggcgtgctggagagcgagatgatcatccccaagatctacggtggcccgatctcccagcacaattaccggcccggatactttacacagaccgccgggccctggcacctcgggaagctggagctggatttcgacctctgcgagggaaccacagtggtcgtggacgagcactgcggcaaccggggaccatccctgcgcacaaccaccgtgactggcaagatcattcatgagtggtgctgtcggtcatgcacgctgcctccccttcgctttaagggggaggacggctgctggtacgggatggagatccgtcccgtcaaggagaaggaagagaacctagtcaagagcatggtgagtgccggctccggtgaggtcgacagcttttccctggggctcctgtgcatcagcatcatgattgaggaggtaatgcgctcccggtggagccggaaaatgctgatgacaggcaccctcgccgtgttcttcctgctgatcaccgggcagctcacgtggaacgacctgatccgcctgtgcatcatggtcggcgcgaacgcctccgaccgcatggggatgggcaccacctacctcgccctgatggcgacgttcaagatgcgccctatgttcgccgtgggacttctttttcggcgcttaacgtctcgagaggtactgctcctgaccatagggctgtccctcgtcgctagcgtggagctgccaaacagtctggaggagctcggcgatgggctggccatgggcattatgatcctgaaactcctgactgacttccagtcccaccagctatgggcgaccctcctgtccctgacgtttatcaagaccacctttagcctccactacgcctggaagaccatggcgatggtcctgtcgatcgtcagcctattcccactctgtctttctacgacaagccagaagaccacctggctgcccgtgctcctgggatccttaggatgcaagccgctaaccatgttcctaatagcagagaacaagatctggggccgcaagagctggcctctcaacgaggggatcatggccgtcggcattgtgtccatattgctgtcgtcactgctcaagaacgatgtccccctggcgggtcccctgatcgccggcggcatgctcatcgcgtgctacgtaatctccggcagctccgccgacctgagcctggagaaggcagccgaagtgtcctgggaggaggaggcagaacacagcggcgcgagccacaacatcctcgtggaggtccaggacgacgggaccatgaagatcaaggacgaggagcgggacgatacgctgacgatcctgctcaaggccaccctgctggccgtgagcggcgtttacccgctctccatccccgccactctgttcgtctggtacttctggcagaagaagaagcagcgcagcggggtgctgtgggacatccccagcccacccgaagtggagcgggccgtcctcgacgacggcatttaccgcatcatgcagcggggtcttctggggcgcagccaggtaggcgtaggcgtgttccaggagaacgtgttccacaccatgtggcatgtgacacggggagcggtcctgatgtaccaggggaagcgcctcgagccttcgtgggcgagcgtgaaaaaggaccttatcagctacgggggaggctggcggctgcagggcagctggaacaccggagaggaagtgcaggtcatcgccgtggagcccggcaagaatcccaagaacgtgcagacggccccagggacgttcaagacttcggagggcgaggtcggcgccattgcgctcgactttaaacccgggaccagcggtagccccatagtgaaccgcgagggaaagatcgtgggcctgtacggaaacggggtcgtgactacctccggtacctacgtgagcgccatagcccaggccaaggcgtcccaggagggaccactgccggagatcgaggacgaagttttccggaagcgcaacctcaccatcatggacttgcaccccggcagcgggaaaacgcggcgttacctgcccgccattgtgcgagaggccatcaagcgcaagctccggaccctgatcctggcccccaccagggtggtcgcctccgagatggcggaggccctcaaaggcatgcccatcagataccagaccacggccgtcaagagcgagcacactggcaaggagatcgtggacctgatgtgccacgccaccttcacaatgcggctcctctcccccgtgcgcgtgcccaactacaacatgatcatcatggatgaagctcatttcacggacccgagcagcatcgcggcgcgggggtacatcagcacccgcgtggggatgggggaggctgccgctattttcatgaccgcgacgccgccaggctcagttgaagccttcccccagagcaacgccgtgatccaagacgaggagcgcgacatcccggagcggtcctggaactccgggtacgagtggattacggatttccccggcaagaccgtgtggttcgtcccctccatcaagagcggcaatgacatcgccaactgcctgcggaagaatgggaaacgcgtgatccagctgtcacggaaaaccttcgacaccgagtaccagaagacgaagaacaatgactgggactacgtagtcaccaccgacatcagcgagatgggcgcgaacttccgagctgaccgcgtcattgacccgcgccgttgcctcaaacccgtcatcttgaaagacggacccgaacgcgtcatcctggccggtcccatgcccgtcacagtcgccagtgccgcgcagcgtcgcgggcggatcggccgcaaccacaacaaggaaggcgaccagtacatctacatggggcagccgctcaacaacgacgaagatcacgcccactggacagaagccaagatgctgctagacaacatcaatacccccgagggcatcatccccgccctcttcgagcccgagcgggagaagtccgccgcgatagatggggaataccgccttcgcggcgaggcccgaaagaccttcgtcgagctgatgcgccgcggggacctcccggtctggctgagctacaaggtcgcctcagagggcttccagtactccgaccgccgctggtgtttcgacggtgagcgcaacaaccaggtgctggaggagaacatggatgtggagatctggaccaaggagggggagcgaaagaagctcagaccccgttggctggacgcccgcacgtactccgacccgctggctctccgggagtttaaggagttcgcggccggccgccggagcgtctccggagacctcatcctggagatcggcaaactcccccagcacctgacccagcgtgcccaaaacgctctagacaacttagtgatgctgcacaatagcgagcagggcgggcgggcgtaccgccacgccatggaggagctgcccgacaccatagagaccctcatgctgctggccctcatcgccgttctgacgggcggggtcacactgttcttcttgagcggccgggggctgggcaaaaccagcatcggcttgctctgcgtaatggcatcatcagtgctgctgtggatggcgtccgttgagccacactggatcgcggccagcatcatcctcgagttctttcttatggtgctgctcatccccgagccagaccgccagcggaccccacaggacaaccaattagcgtacgttgtcatcgggttgctcttcatgatcctgaccgtggcagcgaacgagatgggcctgctcgagacgacgaagaaggacctggggataggtcacgttgccgccgagaatcaccaccacgccgccatgctcgacgtagacctccatcccgcgtccgcctggaccctatacgccgtggccaccacaatcatcactccgatgatgcgccacaccatcgagaacaccacagccaacatcagcctgaccgcgatcgccaaccaggccgccatcctcatggggctggacaagggctggccaatatcaaaaatggacattggcgtgccactgctcgcactggggtgctactcacaggtcaaccccttaaccctcacagcggccgtgctgatgctggtggcccactacgccattatcggccccgggctccaggcgaaggctacaagggaggctcagaagcgcaccgccgccgggattatgaagaacccgaccgtcgatgggatcgtggcgatcgacctggaccctgtggtatatgacgccaagttcgagaagcagttaggtcagataatgctcctgatcctctgcacctcgcagatcctcctgatgcgcacgacctgggcgttgtgcgagagcatcaccctcgccaccggccctctcacaaccctgtgggagggctctcccggcaagttttggaacaccaccattgccgtaagcatggcgaatatcttccgggggagctacctcgccggcgcgggcctggccttctccctcatgaagtctctaggtggggggcgccggggaacgggggcgcagggggaaactctgggcgagaaatggaagaggcaactgaaccagctctctaagagcgaattcaacacctacaagcggtccggtatcatggaggtggaccgcagcgaagccaaagagggactaaagcgtggggagaccacgaaacacgccgtctcccgcggaaccgccaagctgaggtggttcgtggagcgtaacctcgtaaagcctgaagggaaggtcatagacctgggctgcggccgcggcgggtggagctattactgcgctgggctgaaaaaggtgaccgaggtcaaggggtacaccaaggggggccccggacatgaggagcccatccccatggcaacgtacgggtggaacctggtcaagctccactccggtaaggacgtgttcttcatccctcctgaaaagtgtgacaccctgctgtgcgacatcggggagagcagtcccaaccccaccatcgaggagggtcggaccctccgggtgttgaaaatggttgagccgtggctccgggggaaccagttctgcatcaagatattgaacccctacatgcccagcgtggttgagacgctggagcagatgcagcggaagcacggcgggatgctagtccgcaaccccctctcccggaactcgacccatgagatgtattgggtgtcctgcgggacaggaaacatcgtaagcgcggtcaacatgacgtcccgcatgctgctgaaccggttcaccatggcacatcgcaagccgacatacgagcgcgacgttgacctcggggctggtacccggcatgtcgcagtcgagcccgaggttgctaatctggacattatcggccagcgcatcgaaaacatcaaacacgagcacaagagcacttggcactacgacgaggacaatccctacaagacgtgggcctaccacgggagttacgaggtgaagcccagcggcagcgcctccagcatggtcaacggggtggtcaagctgctcacgaagccatgggacgtgatccctatggtcacccaaatcgccatgaccgacaccacgcccttcggccagcagcgggtcttcaaggagaaggttgacacccgcacccccaaggccaagcgtgggactgcgcagattatggaggtgacggccaagtggctttggggcttcctgtcccgaaacaagaagccgcggatatgtacccgcgaggagttcacccggaaggtccgcagcaacgccgccatcggcgcggtgttcgtggacgagaaccagtggaactccgccaaagaggccgtcgaggacgaacggttctgggacctcgtacatcgcgagagggagcttcataagcaaggcaagtgcgcaacctgcgtgtacaatatgatgggaaagcgcgagaagaagttgggggagttcggcaaggccaaggggagccgtgctatatggtacatgtggctcggtgcccgcttcctggagtttgaggccctgggcttcatgaacgaagaccactggttttcccgagagaacagcctttccggggtcgagggcgaagggttacacaaactcggctacatcctccgcgacatctcaaagattcccggagggaacatgtacgccgacgacacggccggctgggacacccggatcacggaggacgacctgcagaacgaagcgaagattacggacataatggagcccgagcacgccctgctcgcaaagtccatcttcaaactgacctaccagaacaaggtggtacgcgtccaacgtccggcgaagaacggaacggtgatggacgtgataagccgccgcgaccaacggggatccgggcaggtcggcacctatggcctgaacaccttcacgaatatggaggcccaactcatccgccagatggagtctgaaggcatcttctcgcccagcgagcttgagacccccaacctggcgggccgagtgctcgactggctggagaaatacggggtggaacgcctgaagcggatggccatttccggcgacgactgcgttgtgaagcccatcgacgaccgctttgccaccgccctcactgccctgaacgacatgggtaaggtgagaaaggacatcccccaatgggagcccagtaagggctggaacgactggcagcaagtcccgttctgtagccaccacttccaccagttgatcatgaaggacggccgcgaaatcgtggtgccttgccggaaccaggacgaactcgtcgggcgcgctcgggtgtcccagggcgccgggtggagcctgcgtgagactgcatgtctgggcaagtcctatgcccagatgtggcagctcatgtacttccaccggcgcgacctgcggctggcggctaacgccatctgcagcgctgtgccggtagactgggtgcccacctcccgcaccacctggagcatccacgcccaccatcagtggatgacgaccgaggacatgctctccgtgtggaaccgagtttggatagaagagaacccctggatggaggacaagacccacattagctcctggggcgacgtgccctatctgggcaagcgcgaggaccagtggtgcggcagcctgatcgggctcaccgcgcgggccacgtgggccactaacatccaggtggcgatcaaccaggtgcgtcgcctgataggcaatgagaactatctagactatatgacctccatgaagcggttcaagaatgagagcgacccggagggggcgctctggtga

SEQ ID NO: 24376 - RNA, 9879 nt, synthetic construct
  misc_feature 1..9879: note = derived and/or modified CDS sequence (opt11) from DENV-1__FJ898405__SS-prME
  source 1..9879: mol_type = other RNA
tccgtgaccatgctactaatgttaatgcccaccgccctggccttccacctcaccaccaggggaggggaaccccacatgatagtgaccaagcaagagcgcggcaagagcctgctcttcaagaccagtgcgggggtgaatatgtgcacattaatcgcaatggacctgggggagttatgtgaggacaccatgacctacaaatgcccccggatcaccgaggccgagcccgacgacgtagactgctggtgcaacgccaccgatacctgggtgacctacgggacctgctcccagacgggagagcacagacgcgacaagaggagcgtggcccttgcaccccacgtagggctcgggcttgagacccggaccgagacgtggatgtccagcgaaggcgcgtggaagcagatccagcgggttgagacctgggctttgcgccaccccgggttcaccgtgatcgccctgttcctcgcgcatgccatcgggacctcgattacgcagaaggggatcatcttcatccttctaatgttggtgacccccagcatggccatgcgttgcgttggcatcggctcccgcgacttcgtcgagggactctctggggccacctgggtggacgtcgtgctggaacacgggtcctgcgtaaccaccatggccaaagataagcctacgctggacattgagctcctgaagaccgaggtcacgaaccccgcggtcctgcggaagttatgcatcgaggccaaaatcagcaacaccactaccgactcccggtgcccaactcaaggcgaggccaccctgatggaggagcaggacgcaaacttcgtgtgccggcgcacctttgtagatcggggttgggggaacggctgcggcttgttcggcaaggggagcctcatcacatgcgccaaattcaagtgtgttacgaagctggaaggcaagatcgtacagtatgagaacttaaagtactccgtaatcgtgaccgtgcacacgggcgaccagcaccaggtcgggaatgagagcaccgagcacgggaccacagcgaccataacgccccaagcacccacatccgagatccagctcaccgactacggcgctttgaccctggactgcagccccagaacgggtctcgacttcaacgaaatggtgctactaacgatgaaggagaagtcctggctggttcacaagcagtggttcttggacctgccgctcccttggacctcgggggccagtacctcgcaggagacctggaaccggcaggatctcctggttacgtttaaaactgcccatgcgaagaagcaggaagttgtagtgctaggcagccaggagggcgccatgcataccgcactgacaggagcgaccgaaatccaaacctccggtactactaccatcttcgccgggcacctgaagtgcagactaaagatggacaagctgaccctgaagggcatgagctacgtgatgtgcaccggctccttcaagcttgaaaaagaggttgcagagacgcaacacggtaccgttttggtgcagatcaagtacgaaggaaccgacgccccctgcaagatcccttttagcacccaagacgaaaagggagtcacacaaaacggccggctaatcaccgccaacccaatcgtgactgacaaggagaaacccgtgaacatcgaggccgaaccgcccttcggggagtcctacatagtgatcggcgcgggcgagaaggccctgaaactctcctggttcaaaaagggaagcaacataggcaagatgtttgaggcaaccgcacgcggggcccggcgtatggcaatcctgggcgacacggcctgggacttcggtagcatcggcggagtgttcacctcggtggggaagttggtccaccaaatatttggcacagcctacggagtgctgttcagcggagtgtcctggaccatgaagatcgggatcggtgtacttctgacgtggctcggcctgaatagccgcagcacctcactatccatgacctgcatcgcggtggggctggtcaccctgtatctgggcgtcatggtacaggccgactctgggtgcgtaatcaactggaaaggcagagagcttaaatgcggctccggcatattcgtgacgaatgaggtgcacacctggaccgaacagtacaagttccaggcggatagcccgaagcgactgagcgccgcgattggcaaggcctgggaggaaggcgtgtgcggaatccggtcagccactcgattagagaacatcatgtggaagcaaattagcaacgagctcaaccacatcctactggagaatgacatgaagttcaccgttgtggtaggcgacgtcgtgggcatcctcgcacaggggaaaaagatgattcggcctcagcccatggagcacaagtactcctggaagtcctggggcaaggcaaaaatcattggcgccgacgtgcagaacacgacgttcatcatcgacgggcccaacacccctgagtgccccgatgaccagcgggcctggaatatctgggaggtagaggactacggctttggcatattcaccacgaacatatggctgaagctgcgggactcctatacacaggtgtgcgaccaccgcctcatgagcgcggccataaaggactcgaaggcggtccacgccgacatgggctattggatcgagagcgagaagaacgaaacttggaagctggcccgggcgtccttcatcgaagtgaagacctgcatctggcccaagtctcacaccctttggtctaatggagtgctcgagagcgagatgatcatccccaaaatttatgggggcccgatttcccagcacaactatcggcccgggtacttcacccagaccgcagggccctggcacctaggcaagttggagctcgattttgacctgtgcgagggcacgacggtcgtggttgatgaacactgcggaaacaggggtccgagcctacgaacaaccaccgtcacgggcaagatcatacatgagtggtgctgccgtagctgcacccttccacctctccgcttcaagggcgaggacggctgttggtatggaatggagatccgacctgttaaagagaaggaggagaacctggtcaagtccatggtatccgccggctcgggcgaggttgacagcttctccctcgggctgctgtgcataagcattatgatcgaggaagttatgcgatcccggtggagccgcaaaatgctcatgaccggcaccttggccgtgttcctgcttctgatcatggggcaactgacgtggaacgatctcataaggctctgcattatggttggcgcaaacgcgtctgaccggatgggcatgggcaccacctacctggccttgatggccacgtttaagatgcgtccgatgttcgccgtgggattactgttccggaggctaacgagccgtgaagtgctgctactcacgatcgggctgtctctggttgccagcgtggagctccccaactcccttgaggagttgggcgacggactcgcgatgggaatcatgatactgaagctgctcaccgacttccagagccaccagctgtgggccaccctgctctcactgacgttcatcaagaccaccttatcactgcattacgcgtggaagactatggccatggtactttccatcgtgagtctgttccccttgtgcttatccacgaccagccagaaaaccacctggctccccgtactcctgggcagtctggggtgtaagcctctcacgatgtttctaatcgctgagaacaagatatggggccgaaagagctggccccttaacgaggggatcatggccgtaggcgtggtttccatcctcctgtcaagcctgctcaaaaacgacgtgccccttgcagggcccctgatcgccggcggcatgctcatcgcctgctacgtgatctcgggcagctccgccgacttgagcctggaaaaggccgccgaagtgtcgtgggaggaggaggccgagcacagcggcgcgtcccacaacatcctcgtcgaggtccaagacgacggtaccatgaaaatcaaagatgaggagcgggacgacaccctgaccattctgctcaaggcgacactgttagctgtttctggcgtctatcccctttccatcccggcgactctgttcgtatggtatttttggcagaagaagaagcagcgcagcggggtgctctgggataccccatccccgcccgaagtcgagcgggccgtgctggacgacggcatctaccgcatcatgcagcggggcctcctgggccgcagccaggtgggcgtcggggtcttccaagagaatgtcttccataccatgtggcacgtcacccggggagcggtgctgatgtatcaaggaaagcgtctcgagccctcgtgggcgagcgtcaagaaggacctgatcagttacggcggagggtggcggctgcagggaagctggaacactggggaggaggttcaggtgatcgccgtggagcccggtaaaaaccccaagaacgtgcagaccgcgccggggacgtttaagacgccggagggggaggtgggcgcaatcgccctcgacttcaagcctgggacgtccggcagcccaatcgtgaatcgcgaggggaagatagtcggcctgtatggcaacggtgtggtcactacctccggcacctacgttagcgcgatcgcccaggctaaagcgagccaggagggtccgctgcccgagatcgaggacgaggtttttcggaagcgcaacttgacaatcatggacctgcatcccggctccgggaagacccggcgctacctgccggctatcgtgagggaagcgatcaagcgaaagctccggaccctgatccttgccccgacacgcgtcgtggccagcgagatggccgaggcgctcaagggaatgcccatccgataccagacaacagccgtgaagtccgagcacacaggcaaggagattgtcgacctgatgtgccacgcgactttcacgatgcggcttctcagccccgtgcgcgttccgaattacaacatgatcatcatggatgaggcccatttcaccgatcccagttctatcgccgcgcggggatacatctcgacccgtgtcgggatgggggaggccgcggcaattttcatgactgcgacgccgcccggcagcgtggaggcgttcccgcagtccaacgctgttatccaggacgaggagcgcgacatacccgaacgcagctggaacagcgggtatgagtggatcaccgacttccctggtaagacggtctggttcgtgcccagcataaagtcgggaaacgacattgccaactgcctacggaagaacggtaagcgcgtgatccaactgtcacggaagaccttcgacacagagtaccagaagaccaagaataatgactgggactacgtcgttaccaccgacatctccgagatgggcgcgaatttccgcgcggaccgtgtcatcgacccgcgccgctgtctcaagcccgtcatccttaaggatgggcctgagcgcgtgatcctcgccggcccaatgccggtcactgtggccagcgccgcccaacggcgcggcaggatcggccgcaaccacaacaaagagggagaccagtatatttatatgggacaaccattgaacaacgacgaggaccacgcgcactggaccgaagcaaagatgctcctggacaatataaacacccccgaggggatcatccctgccttgttcgagccggagagggagaagagtgccgccatcgatggggagtatcgcttgcgcggcgaagcgaggaaaaccttcgtggagctgatgcgtcgcggggatcttcctgtctggctgagctacaaggtggccagcgagggcttccaatacagcgatcgcaggtggtgcttcgacggcgagcgcaacaaccaggtgctggaggagaacatggacgtagagatctggacaaaagaaggggagcggaaaaagctacgcccgcggtggctggatgcccgtacttactcggacccactggccctcagggagttcaaggagttcgccgcgggccgccggtccgtgtcaggggacctgatcctcgagatcggtaagctcccgcagcacctgacgcaacgcgcgcagaacgctctggacaacttggtcatgctgcacaattccgagcaaggcgggcgggcctaccggcacgcaatggaggaactgcccgacacaatcgagacgttaatgctactggccctgattgccgtcctgaccggcggagttaccctcttctttctcagcggccggggactaggcaagacctccatcggcttgctctgcgtgatggccagctcagtcctcctgtggatggccagcgttgagcctcactggattgcggcttccatcattctcgagttttttcttatggtcttactcattcccgagccggatcgacagcggactccccaggacaaccagctggcatacgtcgtaatcgggctcttattcatgatcctgacggtagccgcaaacgagatgggccttctagagaccactaagaaggacctgggcatcggccacgtcgcggtggagaaccaccatcacgccaccatgctggacgtggacctccaccctgctagcgcctggaccttatacgccgtcgcgacaaccatcatcaccccgatgatgcgacatacaatcgagaacaccacggcaaacatttcactgaccgccattgccaaccaggctgctatattaatggggctggataagggatggcccattagtaagatggatatcggagtgcccttgctcgcccttgggtgctactcccaggtgaaccccctcacgctcaccgccgccgtcctgatgcttgtagcgcattacgccattatcggaccggggctacaagccaaagccacgcgggaagcccagaagcgcacggcggcaggcattatgaagaatcccacagtagacgggattgttgccatcgacctggaccccgtggtgtacgacgctaagttcgagaaacagctgggccagatcatgctcttgatactttgcacttcacagatcctcctgatgcgtacaacgtgggccctctgcgagtccatcactttagcgaccggccctctgaccacactctgggaagggagccccggcaagttctggaacaccaccatagccgtctccatggccaacattttccgggggagctatctcgctggagccggcctggcgttctccctgatgaaaagcctcggcggcgggcgccgcggcaccggagcccagggggagaccctgggcgagaagtggaagcgccagctgaaccagctctccaagtccgagttcaacatctacaagcggagcggtattatggaggtcgaccggagcgaggccaaagagggcctgaagcgcggggaaactaccagacacgctgtctcgcgggggaccgccaagctgcgctggttcgtcgaacgtaacctggttaagcccgaggggaaggtgatagacctcggctgcggccgcgggggctggtcctactattgcgcgggtctcaagaaagtaaccgaggtcaagggctacactaagggcgggcccggacacgaggagcccatccccatggcgacctacggctggaacctggtgaagctccatagtggcaaggacgtcttcttcacaccgcccgagaagtgtgacacccttctctgcgacatcggggaatcctcaccgaacccgacgattgaggagggccggaccctccgcgtgctcaagatggtggagccctggctgcgtggaaaccagttctgcatcaagatcctcaacccctacatgccctccgtggtggagactttagaacagatgcagcgcaagcatggcggcatgctggtgcggaaccccctctcacgaaactccacccacgaaatgtactgggtttcatgcggtactggtaacatagtgtccgccgtgaacatgactagccgaatgctgctcaacaggttcaccatggcccaccgcaagcccacctacgagcgcgacgtcgacctcggggcgggcacccgccacgtcgcggtggaacccgaggtagccaacttggacatcatcggccagcggatcgagaacatcaaacatgagcacaagtccacttggcattacgatgaggacaatccctacaaaacatgggcttaccacgggagctacgaggtgaagccgagcggcagcgccagcagcatggtcaacggagtggtgaaactgcttactaagccttgggatgttatccccatggtgactcagattgcgatgacggacaccacccccttcggccagcagagggtgttcaaggaaaaggtcgacacgcggacgcccaaagccaagcgcgggacggcccagatcatggaagttaccgcaagatggctgtggggcttcttgtcacgcaacaagaagccccgtatctgtaccagagaggagttcacgcgtaaggtgaggtccaacgctgcgatcggcgccgtcttcgtcgacgagaaccagtggaacagcgccaaggaagccgtggaggacgagcggttctgggacctcgttcaaaaggagcgcgagctgcataaacaaggcaagtgtgcgacctgtgtgtacaacatgatgggcaagagagagaagaagcttggggaattcggcaaggcaaagggatcccgcgccatctggtatatgtggctaggcgcccgcttcctggagttcgaggccctgggctttatgaacgaggaccattggttcagccgcgagaattccctcagcggcgtagagggcgaagggttgcacaagttggggtatatcctccgggacatatccaagatccccggtggtaatatgtacgcggacgacaccgccggctgggacacaagaatcacggaggacgacttgcagaacgaagctaaaatcacagatatcatggagccggagcatgccttattagccaccagcatcttcaagctgacctaccagaataaggtcgtgcgggtacagcgacccgcgaaaaacggaaccgtcatggacgtgatctcccggcgggaccagcgcggcagcggccaggtaggcacgtacggcctgaacacatttaccaacatggaggcacagcttatccggcagatggagtccgaggggatcttcagcccctccgagctggagattcccaacctggccgagcgcgttctcgactggcttgagaagtacggcgtggagcggctgaagcgcatggccatctcgggggatgactgcgtagtcaagcctatcgacgaccgctttgccacggctctcaccgccctgaatgatatgggtaaggtgcgcaaggacgtaccccaatgggagccaagtaagggctggaacgattggcagcaggtccccttctgcagtcaccatttccaccaactgatcatgaaggatgggcgggaaatcgtcgtcccttgccgcaaccaagacgagctagtcggccgggcccgcgtaagccagggggccggctggagcttgcgggagaccgcttgcctgggcaaaagctacgctcagatgtggcagcttatgtatttccaccgccgggacctgcgactggcagccaacgccatctgtagtgcggttcccgtcgactgggtccccacatcccggacgacctggtccattcacgcacaccatcagtggatgaccactgaggacatgctaagcgtatggaaccgcgtctggatcgaggagaatccctggatggaggacaagactcacgtgtccagctggggcgacgtgccgtacctggggaagcgggaagaccagtggtgtggttccctgataggtcttaccgcacgcgctacctgggcaagcaacatccaggttgcgatcaatcaagtgcgccggctgatcgggaacgagaactacctagactatatgacctccatgaagcgattcaagaatgagggcgaccccgagggcgctctctggtga

SEQ ID NO: 24377 - RNA, 9879 nt, synthetic construct
  misc_feature 1..9879: note = derived and/or modified CDS sequence (opt11) from DENV-1__FJ898406__SS-prME
  source 1..9879: mol_type = other RNA
agcgtgaccatgctgctcatgctgatgcccaccgccctggccttccacctcaccacccggggcggggagccccatatgatcgtgaccaagcaggaacggggaaagagcctgctgttcaagaccagtgccggggtgaacatgtgcaccctcatagccatggatctcggagaactgtgcgaggacaccatgacctacaaatgcccccggatcaccgaggccgagcccgacgatgtggactgctggtgtaacgccaccgacacatgggtgacctacgggacgtgctcccagaccggggagcaccggcgcgataagcggtcggttgccctcgcgcctcacgtaggtctgggtttggaaacccgcaccgagacctggatgtccagcgagggcgcctggaaacagatccagcgggtcgaaacgtgggccctccggcacccaggtttcactgtgatcgccctgttccttgcccacgccatcggcacctccatcacccagaaggggatcatcttcatcctcctgatgctggtgacgccctcgatggccatgcggtgcgtcggcatcggatcccgcgactttgtggaggggctctcgggcgccacttgggtggacgtagtgctggagcacgggtcgtgcgtcaccaccatggccaaggataagcccacgctagacatcgagctcctgaagacagaggtaaccaacccggcggtgctgcgcaagctctgcattgaagccaagataagcaacaccacgaccgactcccgctgccccacccagggcgaggccacactcatggaggagcaagacgccaacttcgtgtgccgacgcacgttcgtcgaccggggctgggggaacggctgcggtctgtttggcaagggatcgctgataacgtgtgctaagtttaagtgcgtgaccaagctggagggcaagatcgttcagtacgagaacttgaaatactcagtgatcgtgaccgtccacacgggcgaccaacaccaggtcgggaacgagagtaccgagcacggcaccaccgcgaccatcacaccccaggcccccacctccgagatccagcttaccgactacggggccctgacactggactgcagcccccgaactggcctcgacttcaacgagatggtgctgctaaccatgaaagagaagtcctggttagttcacaagcagtggttcctggacctgcccctcccctggaccagcggggccagcacctcccaggagacttggaaccgacaagacctgctggtgactttcaagaccgcccacgcgaagaagcaggaggtggtcgtgttgggcagccaggagggtgccatgcataccgcactgacgggggccacggagatccagacctctggcaccacgaccatcttcgccgggcacctgaagtgccgcctcaagatggacaagctgaccctgaagggcatgagctacgtaatgtgtacggggtccttcaagctcgaaaaggaggtcgcggagacgcagcatggcaccgttctggttcagatcaaatacgagggaaccgacgctccctgcaagattccctttagcactcaggacgaaaaaggtgtcacgcagaacggccggctgatcaccgcaaacccgatcgtgaccgacaaggagaagcccgtgaacatcgaggcagagccgcccttcggggagtcgtacattgtcatcggcgccggcgagaaagcactcaagctcagctggttcaaaaagggatccaacatcggcaagatgttcgaggccaccgcccgcggggcccggcgcatggcgatactgggcgacacggcctgggacttcggtagcatcggcggtgtgttcacatccgtggggaagctggtccaccagatcttcggcaccgcctacggggtcttattcagcggggtgagctggaccatgaaaatcgggatcggcgtcctgctaacatggctcggcttaaatagccgctccacctcactttctatgacgtgtatcgccgtagggctcgtgaccctgtatctgggcgtcatggtgcaggcagatagcggctgcgtgatcaattggaagggccgcgagctcaagtgcggctccggcatcttcgtcacgaacgaagtgcacacctggaccgagcagtacaagttccaggcggactccccgaagcgcttatctgccgcgatcggcaaggcctgggaggagggggtctgcggaattcggtccgccacccgcctggagaatataatgtggaagcagatctctaatgagctcaaccacatcttacttgagaacgacatgaagttcaccgtggtggtaggggacgtcgtgggcattctcgcgcaggggaagaagatgatccggccccagcccatggagcacaagtactcctggaagtcctgggggaaggctaagatcatcggcgccgacgtgcagaacacgacctttatcatcgacgggccaaacacccccgagtgccccgacgaccagcgcgcctggaacatctgggaggtcgaggactacggattcgggatcttcaccacgaatatctggctgaagttgcgggactcatacacccaagtgtgtgaccacaggctcatgagcgcggctatcaaagattccaaagccgtgcacgcggatatgggctactggatagagagcgagaagaacgagacgtggaaactggcccgggcatccttcatcgaggtcaagacctgcatctggccgaagagccacacgctgtggtccaatggcgtgctcgagtcggagatgatcatccccaagatctatgggggcccgatttcccagcacaactaccgcccaggatactttacgcagacagccggcccctggcacctgggtaagctggaactcgatttcgacctgtgcgaagggaccacggtggtggtggacgagcattgcggcaacagggggccgagcctgcgcaccaccaccgtgacgggcaagattatccacgagtggtgctgccggtcctgcaccttaccgcccctccgcttcaaaggggaggatggctgttggtatggaatggagatccggcccgtcaaagagaaggaggagaacctggtcaagagtatggtatccgccggcagcggggaggtagacagcttcagcttggggctgttgtgtatctccatcatgatagaggaggtgatgcgttcgcggtggagccgcaagatgctcatgacaggcaccttagcggtgttcctgcttctgatcatgggtcagctgacctggaacgacctcatccggttgtgcatcatggttggcgccaacgcatcagacaggatggggatgggcaccacttatctggccctcatggctactttcaagatgcgcccgatgttcgccgtgggcctgctgttccggcgcctaacgagccgggaagttctgctgctcacgatcgggttgagcctggtcgcctcagtggagctccccaattccctggaggagctgggggacgggctcgcgatgggcatcatgatcctgaagctgctcacggacttccagagccaccagctgtgggccaccctgctgtccctgaccttcatcaagaccacactgtcgctccactacgcctggaagaccatggccatggtcctgtcgatcgtgagcctgttccccctctgcctgagcacgaccagccagaagaccacctggctacccgtgctcctgggctcactggggtgcaagccgctcacgatgttcctgatcgcggagaataagatctggggccgcaagagctggcccctgaacgaggggatcatggccgtgggcgtggtgtccatactcctgtcgagcctgctcaagaacgacgttcccctggcagggcccctgatcgccggcggcatgctcatcgcctgctacgtgatctccgggagttccgcggacctaagcctcgagaaggccgctgaagtctcctgggaagaggaggccgaacatagtggcgcctcccacaacatcctcgttgaggtgcaggatgacgggaccatgaagatcaaagatgaggagcgggacgataccctgaccatcctgctcaaggctaccctactcgccgtgagtggtgtctacccgctctctatccccgccacgctgttcgtgtggtacttctggcaaaagaagaagcagcgcagcggggtgctgtgggacaccccgagccctcccgaagtggagcgggccgtgcttgacgacgggatctaccgaatcatgcagcggggactcctcgggcgcagccaggtgggcgtcggggtgttccaggagaacgtgtttcacacgatgtggcacgtgactcggggcgccgtgttaatgtaccaggggaagcgcctcgagccctcctgggcgagcgtaaagaaggacctgatatcctacggcggtgggtggcgccttcagggctcgtggaacacgggagaggaggtccaggtgatcgccgtggagcccggcaagaacccaaagaacgtacagaccgcccccgggaccttcaaaacccccgagggcgaggttggggccatcgcactcgacttcaagcccgggacgagtggcagccccattgtgaaccgcgaggggaagatcgtcggcctatatggcaacggtgtggttaccacctctgggacctacgtaagcgcgatcgcccaggccaaggccagccaggaggggccgctgcccgagatagaagacgaggttttcaggaagcggaacctcacgatcatggacctgcaccccggctccgggaagacgcggcgctatctgccagcgatcgtgcgggaggctataaagcggaagctccggaccctgatcctggctcccacccgcgtcgtcgcctcggagatggccgaggctttaaaggggatgcctatacgataccagacgaccgctgtgaagtccgagcacaccggcaaggagatagttgacctaatgtgccatgccaccttcacaatgcggctgttgagccctgtacgagtgcctaactacaacatgatcatcatggacgaggcccacttcaccgacccctccagcatagcagcgcgggggtacatctccacccgcgtcggcatgggggaggccgccgccatcttcatgaccgcaacaccgcccggcagcgttgaggcgttcccgcagtccaacgccgtgattcaggacgaagagcgggacattcccgaacgcagctggaactccgggtacgagtggatcaccgacttccccggaaagaccgtctggtttgtgcccagcatcaagtccggcaacgacatcgccaactgcctgcgcaaaaacgggaaacgcgtgatccagctgagccggaagaccttcgacacggaataccagaagaccaaaaacaacgactgggactacgttgtgaccaccgacatctccgagatgggcgccaacttccgcgcggaccgggtgatcgacccacgccggtgccttaagccagtcatcctgaaggacggacccgagcgggttatcctggccggccccatgcccgtcactgtggccagcgccgcgcagcggcgcgggcggatcggcaggaaccacaataaggagggtgaccagtacatctacatgggtcagcccttaaacaacgacgaggaccacgctcattggaccgaggccaagatgttgctggacaacatcaacacgcccgagggcatcatccccgcactcttcgagcccgagagggaaaagtctgccgccatcgacggggagtaccgcctgcgaggggaggcgcgaaagaccttcgtggagctgatgcgacgcggggacctccccgtctggctaagctacaaagtggcgtccgaggggttccagtacagcgaccgccgttggtgcttcgatggcgagcgcaacaaccaggtgctggaagagaacatggacgtcgagatttggacgaaggaaggtgagcgaaagaagctccgcccccggtggctcgatgcccgcacgtacagcgaccccttagctttgcgggagttcaaggagttcgccgcgggtcgcaggtccgtgagcggggacctgatcctggaaatcggcaagctcccgcagcacctgacccagcgcgcccagaatgccttagacaacctcgtgatgctgcacaactctgagcagggggggcgggcctaccgccacgcgatggaggaactgccagacaccatcgagacgctcatgctgctggccctcatcgccgtactgactggcggggtgacgctgttcttcctctcgggccggggtctgggcaagacatcaattggcttgttatgcgtgatggccagctccgtcctgctttggatggcctcagtggagccccactggatagcggcttccatcatcctcgagttctttctgatggtgctgcttatccccgagccggatcgccaacggacgccccaggacaaccagctggcctacgtagtgatcgggcttctcttcatgatcctgacggtagccgccaacgagatgggtctgctagagaccaccaagaaagacctgggcatcggccatgtcgccgtggagaaccaccaccacgccaccatgctggacgtagaccttcaccctgccagtgcctggacgctgtacgccgtcgcaaccaccatcataaccccgatgatgcgccacacaatcgagaacaccaccgcgaacatctccctgaccgctatcgccaaccaagccgcgatcctcatggggctggacaaggggtggcccatcagcaagatggacatcggggttccactgctcgccttggggtgctactcccaggtgaaccccctaacgttgactgcagccgtcctgatgcttgtggcgcactatgcaattatcggaccggggctccaagccaaggccacccgggaagcccagaaacgtaccgcggccggtatcatgaaaaacccgacggtggacgggatcgtcgccatcgacctcgaccccgtggtgtacgacgcgaagttcgagaagcagctgggccagatcatgttgctgatcctatgtacctcccagatcttgctgatgcgcacgacctgggccctgtgcgaatccattacgcttgcgaccggccccctgaccactctgtgggaggggtcgccgggcaagttttggaacacgaccatcgccgtttccatggccaatatcttccgcgggagctacctggccggcgccggcctggcgttctccctgatgaaatccctcgggggcggccgccggggcaccggcgcccagggcgagacgctgggcgagaagtggaagagacagctgaaccagttgagtaagtccgagttcaacatctacaagcggagcgggatcatggaggtggaccgctccgaggccaaagagggcctgaagcgcggggagacgacccggcacgccgtgagcagaggcacggcgaagctgagatggttcgttgagagaaacctggtcaagcccgaggggaaggtgatagacctcgggtgcggccgagggggctggtcctactactgcgccgggctaaagaaggtcacggaggtgaaggggtacacgaaaggcggacccggccacgaggaacccatcccgatggccacctacgggtggaacctggtaaagctacacagcggaaaagatgtgttcttcaccccccccgagaagtgcgacacgctgctgtgtgacatcggggagagcagccccaatccgacgatcgaggaaggccggaccctccgcgtactgaagatggtggaaccctggctgcggggtaatcagttctgcataaagatcctcaacccctacatgccatccgtagtggagaccttggagcagatgcagcgcaagcacggcggcatgcttgtgcgaaacccgctcagccgcaactcgacccacgagatgtactgggtgagctgcggtaccggcaacatcgtgtccgccgtgaacatgactagccggatgttactgaaccgctttaccatggcccatcgcaagcccacctacgagcgggacgtcgacctgggcgcaggcacccgacacgtggctgtggagcccgaggtcgccaacctggacatcatcggccagcggatcgagaacatcaagcacgagcacaagtccacgtggcattacgatgaggacaacccctataagacctgggcataccacgggagctacgaggtgaagccgtccggctccgcctcctcaatggtcaacggggtggtaaagctgctcaccaagccctgggacgtaattcccatggtcacgcagatcgcgatgacggacaccactcccttcggccaacagagggtcttcaaggaaaaggttgacacccgtacgccgaaggccaagagagggaccgcccagatcatggaggtgaccgcccggtggctgtggggtttcttaagtaggaacaaaaagccacgaatctgcacccgcgaggagttcacgcggaaggtgcgctccaacgcagcgatcggcgccgtcttcgtggacgagaatcagtggaatagcgccaaggaggcagtagaggacgagcggttttgggacctcgtgcagaaggagcgagagctgcacaagcagggaaaatgcgcgacctgtgtgtacaacatgatgggcaagcgggaaaagaagctgggcgagttcggcaaggccaaagggtccagggccatctggtatatgtggttaggcgctcgcttcctagagttcgaggcgctggggtttatgaacgaagatcactggttcagccgcgagaattccttaagcggggtggaaggggaggggctgcacaagctgggctacatcctccgggatatctccaagatccccggaggcaatatgtacgcggacgataccgccggctgggacacacggattacggaggacgacctgcagaacgaagctaagatcaccgatatcatggagccggaacacgccctgctcgccaccagcatcttcaagctgacctatcagaacaaggtcgtgcgggtgcagcgccccgcgaagaacggtacagtcatggacgtgatatcccgccgagaccagcgcggcagcggccaggtgggcacctacggactgaacaccttcaccaacatggaggcccagctcatccggcagatggagagtgaggggatcttcagcccctccgagctggagatcccgaaccttgcagagcgcgtcctggactggctggagaaatacggagtggagagactgaagcgcatggccatcagcggggacgattgtgtggtcaagccgatcgacgaccggtttgcaacagcgctcaccgctctcaacgacatgggcaaggtgcgtaaggacgtgccccagtgggagccctccaaagggtggaatgactggcagcaggtccccttctgcagccaccacttccaccagctgatcatgaaggacggccgggagatcgtcgttccatgccgcaaccaggacgagctcgtcggccgggcacgcgtttcccaaggggctggctggagtctgagagaaaccgcctgccttggcaagtcatacgcgcaaatgtggcagctcatgtacttccaccgtcgggacctgcgcctggccgccaatgccatatgctccgcggtgcccgtcgactgggttcccacaagtcggacgacttggtccattcacgcccaccaccaatggatgacaaccgaggacatgctcagcgtgtggaaccgcgtctggatcgaggagaacccctggatggaggacaaaacacatgtgtctagctggggcgacgtgccatacctggggaagcgagaggatcagtggtgtggctccctgataggcctcaccgcccgcgcgacttgggccagcaacatccaggttgctatcaaccaggtgcgccggctgatcggcaacgaaaattacctggactacatggcaagtatgaaacgcttcaagaacgaaggcgaccctgagggggccttatggtga

SEQ ID NO: 24378 - RNA, 9879 nt, synthetic construct
  misc_feature 1..9879: note = derived and/or modified CDS sequence (opt11) from DENV-1__GQ199841__SS-prME
  source 1..9879: mol_type = other RNA
agcgtaaccatgctgctcatgctgatgcccaccgccttagccttccacctgactacccggggcggtgagccccacatgatcgtaagcaagcaggagagagggaagagcctgctgttcaagaccagcgcgggtgtgaacatgtgcaccctcatcgccatggacctgggcgagttctgcgaggataccatgacgtacaagtgcccccgcataaccgaggccgaacccgatgacgtggactgctggtgcaacgccaccgacacgtgggtgacctacggaacctgcagccagactggtgagcaccggcgcgacaagcggtccgtggctctggcaccccacgtgggcctcgggctggagacgcgcaccgagacctggatgtcgtctgagggtgcctggaagcagatccagcgggtcgagacctgggccctgaggcaccccggattcacggtgattgccctcttcctggcccatgccatcggcaccagcatcacccagaaggggataatcttcatcctgctcatgttagtgacaccctctatggccatgcggtgcgtcgggataggcagccgcgacttcgtggagggcctgtccggtgccacctgggtggacgtcgtgctcgagcacgggagctgcgtgaccaccatggccaaggacaagccgacactggacatagaactgctcaagacggaggtcaccaaccccgcggtgctgcggaagctgtgcatcgaggccaagatatccaacaccaccacggacagccgttgcccgacccagggcgaggccacgctcgtggaggaacaggatgccaacttcgtctgccgtcgcacgttcgtggaccgaggctgggggaacggctgcggcctgttcggcaaggggtccctgatcacgtgcgcgaaattcaagtgcgttacgaagctcgagggcaagaccgtccagtacgagaacctgaagtacagcgtgatcgtgacggtccacaccggcgaccagcaccaggtggggaatgaatccaccgagcacgggaccacggcaaccatcacgccccaggcccccagcaccgagatccagctgaccgactacggtgccctcaccttggactgttccccccggaccggtctggactttaacgagatggtcctcctgactatgaaggaaaagtcctggctggtgcacaagcagtggttcctcgacctgccgctcccctggaccagcggggcctctaccagccaagagacgtggaaccggaaggacctcctggtgaccttcaaaacggcccacgcgaagaagcaggaagtcgtggtactgggctcccaggagggcgccatgcacacggcactcaccggggcaaccgagatccagaccagcgggaccacgaccatcttcgccgggcacctgaagtgccgcctgaagatggacaagctcaccctgaaaggcatgtcctacgtcatgtgcaccgggtcattcaagctggagaaggaggtggcggaaacgcagcacggcaccgtgctcgtccagatcaagtacgagggcaccgacgccccctgcaagatccccttctccacccaagacgagaagggggtgacgcagaacggccggcttattaccgccaatccgatcgtgaccgataaggagaagcccgtcaatattgaggcagagccgcccttcggggagagctacatagtaatcggggcgggcgaaaaggcactgaagctgtcctggttcaaaaaggggtcttccatcggtaagatgttcgaggccaccgcccgcggggcccggcgcatggcgatcctcggcgacacggcctgggacttcgggagcatcggaggcgtgttcacctccgtcgggaagctggtgcaccagatcttcggcaccgcctacggggtgctgttcagcggcgtctcctggaccatgaagattgggatcggggtgctcctgacgtggctgggcctcaacagccgctccaccagcttatccatgacctgcatcgcggtggggctggtcactctctacttaggcgtgatggtgcaggccgactcgggctgcgtcattaactggaagggccgtgaactgaaatgcgggagcgggatcttcgtaacgaacgaggtgcacacctggaccgagcaatacaagttccaggcggactccccgaagcgtctcagcgccgccatcggcaaggcttgggaggagggggtctgcggcatccggtccgcgacccgcctagaaaacatcatgtggaagcagatctcgaacgaactgaatcacattctcctggagaacgacatgaagttcaccgtggtggtgggggacgtggcaggaatcctggcgcagggcaagaagatgatccgccctcagcccatggagtacaagtactcctggaagtcctggggcaaggccaagatcataggcgctgacgtgcaaaacacgaccttcatcatcgacgggcccaacaccccggagtgtcccgatgatcagagagcgtggaatatttgggaggtcgaggactacggcttcggaatttttacgacgaacatatggctcaaactacgggacagttacactcaagtgtgcgatcaccgcctgatgagcgccgccatcaaggactccaaggcggtacacgcggacatgggctactggatcgagtcggagaagaacgagacatggaaactggctcgtgcctccttcatagaggtcaagacctgcatctggcccaagagccatacgctatggagtaacggcgtgcttgagagcgagatgatcatacccaagatctacggtggcccgatctcccaacacaactaccgacccgggtacttcacccagaccgccggcccctggcacctggggaagttagagctggatttcgacctgtgcgagggaaccacagtggtcgtggacgaacattgcggcaaccgggggccgagcctgcgcaccaccactgtgacgggtaagatcatccacgagtggtgctgccggtcctgcacccttccgcccctgcgcttcaagggggaggacggctgctggtacgggatggagatccggcccgtcaaggagaaggaagagaacctggttaagagcatggtgagcgccggctccggcgaggtcgacagcttctccttggggctcctctgcatcagcatcatgatcgaggaggtgatgcgctctcggtggtcgcgcaagatgttaatgaccggcacgctcgccgtattcttcctgctgatcatggggcagctcacgtggaacgacctgatccggctgtgcatcatggtcggtgcgaacgcctctgacaggatggggatgggcaccacctatctcgcgctgatggccaccttcaagatgcgcccgatgttcgctgtaggcctcctgttccggcgtctgacgagccgggaggtgttactactgaccatcgggctttccctcgtcgcgagcgtcgagctccccaactccctggaggagttaggcgacgggctggccatgggcatcatgatactgaagctcctgaccgatttccagagccaccagctgtgggccaccctcctgtccctgacatttattaagaccaccttcagcctccactacgcttggaagacgatggcgatggtcctgtccatcgtgagcctgttcccgctctgcctgtccactactagccaaaagaccacctggctgcccgtgcttctgggctccctggggtgcaagccgcttacgatgttcctgatcgccgagaacaagatatggggccgcaagtcgtggcccctgaatgaagggatcatggccgtcggcatcgtgagcatcctcctgtcctcgctgctcaagaacgacgtgcccctggccgggcccctgattgccggcggaatgctcatcgcgtgctatgtcatctccggtagctccgccgacctgagcctggagaaagccgccgaggtgtcctgggaggaagaggctgagcactcgggggcgtcccacaacatcctcgtggaagtccaggacgacgggaccatgaagatcaaggacgaggagcgggacgacaccctgaccatcctgcttaaggccaccctgctggctgtgtcgggagtgtaccccctcagcatccccgccacgctgtttgtctggtacttctggcagaagaaaaagcagcgctcaggggtgctgtgggacacccccagcccgccagaggtggagcgggctgtcctcgacgacggaatctaccgcataatgcagcggggcttgctggggcgcagccaggtgggagtgggggtcttccaggagaacgtgttccacacaatgtggcacgtgacccggggcgcggtcctgatgtaccaggggaagcgcctcgagccttcttgggcgtcggtgaagaaggacctgatctcctacggcggcgggtggcgtctgcagggcagctggaacacgggggaggaggtgcaggtcatcgccgtggagcccggtaagaaccccaagaacgtgcagaccgcccccgggaccttcaaaacctccgagggcgaggtcggcgccatcgcgctcgatttcaagcccgggacgtcaggaagccccatcgtgaaccgcgaggggaagatcgtgggcctgtacggcaatggagtcgtcaccacctccggcacttacgtgtctgccatcgcccaggccaaggcgtcccaagaggggccgctcccggagatcgaggacgaggtcttccggaagcgcaacctcacgatcatggacctgcaccccgggagcgggaagacccggcgctacctgcccgccatcgtgcgggaggcaatcaagcgcaagctccggaccttaatcctggccccgacccgcgtggtcgcctccgaaatggcggaggccttaaagggcatgcccatcaggtaccagacaaccgcagtcaagagcgagcacaccggcaaagagatagtggacctgatgtgccacgccaccttcacgatgcggcttctctccccggtccgagtgcccaactacaacatgatcatcatggacgaggcccacttcaccgacccgagctctatcgcggcccgggggtacatcagcacccgcgtgggcatgggggaggccgccgccatcttcatgaccgctacgccgcccggcagcgtcgaggccttcccccagagcaacgccgtgatccaggacgaggagcgggacattccggagcgctcctggaacagcgggtacgagtggatcaccgacttccccgggaagaccgtgtggttcgtcccctccatcaagagcggcaacgacatcgccaactgcctgcggaagaacgggaagagagtcatccagctctcccgtaagaccttcgacacggagtaccagaagaccaagaacaacgactgggattacgtggtcaccaccgacattagcgagatgggcgcgaactttcgcgccgaccgggtgatcgacccccgccggtgcctgaagccggtgatccttaaggacggacccgagcgcgtaatcctggcaggcccaatgcccgtgacggtcgcatccgccgcgcagcggcgcggtcggatcggccgcaaccacaacaaggagggcgaccagtatatctacatggggcagccattgaacaacgacgaggaccatgcccactggaccgaggccaagatgctgctggacaacatcaacacacccgagggcatcatccccgccctcttcgagcccgagcgggagaagtccgcggcgatcgacggggagtaccgtctgcgcggcgaggcccggaagaccttcgtggaacttatgaggcgcggggacctgcctgtctggctgagctacaaggtcgcctctgagggctttcagtatagcgaccgccggtggtgctttgacggagagcgcaacaaccaggtgctggaggagaacatggacgttgagatctggaccaaggagggtgagaggaagaagctccgcccccggtggctggacgcccgcacctactccgaccccctggccctccgggagttcaaggagttcgcggccggccgccggtcagtctccggggacctgatcctcgaaatcggcaagttaccacaacacctgacccaaagagcccaaaacgccctggacaacctcgtgatgctgcacaacagcgagcagggcgggcgggcgtaccgccacgccatggaggagctgccggacacaatcgagacactcatgcttctggctctcatcgcggtgctgaccggcggagtcaccctgtttttcctctccggtcgggggctgggcaagaccagcatcggcctgctctgcgtgatggccagttccgcgctgttgtggatggcctccgtagagccccactggatcgccgcgagcatcatcctcgagttcttcctgatggtactgctaattcccgaacccgatcgtcagcggaccccgcaggacaaccaacttgcctacgtggtcatcgggctcctcttcatgatcctgactgtcgcggccaacgaaatggggttactcgagaccacaaaaaaggacctggggatcggccacgtggccgtggagaaccaccaccacgccgccatgctggatgtcgacctccacccagcgagcgcctggacactgtacgcagtggccaccaccatcatcacccccatgatgagacacaccatcgaaaacacgaccgccaacataagcctaaccgcgatcgccaaccaggccgccatcctcatggggttagacaagggatggccaatctccaagatggacatcggcgtacccctgctcgccctggggtgctacagccaggtcaaccccctgaccctcacggcagccgtgctgatgctggtggcccactacgccattataggccccgggctccaggcgaaggccacccgtgaggctcagaagcgcaccgccgcgggcatcatgaagaacccgacggtcgacgggatcgtggcgatcgacctggaccctgtggtctacgacgctaagttcgagaagcagctgggccagattatgctcttgatcctgtgcacctcccagattctcctcatgcgcaccacctgggctctgtgcgagagcattaccttggccacgggccccctgacgaccctgtgggaggggtcccccggcaagttctggaacaccacgatcgccgtgagcatggcgaacatcttccgggggagctacttggccggcgccgggctggccttctccctcatgaagtccctcgggggcgggcgccggggcaccggggcacaaggcgagacactgggcgagaagtggaaacgccagctgaaccagttaagtaagagcgagttcaacacctacaagcggtccgggatcatggaagtggaccgcagcgaggccaaggagggcctgaagcgcggagaaacaaccaagcatgccgtctcccgcggcaccgccaagctaagatggttcgttgagcgcaacctcgtgaagccggaggggaaggtcatcgacctgggctgcggtcgcggggggtggtcatactactgcgccgggctgaagaaggtgactgaggtgaaggggtatactaagggcgggcccggccatgaggagcccatccctatggcgacctacgggtggaacctggtcaaactccactccggcaaggacgtgttcttcattccacccgagaagtgtgacactctgctctgcgatatcggggagtcatcccccaatcccaccatcgaggagggtcgcacgttacgagtgctgaagatggtcgagccgtggctgcgcgggaaccagttctgcatcaagatcctcaacccctacatgcccagcgtggtggagaccctggagcagatgcagcggaagcacggcgggatgctggtccggaaccccctctcccggaacagcacccacgagatgtactgggtgtcctgcgggaccggtaacatcgttagcgccgtcaacatgacctcccgcatgctgctgaaccggttcaccatggcccaccgcaaacctacctacgagcgcgacgtggacctcggggccgggacacggcacgtggccgtggaacccgaggtggcgaacctggacatcatcggccagcgcatcgagaacatcaaacatgagcacaagagcacctggcactatgatgaagacaacccctacaagacgtgggcttaccacgggtcctacgaggtgaagcccagtggcagcgcctccagcatggtcaacggggtcgtcaagctgctcaccaagccgtgggacgtgatccccatggtcacccagatcgccatgaccgacacgaccccgttcggccagcagcgggtctttaaggagaaggtagacacccgcacccccaaagcgaagcggggaacggcgcagatcatggaggtgaccgccaagtggctgtggggatttctgtcccgcaataaaaaaccgcggatatgtaccagggaggaattcacccggaaggtccgctcaaacgccgccatcggcgcggtgttcgtggacgaaaaccagtggaattccgcaaaagaggccgtcgaggacgaacggttctgggacctcgtgcaccgcgagcgggaattgcacaaacaggggaagtgcgcaacgtgcgtgtacaacatgatgggcaagcgcgagaagaagctgggggagttcggcaaggccaaggggtctcgggcgatctggtacatgtggctcggcgcccgcttcctggagtttgaggccctgggcttcatgaacgaggaccactggttctcccgggaaaactcgctctcgggggtcgagggcgaggggctgcacaagctgggctacattctccgcgatataagcaagatccccgggggtaacatgtacgccgatgacaccgccggctgggacacccggatcaccgaggacgacctgcagaacgaggcgaagatcacggacatcatggagcccgagcacgcactgctcgccaagtccatcttcaagctgacctaccaaaacaaagtagtgcgcgtccagcgaccggccaagaacgggaccgtgatggacgtgatcagccgcagggaccaaaggggctccgggcaggtcggcacgtacggcctgaacacattcactaacatggaggcccagctcatccgccagatggagagcgaggggatcttctccccgagtgaattagagacccccaacctggcgggtcgggtgctcgactggctggagaagcacggggtggagcgcctgaagcgtatggccatctccggcgacgactgcgtcgttaagcccatcgatgaccgcttcgccaccgccctcacggccctaaacgacatggggaaggtgcggaaggacatcccgcagtgggagcccagcaagggctggaacgactggcagcaggtccctttctgcagccaccactttcaccagctgatcatgaaggacgggcgcgaaattgtggtcccctgccggaaccaggacgagctcgttgggcgggcgcgggtttcccagggagccgggtggtccctgcgagagaccgcctgcctgggcaagtcctacgcccagatgtggcagctcatgtacttccaccgtcgagacctgcggctggcggcaaacgccatttgcagcgccgtgccggtcgactgggttcctacctctcgcaccacgtggtcaatccatgcccaccatcagtggatgacaaccgaagatatgctctccgtgtggaaccgagtctggatcgaggagaacccctggatggaggacaaaacccacatcagctcctggggcgacgtgccgtacctgggcaagcgcgaggaccagtggtgcggcagcctgatcgggctcacggcgcgggccacctgggccaccaacatccaggtggctatcaaccaggtccgcagactgattggcaacgagaattacctggattacatgaccagtatgaagcggttcaaaaacgagagcgacccggagggggccctctggtga

SEQ ID NO: 24379 - RNA, 9879 nt, synthetic construct
  misc_feature 1..9879: note = derived and/or modified CDS sequence (opt11) from DENV-1__FJ898407__SS-prME
  source 1..9879: mol_type = other RNA
agcgtgaccatgcttctcatgctgatgccaaccgcccttgcctttcacctcaccacccggggcggggaaccccacatgatcgtgagtaagcaggagcgaggcaaatccctgctgttcaagacctccgcaggggtgaacatgtgcacgctcatcgccatggaccttggcgaactgtgtgaggacaccatgacttacaagtgcccccggattaccgaggtggagcctgacgacgtggactgctggtgcaacactacggacacctgggtgacctacgggacctgcagccagacgggcgagcaccggcgcgacaagcggagcgtggccctcgcaccccacgtcggcctggggctggagacccgggccgagacctggatgagctctgaaggcgcgtggaagcaaattcagaaagtggagacctgggccctccggcacccggggttcacggtgatagccctcttcctggcccatgcgatcggcaccagcatcacccagaaggggatcatcttcatactgctgatgctggtcaccccctccatggccatgcgctgcgtgggcatcgggagccgggacttcgtagaggggctctccggcgccacgtgggtcgacgtggtgctggagcatgggagttgcgtcaccaccatggccaaggataagcccacgctggacatcgagctcctgaagacggaggtgaccaatcccgccgtgctgcgtaagctctgcattgaggccaagatctcaaacaccaccacggacagccgttgtcccacccagggcgaagccaccctggtcgaggagcaggacgccaacttcgtgtgccgccgtaccttcgtggaccgcggctgggggaacgggtgcgggctgttcggcaaggggtcccttatcacttgtgccaagttcaagtgcgtaactaagctggaaggcaagatcgtacagtatgagaacctgaagtacagtgtgatcgtcaccgtccacaccggcgaccagcatcaggtggggaatgaatccacggagcacggcaccaccgctaccatcacgcctcaggcgcccacgagcgagatccagctcaccgactacggtgccctgaccctggactgcagcccgcggaccggcctcgacttcaacgagatggtactgctgacgatgaaggagaagtcctggctcgtgcacaagcagtggtttctggacttacccctcccctggaccagcggggcgtccaccagccaggagacctggaaccgccaggacctgttagtcacgttcaagaccgcccacgccaaaaagcaggaggtggtggtgctcggctcgcaggagggcgcgatgcacaccgccctgaccggggccacggaaatacagaccagcggcaccaccaccatctttgccgggcacctgaagtgccggctcaagatggacaagctgaccctcaagggcatgtcctacgtgatgtgcaccgggtcgttcaagctcgagaaggaggtggccgagacccaacacggcacggtcctggtgcagattaaatatgaaggcaccgacgcgccgtgcaagatccccttcagcacccaggacgagaagggagtgacccagaacggccgcctgatcacggccaacccgatcgtcaccgataaggagaagcccgtaaacatcgaggccgagccgcccttcggggagagctacatcgtgatcggcgccggcgagaaggcactgaagctctcctggtttaagaaggggagctccatcggcaagatgttcgaggccaccgcccgcggggcccgccggatggccatcctgggtgacactgcttgggactttgggagcatcggcggcgtcttcacgtccgtggggaagctagtacaccagatttttggcaccgcctacggggtcctcttcagcggcgtatcctggaccatgaagatcgggatcggggttctactgacctggctcggcctgaattccaggtccacgagcctgtccatgacctgcatcgccgtcgggctcgtgaccctgtacctgggcgtgatggtccaggccgacagcgggtgtgtgatcaactggaagggacgcgagctcaagtgcgggagcggcatcttcgtgaccaacgaggtccacacctggaccgagcagtacaagttccaggccgactccccgaagcggctgagcgccgccatcggaaaggcctgggaggagggcgtttgcggcatccgcagtgccacccggctggagaacatcatgtggcgccagatctctaacgagctcaatcacatcctgctggagaacgatatgaagttcaccgtggtcgtgggggacgtggtcggcatcctcgcccaggggaaaaagatgatccggccccagcctatggaacataagtactcctggaagtcatgggggaaggcgaagatcatcggagccgacgtgcagaacaccacgttcatcatcgacgggcccaacacccctgagtgccccgacgaccaacgcgcctggaacatctgggaggtggaggactacggtttcgggatcttcaccaccaacatctggctaaagctgcgggattcctacactcaggtctgcgaccacaggcttatgagcgccgcgatcaaggactccaaggccgtacacgccgacatgggctactggatcgagagcgagaaaaacgagacctggaagctggcccgagcctccttcattgaggtcaagacctgcatctggcccaagagccataccctgtggtccaacggcgtcctcgagagcgagatgatcatccccaagatctacgggggcccgatctctcagcacaactacagacccgggtacttcacgcagaccgcgggcccctggcacctggggaaactggagctcgactttgacttatgcgagggcaccaccgtcgtggtcgacgagcactgcggcaaccgggggccgagcctgcgaacgactaccgtaaccggcaagattatccacgagtggtgttgccggtcctgcacgctgcctcccctccgctttaagggggaggacggctgctggtacgggatggagatcaggcctgtgaaggaaaaggaagagaacctggtcaagagcatggtcagcgccggctccggtgaggtggacagtttctccctcgggctcctgtgcatcagcatcatgatcgaggaggtcatgcgctcccggtggagccgcaagatgttgatgaccggtaccctggccgtgttctttcttctcatcatgggtcagctgacctggaacgacctgatacggtcctgcatcatggtgggcgccaacgccagcgaccgcatggggatgggcaccacctacctcgcgctgatggccaccttcaagatgcgcccgatgttcgccgtcggcctgcttttccggcgccttacctcacgggaggtgttactcctgacgatcggtctgagcctcgtcgcgtccgtggagctgccaaacagcttggaggaactcggcgacggactggccatgggcatcatgatcctgaagctcctgaccgacttccagtcctaccagctgtgggcgaccctcctgagtctgaccttcatcaagacgaccttctccctccactacgcctggaagaccatggccatggtgctgagcatcgtctccctgctcccactgtgcctgagcaccacgtcccagaagaccacctggttgccggtgctgctgggcagcctcggctgcaagccgctgaccatgtttctgattgctgagaacaagatctgggggaggaaaagttggcccctcaacgaggggataatggcggtgggcattgtctccatcctgctgagcagtctcctgaagaacgacgtcccgctagccgggcctctcatcgcaggcgggatgctgatcgcctgctacgtaatcagcgggtccagcgccgacctgtccctcgagaaggcggccgaagtcagctgggaggaggaagccgagcacagtggggcaagccacaacatcttagtggaggtgcaggacgacgggacgatgaagatcaaggacgaggagcgggacgacaccctgaccatcctgctaaaggccaccctgctcgcggtttccggcgtgtacccgctcagcatccccgccaccctattcgtgtggtacttttggcagaagaagaagcagcgcagtggtgtgctctgggacacgccatctccgccagaggtggagagggccgtgctggacgacggcatctaccgcatcatgcagcggggcttactggggcgctcccaggtgggcgtgggggttttccaggagaatgtgttccataccatgtggcacgtgacacggggagccgtgctcatgtaccaagggaagcgactggagcccagctgggcctccgttaaaaaagacttgattagctacggcggcgggtggcggctccagggctcgtggaacaccggggaggaggtccaggtgatcgccgtcgagcccggcaagaaccccaagaacgtgcagacggcccccggcaccttcaagacccccgagggcgaggtgggcgcaatcgccctggacttcaagcccgggacctctggctcgcccatcgtcaatcgcgaggggaagatcgtgggcctgtacggcaacggggtggtcacgacctccggtacctacgtgagcgccatcgcgcagacaaaggcctcccaggagggcccgctcccggagatcgaggacgaggtcttccgtaaacgcaacctgacgatcatggacctacatcccggcagcggaaagacacggcgctacttaccggccatcgtccgggaggccatcaagaggaagttacggaccctgatcctcgctcccacccgcgtggtagcctccgagatggccgaggccctgaagggcatgcccatccgctaccagacgaccgccgtcaaaagcgagcacaccggccgggaaatcgtcgacttaatgtgccatgcgaccttcacgatgcgcctcctgtcccctgtgcgggtcccgaactacaatatgatcattatggacgaggcccacttcaccgaccccagctccatcgccgcccgcgggtacatcagcacccgggtgggcatgggggaggccgcggccatcttcatgaccgccacgccgcccggctccgtggaggcttttccgcagagcaacgccgtcatccaggacgaggagcgagacatccccgagcggtcctggaacagcgggtacgagtggattaccgacttccccggcaagaccgtgtggttcgtgccctccatcaagagtggcaacgacattgccaactgcctgcgcaagaacgggaagcgggtaatacagctctcccgcaagaccttcgacacggagtaccagaagaccaaaaacaacgactgggactacgtggtgaccacggacatcagcgagatgggcgcgaacttccgggccgaccgcgtgatcgatccgcggcgttgtctgaagcccgtgatcctgaaagacgggcccgagcgggtcatcctcgccggccctatgccggttacggtggcgtcggccgcccagcgccgtgggcgcatcgggcggaaccacaacaaggagggcgatcagtacatctacatggggcagcccctgaacaacgacgaagaccacgcgcactggaccgaggccaagatgctgctcgataacatcaacactcccgagggtatcatccccgcgctgtttgagccagagagggagaagtccgcggccatagacggggagtataggctgcggggcgaggcccggaagacctttgtcgagctcatgcggcgcggtgacctgcccgtgtggctgtcatacaaggtggcctctgagggcttccagtactcagaccggcgctggtgcttcgacggggagcggaataaccaggtcctcgaggaaaacatggacgtggagatctggacgaaggagggtgagagaaagaagctgcgtccgcgctggcttgacgcgcggacttactccgaccccctcgcccttcgcgagttcaaggagtttgcggcaggacggcgctcagtgtccggggacctgatcctcgagatcggcaagttgccacagcacctgacacagcgggcccagaacgcgctcgataacctggtaatgctgcacaacagcgagcagggcgggcgcgcctaccggcacgcgatggaggagttgcccgacaccatagaaacgctgatgctgctcgccctgatcgcggtgctgaccggcggggtcaccctcttctttctgtccggccgcgggctgggcaagaccagtatcggcctcctgtgcgtcatggcctcaagcgccctgctctggatggcctccgttgagccccactggatcgccgccagcatcatcttggagttcttcctgatggtgctcctgatccccgagccggaccggcagcggacgcctcaggacaaccagctggcctacgtcgtgatcgggctcctgttcatgatcctgacggtagccgcaaacgagatgggcctcctagagaccactaagaaggacctggggatcggccacgttgccgtggagaaccaccaccacgctacgatgttagacgtcgacctgcaccccgcttccgcctggacgttgtatgccgtcgccacaaccatcatcacgccgatgatgaggcacacgattgagaacaccaccgcgaacatctccttgaccgctatcgccaaccaggccgcgattttgatgggtctggacaagggttggccaatctccaagatggatatcggcgtgcccctcctagcgctggggtgctacagccaagtgaaccccctgacgctgaccgccgccgtgctgatgctcgtggcccactacgcgatcatcggcccggggctgcaggcgaaggccacccgcgaggcccagaagcgcacagccgcgggcatcatgaaaaaccccacggtggacgggatcgtcgccatcgatctggacccagtggtctatgacgccaagttcgagaagcagctcggccagataatgctactgatcctctgcacctcccaaatcctactgatgcggaccacctgggccctctgcgagtcaatcactctggccaccggcccgctgaccaccttatgggaggggtccccgggcaagttctggaatacgaccatcgcggtcagcatggccaatatcttccgcgggagctacctggccggcgcaggcctggccttttccctcatgaagtccctcgggggcgggcggcgcgggaccggtgcgcagggcgagacactgggcgagaagtggaagcggcagctcaatcagctgtccaagagcgagttcaacacatacaagcgctccgggatcatggaggtggaccgcagcgaggccaaggagggcctgcgccgcggggagaccaccaagcacgccgtctcccgcggcacggcgaaactccggtggttcgtcgaacgcaacttagtgaagcccgaggggaaggtgatcgacctgggctgcggccggggcggttggagctattactgcgctgggctgaagaaggtcacggaggtgaaggggtacaccaagggcgggcccggacacgaggagccgatcccgatggccacctacggctggaacctcgtgaagctgcactccggcaaggacgtctttttcataccaccggagaagtgcgacaccctgctctgtgacatcggggagagctcccccaaccccacgattgaagaaggccgcaccctgcgggttctgaagatggtggagccctggctccgcgggaaccaattctgcatcaagatcttaaacccctacatgccaagcgtcgtggaaaccctggagcagatgcagcggaagcacggcggcatgctcgtgcgcaacccgctgtcccggaacagtacccacgagatgtactgggtctcctgtgggaccggcaacatagtgagcgccgtgaacatgacgtcccgcatgttattaaaccgcttcaccatggcccaccggaagcccacctacgagcgcgacgtggatctcggggccggcacacgtcacgttgcggtggagcccgaggtcgccaacctggacataatcggccaacgcatcgagaatatcaagcacgagcacaagtcgacgtggcactacgacgaggacaatccctacaagacatgggcctaccacgggtcctacgaggtgaagccgagtggctccgcaagcagcatggtcaacggggtggtgaagctccttaccaaaccctgggacgtcatccccatggtgacccagatagccatgacagatacaaccccattcggccagcaacgggtgtttaaggagaaggtcgatacccgcacgccgaaggcgaagcgggggaccgcacagattatggaggtgaccgcccgctggctctggggcttcctctcccggaacaagaagccccgcatctgcacccgggaggagttcacccgcaaagtgcggagcaatgccgccattggcgcggtcttcgtggatgagaaccagtggaattccgccaaggaggccgttgaagacgagcgcttctgggaccttgtccaccgggagagagagctgcacaagcaggggaagtgcgcgacctgcgtgtacaacatgatgggcaagcgggagaagaagctcggagagttcggcaaggcgaaaggcagccgcgcgatctggtacatgtggttaggcgcccggttcctggagttcgaggccctcggtttcatgaacgaggaccactggttctcccgcgagaacagcctttccggggtggagggcgaggggctgcacaagctcggctacatcctacgggacatcagcaagatccccgggggcaacatgtatgccgacgacaccgcgggctgggatacccgcatcacggaggacgacctgcagaacgaggccaagatcaccgatatcatggagccggagcacgccctcctggccacctccatcttcaagctgacctaccagaataaggtcgtgcgagtgcagcggcctgcccgcaatgggacggtcatggacgtaatttcacggcgcgaccaacggggctccggccaggtaggcacctacggcctcaacaccttcaccaacatggaggcgcagctgatccgtcaaatggagtcggagggaatcttctcccccagcgagctagagacgcccaacctcgcggagcgtgtactggactggctggagaagcacggcgtggagcgactcaagcggatggccatcagcggggatgactgcgtggtgaagccgatcgacgaccgcttcgccaccgccctgagcgcgctgaatgacatgggcaaggtgcggaaggacatcccccagtgggagcccagcaaagggtggaacgactggcagcaggtccccttctgctcccatcacttccaccagctcatcatgaaggatggccgcgagatcgtcgtaccgtgccggaaccaggacgagctggtgggccgcgcccgggtcagtcagggggccggctggtccctgcgcgagaccgcctgcctcggcaagtcctacgcccagatgtggcagctgatgtacttccaccgtcgagatctgcgcctcgccgccaacgcgatctgctccgccgtccccgtggactgggtccccaccagcaggacaacatggtccatccacgcgcatcaccagtggatgaccactgaggacatgctgagcgtgtggaaccgcgtgtggatcgaggagaacccctggatggaagataagacgcacatctccagctggggtgacgtcccgtacttagggaagcgggaggaccagtggtgcggcagtctcataggcctgacggcccgcgccacctgggccaccaacatccaggtggccatcaaccaggtgcggcgcctgatcgggaacgagaactacctcgactacatgaccagcatgaagcggtttaagaacgagagcgaccccgagggcgcgctgtggtga

SEQ ID NO: 24380 - RNA, 9879 nt, synthetic construct
  misc_feature 1..9879: note = derived and/or modified CDS sequence (opt11) from DENV-1__FJ898408__SS-prME
  source 1..9879: mol_type = other RNA
tcggtgaccatgctgctcatgctcatgcccacggccctggcctttcacctcactacccgaggaggggaaccccatatgatcgtgacgaagcaggagcgggggaaaagcctactcttcaaaaccagcgctggggtgaatatgtgcaccctcatcgccatggacctgggcgagctgtgcgaggacaccatgacctacaagtgcccccgcatcaccgaggccgagcccgacgacgtagactgctggtgcaacgcaaccgacacctgggtaacctacggtacctgcagccagaccggagagcaccgtcgcgacaagcggagcgtggccctcgcgccccacgtgggcctggggcttgagaccaggaccgaaacctggatgtccagcgagggcgcctggaaacagatccagcgtgtagagacttgggcccttagacaccccggcttcaccgtgatcgccctcttcctggcgcacgccatcggcacatccatcacacagaaggggatcatcttcatcctcctgatgctggtaacgcccagcatggccatgcggtgcgtcggcatcggctcccgcgacttcgtggaggggctcagcggcgccacttgggtggacgtcgtgctggaacacggctcctgcgtcaccacgatggcgaaggacaagcccacgctggacatcgagctcttaaagaccgaggttaccaaccccgctgtgctgcgtaagctctgcatcgaggccaaaatcagcaacaccacgaccgactcccgttgccccacccagggcgaggccaccctgatggaggagcaggacgccaacttcgtctgccggcgtacgttcgtcgaccggggatggggtaacggctgtgggctgttcggaaaggggagcctcataacgtgtgcaaagttcaagtgcgtgaccaagctggagggaaagatcgtgcagtacgaaaacctgaagtactccgtaatcgtcaccgtgcatactggtgaccagcaccaggtcgggaacgagagcaccgaacacggcacaaccgcgaccataacgccccaggcccctacctccgagatccagctcaccgattacggggccctgaccttagactgtagcccccgcaccggcctcgacttcaacgaaatggtgctgctgaccatgaaggagaaatcctggctcgtccacaagcagtggttcctggatctgccgctcccctggaccagcggggctagcacctcccaggagacgtggaaccggcaggacctgctggtcaccttcaagaccgcccacgcgaagaagcaggaggtggtggtcctgggcagccaagaaggggccatgcacaccgccctcacgggagccaccgagatccagacctcaggcaccactacgatttttgccgggcatctgaaatgccgcctcaagatggacaagctgaccctgaagggcatgagctacgtgatgtgcacagggtccttcaaactcgagaaggaggtagcggagacacagcacggcaccgtattggtacagatcaagtacgagggcaccgacgccccctgcaagatccccttcagcacccaggacgagaagggggtcacgcagaacggccggctgatcaccgccaacccgatcgtgaccgacaaggagaagccggtgaacatcgaggccgagccgccctttggggagtcctatatcgtcataggcgctggcgagaaggccctgaaactcagctggttcaagaaggggtccagcatcggcaaaatgttcgaggccaccgcccgcggtgcccggcgcatggcgatcttaggcgatacggcctgggactttgggtccatcggcggggtgttcacaagcgttgggaagctggtccatcagatcttcggcaccgcatatggggtactgttctccggcgtgtcgtggaccatgaagattggaatcggcgtcctgcttacgtggctcggcctgaactcacgctccaccagtctgagcatgacctgcatcgccgtggggctcgtgactctttatctgggcgtaatggtgcaggcggactccgggtgcgtgatcaactggaagggtcgggagctaaaatgcgggagcggcatcttcgtgacaaacgaagtgcacacatggaccgagcagtacaagttccaggcggacagcccgaagcgcctgtccgccgcgatcggcaaggcgtgggaggagggcgtctgcggcatccggagcgccactcgcctggaaaacatcatgtggaagcagatatccaacgagctcaaccacatactgctggaaaatgggatgaagttcaccgtagtggtgggcgacgtcgtggggatcttggcgcagggcaagaaaatgattcggccacagcccatggagcacaagtacagctggaagagttggggcaaggccaagatcatcggggctgatgtgcagaacacgacctttattattgacggacccaacactccggagtgtcccgacgatcagcgcgcctggaacatctgggaggtcgaggactacgggttcggtatattcaccacgaacatttggctgaagttgcgggacagctacacccaagtgtgcgaccaccggctaatgtccgcggcaatcaaggacagtaaggccgtccatgcagatatgggctactggatcgagtccgagaagaacgagacctggaagctggcccgcgcgagcttcatcgaggtcaaaacctgcatctggcccaagtcccacacgctgtggtcaaacggcgtgctcgagtccgagatgatcatacccaagatctacggcgggcctatcagccagcataattaccgccccggctacttcacccaaaccgctgggccctggcacctgggcaagctagagctcgacttcgacctgtgcgagggcaccaccgtggtcgtagatgagcactgcgggaaccggggcccgtccctccgcaccaccaccgtgacggggaagatcatccacgagtggtgctgccgcagctgcactctgccgcccctacgtttcaagggcgaggacgggtgctggtacggcatggagatccggcccgtcaaggagaaggaagagaacctggttaagtccatggtgagcgccggcagtggggaggtcgatagtttcagcctcgggctgctgtgcacctccatcatgatcgaggaggtcatgcgaagtcggtggtcccgcaagatgctcatgactgggacgctggctgtattcctgctcctgatcatgggccagctgacctggaacgacctcatccggctgtgcatcatggtcggagccaatgcgagcgaccgcatgggcatgggaactacctacctggccctaatggccacgttcaagatgcgcccgatgtttgctgtgggactgctgttccggcgcctcaccagccgggaggtgctgcttctcaccatcggtctgagcctggttgccagcgtagagctccccaacagcttagaggagcttggggacggcctcgcgatgggcatcatgatcctgaagctcctcacagacttccagtcccaccagctgtgggccactctgttaagcctgaccttcatcaagactaccttatccctccactacgcctggaagacgatggcaatggtccttagcatcgtgagcctgttccccctctgtctgagcacaacctcccagaagacgacatggttgcccgtgctcctcggaagcctcggctgcaagccgcttaccatgttcctgatcgcggaaaacaagatctgggggcgcaaatcttggcccctgaatgagggcatcatggccgtcggggtggtgtcgatattactgagcagcctgctcaagaacgacgtccccctggccggccctctgatcgccggcggcatgctcatcgcgtgctacgtgataagcggctcctccgcggacctgtccctggagaaagcagccgaggtgtcttgggaggaggaggccgagcattccggcgccagccacaacattctcgtcgaagtgcaagacgacggcacaatgaaaatcaaggacgaggagagagacgataccctgaccatcctgctcaaggccacgctgctggctgtgagtggggtctacccgctctcgatccccgccacccttttcgtgtggtatttctggcagaagaagaagcagagatctggcgtgctgtgggacacgcccagcccgccagaggtcgaacgggccgtgctggacgatggcatctacaggatcatgcaacggggacttctaggccgctcccaggtgggggttggcgtgttccaggagaacgtattccacaccatgtggcatgtcacgcgcggggccgtgctgatgtaccaaggcaagcgcctggagccctcttgggcgtctgtcaagaaagacctgatcagctacggcgggggctggcggctgcaggggtcatggaacaccggtgaggaggtccaggtgatcgccgtggagcccgggaagaatcccaagaacgtccagaccgcccccggcacgttcaagacgcccgagggcgaagtcggggccatcgcgctagacttcaagccggggacctcaggatcccccatcgtgaacagggagggcaagatcgttggcctgtacgggaacggcgtggtgaccaccagcggtacatatgtcagcgcgatcgcccaggccaaggcctctcaggaagggccgctgcccgagatcgaggacgaggtgtttcggaagcgcaacctcaccatcatggacctgcaccccgggagcggcaagacccggcgctacctgcccgcgatcgtgcgggaggccatcaagcgcaagctgcggacgctgatcctggcccccacgcgcgtcgtggcttccgagatggctgaggcactcaagggcatgcccatccgctaccagaccaccgctgttaagagcgagcataccgggaaggagatcgtcgacctgatgtgccatgccacgtttacaatgcggctattatcccccgtgcgtgtaccgaattacaacatgatcatcatggacgaggcccacttcactgatcccagctccatcgccgcgcgtggctacatcagcacgcgcgtagggatgggcgaagccgccgccatctttatgacggccacgccgcccggcagtgtcgaggcgttcccgcagagcaacgcagtgatccaggacgaggagagagacatcccagagcgctcatggaacagcggctacgaatggatcactgacttccctggcaagaccgtatggttcgtgccctccatcaagagcgggaacgacatcgccaactgcctgcggaagaacggcaagcgcgtgatacaactgtcccggaaaacgttcgacaccgagtaccagaagactaagaacaacgactgggactatgtcgtgaccacggacatcagcgagatgggggcgaactttagggcggaccgggtgatcgacccgcggcggtgcctcaaacccgtcatcctgaaggatggccccgaacgcgttatccttgccgggcccatgccggttaccgtggcctccgctgcccagcggcgcggccggatcggccgcaaccacaacaaggagggggaccaatacatatacatgggccagccactcaacaacgatgaggaccacgcgcactggacagaggccaagatgcttctggacaatattaacacccccgaaggtatcatccccgccctcttcgagccggagcgggagaagtccgctgcaatcgacggcgagtaccgcctgcgcggggaggcgcggaagacgtttgtggagcttatgcgccggggcgacctcccagtctggctgtcctataaggtggccagcgagggattccagtacagcgacagacggtggtgcttcgatggggagcgcaataatcaggtgctggaggagaacatggacgtcgagatttggacgaaggagggcgagcggaagaagctcagaccccggtggctggacgcccgcacgtactccgaccccctggcactaagagaatttaaggagtttgccgcggggcgccggagcgtgtccggcgacctaatcctggagatcggcaaacttccgcagcacctgacccagcgcgcccagaacgccctggataacctcgtgatgctgcacaacagcgagcagggagggcgggcctaccgccacgcgatggaggaactgccggacacgatcgagaccctcatgctgctggcgctcatcgccgtcctgacagggggcgtgaccctgttcttcctcagtggacggggcctgggcaagaccagcataggactgttatgcgtcatggcctccagcgtcttactgtggatggcctcagtggagccccactggatcgcggcctcgatcatcctcgagttcttcctgatggtgctgctcatacccgagccggacaggcagcggacgccgcaggataaccagttggcctacgtcgtcatcggtctcctcttcatcatcttgaccgtggccgccaatgagatgggtctgctcgaaacaaccaagaaggacctgggcatcgggcacgtcgcggtggagaaccaccaccacgccacgatgctggacgtagacctgcaccccgcctccgcctggaccctgtacgccgtcgcgaccaccatcatcacgccgatgatgaggcatactatcgaaaacaccactgccaacatcagccttactgccatcgccaaccaagccgcgatactaatgggtctggataaaggctggcccatttcaaagatggatatcggggtgccattattagccctgggctgctacagccaggtaaatcccctgaccttgacagcggccgtcttaatgctggttgcacactacgccatcatcgggcctggccttcaggccaaggccactcgggaggcccagaagcgcactgcggccgggatcatgaagaaccccaccgtggacggcatcgtcgccattgacctggaccccgtggtgtacgacgccaagttcgagaagcagctcggccagatcatgctcctgatcctgtgcacatcgcagatcctcctgatgcgcaccacgtgggccctgtgcgaatccataaccctcgcgacaggcccactgaccacgctgtgggaaggctccccggggaagttctggaataccaccatcgccgtcagcatggctaatatcttccggggctcctacctcgcgggcgccggcctggcgttctctctgatgaagtccctcggcggtggccgcaggggtaccggcgcacagggcgagacgctgggggagaagtggaagcgccagctgaaccagctctccaagtctgagttcaatatctacaagcgctccggcatcatggaggtggacagaagcgaggccaaggaagggctcaagcggggcgagaccacccgccacgctgtctctcggggaacggctaagctccgctggtttgtcgagcggaatctggtgaagccagagggcaaggtgatcgacctcggctgcggacgcggcggctggagctactattgcgccggtctgaagaaggtcaccgaagtgaagggctacaccaaaggcggcccgggacacgaggaacccatcccgatggccacctacggctggaacctggtgaagctccactccggtaaggacgtcttcttcaccccgcccgagaagtgcgatacgctgctctgtgacatcggcgagagctcccccaacccgactatcgaggaggggcggactttgcgcgtcttaaagatggtggaaccctggctgagaggaaaccagttttgcatcaagatcctcaacccctacatgccgagcgtggtagagaccctagagcagatgcagcgcaagcacggcgggatgctggtgaggaatcctttgtcccgcaacagcacccacgagatgtactgggtctcctgcggcacggggaacatcgtgagcgccgtgaacatgacctccagaatgctactgaaccgcttcaccatggcccaccgcaagcccacctacgaacgggacgtcgacctcggcgcgggcacgaggcacgtggccgtcgagcccgaggtggccaacctggacatcatcggccagcgaatcgagaacatcaaacacgagcacaagagcacctggcactacgacgaagataacccttacaagacctgggcataccacggttcctacgaggtgaaacccagcggaagcgccagcagcatggtcaacggggtggttaagctgttaaccaagccctgggacgtcattcccatggtgacgcagatagcgatgacagacactacccccttcgggcagcagcgagtgttcaaggagaaggtggacacgcgaactccgaaggctaagcgcggcaccgcccaaatcatggaggtgaccgcccgttggctctggggtttcctgtcccgcaacaagaagccccggatctgcacgcgcgaggagttcaccagaaaggtgcgctcgaacgccgcgattggggcggtcttcgtagacgagaaccagtggaactccgccaaagaggccgtggaggacgagcggttctgggatctcgtccagaaggagcgcgagctgcacaaacaaggcaagtgtgcgacgtgcgtgtacaacatgatggggaaacgggagaagaaacttggcgagtttgggaaggccaaaggcagccgagccatctggtacatgtggctcggggcccggttcctggagttcgaagctctggggttcatgaacgaagatcactggttctcgcgcgagaacagcctttccggcgtcgagggggaaggcctgcacaagttaggttacatcctccgggacatcagtaagatccccggcggaaacatgtatgcggacgataccgccggatgggacacgcgcatcacagaggacgacctgcagaacgaagcaaaaatcaccgatatcatggagcctgagcacgcgctgcttgccacctccatcttcaaactgacgtaccagaacaaggtcgttcgggtccaacgcccagcgaagaacggcaccgtcatggacgtgatctcgcgccgggaccagcgggggagtggacaggtgggtacctacgggctgaacaccttcacgaacatggaggcccagctcatccggcagatggaaagtgagggcatcttccttccctccgagctggagacccccaacctcgctgagcgcgtccttgactggctcgaaaagtatggtgtggagcggctcaagcgcatggccatctctggtgatgactgcgtggttaaaccaattgacgaccggttcgctaccgctctgaccgccctgaacgatatggggaaggtacgcaaggacatcccccagtgggagcccagtaagggctggaacgactggcagcaggtccccttctgcagccaccacttccatcagctcatcatgaaggacggcagagagatcgtcgtgccgtgccgaaaccaggacgagctggtggggagagcccgcgtctcccagggcgccgggtggtccttacgggaaacggcctgcctcggcaagtcgtacgcgcagatgtggcaactgatgtacttccaccgccgggacttgcgcctcgccgccaacgccatctgttccgcagaccccggagattgggtgcccacaagcagaaccacctggtccatccacgcccaccaccagtggatgacgaccgaagatatgctgagcgtgtggaaccgagtatggatcgaggagaacccctggatggaggacaagacccacgtgtccagctggggcgacgtgccgtatctgggtaagcgagaggaccaatggtgcgggtcactaatcggcttaaccgcccgcgccacctgggccagcaacatccaggtagcaatcaaccaggtgcgtcggctgatcgggaacgaaaactacctcgactacatgacgtccatgaaacgcttcaaaaacgaaggcgacccggagggggccttgtggtga

SEQ ID NO: 24381 - RNA, 9879 nt, synthetic construct
  misc_feature 1..9879: note = derived and/or modified CDS sequence (opt11) from DENV-1__GQ199843__SS-prME
  source 1..9879: mol_type = other RNA
agcgtcaccatgctgctcatgcttatgccgaccgccctggccttccacttaacaaccagaggcggggagccccacatgatcgtaagtaagcaggagagaggcaagagcctgctgttcaaaaccagcgcaggggttaatatgtgcacactaatcgccatggacctgggggagctttgtgaggacaccatgacctacaagtgcccacggatcacggaggtggaacccgacgacgtggattgctggtgcaacacaaccgatacctgggttacctacgggacctgtagccagacgggggaacatcggcgcgacaaacggagcgtcgccctcgctccacacgtcggcctggggcttgagacccgggccgagacttggatgtcgtccgagggcgcgtggaagcaaatccaaaaggttgaaacctgggcactccggcaccccgggttcacggtgattgccctgttcctggcccacgcgatcggcactagcataacccagaaggggatcatctttatcttgttaatgctggtcacaccctccatggccatgcggtgcgtggggatcggtagccgggatttcgtggaggggctctccggcgcaacgtgggttgacgttgtgctggagcacgggagctgcgtgaccactatggccaaagacaaacccacgctggacatcgagctcctgaagacggaggtgacaaaccccgccgtcttgcgcaagctctgcatagaagcgaagatatccaataccaccacggacagccggtgcccgacgcagggcgaggccaccctcgttgaggagcaggacgccaacttcgtgtgccgtcggaccttcgtggaccgcggctggggaaacggctgtggactcttcggaaaggggtccttaatcacgtgcgcgaagtttaagtgcgtcaccaagttggagggtaagattgtgcagtatgagaatctgaagtactctgtaatcgtcactgtgcacaccggcgaccagcaccaagtcgggaacgaatccacggagcacggtaccacggctacaattacaccccaagcccccacgtctgagatccagctcaccgactacggagccctgaccctggactgcagcccccggaccggcctcgacttcaacgagatggtgctgctgacgatgaaggagaagtcctggttggtgcacaagcagtggttcctagacctgcccctcccatggaccagtggggcctccaccagccaggagacctggaaccgccaggacttgcttgtcactttcaagaccgcgcacgccaagaagcaggaagtagtggtcctcggctcacaggagggcgcgatgcacaccgccctgaccggagcgacggagatccaaaccagcggcaccacgacgatcttcgccgggcacctgaagtgccggctcaaaatggacaagctgaccctgaaggggatgtcctacgtaatgtgcaccgggagcttcaagctagagaaggaggtcgcggagactcagcacggcacagtcctggtgcaaataaagtacgagggcactgacgcgccctgcaagatccccttttctactcaggacgagaagggcgtaacccagaatggcaggctgatcacggccaatccgattgtaaccgacaaggagaagcctgttaacattgaggccgagccgcccttcggggagagttacatcgtgatcggcgccggcgaaaaagcgctgaagctcagctggttcaagaagggaagctccatcggtaagatgttcgaagctaccgcccgcggggctcgacgtatggccatactaggtgacaccgcttgggacttcggtagcatcggcggcgtcttcacgtccgtggggaaacttgtgcaccagatcttcggcaccgcgtacggcgtcctcttcagcggcgtctcctggacgatgaagatcggaatcggcgtcctgttgacctggctgggcctgaatagccgctccacgagcctatccatgacatgcatcgccgtcgggctcgtgaccctgtatctgggggtgatggtgcaggccgatagcgggtgcgtgatcaactggaagggccgagagctcaaatgcggcagcggaatattcgtgaccaatgaggtccacacgtggaccgagcaatacaagttccaggccgattccccgaagcggctgagcgctgccataggtaaggcctgggaggagggggtgtgcggcattcgctctgccacccggctagagaatatcatgtggcgccaaatcagcaacgagttaaatcacatacttctagagaacgacatgaaattcaccgtcgtcgtcggggatgtggtaggcatactcgcccaggggaagaagatgatccggccgcaacccatggagcacaaatactcctggaaaagctggggcaaggcaaagataatcggcgccgacgtgcagaacaccacattcatcattgatgggcctaacacgccggagtgccccgacgaccagcgtgcctggaacatctgggaggtggaggactacggattcggtatttttacgacgaacatctggctgaagttacgggacagttacacgcaggtctgcgaccacagactcatgagcgccgcgatcaaggactccaaggccgtgcacgcggacatggggtattggatcgaatcggagaagaacgaaacctggaagctcgcccgggcgtccttcatcgaagtgaaaacctgtatctggcccaagagccataccctgtggtccaatggcgtcctcgagagcgagatgatcatccccaagatctatgggggcccgatctcccagcacaactaccgcccgggttactttacacagacagcgggcccatggcacctggggaagttggagctcgacttcgacctatgcgaaggaaccaccgtggtggttgatgagcactgcggaaaccgggggccgagcctgcgaacaaccacagtgaccggcaagatcatacacgagtggtgttgtcggtcttgcactctgccgcccctccgattcaaaggggaggacggttgttggtacggaatggagatacggcccgtgaaagagaaggaggagaacctggtcaaaagcatggtctccgccggctcaggcgaggtggacagcttctccctcgggctgctatgcatcagtattatgatcgaggaggtcatgcgatcccggtggagccgcaaaatgctgatgaccggtacgctggctgtgttcttcctgttaatcatggggcagctgacctggaacgatctgatccggtcctgtataatggtgggcgccaacgccagcgatcgcatggggatgggcacgacctacctcgcgttgatggccacctttaagatgcgcccgatgttcgcggtcggcctgttgttcagaaggctgacctcccgcgaggtcctgctcctgacgatcgggttgagcctcgtcgcatcggtggagctgcccaattccctggaagagttaggtgacgggctcgccatgggcatcatgattctgaagctcctgaccgacttccagtcctaccagctgtgggcgaccctgctgagcctgaccttcatcaaaacgactttctccctccactacgcgtggaaaaccatggccatggtgctgagcatcgtctccctcctccccctgtgcctgagcaccacgtctcagaagaccacgtggctccccgtgttgctgggtagcctcgggtgcaaacccctgaccatgtttcttatagccgaaaacaagatctggggccgcaagagctggcccctcaacgaggggataatggcagtgggcatagtcagtatattactatcttccttactgaagaacgacgtgcccctggccgggccgctcatcgccggcggcatgctgatcgcctgctacgtaatctctgggtccagcgcagacctgtccctcgaaaaggcggcggaggtttcgtgggaggaggaggcagaacactccggcgccagccacaacattctagtggaggtgcaggacgacgggacgatgaagatcaaggatgaggagcgagacgacaccctgactatactcctgaaggccactctactcgcggtctccggcgtctacccactcagcatccccgcgaccctgttcgtgtggtacttttggcagaaaaagaaacagcgctccggggtcctctgggacacgcccagcccgccggaggttgagcgtgccgtactggatgacggcatctaccgtatcatgcagcggggcctgctaggtcgctcccaggtaggcgttggggtgttccaggagaatgtctttcacaccatgtggcacgtgacccggggagccgtgttgatgtaccaggggaagcgactggagcccagctgggccagtgtcaaaaaggacctgatcagctacggtggagggtggcggctccagggctcatggaacacgggcgaggaggtccaggtcatcgcggtcgaaccggggaagaatcctaagaatgtgcagacggcccccggtaccttcaagaccccagaaggcgaggttggcgccatcgcgctggacttcaagcccgggactagcggcagccccatcgtcaatcgcgaggggaagatcgtgggcctctacggaaacggggtggtcaccacctcgggcacctacgtgagcgcaattgcgcaggcaaaggcctcccaggagggccctctccccgagatagaggacgaggtcttccggaagcgcaacctgaccattatggacctgcaccccggctcggggaagacgcggcgctacttacccgccatcgtgcgggaggcaatcaagcgcaagttaagaacactgatcctcgcccctacccgcgtggtggcctccgagatggccgaggccctgaagggcatgcccatccgctaccagaccactgcggtaaaaagcgagcacaccggccgggagatcgtggatctgatgtgtcacgccaccttcaccatgagattactctcccccgtgcgggttccgaactataacatgatcattatggacgaagcacacttcacggacccctcgtccatcgccgcccggggttacatatctacccgagttggtatgggagaggcggccgccatattcatgaccgctacgcctcccggctccgtggaagccttcccgcagagcaacgccgtcatacaggatgaagaacgcgacatccccgagcggtcctggaatagcggttacgagtggattacagacttccccggcaagaccgtgtggttcgtgccctccattaagtccgggaacgacatcgctaactgcctgcgcaaaaacgggaagcgggtaatccagctcagccgcaaaaccttcgataccgagtaccaaaagacgaagaacaacgactgggactatgttgtgaccacagacatcagcgaaatgggtgccaacttccgggctgaccgagttatcgacccgaggcggtgcctgaagcccgtgatccttaaggacgggcccgaacgtgtcatcctcgcgggacccatgccggttacagtagcctccgccgcccagcgccgggggaggatcggccggaatcacaacaaggagggcgaccagtacatctacatggggcagcctctaaacaacgacgaggaccacgcccactggacggaggcgaaaatgcttctggacaatatcaatacccccgaaggcattatacccgcgctgttcgagccggagcgcgaaaaatccgccgccatcgacggtgaataccgcttgcggggcgaggcccgcaagaccttcgtcgagttgatgcgacgcggggacctgcccgtgtggctgagctacaaagtggcgtcagaaggattccaatactcagaccggcgctggtgttttgacggcgagcgtaacaaccaggtgctcgaggaaaacatggacgtggagatatggaccaaagagggcgagcgcaagaagctgcggccccgctggctggacgcccggacgtactccgacccactcgcgctaagggagttcaaggagttcgccgccggccggcgcagcgtgagcggggacctaatcctcgagatcggcaagctgccccagcacttaacacagcgggcgcagaacgccctcgataacctggtcatgctgcacaacagcgaacagggcgggcgcgcgtatcggcacgccatggaggaactccctgataccatcgagaccctgatgctgctagcgctgatcgccgtgcttacaggaggggttaccctcttcttcctgtccggccgcggcttgggaaagaccagcataggtctcctgtgtgtgatggcctcgtcggccctcctctggatggcctccgtggagccccactggatcgcggcctcaatcatcttggagttcttcctcatggtgctcctgatccccgagccggaccggcaacgcactccgcaagacaaccagttggcctacgttgttatcgggctcctgttcatgatactgaccgtggccgccaacgagatgggcctcttggagacgacgaagaaagacctcgggattggccacgcggccgtcgaaaaccaccaccacgccaccatgctcgatgtggatctgcaccccgcctccgcatggaccctttacgcggtggccacgacgatcatcacgccgatgatgcggcacaccatagaaaacacgaccgctaacatcagcctcacagccatcgccaatcaagctgccatcctgatgggtctggacaaaggctggccaatctccaagatggacatcggcgtacccctactggccctgggttgctacagccaggtgaaccccttaactctgacggccgctgttctgatgcttgtcgcccactacgcaatcatcgggcctgggctgcaagccaaggccactcgcgaggcgcagaagcgcacagcggcgggaattatgaaaaaccccaccgtggacggaattgtagccatcgacctggatcccgtggtgtacgatgcaaagttcgaaaagcagctcggccagataatgctcctcatactctgtacgtcccagatcctgctaatgcgaaccacctgggcgttgtgcgagtcaatcaccctcgccacgggccccctgaccactctctgggaggggtcccctggcaagttctggaacaccacgattgcggtgagcatggccaacatcttccgcgggagctacctggcaggcgctggtcttgccttctccttgatgaagtcgctcggcggagggcgtcgcgggacgggggcgcagggtgagaccttgggcgagaagtggaaacggcagctcaaccagctgtcgaagtcggagttcaacacctacaaacgcagcgggattatggaggtcgaccgttctgaagcgaaggagggcctgcgccgcggggagacgaccaagcacgcagtgtcccgaggcaccgccaagttgcggtggttcgtagagcggaacttggtcaagccggaggggaaggtgatcgacctcggctgcggccgcggagggtggtcttactactgcgccgggctgaagaaggtgactgaggtcaaggggtacaccaaaggcgggcccggacacgaggagccgatcccgatggccacctacggctggaatctcgtgaagctccatagcggcaaggacgtattctttatcccgccggagaaatgcgacaccctgctgtgcgacatcggggagagctcccccaacccgacaatcgaggagggcagaacgctgcgggtcctgaagatggtagagccctggctccgcgggaaccaattctgcatcaagattctcaacccctacatgcccagcgtagtcgagaccctggaacagatgcagcgcaagcacggcggaatgctcgtgcgcaacccgctgtctcgtaatagcacccatgagatgtactgggtgtcctgcgggacaggcaatatagtcagcgccgtgaacatgacatcccgcatgttactcaatcgcttcacgatggcgcaccggaagcccacgtacgagcgcgacgtggacttaggggccggcacccggcatgtcgcggtggaacccgaggttgccaacctggacatcatcggccagaggatcgagaacatcaaacacgagcacaagtcgacctggcactacgacgaggacaacccatacaagacgtgggcctaccacgggtcatacgaggtcaagccgagcggctcggcgtccagcatggtgaatggggtagtgaagctcctgaccaagccctgggatgtgatccccatggtaacccagatcgccatgaccgacacgaccccattcggccagcaacgcgtgtttaaggaaaaagtggatacgcgcactccgaaggccaagcggggaacggcgcaaattatggaagtgaccgcgcgatggttgtggggcttcctttcccggaacaagaagccacgtatctgtaccagggaggagttcacccgcaaggtgcggagcaacgcggccatcggtgccgtgttcgtcgacgagaaccagtggaacagcgccaaggaggcggtggaggacgagagattttgggaccttgtgcaccgtgagagggagctgcacaagcaagggaagtgcgcaacgtgcgtctacaacatgatgggcaaacgagagaagaagctcggagagttcggcaaggccaaggggagccgtgccatttggtacatgtggctaggtgcccggttcctggagttcgaggcgctcgggttcatgaacgaggaccactggttttcccgagagaacagcctttccggggtagagggcgaggggctgcacaagctcgggtacatcctgcgggatatcagcaagatccccggcggtaacatgtatgccgacgacacggccggatgggacacaaggatcacggaggacgacctgcagaacgaggccaagatcaccgacataatggaaccggagcacgccctcctggcgacctccatcttcaagctgacctaccaaaacaaggtggtccgcgtgcagcgccccgcacgcaacgggacagtgatggacgtcatctcgcggcgcgaccaacgggggtctggccaggtgggcacgtacggcctcaacaccttcaccaacatggaggcccagctgatacgacagatggagagcgagggcatcttctctcccagcgagctggagacccccaacctcgccgagcgggtgcttgactggctggagaaacacggcgtcgaacgcctcaagcggatggcaatctccggtgacgattgcgtggtgaagccaatcgacgaccgcttcgcaaccgccctgagcgcccttaacgacatgggcaaggtccggaaggacataccacagtgggagccaagtaagggctggaacgactggcagcaagttccgttttgctctcatcacttccaccagttaataatgaaggacggccgcgagatagtggtcccgtgccggaaccaagacgagctggtcggccgcgcccgggtgagccagggggcaggctggtccctgagagagaccgcctgcctcgggaagagttacgcccagatgtggcagctgatgtacttccatcggcgcgacctgcggcttgccgccaacgcgatctgttccgccgtccctgtggactgggtgcccaccagccgcaccacgtggtcgatacatgctcatcaccaatggatgacaacggaagacatgctgagcgtgtggaaccgggtgtggatcgaagagaatccctggatggaggacaaaacccacatctccagctggggcgacgtgccttacttggggaagagggaggaccagtggtgcggctccctcatcggcctgacagctcgggcgacctgggcgaccaatattcaggtcgccatcaaccaggtgcggcgcctgatcgggaacgagaattacctcgactacatgacctcgatgaagcggtttaagaacgagtctgaccccgagggcgccctgtggtag

SEQ ID NO: 24382 - RNA, 9879 nt, synthetic construct
  misc_feature 1..9879: note = derived and/or modified CDS sequence (opt11) from DENV-1__GQ199844__SS-prME
  source 1..9879: mol_type = other RNA
tccgtgacaatgctcctcatgctgatgcccaccgccttggcgtttcatctcaccaccagaggaggggaaccccacatgatcgtgaccaaacaggagaggggcaaaagtctactcttcaagacatccgcgggggtgaacatgtgcacactcatcgccatggatttaggcgagctttgcgaggacaccatgacttacaagtgcccccggatcactgaggccgaacctgatgacgttgactgctggtgcaacgccaccgacacctgggtgacctacgggacctgtagccaaacgggcgagcacaggcgcgataagcggagcgtggccctggcgccccatgtgggcctggggcttgagaccaggaccgagacctggatgtccagcgagggcgcctggaagcaaatacagcgggtcgagacatgggcacttcgccaccccgggttcaccgtgatagcccttttcctggcgcacgcaattggcacttccatcacacagaaggggatcatattcatactcctgatgctggtgacgcccagcatggccatgcgctgcgtcgggataggctcccgagatttcgtggagggcctgagcggcgccacttgggtggacgtcgtgctggagcacgggtcctgcgtgacgactatggccaaagacaagccaacgctggacatcgagctcctgaagaccgaggtcacaaaccccgccgtgctacggaagctctgcatagaggccaagatctcaaacacgacgaccgactcaaggtgccccacccagggcgaagcgaccctgatggaggaacaagacgccaacttcgtgtgccgtcgcacctttgttgaccgaggctgggggaacggttgcgggctgttcggcaaggggagcctaatcacgtgcgccaaattcaagtgcgtaaccaagttagagggcaagatcgtgcagtacgagaacctgaagtattcagtcatcgtcaccgtgcacacgggcgaccagcaccaagtcgggaacgagagcaccgagcacggcaccatcgcgaccatcacgccccaggcccccacgtccgagatccagcttaccgactacggtgccctgaccctggactgtagcccccgcaccggcttggacttcaacgaaatggtcctgcttactatgaaggaaaagtcgtggctagtacacaagcagtggttcttagacttgccgctcccgtggacctcgggggcctctacttcccaagagacatggaaccggcaggacctactggtgacgttcaagaccgcccacgctaagaagcaggaggtcgtcgtgctcgggtcacaggagggcgccatgcacaccgccttaaccggggccactgagattcagacctctggcaccaccacgatatttgctgggcatctgaagtgtcgcctcaagatggacaagctgaccctgaagggcatgtcgtatgtcatgtgcactgggtccttcaagctcgagaaggaggtcgcggagacccagcacggtaccgtgctggtacagatcaagtacgagggcaccgacgccccctgtaagatcccattctccacccaggatgaaaagggggtcactcagaatggccggttgataaccgccaaccccatcgtgaccgataaggagaagccggttaacatagaggccgagcctccctttggggagtcctacatcgttatcggcgcgggcgagaaggccttgaaacttagctggttcaagaaggggtcctcgatcggcaagatgttcgaggcgaccgcccgcggagcccgtcgcatggcaatcctgggggacaccgcctgggacttcgggagtgtcggcggagtcttcacgagcgtcgggaaactggttcaccaaatcttcggcaccgcctatggggtcctgttctccggcgtgtcctggaccatgaagatcggtatcggcgtgttgttgacctggctcggcctgaactcccgcagcacgtccctgtccatgacatgcatcgccgtgggactcgtcaccctgtacctaggcgtgatggtccaggcggactccggttgtgttatcaactggaagggccgggagctcaagtgcgggtcgggcattttcgtcactaacgaggtgcatacatggacggagcaatacaagttccaggccgatagcccgaagcgcctgtccgcagctatcggcaaggcgtgggaggaaggggtctgcggcatccgcagcgcaacccgcctggagaacatcatgtggaagcagatcagcaacgagctcaaccacatcctactggagaacgacatgaaattcaccgttgtcgtcggagacgtggtcgggatcctcgctcaggggaagaagatgatcaggccccagcccatggagcacaagtacagctggaagtcctggggcaaggccaagatcattggcgccgacgtacagaacactacgttcatcatcgacgggcccaatacccctgagtgccctgacgaccagcgtgcctggaacatctgggaggtggaggactacggcttcgggatatttacgaccaacatctggctaaaactgcgggacagctacacccaagtgtgcgaccatcgccttatgagcgcggccatcaaggactccaaggctgtccacgccgacatgggatattggatcgagtccgagaagaacgagacctggaagctggcccgggcgagcttcattgaggttaaaacgtgcatttggcctaagtcccacaccctgtggtctaacggcgtgctcgagtccgagatgatcattccgaagatctatggcggcccaatcagccaacacaattaccgccccgggtacttcacgcagaccgctggcccctggcacctggggaagctggagctcgactttgatctgtgcgagggcaccaccgtcgtggtagacgagcattgtggcaaccggggcccgtccctgcgcactaccactgtcacgggcaaaatcatccatgagtggtgctgcaggagctgcaccctgccgcccctgcgcttcaagggagaagacggctgctggtacgggatggagatccggcccgtgaaggagaaggaggagaatctggtgaagtccatggtctccgctgggagcggcgaggtagattccttctccctcgggcttctgtgcatctccatcatgatcgaggaggttatgcgcagtcggtggtcacgcaagatgctcatgaccgggacattagccgtctttctgctcctgatcatggggcagctgacatggaacgacctcatccggctgtgcatcatggtgggtgccaacgccagcgaccgcatgggaatgggcacgacctatctggccctcatggccactttcaagatgcgcccgatgttcgccgtagggctgctattccggcgcctaacgtccagagaagtcctgctgctcacgatagggctgagtctggtggcttccgttgagctccccaatagcctcgaggagctgggcgacgggctcgcgatgggaatcatgatccttaaactgctcaccgatttccagtcacaccagctgtgggccacccttctcagcctgacctttatcaagacgacgctttccctgcactacgcttggaagacaatggctatggtgctgtctattgcgtcgctgttccccctctgcttaagcaccacgagccagaaaacgacctggctgcctgtgctcctgggcagcctggggtgtaagccgctcactatgttcttgatcacggagactaagatctggggccgcaaatcgtggcccctgaatgaggggatcatggcagtgggcgtggtgtctatcctactgtcctctctgctcaaaaatgacgtcccattggctggcccgctgatcgcgggcgggatgctcatcgcctgctacgttatcagcgggtccagcgcagacctgtccctggagaaggccgccgaagtgagctgggaagaagaggccgagcactccggcgccagccacaacatcctcgtcgtggtgcaggatgacgggaccatgaaaataaaggacgaagaacgggacgacacactgaccatccttctcaaagctacactactggctgtatccggcgtataccccctcagcatccctgccaccctgtttgtgtggtacttctggcagaagaagaagcagcgctccggggtattgtgggatacccccagccctcctgaagtggaacgggctgtgctcgatgacgggatctaccgtatcatgcagcgcggcctcctagggcgctcacaggtaggggtgggggttttccaggagaacgtcttccacaccatgtggcacgtgacgcgtggcgcagtactgatgtaccaggggaagcgcctcgagcctagctgggcgtccgtcaagaaagatctgattagctacggcggtgggtggcggctgcagggctcctggaacacgggggaagaagtacaggtgatagccgtagagcccggcaagaaccctaagaacgtgcagacagcacccgggacctttaagacgcccgagggcgaggtcggcgccatcgccctcgactttaagcccggaacctcgggctcgcccatcgtcaaccgcgaggggaagatcgtggggttgtacggcaacggggtggtcacgaccagcggcacgtacgtcagcgccatcgcccaggccaaagcaagtcaggagggtccgttacccgagatcgaagacgaggtgtttcggaagcgcaacctcaccataatggacttacatcctggtagcgggaagacccggcgctacctgccggcaatcgtccgggaggccatcaaacgcaaactccggaccctgatcctggccccgacgcgcgtcgtggcttccgaaatggccgaggcgctcaaagggatgcccatccgctaccagactaccgccgtcaagagcgagcacaccggcaaggagatcgttgacttgatgtgtcacgccacgtttaccatgcggctgctctcccctgtgcgcgtgccgaactacaatatgatcattatggacgaggcccacttcactgaccccagctccatcgcagcgcgagggtacatcagcaccagggtgggcatgggggaagccgcggcgattttcatgacggccacgccacccgggtccgtggaggctttcccgcagtcaaacgcggtcatccaggatgaggagcgggacataccggagcgctcgtggaacagcgggtacgaatggatcaccgacttcccaggcaagaccgtgtggttcgtgccctccatcaagagcgggaacgacatcgccaactgtctccgcaaaaatggcaagagagtcatccaactttcccggaaaacgttcgacactgagtaccagaagacaaagaacaacgactgggactacgtggttaccaccgacatcagcgaaatgggcgcaaacttcagggcggatagagttatcgatccgagaaggtgcctcaagcccgttattctgaaggacggaccagagcgcgttatcctggccggtcccatgcctgtgactgtggcctccgccgcccagcggcgcgggcgcatcggccgtaaccacaacaaggaaggcgaccagtacatctacatggggcaacccctcaataacgacgaggaccacgctcactggaccgaggccaagatgctgcttgacaacatcaacacccccgagggaatcatcccggccctctttgaaccagagcgggagaagtccgccgccatcgacggagagtaccgcttacgaggtgaagccagaaagacgttcgtcgagcttatgcgccgcggggatctccccgtgtggctgtcctacaaggtggccagcgagggattccagtacagcgacagaaggtggtgcttcgacggcgagcgcaacaaccaggttctggaggagaatatggacgtggagatctggacaaaggagggcgagcgaaagaaactcagaccccgttggcttgatgcccgcacgtactccgatccactggctctccgggaatttaaggagttcgccgctgggcgccggagcgtgtccggggacctgatcctggagataggtaaactcccccagcacctaacccaacgcgcgcagaacgcgctggacaacctggtcatgctgcacaactcagagcagggcggtcgggcctatcgccacgcaatggaggagctacccgacacgatcgagaccctcatgctgcttgctcttatcgccgtcctcacaggcggggtgacgctgttcttcctcagtggccgggggctggggaagacctctattggcctcctgtgtgtcatggcctcctccgtgctgctgtggatggcctccgttgagcctcactggatcgcggcatcgataatcctagagttcttcctgatggtcctgttaatccccgaaccggaccgccagcggacgccgcaggacaaccagctggcttatgtcgtaatcgggctactcttcatgatcctgaccgtcgccgctaacgagatgggcttgctcgagaccactaagaaggacctggggatcggccatgtggctgtggagaaccatcaccacgccaccatgcttgatgtcgacctccaccccgcctcagcctggaccctgtatgccgtcgcgaccaccataatcacgccgatgatgcgccacaccatcgagaacaccaccgccaatatcagcctgaccgcgatcgccaaccaggccgcgatcctcatgggactggacaaagggtggcccatctccaagatggacatcggtgtacccctgcttgccctcgggtgctacagccaggtcaatccactgaccctaaccgccgcggtgctgatgctggtggcgcactacgcaatcatcggcccggggctacaagcgaaggctacacgggaggcccagaagcgcacagctgccggcataatgaagaaccccaccgtcgacgggatcgttgccattgatttagaccctgttgtatacgacgccaagtttgagaagcagcttggccagatcatgctcttaatcctgtgtacctcgcagattctccttatgcgcaccacgtgggccctgtgcgagagcatcaccctcgcgaccggccctctgactacgctgtgggagggatccccgggcaagttctggaacaccaccatcgccgtaagcatggctaacatattccgggggagctacctcgcaggagccggactggcgttctcactgatgaagtccctcggcggagggcgcagaggcacgggggcacaaggcgagacgctcggcgagaagtggaagcgccaactgaaccaactttccaaaagcgagttcaacatctacaagcggagcgggatcatggaagtggaccgcagcgaggccaaggaggggctgaagcgtggtgagaccaccaggcacgccgtctcccgggggaccgcaaagctccgctggttcgtggagcggaacctggttaagccagagggcaaagttatcgacctcggttgcgggcgcggaggctggagctactactgcgccgggctgaagaaagtgacggaagtgaagggctacaccaagggcgggcccggccatgaggagcccatcccgatggccacgtacgggtggaacctggtcaagctccattccggaaaggacgttttcttcacgccgcccgagaagtgcgacacgttactgtgcgacatcggagagtcatcccccaaccctaccatcgaggagggccggaccctccgggttctgaagatggtcgaaccctggctccgtgggaaccagttctgcatcaaaatcctcaacccttacatgccatcagttgtggagacactggaacagatgcagcgcaagcacggtggtatgctggttcggaacccgctttcccggaacagcacgcatgagatgtactgggtgtcctgcgggacgggtaacatcgtcagcgccgtcaacatgacttcccggatgctgctcaaccgcttcactatggcccaccgcaaacccacatacgaacgggacgtggacctcggggcgggcactcgccacgtcgccgttgaacccgaagtggccaaccttgacatcatcggccagcggatagagaacatcaagcacgaacacaagtccacctggcactacgacgaggacaacccctacaagacgtgggcctaccacgggtcctacgaggttaagccaagcggcagcgccagcagcatggtgaacggggtggtgaagctgctcaccaagccctgggacgtgatccccatggttacgcagatcgcgatgacggataccacccccttcggccagcagcgcgtcttcaaggaaaaggtggacacgcggaccccgaaggccaagcgaggtaccgcccaaatcatggaggtgaccgcgcgatggctgtggggcttcctgagtcgcaataagaaaccccgtatctgtacgcgcgaggagttcacccgtaaggtccgcagcaacgcagcgatcggcgcagtgttcgtggacgagaaccagtggaactccgcaaaagaggcagttgaagacgagcgcttctgggacctcgtgcaaaaggagcgcgagcttcacaagcaggggaagtgcgcgacctgtgtgtacaacatgatgggcaagcgggagaagaagctgggagagtttggcaaagccaaggggagtcgagctatatggtacatgtggctcggcgcgcggtttctggagttcgaggcgctaggctttatgaacgaagaccactggttctcccgcgagaatagcctctccggcgtcgaaggagaggggctgcataagctgggctacatactccgggacatcagcaaaatccccgggggcaacatgtacgcggacgacaccgccggctgggacacgcgcattaccgaggacgatctgcagaatgaggccaagatcacggacatcatggagccggagcacgccctgttagccacctccatcttcaagctgacgtaccagaacaaggtggtgcgagtccagcgccctgcgaagaacgggaccgtgatggacgtgattagccgtcgagaccagcgcggatccgggcaggtcggcacctacggcctgaacacattcacgaacatggaggctcagctaatacggcagatggagagcgaggggattttcctcccctcggagctggagaccccgaacctcgccgaacgtgtgctggactggctggagaagtacggcgtggagcgtctcaagcgtatggctatcagcggcgacgactgcgtcgtgaagccgatcgacgacaggttcgccaccgccttaaccgcgctgaacgacatgggcaaggtgagaaaggacataccccaatgggagccctccaaggggtggaacgactggcagcaggtcccgttctgcagccaccacttccaccagctcatcatgaaggatggtcgggagatcgtggtgccctgccgcaaccaggatgagctggtggggcgggcacgggtttcacagggagctggctggagcctgcgggagacggcctgcctcggcaaaagctatgcccagatgtggcagctgatgtacttccacaggcgggacttgcgcctcgctgccaacgccatctgttccgctgtgcccgtcgattgggtgcccaccagccggactacctggtccatccacgctcaccaccaatggatgaccaccgaggacatgctgagcgtgtggaaccgcgtatggatcgaagagaatccgtggatggaggacaagacccacgtgtccagctggggagacgttccgtacctggggaagagagaggatcagtggtgcggctctctcattggcctgaccgctagagccacgtgggccagtaatatccaggtcgcgataaatcaggtacgccggctgataggaaatgagaattacctcgactacatgacgtccatgaagcgctttaagaacgagggagaccccgagggggctctgtggtga

SEQ ID NO: 24383 - RNA, 9879 nt, synthetic construct
  misc_feature 1..9879: note = derived and/or modified CDS sequence (opt11) from DENV-1__GQ199845__SS-prME
  source 1..9879: mol_type = other RNA
tctgtcacgatgctactgatgctgatgcccacggccctggcttttcatctcacgacacggggaggggaaccccacatgatcgtctcgaaacaggaacgagggaaaagcctcctattcaaaacatccgccggggtgaacatgtgcacactcatcgcaatggacttgggggagttctgcgaggataccatgacatacaagtgcccacggataaccgaggccgaacctgatgacgtcgactgctggtgcaacgcaacagacacatgggtcacctacggcacttgttcgcagacaggcgaacatcgacgagacaaacgcagcgtcgccctagcaccccatgtaggcctcgggctcgagacccgaaccgagacctggatgagctcagaaggcgcatggaaacagattcagcgtgtcgaaacatgggcacttaggcacccgggcttcaccgtcatagctctcttccttgcccatgcaataggaactagcataacccagaaaggcatcatcttcatactgcttatgctcgtcactccatccatggctatgagatgcgtaggtatcggttctcgtgacttcgtcgaaggtctaagcggcgcgacctgggtagacgtagtcctagaacacgggtcgtgcgttacaacaatggccaaagacaaacccaccctcgacatagagctgttgaaaacggaagtcacgaacccagcagtgttgcgaaaactctgtatcgaagctaaaatttcgaacacgaccactgacagtaggtgccccacccagggagaagccaccctagtagaagaacaggacgctaactttgtgtgtaggaggacgttcgtggatagagggtggggtaacgggtgcggcctcttcgggaaagggagcctaataacctgcgcgaaattcaaatgcgtgacgaaactcgaaggaaaaatcgtccaatacgaaaacctaaaatatagcgtgatcgtaacggtgcatacaggggatcagcaccaggtcggcaacgagagtacagagcacggcaccacagccacaattactccccaagccccatcgaccgagatacaattgaccgactacggagccctaacgctcgactgtagcccgaggactggactggacttcaacgagatggtcctcctaacaatgaaagaaaaatcttggcttgtacacaaacaatggttccttgatctacccttaccgtggaccagtggggcgagtacaagtcaggaaacatggaacagacaggacctgctagttacgtttaaaacagcacacgcaaagaaacaggaagtcgtcgttctcggaagccaagaaggagctatgcatacggcactgacaggagcaaccgaaatacaaacctcaggaactacgaccattttcgcaggacacttaaagtgccggctaaaaatggacaaactcaccttgaagggcatgtcatacgtgatgtgcaccggatctttcaaactcgaaaaagaggttgcagaaacgcaacacgggacagtcttagttcagattaaatacgagggtacagacgcaccctgcaaaattccttttagcacgcaagacgagaaaggggtcacacagaacggacgattgatcaccgcaaacccgattgtgacagacaaagaaaagccggtcaacatcgaagccgaaccgccgttcggagaaagctacatagtaatcggagccggggaaaaagcccttaaactttcctggttcaagaaaggaagcagcatagggaaaatgttcgaggcgacagcacgcggagcaagaaggatggccatactaggcgatacagcatgggactttggaagtatcggtgggatgtttactagcgtggggaaactcgttcaccagatattcggcactgcgtacggtgtattattttccggagtttcgtggaccatgaagataggaataggagttctcctcacatggctgggcctaaatagcagatccacatcccttagcatgacatgcatagctgtcggccttgtcacgttatatcttggggtgatggtacaagcggacagtggctgtgtgataaactggaaaggaagggaattaaaatgcggatccggcatcttcgttacaaatgaggtacacacatggaccgaacagtacaaattccaggccgacagcccaaagcggctatcggcagcaattggaaaagcatgggaggagggagtctgcggaattagaagcgccacccgcctcgaaaacataatgtggaaacagatatccaatgaactaaaccacattctgcttgaaaatgacatgaaattaaccgtagtcgttggagacgtcgcagggatactagcgcaagggaagaaaatgatcaggccccaaccaatggaatataagtatagctggaagatatggggaaaagcaaagatcataggggcagatgtacagaacaccacattcatcatagacggccctaacaccccagagtgtcccgatgaccaacgtgcatggaacatatgggaagtagaggattacggcttcggcatcttcacaactaacatctggctgaaacttcgcgactcttacacccaggtctgtgatcaccgacttatgagcgcagcaatcaaagactccaaggccgtacatgcagatatgggatactggattgagtcggagaaaaacgagacctggaaactcgccagggcgtcattcatagaagtcaaaacgtgtatatggcccaagtcgcacacactgtggagcaacggggtcctggaatctgagatgataattccaaagatctacggtgggcccatttcgcagcataactatcgccccggttactttacccaaacagcaggcccctggcatctaggaaaattagaattagactttgacctgtgcgaagggaccacagtagttgtcgacgaacactgcggaaaccggggcccgagtctgcgaacgacaaccgtaacagggaaaatcatacacgaatggtgctgtcgcagctgtacgctaccaccccttcggttcaaaggggaagacgggtgttggtatggcatggagatacgcccagtaaaggaaaaagaggagaacctggtcaagtccatggtaagcgcaggcagtggggaggtagacagcttctccctaggactgctttgcatctcgatcatgatcgaagaagtcatgcgcagcagatggtcgcgtaaaatgctcatgacagggacactagccgtctttttcctgcttataatggggcaattgacgtggaatgacctgatcagactctgcatcatggtaggagcgaacgccagtgatcgaatgggaatgggcaccacatacctcgcacttatggcaaccttcaagatgcgcccaatgttcgcagttggcctgctttttcgacgcctgacgagccgggaagttcttctactcacaataggcctgtccttagttgcaagtgtagagttaccaaattctttggaagaacttggtgacggactcgccatgggcatcatgatactaaaactcctgaccgacttccaatcgcaccagctctgggccacactcctgtccctcacattcataagaactaccttctcactacactacgcgtggaagacaatggccatggtcctatccatagtctcactattccccctatgcttatccacaacctcacagaaaacaacgtggctccccgtactcctcggatcattaggctgtaagcccttgacgatgttcctcatcgcggaaaataaaatatggggacggaaatcgtggccactgaacgaaggaataatggcagtgggcatagttagcatactcctatcaagtctcttgaaaaacgacgtaccgctagcgggtcctctaatagccggcggcatgctaattgcgtgctatgtcatttcagggtcaagcgctgacctgagtctcgaaaaagccgcagaagtatcgtgggaggaggaagctgagcactcaggcgccagccacaatatccttgtcgaagtacaagatgacggcacaatgaagatcaaagacgaagaaagggatgacacattgaccattctgcttaaggcgactctgctggccgtaagcggagtatatcccctatccatcccagcaaccctgttcgtgtggtatttctggcaaaagaaaaagcaacgaagcggcgtactgtgggacaccccctctcccccagaggtcgaacgagctgtcctcgacgacggaatctatcgcatcatgcagcgggggctcctgggtcgaagtcaagtgggagtaggcgtttttcaggaaaacgtattccacaccatgtggcacgtgactcgaggggccgttctcatgtaccaaggaaaaaggcttgagccatcctgggcaagcgttaagaaagaccttatttcttacgggggcggctggcgactccagggctcctggaacactggggaagaggtccaagtaatcgcggtcgaaccgggcaagaacccgaaaaacgtacagaccgcaccgggcaccttcaagactagcgaaggcgaggtcggcgcaatagcactggacttcaaacccggaacatcgggaagtcctatagtcaacagagaaggcaagatagtcggtttatatggaaacggagtcgtgactactagcggaacctacgtatcggccatcgcccaggccaaagcaagccaagaaggccctctaccagaaatcgaagacgaggtcttccgaaagcggaatctcaccatcatggatctacacccaggatcaggcaaaacccgtcgatacctaccagcgatcgtcagagaagcaacaaaacggcggctcagaacactaatcctcgcacctacccgagtcgtagccagcgaaatggcggaggccctcaaaggcatgccgattcgataccagaccacagcggtgaaatcagaacacaccggtaaagaaatagtcgacttgatgtgccacgccacgtttacaatgcgccttctcagtcccgtgcgagttcctaactacaacatgataatcatggacgaggcgcacttcacggacccctcatcaattgccgctagaggttatatatccactcgagttggcatgggcgaggcagccgcgatattcatgacagcaacgccccctgggtcggtagaagcgttcccccagtccaacgccgtgatacaagacgaggaacgcgatataccagaacgcagttggaacagcggatacgaatggatcacagactttccaggcaaaacagtctggttcgtacccagcatcaagagcggtaatgacattgcgaactgcctgaggaagaacgggaaacgagtaatacagttgagtaggaaaacattcgacacagaataccaaaagactaagaacaatgactgggactatgtagtgaccacagacattagcgaaatgggcgccaatttcagagcagacagagtaatagacccccgacgttgcctcaagcccgtcatactaaaggatggccccgagagagtcatacttgccggccccatgcccgtaacagtggccagcgcggcgcagaggcgaggcagaatcggaaggaaccacaacaaagaaggggaccaatacatttatatgggccagcccctaaataacgacgaagaccatgcgcactggacagaggcaaagatgctgctagacaacatcaataccccagaagggatcattccagcgctctttgaaccagaacgcgagaaaagcgcagcaattgacggggaataccgtttgcgcggagaagcccgaaagaccttcgtggagctgatgcgaagaggggatctacctgtatggctgtcctacaaggtagcctcagaaggcttccagtactcagataggcggtggtgcttcgacggggagcgaaacaaccaggtgctggaagaaaatatggatgtcgaaatctggacgaaggagggagaaaggaagaaattgcgccctcgttggctagacgcaagaacatattcagacccgctggcgctaagagaatttaaagagttcgctgcaggacgacgatcggtaagcggcgacctaattctggaaataggaaagttaccgcaacacctcacccaaagggcgcagaacgccctcgacaacctcgtaatgctacacaactcggaacaaggaggccgagcctaccgtcacgcaatggaagaattacccgacacgatcgagaccttaatgttactcgccctaattgcagtgctcacgggcggtgtaactctcttctttctgagcggtagagggctcggaaaaacgtcgattggactgctctgcgttatggcctcctccgtcctactatggatggccagcgtcgaaccacactggatcgcagcttcaataatactcgagttctttttgatggtgctactgatccccgaacccgatcgccaacgcacaccgcaggataaccaactagcatatgtcgtaataggactcctcttcatgatattaacagtggcagcgaacgagatggggctgctcgagacgacgaagaaagacctcggaatcggtcacgtagcagtcgaaaaccaccaccacgcggcaatgctcgacgtcgacctgcatccagcctcagcatggacactttacgctgtagcaaccactatcataacgccaatgatgaggcataccattgaaaatactaccgcaaacattagtctaacggctatcgccaaccaggcggccatcctcatggggttagataagggatggcctatatccaaaatggacatcggagttccacttcttgcactcggctgttactcgcaagtaaacccactaaccctgacggcggccgtactcatgctggttgctcattacgcaatcataggtccgggacttcaagccaaggcaacccgggaggcgcagaaaaggacggcagcgggtatcatgaaaaatcccaccgtagacggaatcgtagcgatagaccttgaccccgttgtttatgacgccaaattcgaaaagcaactaggccagatcatgctgttgatactgtgcacatcccaaatcctactcatgagaacgacatgggcgctgtgcgaatctattacactcgccacgggaccattaacaactctttgggaaggctcacccgggaaattttggaataccacaattgcagtaagtatggcaaacatattccgtggaagttacttagcaggagcagggctagccttcagtttaatgaagtcgctcggcgggggaaggcgcggcacaggcgcgcaaggggagactctaggagagaaatggaaaaggcagctaaaccagttatctaaaagcgagttcaacacttacaaacggagcgggataatggaagttgataggtcggaagccaaagaaggactcaaaagaggggaaacgaccaaacacgctgtgagcagagggactgctaaattgcgctggttcgtagagagaaacttagtgaagccagagggaaaggtgatagacttagggtgtggcagaggaggatggtcatattactgcgctggattaaagaaggtcaccgaagtaaaaggatatacgaagggcgggcccggccacgaagaacccatacccatggcaacctatggatggaacctagtgaaacttcactccggaaaggatgttttcttcattccaccagaaaaatgcgatacgttattatgcgacataggggaatccagcccaaacccgaccatcgaagaaggacggacacttagggttctaaaaatggtcgagccttggctacgaggcaaccagttttgtatcaaaattctaaacccctacatgcccagtgtcgtagagaccctggagcagatgcagagaaaacatggcgggatgttagtgcgtaacccactaagccggaacagcacccacgaaatgtattgggtttcatgcggaacaggtaatatagtaagcgcagtcaacatgacgtccaggatgctgctgaaccgcttcacaatggcccaccggaagcccacttacgaacgggatgtcgacctcggagcagggacacgtcacgttgccgtcgaaccggaagtcgctaacctagacatcattggccaacgaatagaaaacatcaagcacgaacacaagtctacatggcactacgacgaagacaacccctacaagacctgggcctatcatggctcatacgaagtgaaaccatcagggtcagcaagcagtatggtaaacggagtggtcaaactgctcacaaagccatgggatgtcataccgatggtgacacaaatagcgatgaccgatacgacgcctttcggccaacaacgagtctttaaggaaaaagtcgacaccagaacacctaaggcaaaacgcgggaccgcccaaattatggaggtcacggctaagtggctgtggggatttcttagtcgaaataagaaaccaaggatctgcacacgtgaagagttcacccgcaaggtgcgcagtaatgcagcaataggagcagtcttcgtggatgagaaccaatggaacagcgcaaaagaggcagtcgaagatgaaagattctgggatctggtgcaccgcgaacgggaactacataaacaaggcaaatgtgcgacgtgcgtctacaacatgatggggaagcgagagaagaaactcggcgagttcggaaaagccaaagggagtagggcaatctggtatatgtggctgggagcgaggttcctggagttcgaggcattgggatttatgaacgaggatcattggttcagccgagagaactcgctctcaggagtcgaaggagaggggctacacaaactcggatacatcctgcgagatatatcgaaaataccagggggaaacatgtacgcggacgacacagcaggatgggacaccagaataacggaagatgacctccaaaacgaagctaagatcactgacataatggaaccggagcacgctctgctggcgaaatccatattcaaactcacgtaccaaaacaaagtagtgcgcgtccaaaggccggcgaaaaacggcacagtaatggatgtaatatcccgcagggatcaaagggggtcgggacaggtcggcacatatggactaaacaccttcaccaacatggaggcgcagctaatacgacaaatggaaagcgaaggcatattctcgccaagcgaactagaaactcccaatctggccgggcgagttcttgattggttggaaaaacatggggtagaacgactcaaaaggatggccatcagcggcgacgactgcgtagttaagcccatagatgacaggttcgcgacagccctgaccgcactaaacgacatgggaaaggtaaggaaggacatccctcagtgggagccctccaaaggctggaacgactggcaacaggtgcccttctgcagtcaccattttcaccaactcatcatgaaagacgggagggaaattgtcgtcccctgccgaaaccaggacgaactcgttggtagagcacgcgtcagtcaaggtgcggggtggtcccttcgggaaacggcatgccttggtaaatcctatgcacagatgtggcagctcatgtacttccacaggcgagacttgcgcttggccgccaacgcaatatgcagcgcagtcccagtggactgggtaccaacgtcgcgaacaacgtggagcatacacgcacatcaccagtggatgaccacggaagacatgctcagtgtatggaatcgagtctggatagaagagaacccatggatggaagacaaaacccacgtatccagctggggagacgtcccgtacctcgggaaacgggaagatcagtggtgtggaagcctgatcggcctgacggcccgagcgacctgggcaaccaatatacaagtggcgataaaccaggtaaggagactgctggggaacgagaactaccttgattacatgacatcaatgaaaaggttcaagaacgagagtgacccagaaggggccttatggtaa

SEQ ID NO: 24384 - RNA, 9879 nt, synthetic construct
  misc_feature 1..9879: note = derived and/or modified CDS sequence (opt11) from DENV-1__GQ199846__SS-prME
  source 1..9879: mol_type = other RNA
tccgtaaccatgctgttgatgctaatgccgactgcgcttgccttccatctaacgacccgaggcggggaacctcacatgatcgtcactaagcaggaacgggggaaaagcctgctgttcaagaccagcgcgggggtgaacatgtgcacgctcatcgccatggatcttggcgagctctgcgaggacaccatgacctacaagtgtccccgcattacggaagccgagcccgacgatgtggactgttggtgcaatgccaccgacacctgggtcacctatgggacctgcagccagactggggagcatcggagggacaagcggagcgtggcgttggctcctcatgtgggcctagggctggagactcgcaccgagacttggatgagctccgagggcgcgtggaagcagatccagcgcgtcgagacctgggcacttcgccaccccggcttcaccgtgatcgccctgttcctggcgcacgccataggcacgtccatcacccagaagggcatcatcttcattcttctgatgctggtaacgcccagcatggccatgcgatgcgtcgggataggctcccgcgactttgtagaggggctcagcggcgccacctgggtggacgtcgttctggagcacgggtcgtgtgtaactatcatggctcgggacaagcccaccctggatatcgagttactcaagacggaagtcaccaacccggcagtgctgcgcaagttgtgcatcgaagcaaagatcagcaatacgacaaccgactctaggtgcccaacccagggggaggccaccctaatggaggagcaggacgccaacttcgtgtgtcggcggaccttcgtcgatcgcggctgggggaacggctgcgggttgtttggcaaggggtcactcatcacgtgcgccaagttcaagtgcgtgacgaagctggagggcaagatcgtgcaatatgagaacctaaaatactccgtcatcgtgacagtgcacaccggcgaccagcatcaggtaggaaacgagtctacggagcacggcactaccgcgaccatcacaccccaggcgccgacgtccgagatccagctcaccgactacggggctctgacgcttgactgcagccccagaacgggcctggatttcaacgagatggtgctgctgacgatgaaggaaaagagctggctcgtccacaagcagtggttcctcgacctgccgctcccctggaccagcggtgcgtcaacctcccaggagacctggaatcgccaggacttactggtgacgtttaagactgcccacgcgaagaaacaggaagtggtcgtgctcggcagccaggagggagccatgcacaccgcactgacgggggcgacagagatccagacctccggcacgactacgatcttcgccggccacttgaagtgccggctcaagatggacaagctgaccctgaaggggatgtcctacgtcatgtgtacaggttccttcaagctcgaaaaggaggtcgcggagacgcagcacggcacggtgctggttcagatcaagtacgagggcaccgacgccccatgcaaaatacccttcagcacacaggatgagaagggggtcacccagaacggcagactgatcacggccaacccgatcgttaccgacaaagagaagccagtgaacattgaggccgagccgccattcggtgagtcttacatcgtcatcggagcaggcgagaaagcccttaaacttagctggtttaagaagggatcatcaatcgggaagatgttcgaggcaacggcccgaggggcccgccgcatggccatactgggcgacaccgcctgggatttcgggtccgtgggcggtgtgttcacctcagtcgggaaacttgtgcaccagatcttcggcaccgcctacggtgtcctgttctcgggcgtcagctggaccatgaagatcggaatcggagtgctgctaacctggctgggcctaaactcccgttccacgtcgctgagcatgacctgtattgccgtaggtctcgtcaccttgtaccttggtgtgatggtgcaggcggattccgggtgcgtgatcaactggaagggacgggagctgaagtgcgggagcggcatattcgtgaccaacgaggtacatacttggaccgagcaatataagttccaggcggacagccccaagagactgagcgccgccataggcaaggcctgggaggagggggtctgcggcatcaggagcgcgacccgcttagaaaacataatgtggaagcagatctctaacgagctcaaccatatcctattagagaatgacatgaagttcaccgtggtagtcggggacgtggttggcatcctggcgcagggcaagaagatgatcaggccccagcctatggagcacaagtatagttggaaaagctggggcaaggcgaagatcatcggagcagacgtccagaataccacctttataatcgacgggcccaacaccccggaatgccccgacgatcagcgggcatggaacatatgggaggttgaggattacggctttggtatcttcaccaccaacatctggctgaagctacgcgacagctacacccaagtgtgcgaccaccggctgatgtccgcggcaatcaaggatagcaaggcggtccacgccgacatgggctactggatcgagtctgagaagaacgagacgtggaagctggccagggccagcttcatcgaagtgaagacatgcatctggcccaaatcccacaccttgtggtccaacggcgtcctcgagtctgagatgatcatacctaagatctacggcggcccgatctcgcagcacaactacaggcccgggtacttcacacaaacagccgggccctggcacctggggaagctggagttggactttgacttgtgtgaaggcacaacggtcgtggtggacgaacactgcggcaaccgcggaccgtctctgcggacgaccaccgtcaccgggaagatcatacacgaatggtgctgtcggagctgcacgctgccacccctccgattcaaaggtgaggatggctgttggtacggcatggaaatccgccccgttaaggaaaaggaggagaacctggtgaagtcgatggtcagcgccggaagcggtgaggtggactccttcagcctcggtttactgtgtatctccatcatgatagaggaagtaatgcggagccgctggagtaggaagatgctcatgacgggcaccctggccgtcttcctgctcctcataatggggcagctgacgtggaacgacctcatccgcctgtgcataatggtgggcgccaacgcaagcgaccgcatgggaatgggcactacctacctggccctcatggccaccttcaagatgcggccgatgttcgctgtaggcctgctgttccgccgcctcacctcaagggaggtcctcctactcactatagggttgagcctggtggcctccgtagagttgcccaacagcctggaggagttgggcgacgggctcgcgatgggcatcatgatcctgaagctgctcaccgatttccagtcccaccagctgtgggccaccctgctcagcctgaccttcatcaagacgaccctgtcactccactatgcgtggaagaccatggccatggtgttgtccattgcatccctgtttcccctatgccttagcaccacctctcagaagaccacatggctgccagtgctcttaggctcattgggttgtaagccactgaccatgtttttaatcacggagaccaagatctggggtcggaagtcatggccgctgaacgaagggataatggcggtaggcgttgtgagcatactcctcagctccttactcaagaacgacgtccccctggccgggccgctgatcgcgggcggtatgctcatcgcctgttacgtgatcagcggatccagcgcggacctttccctggaaaaggcggcggaggtcagttgggaggaggaggctgagcactccggagccagccacaacatcctcgtggtggtgcaggacgacgggaccatgaagatcaaggatgaggaacgcgatgataccctgaccatcctgctcaaggcgaccctgctggccgtctcaggagtgtaccctctcagcatccccgccaccctgttcgtgtggtacttctggcagaagaagaagcaacggtccggggtcctgtgggacactcccagtccacccgaagtggagcgcgccgtgctggacgacggcatctaccggataatgcaacgcgggctcttggggcggtcacaggtgggcgtgggggttttccaagaaaacgttttccacaccatgtggcacgttacgaggggagccgtgctaatgtaccaggggaagcggcttgaacccagctgggcgtccgtgaagaaagacctgatctcgtacggcggagggtggcgcctgcaaggctcctggaataccggggaggaggtccaggtgattgcagtcgagcccggcaagaaccccaagaacgtacagaccgccccgggcaccttcaagacaccggagggggaggtgggcgctattgcccttgacttcaagccggggaccagcggctcccccattgtaaatcgggaggggaagatcgtgggcctgtacggcaatggggtggtgaccaccagcggcacgtatgtgagcgccatcgctcaggccaaggcttcacaggagggcccgctgcccgaaatagaggatgaggtgttccgcaagcggaatttgacaataatggacctgcaccccggctctgggaagacccgccggtacctcccggccatcgtccgtgaagccatcaagagaaaactccgtaccctgatcctggcacccacacgcgtggtggcctccgagatggccgaggcactaaagggcatgcccatccggtaccagactacagcggtcaaaagtgaacacacaggcaaagagattgttgatctgatgtgccacgccacgttcacgatgcgcttgttatcgcccgtgagggtcccgaattacaacatgatcatcatggacgaggcgcacttcaccgacccttcatccatcgctgcgaggggatacatcagcacccgggtgggcatgggggaggccgcggccatattcatgacggcgacgccgcccgggagtgttgaggcgttcccgcaaagcaacgcggttatccaggacgaggagcgagacattcccgagcggtcctggaacagcgggtacgagtggatcaccgatttccccggtaaaacagtgtggtttgtgccctccatcaagagcggaaacgacatcgcaaactgcctgcgcaaaaacgggaagcgggtcatccagttgtcacgcaagacatttgacaccgaataccagaagaccaagaacaacgactgggactacgtggtgacgacggatattagcgaaatgggagccaactttcgggcggaccgcgtaattgaccccagaaggtgtctaaagcccgttatcctgaaggacggccccgagagggtgatcttggccggcccgatgcctgtgaccgtagcatccgccgcccagcgccgggggagaatcggtaggaaccacaacaaggagggagatcaatacatatacatggggcagcccctcaataacgacgaggatcacgctcactggaccgaggcaaaaatgctgctggataacatcaacacccccgagggaatcataccagccctcttcgagccggaacgcgagaaatccgccgctatcgacggagagtatcgcctgcggggcgaggcgcgcaagacgtttgttgagctgatgcggcgcggggatctccccgtgtggctgtcctacaaggtcgcctcagagggcttccagtacagcgaccggcgctggtgctttgacggcgaacggaacaaccaggtcctggaggagaacatggatgtggagatctggactaaggaaggtgagcgcaagaagctccggccccgctggctggacgctcggacctattccgaccccttggccctccgcgagttcaaggagttcgccgcgggccgacgcagcgtctctggtgacctaatcttggaaatcggcaaactccctcagcacctgacccagcgggcccagaacgcacttgacaatctggtcatgctgcacaatagcgagcaaggtgggagagcataccgccacgcgatggaagaattgccggacaccatcgagaccttaatgctgcttgccctcatcgctgtgctgactggcggggttaccctgttcttcctctccggaagggggctgggcaaaacgtcaataggtctgctctgtgtcatggcctccagcgtcctactgtggatggcctcggtggagccccactggattgcagcctccatcatcctcgagttcttcctgatggtcctattgatccccgagccggacaggcagagaacgccccaggacaaccagctggcatatgtggtcatcgggctcctcttcatgatactgaccgtcgccgccaacgagatgggcttactcgagaccaccaagaaggacctggggatcggccatgtggcggtagaaaatcaccaccacgcgacaatgctggacgtggacctccaccccgcctccgcctggacgctgtacgctgtcgcgaccaccatcattacaccgatgatgcggcacaccatcgagaacaccaccgccaacatcagcctaacggccatagcgaaccaggccgcgatactgatggggttagataagggttggcccatttccaagatggacatcggggtgcccctcctcgcgctgggctgctactctcaggtcaatccactgaccctcaccgccgcagtgctgatgctggtggcacactacgccattatcggtccgggactccaggcaaaagcaacccgcgaggcacagaagcgcacggcggccggcatcatgaagaatccgaccgtagacgggattgtggccatcgacctggatcccgtggtatacgacgctaagttcgagaagcagctgggccagattatgctcctgatcctgtgcacctcccaaatactcctaatgcggaccacgtgggccctgtgcgagagcatcaccctcgcgaccggtcccctgacgacgctgtgggaaggatcccctggcaagttctggaacacgaccatagccgtgagcatggccaatatcttccgcgggtcctatctcgccggcgcaggcctggcgttttcactgatgaagtcactcggaggagggcgtcgcggaaccggggcccagggggagaccctgggtgagaagtggaagcggcagctgaaccagctctccaagagtgagttcaacatatataagcggtccgggatcatggaagtcgacagaagcgaggccaaggaggggctgaaacgcggggagaccactcggcacgctgtatcacgcggcacggcaaagctcagatggttcgtggagcgtaacttggtgaagccggaaggcaaggtgatagacctcggttgcggccgaggcgggtggagctactattgcgccggtctcaagaaggtgacggaggtaaaggggtacaccaagggcgggcccggccacgaggagccaatcccgatggccacctacgggtggaatcttgtaaagctccactcaggcaaggacgtgttcttcacaccacccgagaagtgtgacacgctcctgtgcgacatcggggagagctcccccaacccaaccatcgaggagggccgcactcttagagtgctgaagatggtcgagccctggctccgtgggaaccaattctgcatcaagatcttaaacccgtacatgcccagcgtggtggagacccttgaacagatgcaacgaaaacacggaggcatgctagtcaggaacccgctctccagaaattcgacccacgagatgtattgggtctcctgcgggaccggaaacatagtgtcagcggtgaatatgacatctcgcatgctgttaaaccgcttcaccatggcccaccggaagcctacctacgagagggacgttgatttaggagcgggtacgcggcatgtggcagtcgaaccagaggtcgccaatctggatataatcggccagcgcatagagaatatcaagcatgaacacaaaagcacgtggcactacgacgaggacaacccctacaaaacgtgggcctaccacgggtcctacgaggtcaaaccgagtggctccgctagcagcatggtgaacggggtagtaaaactgttaaccaagccctgggacgtgattccgatggtgacgcaaatcgcgatgacggataccacccccttcggccagcagcgggtctttaaggagaaggtggatacgcgcacccctaaggccaagcgggggaccgcccaaatcatggaggtcaccgcgcgctggctttggggcttcctgtcccggaacaaaaagcccaggatctgcacgcgggaggagttcacccgcaaagtccgtagtaacgccgcgataggcgccgtcttcgtggacgagaaccagtggaacagcgccaaggaggctgtcgaggacgaacgcttctgggatctcgtgcagaaagagcgggaactgcacaaacaggggaagtgtgcgacgtgcgtctataatatgatgggaaagcgcgagaagaagctgggagagtttggcaaggccaaggggagccgggccatctggtacatgtggctcggcgcccgcttccttgagttcgaggccctggggttcatgaacgaggatcactggttcagccgggagaacagcctctccggggtcgagggcgaaggcctgcacaagctgggctacatactccgcgacatcagcaagatacccggcggcaacatgtacgcggacgacaccgcaggctgggacacgcgtataacggaggacgacctgcagaacgaggccaagataaccgacataatggagcccgaacacgcgctgctcgccacatccatattcaagctcacgtatcagaataaggtagtccgcgtccagcgacctgctaagaacgggaccgttatggacgtgatcagccggcgcgaccagcggggctccgggcaggtcggcacctacggactgaatacctttacgaacatggaggcccagctcatccgccagatggaaagcgagggaatcttcctgccctccgaactggagacacccaacctcgctgagcgggtgctggactggcttgagaaatacggcgtggagcgcctcaagcggatggcgataagcggggacgactgcgtagttaagccgatagacgatcgcttcgccactgcgctgaccgcccttaacgacatggggaaggtgcggaaggatattccccagtgggagccctccaagggctggaacgactggcagcaagtccccttttgctcgcaccacttccaccaactcatcatgaaggacggccgcgagatcgtagtgccatgcaggaatcaggatgagctcgtcggccgtgccagggtgtcccagggggccgggtggtcgctacgtgagacggcctgtttaggcaagagctacgcccaaatgtggcagttgatgtactttcatcggcgagacttacggctcgcagccaacgccatctgctccgccgttccagtcgactgggtccccacctcgcggacgacgtggagcatccatgcccaccaccaatggatgactaccgaggacatgctgtcagtgtggaaccgggtttggatcgaggagaacccatggatggaagacaagacccacgtgtccagctggggcgacgtgccctacctagggaagcgcgaagatcagtggtgcggcagtctcatcgggcttaccgccagagccacctgggccagcaatatccaggtcgcgatcaaccaggtgcggcgtctgatcgggaacgagaactacctcgattacatgacgtccatgaagcggtttaaaaacgagggcgaccccgaaggcgcactatggtga

SEQ ID NO: 24385 - RNA, 9879 nt, synthetic construct
  misc_feature 1..9879: note = derived and/or modified CDS sequence (opt11) from DENV-1__GQ199847__SS-prME
  source 1..9879: mol_type = other RNA
agtgtgaccatgctgctcatgctgatgcccaccgccctggccttccacctcacgacccggggcggggagccccacatgatcgtcagcaagcaggaacggggcaaaagcctgctgttcaaaacctccgcaggggtgaacatgtgcaccctcatcgccatggacctgggtgagttctgcgaggacaccatgacctataagtgccccagaatcaccgaggccgagcccgacgatgtcgactgctggtgcaacgcgaccgatacgtgggtgacctacgggacctgtagccagaccggcgaacaccggcgggacaagcggtccgtggccctggcgcctcacgtgggcctcgggctggagacgcgtaccgagacctggatgagctccgagggggcctggaagcagatccagcgggtcgagacctgggccctgcgccacccaggatttacggtgattgccctcttcttggcgcacgccatcggtaccagcatcacccaaaaggggataatcttcatcctactcatgctggtgactccctccatggccatgcgatgcgtaggcatcgggagccgcgacttcgtagaggggttatccggggcaacatgggtggatgtcgtcctcgaacacgggagctgtgtgaccaccatggccaaggacaagccaaccctggacattgagcttctcaagacggaggtcaccaatcccgcggtgctgcgtaagctgtgtatcgaggctaagatctcaaacaccaccacggactcgaggtgcccgacccagggcgaggccacactcgtggaggagcaggacgccaacttcgtgtgtcggcgcaccttcgtggaccggggttgggggaacggatgcgggctgtttggaaaagggtccctgatcacgtgtgccaaattcaagtgcgtgaccaagctcgagggcaagatcgtccagtacgagaacctgaagtacagcgtgattgtaactgtccacaccggcgaccagcaccaggtggggaatgagtccacggagcacggcaccaccgccaccatcacgccgcaagcgccctccaccgagatacagctgaccgactacggggccctaaccctggactgctcgccccggaccggcctggactttaacgaaatggtgttgctgacgatgaaggagaaatcatggctggtgcacaagcagtggtttctcgacctgccgctgccctggacctcaggggcctccacctcgcaagagacatggaaccggaaggatctcctggtgaccttcaagaccgcccacgcgaagaagcaggaggtcgtggtgctgggatcccaagagggcgccatgcacaccgccctcactggcgccaccgagatacagacgagcggcaccaccacaatattcgccgggcacctgaagtgccgcttgaagatggataagctcacactgaagggaatgtcctacgtaatgtgcaccgggagcttcaagctggagaaagaggtggccgagacccaacacggcacggtgctcgtccagatcaagtacgagggcacagacgccccctgcaagattcccttctcaacccaagacgagaagggggtgacccagaatgggcggctgatcacggcgaacccgatcgtgactgacaaggaaaagcccgtcaatatagaggccgagccgcccttcggggagtcatacattgtgataggcgcgggcgaaaaggcgttaaaactatcctggttcaagaaggggtcatcaatcggcaaaatgttcgaggccaccgcccgcggggcccggcgcatggcgatcctcggcgacaccgcctgggacttcgggagcatcgggggcgttttcacgtccgtagggaaactggtgcaccagatcttcggcactgcctatggggtgttgttctctggcgtcagttggacgatgaagatcggtattggcgtgctccttacctggctgggcctcaacagccgctccacaagcctgagcatgacttgcattgcggtggggctagtcaccctctacctgggcgtgatggttcaagccgacagcgggtgcgtaataaactggaagggcagggagctgaaatgcgggtctggcatcttcgtgaccaacgaggtgcacacttggacagagcagtacaagttccaggcggactctccgaagcgccttagcgccgcgatcggcaaggcctgggaggagggggtctgcggaatccggtccgccacccgcctggagaacatcatgtggaagcagatctcgaatgaattaaaccacatcttactggagaacgacatgaagttcaccgttgtggtcggggacgtggcgggcatcctggcccaagggaagaaaatgatacggccccagcccatggagtacaagtactcctggaagagctggggcaaggccaagatcatcggcgcagacgtgcagaatacaacgttcatcatcgatgggcccaacacaccggagtgccccgatgaccagcgcgcgtggaacatctgggaagtcgaggactacggctttgggatcttcaccaccaacatctggctcaagctgagagactcctacacccaggtgtgcgaccaccgtctgatgtctgccgccatcaaggatagcaaggcggttcacgccgatatggggtactggatagagagcgagaagaacgaaacctggaaactcgcgcgggcctccttcatcgaggttaagacctgtatttggcccaaaagccacaccctgtggtccaacggcgtgctggagtcagagatgatcatccccaagatctacgggggcccgatcagtcagcacaactaccgccccgggtacttcacgcagaccgctggcccgtggcacttagggaagctcgagctggactttgacctctgcgagggcaccaccgtggtcgtggacgagcattgcggcaatcgagggccgagcctgaggacgaccactgtaacgggcaagatcattcacgagtggtgctgccggtcctgcacgctgccgccgctgcgtttcaagggagaggacggctgctggtacgggatggagatccggcccgtcaaggagaaggaagagaacctcgttaagagcatggtgagcgctggctcgggcgaggtcgacagcttctccctaggcctcttgtgcattagcatcatgatcgaagaggtgatgcgctcccggtggtcgcgcaaaatgctcatgaccggaactctcgccgtgttctttctgctgatcatgggacagctcacctggaacgacctgatacggctgtgtatcatggtaggcgcgaacgcctccgaccgcatggggatggggacgacgtacctggccctgatggccaccttcaaaatgcgcccgatgttcgctgtggggctactgtttcggcgcctgaccagcagggaagtgctgctcctgacaatcgggctgtccctcgtagctagcgtggagctgcccaactcattagaggagctcggcgacgggctagccatgggcatcatgattctgaaactcctgaccgatttccagagccaccagctgtgggctaccctcttatcactgacattcatcaagacgaccttctcactccactacgcgtggaagacaatggcgatggtcctgtccatcgtgagcctgttccccctctgcctgtccaccacgtcccagaagaccacctggctgcccgtactcctcggttccctgggatgtaagcccctcaccatgttcctgatcgccgagaacaagatctggggccgcaaaagctggcccctgaacgaaggtatcatggccgtcggcatcgtaagtatcctcttaagcgccctgttaaaaaacgacgtgcccctggccgggcccctgattgcgggcgggatgctcatcgcctgctacgtcatcagcggttccagcgcagacctttctctagaaaaggccgcagaggtgtcgtgggaggaggaggccgagcactccggcgcgagccacaatatcctcgtggaggtccaggacgacggtacgatgaagatcaaggacgaagaacgtgacgacaccctgaccatcctgctcaaggccactctgctggccgtgtccggcgtgtatccgctctcgatccccgccaccctgttcgtgtggtacttctggcaaaaaaagaaacagcgctccggggtgctgtgggacacgccctccccgcccgaggtagagcgagcggtcctcgacgacggcatttaccgcattatgcagcggggcctgctggggcgctcccaggtgggcgtgggggtcttccaggagaacgtgttccacacaatgtggcacgttacgcggggcgccgtccttatgtaccaggggaagcggctagaaccctcatgggcctccgtgaagaaggatttaatctcctacggcggcgggtggcgtctgcagggctcctggaacaccggggaggaggtgcaggtcatcgccgtggagcccggcaagaaccccaagaacgttcagacggcccctgggacgttcaagaccagcgagggcgaggtcggcgcgatcgccctggacttcaagcccggtacctccggcagccccatcgtgaaccgcgaggggaaaatagtcggcctgtacggcaatggggtcgtgacgaccagcggcacctacgtgtccgcgatcgcccaggcaaaagcgagccaggagggacccctgccggaaatcgaggacgaggtcttccggaagcgcaacctcaccatcatggacctgcaccccggttccgggaagacgcggcgctacctgccagcaatcgtacgggaagccatcaaacgcaaactgcggaccctgatcctggcaccgacccgcgtggtagcgagcgagatggccgaggcgctcaagggcatgcccatccggtaccagaccacggctgtgaaatccgagcacactggcaaggaaatcgtggacctgatgtgccacgccacctttactatgcggctgctcagccccgtccgtgtgcccaactacaacatgatcatcatggacgaagcccacttcacggacccgtccagcatcgccgcccgggggtacatcagcacgcgcgtgggcatgggggaggccgccgcgatcttcatgacagctacgccccccggcagcgtcgaggctttcccccagtccaacgccgtgatccaggacgaggaacgggatatcccggagcgaagctggaattcggggtatgagtggatcacggacttccccggcaagaccgtgtggttcgtcccctctattaagtccggcaacgacatcgcgaactgcctgcggaagaacgggaagcgagtgattcagttgagtcggaagaccttcgataccgagtaccagaagacaaagaacaacgactgggactacgtggttacgaccgacatctccgagatgggcgccaatttcagggccgatcgggtgatcgacccccgccggtgcctcaagccggtgatcctgaaggacgggccagagcgcgtcatactggcgggtcccatgcccgtgactgtcgccagcgccgcgcagcggcgcggtcggatcggccgcaaccacaacaaggaaggcgaccagtacatttacatggggcagcctctcaacaatgatgaggaccacgcccactggacggaggcgaagatgctgctggacaatatcaacacccccgagggcattatccctgccctcttcgagcctgagcgggagaagagtgcggccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgtttcgacggcgagcgcaacaaccaagtgctggaggagaacatggacgtggagatctggaccaaggagggagaacggaagaaactccgcccccggtggctggatgcccggacgtacagcgaccccttggcgctccgggagttcaaggagttcgcggccgggcgccggtccgtcagcggggatctgatactggaaatcggtaagctcccccagcacctgactcagcgcgcccagaacgcactggacaacctcgtgatgctgcacaactccgaacagggcgggcgagcctaccgccacgccatggaggagctaccggacaccatcgagacgctcatgctgctggcactgatcgccgtgctaacgggcggggtcacactgttttttcttagtggccgggggctggggaagacctccatcgggctactctgcgtgatggcgagctccgtgttactgtggatggccagtgtggagccccactggatcgccgcctccatcatcctcgagttctttctgatggtcctcctcatacccgaacccgaccgccagcggaccccgcaggacaatcagctggcctatgtggtaatagggctcctcttcatgatcctgaccgtggcggcaaacgagatgggcctgctcgagacgaccaagaaggaccttggtatcggccatgttgccgtcgagaaccaccaccacgccgccatgctggacgtggatctccaccccgcgagcgcctggaccctttacgccgtggccacaaccatcatcacccccatgatgcgccacaccatcgaaaacaccacggccaacatctccctgaccgcaatagccaatcaggccgccatactgatgggtctagataagggctggccgataagcaaaatggacatcggcgtccccctgcttgcgttgggatgctattcccaggtgaacccactgactttaaccgcagccgttttaatgctggttgcccactacgccatcatcggccccgggctccaggcgaaagccacgcgggaggcccagaagcgaaccgccgccggtatcatgaagaacccgaccgtggacggaatagtcgcgatcgacctggaccccgtggtgtacgacgccaagttcgagaagcagctgggccagatcatgttactgatcctgtgcaccagccagatcctcctgatgcgcacgacctgggccctgtgtgagtccatcacgctcgccaccggcccgctgacgaccttatgggaaggcagccccggcaagttctggaataccaccatcgccgtgtccatggctaacatcttccgggggtcttacctcgccggcgccgggctggccttcagcctgatgaagtccctaggcggcgggcgtcggggcacgggcgcccagggcgagaccttgggggagaagtggaagcgccagctgaaccagctctcgaagtccgaattcaacacctacaagcggagcgggatcatggaagtcgaccgctccgaggccaaggagggtctgaaacgcggggagactacgaagcacgccgtgagccgcgggacagccaagctgcggtggttcgttgagcgcaacctcgtcaaacctgaggggaaagtgatcgaccttgggtgcggtcgcggcgggtggtcatactactgcgccgggttgaagaaggtgacggaggtcaaagggtacaccaagggagggccaggccatgaagaacccatccccatggcgacatatggttggaacctggtgaaactccattcaggcaaggacgtgttcttcatccctcccgagaagtgcgacaccctattatgcgacatcggggagagttcccccaaccctaccatcgaggagggccgcaccctccgggtcctgaagatggtcgagccgtggctgcgtgggaaccagttctgcatcaagatattaaacccctacatgccctccgtggtcgagacgctggaacagatgcagcgaaagcacgggggcatgctggtacgcaaccccctcagccgtaacagtacccatgagatgtactgggtcagctgcgggaccggcaacatcgtctccgccgtgaacatgacctcacgaatgctgctgaaccgctttaccatggcacaccgaaagcccacgtatgagcgcgatgtagacctcggggccggcactcggcacgtcgccgtggagcccgaggtggcgaacctggatatcatcggccagcgcatcgagaacatcaagcacgagcacaagtccacctggcactacgacgaagataatccctacaagacatgggcataccacggatcgtacgaagttaagccttccggcagcgccagctccatggtgaacggcgtcgtgaagctgctcacgaagccgtgggacgtgattcccatggtcacccagattgccatgaccgacaccacgccctttgggcagcagcgggtgttcaaggagaaggtggacacccgcactcccaaggccaagcgggggaccgcgcagatcatggaagtcacggctaagtggctgtggggcttcctgagccgcaataagaagccgcggatctgtacccgcgaggagttcacccggaaagtgcgctccaacgccgccatcggggccgtgtttgtcgacgaaaaccagtggaacagcgcgaaagaggccgttgaggacgagaggttctgggacctcgtgcaccgcgagcgggagctgcacaagcaggggaagtgcgcgacgtgtgtctacaacatgatggggaagagagagaagaagctaggggagttcggcaaggccaaggggtcccgtgcgatttggtatatgtggctgggcgcccgtttcttagagttcgaggccctgggcttcatgaacgaggaccattggttcagccgggagaactccctcagcggggtggagggcgaggggctgcacaagctgggctacatcctccgcgacatatcaaagatccccgggggtaacatgtatgccgacgacacggccggctgggacacccggataacagaggacgacctgcagaacgaagcaaagatcaccgatatcatggagcccgagcacgctctgctagccaaaagcatcttcaagctgacataccaaaacaaggtggtacgcgttcagcggcccgccaaaaacgggactgttatggacgtcatctcccggagagatcagcgaggctcgggccaggtgggcacctacggcctgaacacctttacgaatatggaggcccagctcattcgccagatggagtccgagggtatcttcagcccctccgagttagagacccccaacctcgcaggccgggtgctcgactggctggagaaacatggggtcgaacgcctgaagagaatggccatctcaggagacgattgcgttgtaaaacccatcgacgacaggttcgccaccgccctcaccgccctgaacgatatgggaaaggtccggaaagacatcccacagtgggagccctccaagggctggaacgactggcagcaggtccccttttgtagccaccacttccatcagctgatcatgaaggacggccgcgagatcgttgtcccctgtcggaatcaggacgagctcgtggggagggcgcgggtgagccagggcgcggggtggtctctgcgcgagacggcctgtctggggaagagctacgctcagatgtggcagctcatgtactttcaccggcgcgacctgcggctggcggccaatgccatctgctccgcggacccggatgactgggtacccacaagccgcaccacctggtctatccacgcccaccaccagtggatgacaacggaggacatgctcagcgtgtggaaccgggtgtggattgaggaaaacccctggatggaagacaagacccacatctccagctggggcgatgttccctacctgggcaagcgcgaagaccagtggtgcggctctctgatcgggctcaccgcgcgtgccacgtgggccaccaacatccaggtagccatcaaccaagtgcgccgcctgatcggcaacgagaactacctggactatatgacctcgatgaagcggttcaaaaacgagtccgacccggagggggccctctggtga

SEQ ID NO: 24386 - RNA, 9879 nt, synthetic construct
  misc_feature 1..9879: note = derived and/or modified CDS sequence (opt11) from DENV-1__GQ199849__SS-prME
  source 1..9879: mol_type = other RNA
agcgtcaccatgctgcttatgctgatgcccaccgccctggccttccacctcaccacccggggtggggagccccacatgatcgtgaccaagcaggagcggggcaaaagtctgctgttcaaaaccagcgctggggtcaacatgtgcaccctcatcgcgatggatctgggtgagttgtgcgaagacaccatgacatacaaatgcccgcgaatcaccgaggccgagccggacgacgttgactgctggtgcaacgccacggacacctgggtgacctacggtacgtgctcaagaacgggcgagcaccgccgcgacaagaggagcgtggcgctcgcgcctcacgtgggcttgggactggagacccggacagagacttggatgtccagcgagggcgcctggaagcagattcagcgcgtggagacgtgggccctccggcaccccgggttcaccgtaatcgcactgttcctggctcacgccatcggcacctccatcacacagaaggggatcatctttatcctcctaatgctggtgacgcccagcatggccatgcgctgtgtcggaattgggtcccgggactttgtcgaggggttgagcggcgcgacgtgggtggacgtcgtgctggagcacgggtcttgcgtgaccaccatggctaaggacaagccgaccctggacatcgagctcctgaagaccgaggtaaccaaccccgcggtgctgcgaaagctctgcatagaggcgaagatcagcaacaccactaccgattcgcgctgccccacccagggcgaggcaacccttatggaggagcaggacgccaacttcgtatgccgcaggacgttcgtcgaccgtggctggggaaacggctgcgggctgtttggcaaggggagcctcatcacgtgcgccaagttcaagtgcgtgaccaaactggaaggcaaaattgtccagtacgagaatctgaagtacagtgtcatcgtgaccgtacacaccggcgaccaacaccaggttgggaacgagagcaccgagcacggcacgaccgctacaattacaccccaggctcctacctccgagatacagctcaccgactacggggcgctgactctggactgcagcccccgtacgggcctcgatttcaacgagatggtgctgctgaccatgaaggagaagtcctggctagtccacaagcagtggtttctcgacctgccactcccctggaccagcggggccagcacctcccaagagacgtggaaccgccaggacctgctggtcacgttcaagaccgcccacgccaagaaacaggaggtggtagtgctcggcagccaggagggcgccatgcacaccgcactgacaggggcgaccgagatacagacctcaggcaccacgacaatcttcgccggccacctgaagtgccggctcaagatggataagctggctctgaagggcatgagctacgtgatgtgcaccgggtccttcaagttagagaaggaggtcgccgagacccagcatggcacggtgctggtgcaaatcaaatacgagggcaccgacgccccctgcaagatccccttctcaacccaagacgagaagggagtcactcagaacggccggctaatcaccgccaatccgatagtgacagacaaggagaagcccgtgaacatcgaagcggagccgccctttggcgaatcctatatcgtcatcggcgccggcgaaaaggccctgaaactcagctggtttaagaaggggagcagcattggcaaaatgtttgaggccaccgcccgcggagcccgtcgcatggccatcctgggcgacaccgcctgggactttgggtccattggtggcgtgtttacgagtgtggggaagctggtccatcagatcttcggaacagcttacggggtccttttctccggtgtgtcctggaccatgaagatcgggattggcgtcctgctaacctggcttggcctgaattcccggtctacctctctaagcatgacctgtattgccgtggggctcgtgactctgtacctaggcgtcatggtccaggctgactccggatgcgtgatcaactggaagggccgcgagctcaagtgcgggagcgggatcttcgtaactaacgaggttcacacctggaccgagcagtacaagttccaggccgactcaccgaaacggctgtccgccgccatcggcaaagcctgggaggagggggtgtgcggcattcgcagcgcgacccggcttgaaaacattatgtggaagcaaatctccaacgagcttaaccatatcctgctggagaatggtctcaagttcaccgtcgtggtgggcgatgtcgtggggatcctggcacagggaaagaaaatgatcaggccccagcccatggagcataaatacagctggaagtcctggggcaaggcaaagatcatcggggccgacgtgcagaacaccacgtttatcatcgacggccccaacaccccggagtgccccgacgaccaacgggcgtggaacatctgggaggttgaggactacggcttcggcatcttcaccaccaacatctggctgaagctccgcgactcgtatacccaggtgtgcgatcaccggctgatgtcagctgccataaaagacagcaaagccgtgcacgccgacatgggttactggatcgagtccgagcgtaatgaaacctggaaactggcgcgtgccagcttcatcgaggttaagacatgcatctggcccaaatcccacaccctctggagcaatggggtcctggagtcggagatgatcatccccaagatctacggcggcccgatcagccagcacaattaccgcccaggatacttcacgcagaccgcagggccctggcacctgggcaagctcgagctggacttcgacctgtgcgagggcaccaccgttgtcgtggacgagcactgcgggaatagggggccgagtctcaggacgacaaccgtgactgggaaaatcatccacgaatggtgctgcagatcatgcacgctgccgcccctgcgcttcaagggcgaggacgggtgctggtacggcatggagatacggcccgtcaaggagaaggaggaaaacttagtgaaatccatggtgagcgctggcagcggcgaggtcgactccttcagtctgggcctgctgtgcacctcaatcatgatcgaggaggtgatgcgcagccggtggtcccgcaagatgctgatgactgggacgctggcggtatttctcctgctgatcatgggccagctaacctggaatgacctgatcaggctctgcatcatggtcggggcgaatgccagcgaccggatggggatgggcaccacctatctcgccctgatggccacctttaaaatgcggccgatgttcgccgtgggccttctgtttaggcgcctgacctcccgggaggtgttactcctgaccatcgggctgagcttggtcgcgtccgtggagcttccaaacagcctggaagagctcggggacggcctggcgatgggcataatgatccttaagctcctgaccgacttccaatcgcatcagttgtgggccaccctcctgtctctgacgttcatcaagacaaccctctcccttcactacgcctggaagaccatggcgatggtcctgagcatcgtgtcactcttccccctgtgcctgtctacgacctcccagaagaccacctggctcccggtgttactgggtagcctcggctgtaagccgctgacgatgttcttgattgctgaaaataaaatttgggggcgcaagtcctggcccctgaacgagggcatcatggctgtcggggtggtgagtatcctgctaagcagtctcctgaagaatgatgttcccttagccggccccctcatcgccggcgggatgttgattgcatgctacgtgattagcggctccagcgccgacctgagtctggaaaaggccgccgaagtgagctgggaggaagaggccgagcacagtggggcgagtcacaacatcttcgtcgaagtacaggacgacgggaccatgaagatcaaggacgaggagcgggatgacaccctgaccatactgctcaaggccaccctgctggccgtgtccggagtctacccgctcagcatccccgccacgctgttcgtctggtacttctggcagaagaagaagcagcgctccggggtgttatgggacacgcccagcccgcccgaggtcgagagggccgcgctggacgacggcatctaccgcattatgcagcgggggctcctgggccgctcccaggtgggggtgggcgtcttccaggagaacgtgttccacaccatgtggcacgtgacccgcggggccgtcctgatgtaccagggcaagcgcctcgagcccagttgggccagtgtaaagaaggacctgatcagctacggcgggggatggagactgcaagggtcctggaacacgggcgaggaggttcaggtcatcgccgtggagcccgggaagaaccctaagaatgtccagaccgcccccggcacattcaagaccccagaaggcgaggtcggggcgatcgccctcgatttcaagcccggcacgagcgggtcccccatcgtgaaccgagaaggcaaaatcgtgggcctttacggcaacggggtcgtgaccaccagcgggacctacgtaagcgccatcgcccaaacgaaggcgtcccaggagggcccgctgccggaaatcgaggacgaggtcttccggaagaggaacctcaccattatggaccttcaccccgggagcggcaagacacggcgctatctgcccgccatcgtgagggaggccatcaagcgcaagctccgcaccctgatcctggcccccacgcgcgtagtcgcctccgagatggcggaggcgctcaagggcatgcccatccgctaccagacgaccgccgtcaagagcgagcataccgggaaggagatcgtggacctgatgtgccacgccactttcacaatgcggctgttatcccccgtccgcgtgccgaactacaacatgatcatcatggacgaagcccactttacggatccaagctccatcgccgcccggggttatatcagtactcgagttgggatgggcgaggccgcggccatcttcatgacggcgacgccgcccgggtccgtcgaggcgttcccgcagagcaatgccgtaatccaggacgaggaacgggacatccccgaacgctcctggaatagcggctacgagtggatcaccgactttcccggaaagaccgtgtggttcgtgccttccatcaagagcgggaacgacatcgccaactgcctccggaagaacggcaagcgcgtgatccagctatcccggaagaccttcgataccgagtaccagaagaccaaaaacaatgactgggactacgtggtcaccacggacatcagcgagatgggggcgaacttccgcgcggaccgggtgatagacccgcgccggtgtttaaagcccgtgatcctaaaagacggccccgaacgcgttatcttagccgggcccatgccagtgacggtagcaagcgctgcacagcgtaggggccggatcggtcgcaaccacaacaaggagggggaccagtacatctacatgggccagcccttaaacaacgacgaagatcacgcccattggaccgaggccaagatgctgctggacaacatcaacactcccgagggtattatccccgccctctttgagccggaacgcgagaagtccgccgcgatcgacggcgagtataggctgcgcggggaggcccggaagacgttcgttgagctgatgcgccgtggcgacctccccgtgtggttaagctacaaggtggccagcgagggcttccagtacagcgaccgccggtggtgtttcgacggggagcggaacaaccaagtgctggaggagaacatggacgtagagatatggaccaaggagggcgagcgtaagaagctgcgcccccggtggctggacgcccgcacctactccgaccccctggccctcagagaattcaaggagttcgcagccgggcgacggtcagtctccggcgacctgatcctggaaataggcaagcttccgcagcacctgacgcagcgcgcccaaaacgccctagacaacctcgtaatgctgcacaacagcgagcagggcgggcgggcgtaccgccacgccatggaggagctgcctgacactatcgaaaccctcatgctgctggccttaatcgccgttctgaccgggggagtcacgctgttctttctctctgggcggggcctgggcaagaccagcatcgggctgctctgcgttatggcgagcagcgtgctgctgtggatggcgtccgtcgagccccactggattgccgcgagcatcatcctcgagttcttcctgatggtgctgctcatccccgagccggaccgccagcggacgccccaggacaaccagctggcctacgtcgtcataggattactcttcatcatcctgactgtggccgcgaatgaaatggggctgttggagactaccaagaaagacctgggcattggtcacgtggccgttgagaaccaccaccacgcaactatgctggatgtggacctccaccccgcctccgcctggaccctatacgcggtggccacaaccatcattacgccgatgatgcgccacaccatcgagaacaccaccgccaacatctccctgactgccatcgcgaaccaggcggccatactgatgggcctggacaagggctggcccatctccaagatggacatcggggtccccctgttggccttagggtgctacagtcaggtgaatcccctgacccttaccgctgccgtcctgatgctagtcgcccattacgccatcattgggccgggcctccaggcgaaggccactcgcgaggcgcagaagagaacggccgctgggatcatgaagaaccccaccgtggatggcatcgtggccattgacctggaccccgtagtgtacgacgctaagttcgagaagcagctgggccagatcatgttgctgatcctgtgcacctcccagattctcctgatgcgcacgacgtgggcgctgtgcgagagcatcaccctcgctaccgggcccctgaccacgctgtgggagggctccccggggaagttttggaataccaccatcgccgtgagcatggccaacatcttccggggctcctacctcgctggcgcggggctggcgttcagcttaatgaagtccctcggcggtggacgccgggggacaggggcgcagggggaaactcttggggagaagtggaagcgtcagctgaaccagctctccaaaagcgagttcaacatctataagcggagtggaatcatggaggtcgaccgcagcgaagccaaggaggggctgaagcggggcgagaccacccgccacgcggtgagtcggggtacagccaagctgcgctggttcgtggagcgaaacctggtcaagcctgagggcaaggtgatagacctaggctgcgggcgcggcgggtggagctactactgcgccgggctcaagaaggtgacagaggtcaagggctacaccaaaggcggccccgggcatgaggagcccatccccatggcgacctacgggtggaaccttgtcaaactccactccgggaaagatgtgttcttcacgccgccagagaagtgtgacacgttactttgcgacatcggcgagagctctcccaacccgaccatcgaggagggccgaactttgcgtgtcctgaagatggtggagccctggctgcgagggaaccaattctgcataaagatcctcaacccctacatgcccagcgtggtcgagaccctcgagcagatgcagagaaaacacggcgggatgctggtgcggaacccgctctccagaaacagcacccacgagatgtactgggtgtcctgcggtacggggaacatcgtcagcgccgtgaatatgacctccagaatgcttctgaaccgattcaccatggcacaccgcaaaccaacctatgagcgggacgtggatctcggcgccggcacgcgccacgtcgcggtggagcccgaggtcgccaacttggacattatcgggcagcggatcgagaacatcaaacatgagcacaagagcacctggcactacgacgaagacaacccctacaagacctgggcctaccacggctcctacgaagtaaagccgagcgggtccgcgagcagcatggttaacggcgtcgtgaagcttctcaccaagccgtgggatgtgatccccatggtcacgcagatcgcaatgaccgacaccaccccattcggccagcaacgcgtgttcaaggaaaaggtggacacgcggaccccgaaggccaagcgaggcacggcgcagatcatggaggtgaccgcccgctggctttggggttttctgtccagaaacaagaagccccggatctgcactcgtgaagagttcaccaggaaggtgcgcagcaacgcagccatcggggccgtgttcgtcgacgagaaccaatggaactccgccaaggaggcggttgaggacgagcggttctgggaccttgtgcagaaggagagagagctgcacaagcagggcaagtgtgcgacgtgtgtctacaatatgatgggaaagcgggagaagaagctaggcgagttcgggaaggcaaagggcagccgcgccatctggtacatgtggctcggcgcgcggttcctagagttcgaggcgctcggattcatgaacgaggaccattggttctcccgcgagaatagcctctccggcgttgagggcgagggcctgcacaagctggggtatatcctccgggacatcagcaagatccccggcggtaacatgtacgccgacgacacagcgggatgggatacccgcatcaccgaggacgacctccagaacgaggccaagattacagatatcatggagcccgagcacgccctgctcgcgacctccatcttcaaattgacgtatcagaacaaagtggtccgggtgcagcggccggcgaagaacggcactgtcatggacgtcatcagccgccgtgaccagcgcgggagcggccaggtgggcacgtacgggctgaataccttcacgaacatggaggcacagctaatccggcagatggagagcgagggcatcttcctgcccagcgagttagagacccccaacctcgccgagcgcgtgttggactggctggagaagtacggggttgagagactcaagagaatggccatctcaggggatgactgcgtggtgaagccaatcgacgaccggttcgcgaccgccctaaccgcccttaacgatatggggaaggtccgcaaggatatcccccagtgggagccctccaaggggtggaacgactggcagcaggtccccttctgctcacaccacttccaccagctcattatgaaggacggacgggagatcgttgtcccgtgccgaaaccaggacgagctggtggggcgggcgcgcgtatcccagggcgccggctggagcctacgggagacggcttgcctcggaaagtcttacgcccagatgtggcaattaatgtacttccatcgccgggatttacgcttggccgccaacgcaatctgttccgccgtccctgtggactgggtgcccacctcgagaacaacctggagcattcatgcccaccaccaatggatgacgaccgaggatatgctgagcgtctggaaccgtgtgtggatcgaagagaacccctggatggaggacaagacccacgtgtcctcgtggggagacgtaccgtacctgggcaagcgcgaagaccagtggtgcggcagcctcatcgggctgaccgcccgagcgacgtgggccagcaacatccaagtggccataaaccaggtgcgccggctgattggtaacgagaattacctcgactatatgacgtccatgaagcgcttcaagaacgagggggaccccgagggagccctgtggtag

SEQ ID NO: 24387 - RNA, 9879 nt, synthetic construct
  misc_feature 1..9879: note = derived and/or modified CDS sequence (opt11) from DENV-1__FJ898410__SS-prME
  source 1..9879: mol_type = other RNA
agcgtgaccatgctgctgatgctgaccccaaccgcactggcctttcacctcaccacccgtggcggggaaccccacatgattgtgtccaagcaggagcggggcaagagcctgctgttcaagacctccgcgggcgtgaacatgtgcacgctgatcgccatggacctgggcgagttctgcgaggacaccatgacctacaaatgtccccgcatcaccgaagcggagcccgacgatgtggattgctggtgtaacgccacggacacatgggtcacctacgggacatgcagccagacgggcgagcatcggcgtgacaaacgttccgtagccctggcgccccacgtcggccttgggctggagacccgcaccgaaacctggatgagctccgaaggggcctggaagcagatccagcgggtcgaaacatgggcccttcgacaccctggtttcacggtaatcgccctcttcttggcgcacgccatcggaacgagcatcacccagaagggaatcatcttcatcctgctcatgcttgtgacgcccagtatggccatgcggtgcgtcggcataggcagccgcgacttcgtggaggggctgagcggcgccacctgggtagacgtcgtgttagagcacgggagctgcgttaccaccatggccaaggacaaacctacgctggacattgagttgctcaagactgaggtcaccaaccccgcggtgctgcggaaactttgtatcgaggccaagataagtaacacaacgaccgattctcgctgcccgacccagggcgaggccaccctcgtcgaggagcaggacgcgaatttcgtttgcaggcgcacgtttgtggaccgaggctgggggaacggttgtgggctgttcggcaaaggctccctgattacgtgcgccaagttcaagtgcgtgaccaagctagaggggaagatcgtccagtatgagaacctgaagtacagcgttatcgtgaccgtacatacgggcgaccaacaccaggtggggaacgagtccaccgagcacggtaccaccgcgaccatcactccccaagccccgagcaccgagatccagctgaccgactacggggcgctcaccctggactgtagcccgcggacgggattagacttcaatgagatggttctcctgacgatgaaggaaaagtcctggctcgtgcataaacagtggttcctcgatctgcccctgccctggactagcggggcctccactagtcaagagacttggaaccggcaggacctcctggtcaccttcaagaccgcccacgcgaaaaagcaagaggtcgtggtgctgggctcccaggagggcgccatgcacaccgccctcaccggggccacggagatccaaaccagcggcacaacgactatcttcgccgggcacctgaagtgccgcctcaaaatggacaagctcaccctcaagggcatgtcgtatgtcatgtgcaccgggagctttaagcttgagaaggaggtggctgagacgcagcacgggaccgtgctcgtccagatcaaatatgagggtaccgatgcgccctgcaaaattcccttcagtacgcaggatgagaagggggtaacgcagaacggccggctgatcaccgccaacccgatcgtgaccgataaggagaagccggtcaacatcgaggcggagccgcctttcggggaaagctacatcgtgatcggcgcgggcgagaaggcactgaaactgtcttggttcaagaaggggagctccatcggcaagatgttcgaagccaccgcccgcggggctcggcgcatggcgatcttgggcgacacggcctgggactttgggtcgatcggcggcgtctttacctccgtcgggaagctggtgcaccaaattttcggcaccgcctacggtgtgctgttcagcggcgtctcctggactatgaagatcggcataggcgttctcctgacgtggctgggtctcaacagccgctccaccagcctttcgatgacctgtatcgcagtggggctggtcacgctctacctgggcgtgatggtacaggccgacagcgggtgcgtcattaactggaaaggcagagagctgaagtgcgggtcaggcatcttcgtcacgaacgaggtgcacacatggaccgagcagtacaaattccaggctgactccccaaaacgcttgagcgctgccatcggcaaggcctgggaggaaggggtctgcggtatccggtccgccacccgcctggagaatatcatgtggaagcaaatcagcaacgagttaaaccacatactcctggagaacgatatgaagctgaccgtggtggtcggggacgtggcgggcatcctcgcgcagggtaagaaaatgatacggccccagcccatggaatacaaatacagttggaagatctggggtaaggccaagatcatcggcgccgacgtgcagaacacgactttcatcatagacgggcccaacaccccagagtgccccgacgaccagcgcgcgtggaacatctgggaggtcgaagactacggctttgggatattcaccacgaacatttggctgaagctgcgggattcttacacccaggtgtgcgaccaccgcctcatgtccgccgccatcaaggacagcaaggccgtccatgccgatatgggctactggatcgagtccgagaaaaacgagacctggaagctggcgcgggccagcttcatcgaggtcaagacctgcatctggcccaaaagtcacacgctgtggtcaaacggtgtgctcgaatccgagatgataatccccaagatctacgggggcccgatctctcagcataactaccgcccagggtacttcacccagaccgcgggcccctggcacctggggaagctggaactcgacttcgacctgtgcgagggcacgacggtggtcgtggacgagcactgcggcaaccgggggccgtccctgcgcaccaccaccgtgacgggaaaaatcatccacgagtggtgctgccggagctgcaccttaccgccgctccgtttcaagggggaggacggctgctggtacgggatggagatccggcccgtcaaggagaaggaagagaacctggttaagtccatggtcagcgccggcagcggcgaggttgactccttcagcttgggtctcctgtgcatatctatcatgattgaggaggtgatgcggagccgctggtcccgaaaaatgctcatgaccggcaccctagctgtgttctttctgctcatcatggggcagctgacgtggaacgacctgatccggctctgtatcatggtcggcgcgaacgcctcggaccgtatggggatgggcaccacgtatctggccctgatggccacctttaagatgcgcccgatgttcgcagttggcctgctgttccggcgcctgacttccagggaagtgctcctgctgactatagggctcagcctggtggcgtccgtggagcttcccaacagcctcgaggagctaggcgacgggctcgccatgggcatcatgatccttaagctgctaaccgacttccagtcccaccagctctgggccacgcttctgagtctcacgttcatcagaaccaccttctccctgcactatgcctggaagaccatggcgatggtccttagcatcgtgtccctctttcccctgtgcctgtcaacgacctcccagaagaccacctggctgcccgtgctgcttggtagtctcgggtgcaagcccctgacgatgttcctgatcgccgagaacaagatctggggccgtaaatcctggcccctcaacgaggggatcatggccgtcggaatcgtgagcatcctgctgagctccctcctgaagaacgacgtgccgctggccgggcccctcatcgccggcggtatgctgatcgcgtgctacgtcataagcgggtctagcgcggacctgtccctcgagaaggcagccgaggtgagttgggaggaggaggccgagcactccggcgccagccacaacatcctggtagaggtccaggacgacgggaccatgaagatcaaggacgaggagcgtgacgacaccctgaccatcctcctgaaggccactctgctcgccgtgtcaggcgtgtacccgctgagcataccagccactctgttcgtgtggtacttctggcagaaaaaaaagcagcggtccggggtcctctgggacacccccagcccgcctgaggtggagcgcgcggtcttggacgatggcatctaccggatcatgcagcgcggactgctggggcggtcccaggtgggcgtaggggtcttccaagagaacgtgttccacacgatgtggcacgtgacccgcggcgcggtcctcatgtaccaggggaaacggttagagccgagctgggcctccgtgaaaaaggacctaatcagctacggcggcggttggcgcctccaggggtcctggaatacgggggaggaggtgcaagtcatcgccgtggaacccggcaagaaccccaagaacgtgcagaccgcccccgggaccttcaagacgtcggagggcgaggtcggcgccatcgcgctggacttcaagccggggacgtccggctcacccatcgtgaacagggaggggaagatcgtgggcctgtacggcaacggggtcgtgaccaccagcggcacctacgtgtcagccatcgcccaggccaaggcgtcccaagagggtcccttaccggagatcgaggacgaagtctttcgcaagcggaacctgacgattatggatctgcacccgggatcggggaaaacccgcaggtacctccccgccatagtgcgcgaggccatcaagcgtcgcctgagaaccttgattctcgccccgaccagggtggtcgccagcgaaatggcagaggccctgaagggtatgcccattcgctatcagacgaccgcggtgaagtctgagcacacgggaaaggaaatcgtggatttgatgtgccatgccaccttcacgatgcggctcttatcccccgtccgggtgcctaactacaacatgattatcatggacgaggcacactttactgatccgtcctcaattgcggcacggggatacatctctacccgcgtgggcatgggggaggccgccgccatattcatgaccgcgacgccccccggcagcgttgaagccttcccccagtccaacgccgtgatccaggatgaggagcgggacatcccggagcgctcatggaactcggggtacgagtggatcaccgacttccctgggaagaccgtgtggttcgtccccagcatcaagtccgggaacgacatcgcaaattgcctgcggaagaatggtaagcgcgtgatccagctctctcggaagaccttcgacacggagtatcagaagaccaagaacaacgactgggactacgtggtcaccaccgacatctccgagatgggtgcgaacttcagggccgacagagtgatcgacccccgccggtgcctcaaaccggtgatcctgaaggacggtcccgagcgcgtcatcctcgccggccccatgccggtgacagtcgccagcgccgcgcagagacgcgggaggatcggccgcaaccacaacaaggagggggaccagtatatttacatggggcaacccctgaacaacgatgaggaccacgctcactggaccgaggccaagatgctgcttgacaatatcaacacccccgagggcattatccccgcgctgttcgagcccgagcgcgagaaatctgcagcgatcgatggtgagtaccggctgcgcggcgaggctcggaagacctttgtggagctcatgcgaaggggcgacctgcctgtgtggctgagctacaaagtcgccagcgagggatttcagtattcagaccgccgttggtgcttcgacggcgagcgcaacaaccaggtgctcgaggagaacatggacgtggagatctggacgaaggagggggagagaaagaaactgcgcccccgatggctggatgctcgcacctacagcgaccccctcgccttgcgagagttcaaggagttcgcggccggccgccggtccgtcagcggggaccttatcctagagatcggcaagctcccccagcacctgacgcagcgcgctcagaacgccctcgacaaccttgtcatgctgcacaactctgagcaaggcgggcgggcgtaccgccacgcaatggaggagttaccagatacgatcgaaacgctgatgctgctcgccctgatcgccgtgctgaccggcggtgtcaccctcttctttctgagcggccgggggctgggcaagacctccatcggcctcctatgcgtgatggcgagctccgtgctgctctggatggcaagcgtcgagccgcactggatcgcggccagtatcatccttgagttctttctgatggtgctcctgatccccgagcccgaccgccaacggaccccccaggacaatcagctggcctacgtggtcatcgggctcctgttcatgatcctgactgtcgccgcgaacgagatgggcctcttagagaccaccaaaaaggatctagggataggccacgtggccgtcgagaaccaccatcacgccgccatgctcgacgtcgacctgcaccccgcctcggcgtggaccctgtacgctgtagccacgaccatcatcactcccatgatgcgccacaccatcgagaacaccactgcgaacatctccctcacggccatcgccaatcaggcagccatcctgatggggttagacaagggatggccgatctctaagatggacattggcgtgccgttgctggcgctggggtgctattcccaggtgaacccccttaccctgacggcggcagtgctgatgctcgtcgcccactacgctatcattggcccggggctgcaggccaaggcgacccgcgaggctcaaaagcgaaccgccgccggcattatgaagaacccgaccgtggacgggatcgtggccatcgatctggaccccgtcgtgtacgacgcgaagttcgagaagcagctcgggcagattatgctgctgatcctctgtacgagccagatcctgctaatgaggaccacctgggccctctgcgagtctattacactggcaacgggcccgctgactaccctctgggagggaagccccggcaagttctggaacaccacgattgcagtgtccatggccaatatcttccggggaagctacctggcgggcgccggcctggccttcagcctcatgaaatccctcggcggcgggcgcagagggaccggcgcccagggagagaccttgggcgaaaagtggaagcgccagctcaaccagctatctaagcccgagttcaatacctacaagcggtccgggatcatggaggtagaccgcagcgaggcgaaggagggcctgaagcgcggggagacaactaagcacgccgtgtcccgcggcaccgccaagcttcggtggttcgttgagagaaacctggttaaacccgaggggaaggtaatcgacctgggttgcggccggggaggttggagctattactgcgctgggctgaagaaggttaccgaggtcaaagggtacacgaagggggggcccggccacgaggaacccatcccgatggccacctacggatggaacctcgtgaaactgcactccggcaaggacgtgtttttcatccccccggagaagtgcgacaccctgctctgcgacatcggggagagctcccctaacccgaccatcgaggagggccgcacgctgcgggtcctgaagatggtggagccctggttgcgcgggaaccagttctgcatcaagatcctgaacccctacatgccctctgtggtcgagaccctggagcaaatgcagcgcaagcacggcggcatgctcgtgcgcaatccgctttcccggaacagcacccacgagatgtactgggtgtcctgtgggaccggcaacatcgtcagcgcggtgaacatgaccagccgcatgctgctcaaccgctttacgatggcccaccggaagcccacctacgagcgcgatgtggacctgggggcaggcacccggcacgtcgccgtggagcccgaagtggccaatctggacataataggccagcgcatcgagaacatcaaacacgagcacaagagtacctggcactacgacgaggacaacccgtacaagacctgggcgtaccacgggtcgtacgaggtgaagccctccggctctgccagctcaatggtgaacggggtagtgaagctcttaactaagccctgggacgtgatcccgatggtaacccagatcgccatgaccgacacgacccccttcggccagcaacgggtttttaaggaaaaggtggacacccgcaccccgaaggccaagcgcgggacggcacaaatcatggaggtcaccgcgaagtggctgtggggctttctctcccgcaacaagaagccccggatctgcactagggaggagttcacccggaaagtaagatcgaacgccgctatcggtgcagtgttcgtcgatgaaaaccagtggaattccgcgaaggaggccgtcgaggacgagcggttttgggacctggtccaccgcgagagagagcttcacaagcaggggaagtgcgccacgtgcgtatacaatatgatgggcaagcgagagaagaagctgggggagttcggcaaggcgaaggggtcgcgggccatctggtacatgtggctgggcgcgagattcctggagttcgaggccctcggcttcatgaatgaggaccactggttctcccgggagaacagcctgtccggcgtggagggggaggggctacacaagctcggctacatcctgcgcgacatcagcaaaatccctggtggcaacatgtacgccgacgacactgcgggctgggacacccggatcaccgaggatgacctccagaatgaagccaagataacggacatcatggagccggagcacgcactcctggccaagagcatcttcaagttgacctaccagaacaaggtggtccgcgtgcagcgacccgccaagaacggcacggtgatggacgtcatcagccgccgcgaccagcggggctccggccaagtgggaacctatggactcaatacgttcacaaacatggaggcacagctgatccgacagatggagagcgaggggatcttctcccccagcgagctggagaccccgaacctcgctggccgcgttctggactggttggagaagcacggggtcgagcgcctcaagcggatggctatctccggcgacgactgcgttgtgaagccgatcgacgaccgttttgccaccgcgctgacggccctgaacgatatgggaaaggttcggaaggacataccccagtgggagccgagcaaaggctggaacgactggcagcaggttcccttctgttcccaccacttccatcaactcatcatgaaagacggccgcgagatcgtggtaccctgcagaaatcaggatgagctggtggggcgcgctcgtgtatcccagggcgcgggatggagcctgcgcgaaaccgcctgcctcggcaagtcgtacgcccagatgtggcagctgatgtacttccaccggcgcgacctgcggctcgcagcgaacgcaatctgtagcgcggtacccgtggactgggttccaacctcccgaaccacgtggtccatccacgcccaccaccagtggatgaccaccgaggacatgctgtccgtttggaacagagtgtggatcgaagagaacccctggatggaggacaaaacccacgtgtcttcttggggcgacgtcccttacctgggcaagcgagaggaccaatggtgcggttcgctcatcgggctgacggcacgcgcgacctgggccaccaacatccaagtggccatcaaccaggtgcggcgcctgctcggcaacgaaaactacctggactacatgacatccatgaagcggttcaagaacgagagcgatcctgagggtgccctatggtga

SEQ ID NO: 24388 - RNA, 9879 nt, synthetic construct
  misc_feature 1..9879: note = derived and/or modified CDS sequence (opt11) from DENV-1__FJ898411__SS-prME
  source 1..9879: mol_type = other RNA
tcggtgaccatgctgctcatgctgatgcccaccgcgctggctttccacctcaccacgcggggcggggagccccacatgatcgtgtccaagcaggagcggggcaaatccctgctgttcaagacctccgccggcgtcaacatgtgtaccctcatcgcaatggacctaggcgagttctgtgaggacacaatgacctacaagtgcccccgcatcaccgaagccgagcccgatgacgtggactgctggtgcaacgccaccgacacttgggtgacctacgggacctgtagccagaccggtgagcacaggcgggataagcggtccgtcgccttagcgccccacgtgggcctcggactggagacgcgcaccgagacctggatgagctccgagggcgcctggaagcagatccaacgggtagagacctgggcactaaggcacccggggttcacagtgatcgctctcttcttagctcacgccatcgggacttcaatcactcagaagggtataatcttcattctgctgatgctggttaccccatctatggcaatgcgatgcgtcggcatcggcagcagggattttgtggaggggctgtccggcgccacgtgggtggatgtcgtgctcgagcacgggtcttgcgtgacaaccatggccaaggacaagcctactctggacatcgagcttctcaagacggaggtcaccaaccccgcggtgctacgtaaactgtgcatcgaggccaagatatcgaacaccaccactgatagccgctgcccaacccagggagaggccaccctcgtcgaggagcaggacgccaactttgtctgccgacgaacctttgtggacaggggttggggaaacggctgcggcctatttggcaagggaagtcttataacgtgtgccaagttcaagtgcgtgaccaagctcgagggtaagattgtccagtatgagaatttaaagtacagcgtgatcgtaaccgtccacaccggcgatcagcaccaggtgggcaatgaaagtacggagcacggcaccaccgcaaccatcacgccccaggcccccagcaccgagatccagctgaccgactatggggctctcaccctggactgcagcccccggacaggtctggatttcaatgagatggtcttgctgacgatgaaggagaagtcctggttagtgcacaagcagtggttcctcgacctgccgctgccctggaccagcggggcctccaccagccaagagacctggaaccggaaggatctcctggtgacattcaagaccgcgcacgctaagaagcaggaggtcgtcgtgctgggctcccaagagggcgccatgcataccgccctcactggtgccacggagattcaaaccagcggcaccaccacgatcttcgccggccatctgaagtgcagattaaaaatggacaaactcaccctgaaaggcatgtcctatgtaatgtgtaccgggtcttttaagctcgagaaggaggtggctgagacccagcatggcacagtgctagtccagatcaagtacgaggggaccgacgccccctgtaaaatccccttttccacccaggacgagaagggggtgacccagaacgggcgcctgataactgccaacccgatcgtgaccgacaaggaaaagcccgtcaacatcgaggccgagccgcccttcggagaaagctacatcgtaattggcgcgggagagaaagcccttaagctatcctggttcaagaaaggctcatccattggcaagatgttcgaagccaccgcacggggggcccggaggatggcgatcttgggcgacactgcctgggacttcggaagcatcggcggcgttttcacgtccgtagggaaactggtgcaccagattttcggcactgcatacggggtactgttcagtggcgtcagttggaccatgaagatcgggatcggcgtgctcctgacctggctgggcctcaacagccgcagtacgagcctgtctatgacatgcatcgccgtggggcttgtcactctctacctgggcgtgatggtgcaggccgacagcggttgcgtcatcaattggaaaggcagagaactcaagtgcggatccggtatcttcgtgaccaacgaagttcacacttggaccgagcagtacaagttccaggcggacagcccgaagagactcagcgccgccatcggcaaagcctgggaggaaggggtctgcggcatccggtcggccacccgtctggagaacatcatgtggaagcagatcagcaacgagctaaaccacatcctccttgagaatgacatgaagttcaccgtggtggtcggggacgtggcgggcatattggcccagggtaagaagatgatccggccccagcccatggagtacaaatactcctggaagtcctggggcaaggcgaagatcattggggccgacgttcagaacaccacgttcatcatagacgggcccaacaccccggagtgcccagacgaccagcgagcctggaacatatgggaggtagaagactacggcttcgggatctttactaccaacatatggctaaagctgcgcgactcctacacccaggtctgcgaccatcgcctgatgagcgcggccatcaaagactcaaaggccgtccacgctgatatgggttactggatcgagagcgagaaaaatgagacatggaaattagcccgggcctcgttcatcgaggtgaagacctgcatctggcctaagagccacaccctgtggagcaacggggtgctcgagtccgagatgatcattcccaaaatttacgggggccctatatcccaacacaactatcgccccgggtacttcacacagaccgccggcccctggcaccttgggaaattggagctggacttcgacctctgcgagggcaccaccgtggttgttgacgagcactgcggcaacagggggccgagcctgagaacgaccactgtgaccggcaagatcatccacgagtggtgctgccggtcctgcacgctgccacccctgcgcttcaaaggggaagacggctgctggtacgggatggagatccggcccgtcaaggaaaaggaggagaacttagtcaaatctatggtgagcgccggatccggcgaagtagacagcttctccctcgggctactgtgcatctccatcatgattgaggaggtgatgcgctcccgatggagtcgcaagatgctgatgacgggaaccctcgccgtgttcttcctgctgatcatggggcagctcacctggaacgacctcatccggctgtgcatcatggtcggtgccaacgcctccgaccgtatgggcatgggtacgacctaccttgccctgatggccacgttcaagatgagaccgatgttcgccgtcgggctcctattccgacgcctgaccagcagagaggtgctgctcttaacgatcgggttaagtctcgtcgcgtcagtggagctgcccaacagccttgaagagctcggcgacgggctagcaatggggatcatgattctgaagctcctcaccgacttccagagccaccagctgtgggccaccctgctaagcttgaccttcataaagacgaccttcagccttcactacgcctggaagaccatggcgatggtcctgagcatagttagcctgttccccctctgcctgagcaccacgagccagaagaccacctggctgcccgtgctcctgggctcccttgggtgtaagcctctcaccatgttcctgatcgcggagaacaagatctggggccgcaagagttggcccctgaacgaggggatcatggccgtcggtatcgtgagcatcctcctgtccgctctgctcaagaacgacgtcccccttgccgggccgctgatcgcgggcggcatgctgatcgcctgttacgtcatcagcggttccagcgccgacctgtccctggagaaggctgccgaggtcagctgggaagaggaggcggaacactccggcgccagccacaacatattagtggaggtccaggacgacggcacgatgaaaataaaggacgaagagcgggatgacaccctgactatcttgctcaaagccaccctgctggctgtgtccggtgtgtacccgctgagcatcccagccaccctgttcgtctggtacttctggcagaagaagaagcagcgctccggggtgctgtgggacaccccgtcaccgcccgaggtggagcgggcggtcctcgacgacggcatctaccgcatcatgcaacggggcctgctggggcgctcccaggtgggtgtaggggttttccaggagaacgttttccatactatgtggcatgtgaccaggggcgcagtcctgatgtaccaagggaagaggctcgaaccaagctgggcttccgtgaaaaaggacctgatcagttacggcggagggtggcggctgcagggatcttggaacaccggcgaagaggtgcaggtcatcgccgtcgagcccgggaagaatcccaagaacgttcagacggcccccgggaccttcaagacaagcgaaggcgaagtgggcgcaattgccctcgacttcaaacccgggaccagcggatcccccatcgtgaaccgcgaggggaagatcgtgggcctgtacggcaacggggttgtgacgaccagcggtacctacgtgtcggccatcgcccaggcgaaggccagccaggagggtcccctgccagagatcgaggacgaagtctttcggaagcgcaacctcacgattatggatcttcaccctggttccgggaagacgcggcgctatctgcctgccatagtgcgggaggccatcaagcgcaagctcagaactctgatcctggccccgacccgcgttgtcgcgagcgagatggccgaggccctaaagggcatgcccatccgataccagaccacggccgtcaagtccgagcacaccggcaaggaaatcgtagacctgatgtgccatgcaactttcaccatgcgactgctgagccccgtccgtgtgcccaactacaacatgatcatcatggacgaggctcacttcacggaccccagttctatcgccgcccgggggtacatctccacccgcgtgggcatgggtgaggccgccgcgatcttcatgacggcgacgccgcccggaagcgtcgaggccttcccccagtcgaacgccgtaattcaggacgaggagcgagatatcccagaacgcagctggaattccgggtacgagtggatcacggactttcccgggaagaccgtgtggttcgtcccgtctatcaagtctggcaacgacatcgcgaactgcctccgcaagaacggaaaaagggtaatccagctgagccggaaaaccttcgacacagagtaccagaagacaaagaacaacgattgggactacgtggtcaccaccgatatctccgaaatgggagccaatttccgcgccgaccgggtgatcgacccccgccggtgcctcaagccggtgatcctgaaggatgggcccgagcgggtcatcctggcaggccccatgcccgtgactgtcgcctcggcggcccagcggcggggaaggatcgggcgcaaccataacaaggagggcgaccagtacatctacatggggcagccgctcaataacgatgaggaccatgcccactggacagaggccaagatgctgctggataacattaacacacccgaaggcatcatcccagctctcttcgagccggagcgcgagaaatcggccgccatcgatggggagtaccgcctgcgcggcgaggcccggaagaccttcgtggaactgatgaggaggggggatctcccagtgtggctgtcttacaaggtcgccagcgaaggattccagtactcagaccgccggtggtgcttcgacggcgagcgcaacaaccaagttctggaggagaacatggacgtggagatctggaccaaggaaggggagcggaagaagctccgcccccgatggcttgacgcccgcacgtacagcgaccccctggccttacgagaattcaaggagttcgctgccggccgccggtccgtcagcggggacctgatcctggaaattggtaagctcccccagcacctgacccagcgcgcccagaacgcgctggacaacctcgtgatgctccataactccgaacagggtgggcgcgcttatcgccacgcaatggaggagctgcctgacaccatcgagaccctgatgctgctggccctcatcgccgtgttaacgggcggggtcaccctgttcttcctcagcggccgggggctgggcaaaacctccatcggactgctctgtgtgatggcaagctccgtgctgctgtggatggcgagcgtggagcctcactggatcgccgcgtccataattttggagtttttcttaatggtgctgctcatccccgagcccgaccgccaacggaccccgcaggataaccaactggcctacgtggtcattgggcttctgttcatgatcctgaccgtggcggccaacgagatgggcctgctagagacgaccaagaaggacctaggaataggccacgtggcggtcgagaaccaccaccacgccgccatgttagatgtggatcttcaccccgcttctgcctggaccttatacgccgttgccaccacgatcatcacccccatgatgcgccacacgatcgagaacaccacggccaacatatcgctgacggcgatcgccaaccaagccgctatcctcatgggactggacaaaggctggcctatatcgaagatggacatcggcgtccccctgctcgcgctgggttgctacagtcaagtgaaccccctgactctcaccgcggctgtccttatgctggtcgcccactacgcgataatcggacccgggctccaggccaaggccacgagagaggcccagaagcgcaccgctgctggaatcatgaaaaacccgacagtggacggaatcgtggcgatcgatttggatccggtcgtgtacgacgccaagtttgagaaacagctggggcagataatgctcctcatcctctgcacctcacagatcctgctgatgcgaacgacatgggctctgtgtgagtccatcaccctcgccacgggcccactgacgaccctgtgggaggggtcccccggcaaattttggaacaccaccattgctgtgtccatggcgaacatcttccgggggtcttacctagccggagccggcctagccttcagcctgatgaagtctttggggggcggccgccgggggactggtgcgcagggcgagaccctgggggagaagtggaagagacaattgaatcaacttagcaagtcggagttcaacacatataagcggagcgggatcatggaggtcgacaggagtgaggccaaggaaggcctgaagcgcggtgagaccacaaaacacgccgtgtctcgcggcaccgccaagctgcgttggttcgtggagcgcaatctcgtcaagcccgagggaaaggtgatcgacttgggctgcggtcgcggcgggtggagttactactgcgctgggctgaagaaggtaaccgaggtaaaggggtatactaagggagggcccggccacgaggagccgatccccatggcgacgtacgggtggaacctggtgaaactccacagcggcaaagacgtattcttcatcccaccggagaaatgcgacactctgctgtgtgacatcggggagtcttcgccaaatcctacaatcgaggagggccgcacactccgagtactaaagatggtcgagccgtggctgagggggaatcagttctgtatcaagattcttaatccctacatgccctccgtggtagagacgctggaacagatgcaacggaagcatggcggcatgctggtgcgaaatccactctcccggaactcaacgcatgagatgtactgggtgagctgcgggactggcaatatcgtgagcgccgtaaatatgacctcgcgcatgctgctgaaccgttttaccatggcccaccgcaagccgacttatgagcgcgacgtagatctcggggctggcacccggcacgtagccgtggagcccgaggtggcgaatctggacattatcggccaacggatcgagaacataaagcatgagcacaagtccacctggcactacgacgaggataacccctacaagacctgggcctaccacgggagctatgaggtcaagccatccgggagcgcctcttccatggtgaacggggtcgtgaagctgctcacgaagccatgggatgtcatccccatggtcacccagatcgccatgaccgacaccacgcccttcggccagcagcgggtgttcaaggaaaaggtggacaccaggaccccgaaagcaaagcgggggaccgcgcagatcatggaggtgacggccaagtggctgtggggcttcctgagccggaacaagaagccccgtatctgcacccgtgaagagttcacacgcaaggtgcgctcgaacgcagccatcggcgcggtgttcgtagacgaaaaccagtggaacagcgccaaagaagccgtggaggacgagcggttctgggacctcgtgcacagggagcgggagctgcataagcaggggaagtgtgcgacctgcgtgtacaacatgatgggcaagcgagagaagaagctgggggagttcggcaaggccaaggggtcccgggcgatctggtatatgtggctcggcgcccgcttcctggaattcgaggccctgggcttcatgaacgaggaccactggttcagccgcgagaactccctcagcggggtggagggagaggggctgcacaaactgggctacatcctccgcgacatctccaagatccctggaggcaatatgtacgccgacgacactgccggctgggacacccgtataacggaagatgatctgcagaacgaggcgaagatcacggacataatggagcccgagcacgccctgctcgccaagagcatcttcaagctgacgtatcaaaacaaggtggtccgcgtgcagcggcctgccaagaacggcaccgtaatggacgtcatctcgagacgcgaccagcgtgggagcggccaggtgggaacctacggcctgaacacatttacgaacatggaggcgcagctcatcaggcagatggagtcagaggggattttcagtccctcggagctggaaacccccaacctggccggacgggtgctcgattggctggaaaagcatggcgtcgagcgcctaaaacgtatggccatctccggcgacgattgcgtggtaaagcccatcgacgaccgcttcgcgactgcccttaccgcgctgaacgacatgggcaaagtcaggaaggacatcccgcagtgggaaccctccaagggctggaacgactggcagcaggtgcccttctgcagccaccatttccaccaacttatcatgaaggacgggcgagagatagtggtcccatgccggaaccaggacgaattagtggggcgggcgcgggtaagccaaggcgccgggtggagtctgcgcgaaaccgcctgcctcggtaagtcttacgcccagatgtggcagctcatgtatttccatcggcgcgacttacgtctggcggccaacgccatctgctccgctgtcccggtggactgggtccccacgagcagaactacatggagtatccacgcccaccaccaatggatgacgaccgaggacatgctcagcgtctggaaccgggtgtggatcgaagagaacccctggatggaggacaagacccacatctccagctggggcgacgtgccgtatctgggcaagcgcgaagaccagtggtgcggctccctgatcggcctaaccgcccgggcaacgtgggccacaaacatccaggttgccatcaaccaggtgcgccgcctgatcggcaacgagaactacctggactacatgacctcgatgaagcggttcaaaaacgagtccgacccagagggcgcgttatggtaa

SEQ ID NO: 24389 - RNA, 9879 nt, synthetic construct
  misc_feature 1..9879: note = derived and/or modified CDS sequence (opt11) from DENV-1__FJ898412__SS-prME
  source 1..9879: mol_type = other RNA
agcgtgaccatgctgctcatgctgatgcccacagccctggccttccacctcaccacccgcgggggggaaccccacatgatcgtaacaaagcaggagcggggcaagagcctgctgttcaagaccagcgcaggggtgaacatgtgcacattgattgctatggacctgggcgagctgtgcgaggataccatgacctacaagtgcccacggatcaccgaagccgagcctgacgacgtcgattgttggtgcaacgccactgacacctgggtgacctacgggacctgcagccaaacgggcgagcaccggcgcgataagcggagcgttgccctcgccccccacgtgggcctggggttagagacccgcaccgagacctggatgtccagcgagggcgcctggaagcagatccagcgcgtcgagacgtgggctctcagacacccagggttcaccgttatcgccctgtttctcgcgcatgcgatcgggacatccatcacacagaaggggatcatcttcatcctcctaatgctggtgacgccatcaatggccatgcgctgcgtcggcataggctcgcgcgacttcgtggaggggctctcaggcgccacctgggtggatgtcgtgctggaacacggatcgtgcgtgacgaccatggccaaggacaagcccacgttagacatcgagctcctgaagaccgaggtcaccaatcccgcggtgctgcggaagctctgcatagaggccaagataagcaacaccacgaccgactcccgctgccccacccagggcgaggccacactgatggaggagcaagacgccaatttcgtgtgccggaggacgtttgtggaccgagggtggggtaacggctgtgggctgttcggcaaggggagcctcatcacgtgcgccaagttcaagtgtgtgaccaagctggaaggcaagatcgttcagtacgagaacctgaagtactcggtcatcgtgactgtgcacacgggcgatcagcaccaggtggggaacgaaagcaccgagcacggcaccacagccaccatcacgccccaggcccccacgtccgagatacagctaaccgactacggggctttgacccttgactgcagcccccgcacgggtctcgacttcaacgagatggttctgctgaccatgaaggagaagtcctggctcgtccacaaacagtggttcttggaccttccgctcccctggaccagcggggcgtccacctcccaagagacgtggaaccggcaggacctgctagtaaccttcaagaccgcccacgcgaagaagcaggaggtggtcgtcctcggtagccaggagggcgcgatgcataccgccctgacgggggccaccgagattcagacctccggaaccacgaccatcttcgccgggcacctaaagtgtcgcttaaagatggacaagctgaccctgaagggcatgagctacgtgatgtgcaccgggtcgtttaagctcgagaaggaggtcgcggagacgcagcacgggactgtgctggtacagatcaagtatgaaggcactgacgccccctgcaagatccccttcagcacccaagatgagaagggggtcacgcagaacggccggctgatcaccgccaacccgatcgtgaccgacaaggagaagcccgtcaacatcgaggccgagcctccatttggggagtcctacatcgtcatcggggccggcgaaaaggccctgaagttaagctggttcaagaaggggtccagcatcggcaaaatgtttgaagcaaccgcccgcggggcccgccgtatggcgatccttggcgacacggcatgggacttcgggtccatcggcggggtgtttacgagcgttgggaaattagtccaccagattttcggcaccgcctacggggttctattctccggcgtgagctggaccatgaagatcgggataggcgtcctgctgacgtggctcggcctgaactcccgcagcacctcactgagcatgacctgcatcgccgtggggttggtgaccttatacctgggcgtcatggtgcaggccgattccgggtgcgtgatcaactggaagggcagggagctcaagtgcgggtcaggcatcttcgtgacaaacgaggtgcacacttggaccgagcagtacaagttccaggcggacagcccgaagcgcctgtccgccgccatcggcaaagcctgggaggagggggtgtgcggcatccggagcgccacccgcctggaaaacatcatgtggaaacagatctccaacgaactcaaccacatacttctggagaatgacatgaagttcaccgtcgtggtgggcgacgtcgtgggcatcctggcgcaaggtaagaagatgatccggccccagcccatggagcacaagtactcctggaagtcctggggcaaagccaagatcatcggcgccgacgtgcaaaacacaaccttcatcatcgacggtcccaacactccggagtgccccgacgaccagcgcgcatggaatatttgggaggtcgaggactatggcttcggaatcttcaccacgaatatctggctgaagctgcgcgacagctacacacaggtatgcgaccaccgcctcatgtccgcggccatcaaggacagcaaagcggttcacgccgatatgggctactggatagagtccgagaagaacgaaacctggaagcttgcacgggcgagcttcatcgaggtcaagacctgtatctggcctaagtcccacaccctgtggagcaacggcgtactcgaatccgagatgatcatccccaaaatatacgggggcccgatcagccagcacaactaccgccccgggtacttcacccagaccgcgggcccctggcacctggggaagcttgaattggatttcgacctgtgcgagggcaccacggtagtcgtggatgagcactgtggcaacagagggccgtcccttcgcacaaccacggtgactggcaagatcatccacgagtggtgctgccggagctgcacgctgccgcccctacgcttcaagggggaggacggatgctggtacgggatggagatacggcctgtcaaggagaaggaggagaacctggtgaagtccatggtgagcgctggaagcggcgaggtggactccttctcgctcgggctgctgtgcatctccataatgatcgaggaggtgatgcgcagccggtggtccaggaagatgctaatgaccggcaccctggccgtgttcctgttgctgattatggggcagctgacgtggaatgatctcatcagactgtgcatcatggttggagccaatgcgagcgaccgcatggggatgggcaccacctacctcgccctcatggcaaccttcaagatgcgcccgatgtttgccgtggggcttctgttccgccgcctcacgtcccgggaggtgctgctgctcaccatcgggctcagcttagtggcctccgtggagctccccaacagcctagaggagctgggcgacgggctggcgatgggcatcatgattctgaagctgctcacagacttccagtcccaccagctgtgggccaccctgctcagcctgaccttcatcaagaccaccctgtccttgcactacgcctggaaaaccatggccatggtcctgtctatcgtgtccctgttccccctatgcctgagcacgacatcccagaagacgacctggctgcccgtgctcctgggcagccttggctgcaagccgctcacgatgttccttatcgcagaaaacaagatctggggccgaaagtcgtggcctctgaacgaaggtataatggccgtcggcgtggtgagcatcctcttgagttccctgctcaagaacgacgtccccctggccgggccactgatcgccggcggcatgctcatcgcatgctacgtgatcagcgggtccagcgcggacctgtcgctggaaaaggccgccgaagtgagctgggaagaggaggccgagcactccggcgcctcgcacaacatcctcgtcgaggtgcaggacgacggtaccatgaaaatcaaggacgaggagcgggacgacacactgaccatcctgcttaaggcgaccttattagccgtatccggcgtctacccgctcagcatccccgccacgctgttcgtttggtacttctggcagaagaaaaagcagcgctccggggtgctttgggacacccccagcccgcctgaggtcgagagggcagtactggacgacggcatctaccgcatcatgcagcggggcctcctagggcggtcccaagtgggcgtcggggtattccaggaaaacgttttccacaccatgtggcacgtcacccggggggccgtgctgatgtaccaggggaagcgactcgagcccagttgggcgtccgtcaagaaggacttaatcagctacggcggcggttggcgtctgcagggttcctggaacacaggagaggaggtccaggtgatcgccgtggagcccggaaagaaccccaagaacgtccaaaccgcccccgggactttcaagactcctgagggcgaggttggggccatcgccttggacttcaagcccgggacgagcggctcccccatagtgaaccgcgaggggaagatcgtcggcctatacggcaacggagtggtgaccacctctgggacctacgtctcagcgatcgcccaggccaaggcttcccaggagggaccgctgcccgaaatcgaggacgaggtgttcagaaagcgcaacctaacgatcatggacttgcacccgggcagcgggaagacccggcgctacctgccggcgattgtgcgcgaggcgatcaagcgaaaattacggacccttatcctggctcccactagagtggtggcctccgagatggccgaggcgctcaagggcatgcccatccgctaccaaacgaccgccgtaaaaagcgagcacaccggcaaagagatcgtcgacctgatgtgccacgctacgtttacgatgcgccttctctcccctgtgcgggtaccgaactataacatgatcatcatggacgaggcccatttcaccgaccccagcagcatcgctgcgcgtgggtacatcagcacccgcgtcggaatgggggaggcagcagccatcttcatgaccgccaccccgcctggatcggtggaggcgttcccgcagagcaacgccgtcattcaagacgaggaacgggatatccccgagcgctcttggaacagcgggtacgagtggatcaccgacttccccggaaagaccgtctggttcgtgccctccatcaagagcggcaacgatatcgccaactgcctgcggaagaacgggaaacgcgttatccagctgtcccggaagaccttcgacacggagtaccagaagaccaagaacaacgattgggactacgtcgttaccaccgacatcagtgagatgggcgccaacttccgcgcggaccgggtgatcgacccgcgccggtgcttgaaaccggtcatcctgaaggatgggcccgagcgcgtcatactggccggcccaatgcctgttacggtagcctccgccgcacagcggcgcgggcggatcggccgcaaccacaacaaggagggcgaccagtacatctacatgggccagcccttaaacaacgacgaggaccacgctcactggacagaagccaaaatgcttttggacaacatcaacacccccgagggcatcatccccgcgctcttcgagcctgagagagagaagtccgctgccatcgacggggagtatcgcctgcgcggggaagcgaggaagaccttcgtggaactcatgcgccgcggggatctccccgtgtggttatcgtacaaggtggccagcgagggcttccagtacagcgaccgcaggtggtgcttcgacggggagcgcaacaaccaagtgctggaggagaacatggacgtcgagatatggacgaaggagggggaacggaagaagctccgcccccgctggctggatgcccgcacctactcggacccactggccctccgggagtttaaggagtttgccgcgggccgccggagcgtgtccggggacctgattctcgagatcggcaagctcccgcagcacctgacccaacgcgcccagaacgccttggacaacctcgtgatgctgcacaacagcgagcagggcgggcgagcctaccgccacgccatggaggagctgcccgacaccatcgaaacgttgatgctgttggccctcatcgcagttttgaccggcggagttaccctgttcttcctctccggccgcgggctgggcaagacatcaataggactgctctgcgtgatggcctccagtgttctgctttggatggcatccgtggaaccccattggattgcggcaagcatcattctcgagttcttcttaatggtgcttctcatccccgagccggatcgccagcgtacgccccaggacaaccagctggcctacgtcgtgatcggactcctctttatgatcttaacggtggcagccaatgaaatgggcctgctcgagactacaaagaaggacctggggatcggccacgtcgcggtggagaaccaccaccacgtgaccatgctggacgtcgacttgcatcccgccagtgcctggacgctgtacgctgtggccaccaccatcatcacacctatgatgcgccatacgatcgagaataccaccgctaacatcagcttgacggccatagccaaccaggccgccatcctcatggggttagacaaaggctggcctatctccaagatggacatcggcgtgcccctgctcgcgctggggtgctactctcaggtcaaccccctgacgctcacggctgcagtgttgatgctggtcgcgcactacgcgatcatcggcccggggctccaggccaaggccacacgggaggctcagaagcgcaccgccgcaggtattatgaagaaccccaccgtcgacgggatcgtggccatcgacctggacccagtcgtttacgacgccaagttcgaaaagcagctgggccagattatgctcctgatcctgtgcaccagccagatcctgctgatgcgcaccacctgggcgctgtgcgagagcatcacgctcgccacgggccccctgaccaccctgtgggaggggtcacccggcaagttctggaacacgaccattgccgtcagcatggcgaacatcttccgggggtcctacctcgccggcgccggcctggccttctctctgatgaagtccctcgggggcgggcgccgtggtaccggggctcagggcgagacactgggcgagaagtggaaacgccagctaaaccagttgtctaagagcgagttcaacatttataagcggtccgggataatggaggtggaccgcagcgaagccaaagagggcctgaaacgcggagagacgacccgccacgccgtctcacggggcactgctaagctgcgctggttcgtcgagcggaacctggttaagcccgaggggaaggtcatcgacctcggctgcggtcgcgggggatggagctactactgcgccgggttaaagaaggtgaccgaagtgaaggggtacacgaagggaggccccggccacgaggagcccatcccgatggctacctacgggtggaacctggtcaagctccactccggcaaggacgttttcttcacgccccccgaaaaatgcgacaccctgctgtgcgacatcggggagagctcccccaacccaacgattgaggagggcaggaccctcagggtgctgaagatggtcgagccctggttgcgtggtaatcagttctgcatcaagatactcaacccctacatgcctagcgtggtggagaccctggagcagatgcagcgcaaacacggcggcatgctggtccggaatccactctcccgcaacagcactcacgagatgtattgggtatcctgtgggacgggcaacatcgtgtcagccgtcaacatgacgtcccggatgctgctgaacaggttcaccatggcccaccgcaagcccacctatgagcgggacgtggacctgggggcaggcacgcgtcatgtggcggtcgagcccgaagtggccaacctggacatcatcggccagcggatcgagaatatcaagcacgagcacaagagcacgtggcactacgacgaggataacccctacaagacctgggcataccacgggtcctacgaggtcaaaccctcgggctccgcctcttcgatggtgaacggcgtggtgaagctgctcaccaaaccctgggacgtgatccctatggtgacccagatcgccatgacggacaccaccccctttggacagcagcgcgtcttcaaggagaaggtggacacccggacgccgaaggcgaagcgtgggaccgcccagatcatggaggtgaccgcgcggtggctgtggggcttcctgtcccggaataaaaagccccgtatttgcacacgcgaggagttcacacggaaggtccgcagtaacgccgccatcggcgcggtgttcgttgatgagaaccagtggaattccgctaaagaggcggtagaggacgagcggttctgggacctcgtacagaaggagcgcgaactgcacaagcaggggaagtgcgcgacctgtgtatacaacatgatgggcaagcgtgagaaaaaactgggggagtttggtaaggcgaaggggtcccgtgccatatggtatatgtggctcggggcccggttcctggagttcgaggccctgggctttatgaacgaggaccattggttctcccgcgagaacagcctctccggggtcgagggcgagggactgcacaagctgggatatatcctccgggatataagcaagatccccgggggcaacatgtacgccgacgataccgcgggctgggacacccgcatcaccgaggacgacctgcagaacgaggccaaaatcaccgacataatggagccggagcatgccctgctcgccacctccatcttcaagctgacctaccagaacaaggtggtgagggtgcagagacccgcgaagaacggaactgttatggacgtgatcagtcgccgggaccagcgcggatccgggcaagtcggcacctacggccttaacacctttaccaacatggaagcgcagctcatccggcaaatggagagcgagggcatcttcctgccctccgagctggagacgcccaatctcgccgagcgcgtgctggattggctggagaagtacggcgtcgagcgactcaagcgcatggccatctcaggggacgattgcgtcgtgaagccgatcgacgacagattcgccaccgccttaaccgcccttaatgacatgggcaaagtccgaaaggacatcccacaatgggagccctccaagggttggaatgactggcagcaggttcccttttgcagccaccacttccaccagctcatcatgaaggacggacgagagatcgtggtgccgtgccgcaaccaggacgagctagtcggcagggcccgggtgtcccagggggccggctggagcttacgggagaccgcctgcctgggaaagagctacgcccagatgtggcagctgatgtacttccacaggcgggaccttcgcctcgcggcgaacgccatatgcagtgccgtgccagtcgactgggtgcccacgtcgcggaccacctggtctatccacgcgcaccaccagtggatgaccacggaggacatgcttagcgtgtggaaccgcgtctggatcgaggagaacccctggatggaggacaagacgcacgtgtccagctggggcgatgtgccgtacctggggaaacgggaggaccagtggtgcggctccctaatcggcctgaccgctcgcgcgacatgggccagcaacatccaggtggccattaatcaagtacgacggctgatcgggaacgagaactacctcgactacatgacctccatgaagcgcttcaagaacgagggcgaccccgagggggcgctttggtga

SEQ ID NO: 24390 - RNA, 9879 nt, synthetic construct
  misc_feature 1..9879: note = derived and/or modified CDS sequence (opt11) from DENV-1__GQ199852__SS-prME
  source 1..9879: mol_type = other RNA
tccgtgaccatgctgctcatgctgatgcccaccgcccttgcctttcacctgaccacgcggggcggggagccccacatgattgtgaccaagcaagagcggggaaagagcctgctgttcaaaaccagcgcgggggtgaacatgtgtaccctgattgccatggaccttggtgagctgtgtgaagacaccatgacttacaaatgtccccggatcaccgaggccgaacccgacgacgtggactgttggtgtaatgccacggatacttgggtgacctacgggacttgctcccaaacaggcgagcatcggcgcgacaaacggagcgtcgctctcgcgccccacgtgggccttgggctggagacgcgcacggagacttggatgtccagcgagggcgcgtggaagcaaatccagcgagtggaaacgtgggccctccgccacccggggttcactgtgatcgcccttttcctggcccacgcaattggaacctccatcacccagaagggcataatattcatcctcttgatgctggtgacgccctctatggctatgcggtgcgtagggataggctcccgcgacttcgtggaggggcttagcggcgcaacctgggtggacgtagtgctggagcatgggtcctgtgttaccaccatggccaaagacaaacccacgctggacatcgagctcctgaaaaccgaggtaaccaacccagcggtgctacggaagctctgcatcgaagccaagattagcaacaccactacagattccaggtgtccgacccagggtgaggcaaccctaatggaggagcaggatgccaactttgtgtgtcggcgcacattcgtggaccgtggctgggggaacggttgtgggctgtttggcaaggggtctttaataacgtgcgccaaattcaagtgtgtgacaaagctggagggtaaaatcgtgcaatacgagaacctgaagtattccgtcatcgttaccgtacacactggcgatcagcaccaggtggggaacgagagcaccgagcacgggacaaccgcgaccattacgccccaagcccccacctccgaaatccagctcactgattatggggccctgaccttggactgcagcccccgcacgggcctcgatttcaacgagatggtgctgctgaccatgaaggagaagtcctggctcgtccataagcagtggttcctggacctcccgctcccctggactagcggagctagcaccagccaggaaacgtggaatcggcaggacctgttggtgactttcaaaaccgctcacgccaagaagcaggaggtagtcgtcttaggcagccaggaaggagccatgcacaccgccctgacgggggccaccgagatccagacctccggcaccacgactatcttcgccggtcacctgaagtgccgcctcaagatggacaaactgaccctgaagggaatgagctacgtgatgtgcaccggatcctttaagctcgagaaggaggtcgcggagacgcagcatggaaccgtcctagtacagatcaagtacgaaggcaccgacgccccctgtaagatccccttcagcacccaggacgagaagggggtaacgcagaacggccgactgatcaccgccaatccgatcgtgaccgacaaagaaaagcccgtgaacatcgaagccgagccgcctttcggggagtcttacatagtcatcggggcgggcgaaaaagccctcaaacttagctggttcaagaaggggtccagcatcggcaaaatgttcgaggccaccgcacgcggggcccggcgcatggcgatccttggcgacacagcgtgggacttcgggagtgtcgggggagtgttcaccagcgtgggcaagctggtgcaccaaatcttcggcacagcctacggcgtcctattcagtggcgtgagctggaccatgaagattgggatcggggtactgctgacgtggctcggcctgaactcccgtagcacatccctgagcatgacctgtatcgccgtcgggctcgtaacgctctacctgggcgtgatggttcaagccgacagtggttgcgtcatcaactggaagggacgggaacttaagtgcgggagcggcatcttcgtcacaaacgaggtgcacacctggaccgaacagtacaagttccaagcggatagcccgaagagactatctgccgccatcggcaaggcctgggaggagggggtctgcggcatccgtagcgcaactcgcctggagaatatcatgtggaagcagatttcgaacgaactgaaccacatcctcctggagaatgacatgaagttcacggtggtggtcggggacgtcgtgggcattctcgcgcaggggaagaaaatgatccggcctcaacccatggagcacaagtacagctggaagtcctgggggaaggccaagatcatcggggccgacgtacagaacacgaccttcatcatcgacggacccaacaccccagaatgccccgacgatcagcgcgcctggaacatctgggaggtggaggactacggcttcgggatctttaccacgaatatctggctcaaacttcgggacagctatacccaggtttgcgaccatcgactaatgtcagcggccattaaggacagcaaggccgtccacgcagacatggggtactggatcgagagcgagaagaacgaaacatggaagctggcccgggcgagcttcatcgaagtgaaaacctgcatctggccaaaaagccacactctgtggagcaacggcgtgttagaatccgagatgatcatcccgaagatctacgggggcccgataagccagcacaactaccgccccgggtacttcacacagacggccggcccttggcacctagggaaactggagctcgacttcgatctgtgcgagggcaccacggtcgtggtcgacgagcactgtggcaacagggggccctcactgcgtacgaccaccgtcacggggaaaatcatccacgagtggtgctgccgaagctgtaccctgccgcctctcagatttaaaggtgaggacggctgctggtacgggatggagatccggcctgtgaaggagaaggaggagaatttagtaaaatccatggtcagcgccggtagcggtgaggtggactccttcagccttgggcttctgtgcatttctatcatgatcgaggaggttatgaggagtaggtggtcacgcaaaatgctgactacgggaaccctcgccgttttcctgctcttgatcatggggcagctaacctggaatgacctaattcggctgtgcatcatggtgggcgccaacgccagcgaccgtatggggatgggtacgacctatctggcactcatggccacgttcaagatgcgcccgatgttcgccgtgggcctgctgttcagacgcttgacaagccgagaagtcttgctgctcaccatcgggctaagcctcgtcgcctctgtagagctcccgaatagcctggaggaactaggcgatgggctcgcgatgggcatcatgatcctgaagctgctcaccgacttccaatcccaccagttatgggccacgctgctgtcgctgactttcattaagaccacattacccctccactgtgcctggaagacgatggccatggttctgtccatcgcatcgctttttcccctgtgcctgtccaccaccagccagaagacaacatggctgccggtgttactcggctccctggggtgcaagcctctgaccatgttcctaattaccgagaccaaaatctggggccgcaagtcctggcctctgaacgaaggtataatggccgtcggcgtcgtgtccatcctcttgtctagcttgcttaagaacgatgtccctctggcagggccactgatcgccggcggcatgctcatcgcctgctacgttatcagtggttcctcggcggatctgagcctagagaaggcagctgaggtgtcctgggaagaggaggccgagcactcaggcgcctctcataacatcctcgtcgtggtgcaggacgacgggaccatgaagatcaaagacgaggagcgggatgacacgctgacaatcctgctaaaggcgaccttactcgccgtgagcggagtgtaccctctctccattcccgccacgctgttcgtctggtatttctggcagaagaagaagcagcgctccggggtcctgtgggacacgccctccccgccggaggtggagcgggccgtgctggacgacggaatctaccgcatcatgcagcggggccttctgggccgctctcaggtcggggttggggtgtttcaggaaaacgtattccacaccatgtggcacgtgacccggggtgccgtgctgatgtaccagggtaagaggctggagccctcctgggcgagcgtcaagaaagatctgatctcctatggcggcgggtggcggttgcaaggcagctggaacaccggcgaggaggtacaggtgatcgccgtcgagcccggcaaaaacccgaagaacgtccagacggcccccgggacattcaagaccccagaaggggaggttggcgccatagccttagatttcaagcccgggacctctggcagtcccattgttaatagggaagggaagatcgtagggctttacggcaatggggtggtaacaacctcgggcacgtatgtgtcagcgatcgcgcaggccaaggccagccaggaggggcctttacccgagattgaggatgaggtcttccggaagcgcaacctcaccatcatggacctgcacccgggttcaggaaagactcggcgatatcttcctgcgatcgtccgagaggccatcaaacgcaaactccggaccctgatccttgcccctacccgcgtggtggccagcgagatggccgaggcgctcaaaggaatgcccattcgctaccaaacaacggcagtcaaatccgaacacaccggcaaggagatcgtggacctgatgtgccacgccaccttcaccatgcgtctgctcagcccggtgcgcgttcctaactataacatgatcatcatggatgaagcccacttcacggaccccagcagcattgcggcgcgggggtacatctctacccgcgtgggaatgggggaggcagccgccatcttcatgaccgccacgccacccggcagcgtagaggccttcccccagagcaacgcagtcatacaggacgaagaacgtgacatacccgaacgcagctggaactccgggtacgagtggataacggatttcccaggcaagaccgtctggttcgtacccagtatcaagtccggtaatgatatcgccaactgcctgcggaagaacgggaagcgggtgatccagctgagccggaagacgttcgacaccgaatatcagaagacaaagaacaacgactgggactacgtggtgaccactgacatttcagagatgggcgccaacttccgcgcggaccgggtgatcgacccccgccgttgtctcaagccggtgatccttaaggacgggccagagcgcgttatacttgccggtccgatgcccgtaaccgtggccagcgccgcgcagcggcgcgggcggataggccgcaaccacaacaaagagggggaccagtacatttatatggggcagcccctgaacaacgacgaggaccacgcgcactggacggaggccaagatgttactggataacatcaacaccccggaaggcatcatccctgccctctttgagccagaacgagaaaaatccgccgccatcgacggggagtacagattgcgcggcgaggcgagaaaaaccttcgtcgagctgatgcgccgtggggatctcccagtgtggctgagttacaaggtggcctccgagggcttccagtacagcgacagacggtggtgcttcgacggcgagaggaacaaccaggtcctggaggagaacatggacgtggagatctggacgaaggagggcgagcggaagaagctccgcccccggtggttggatgctcgtacgtacagcgaccccttagcgctccgggagttcaaggagttcgccgcgggccggcggagcgtgtcaggggacctgattcttgagattggtaagttgcctcaacacctgacgcagcgcgcgcagaacgccctcgataacctcgtcatgctgcataactccgagcagggcgggcgggcttacaggcatgcgatggaggagctgcccgataccatcgagaccttaatgctgctagcattaatcgccgtactgacgggcggggtgaccctgttcttcctcagcggccgggggctggggaagacctccatcggcctgctctgcgtcatggctagcagcgtactgctgtggatggcgagcgtggagccccactggattgcggcctccatcatcctcgagttcttcctaatggtcctcttaataccggagcccgatcgccagcggacgccccaggacaaccagctggcttatgtagtgataggactcctgttcatgatcctgaccgtcgccgccaacgaaatgggcctcttagagacgaccaaaaaggaccttgggataggccacgtcgcggtggaaaaccaccaccacgccaccatgctcgatgtcgacctccacccggccagcgcatggaccctgtacgccgtggcgaccactattatcacacccatgatgagacacactattgagaatacgacagccaacatctccctgactgccatcgctaaccaagcggcgatactcatgggcttagacaagggctggcctatcagcaagatggatatcggcgtgcccctcctggcgctgggttgttactcccaggtcaacccactgacactcacagcagctgtgctgatgctggtggcgcactacgcgataattggccccgggctccaagccaaggccactcgggaagcccagaagaggaccgcggccggcatcatgaagaacccaacagtcgatggaattgtggcgattgacctggatcccgtagtctatgatgccaagttcgagaagcagctgggccaaatcatgttgcttatcctctgcacgagccagatcttgctcatgcggaccacctgggccctgtgtgaatccatcacattggcgacgggcccgctgactaccctttgggaggggtctccgggtaagttctggaataccacgatcgccgtgtccatggccaacatcttccgggggagttacctcgcaggcgccggcctggctttctccctgatgaagtccctcgggggcgggagacggggcacaggtgcccagggcgagaccctgggcgagaagtggaagaggcagttaaaccagctaagcaagtccgagttcaatatatacaagcggtccgggataatggaggtggatcgctcagaggcgaaggagggcctaaaacgcggggagaccacgaggcacgccgtttctcggggcacagcgaagctgcgatggtttgtggagcggaacttagtaaagcccgaggggaaggtcatagacctcggttgcggacgcgggggctggtcctactactgcgccgggctgaagaaggtaactgaggtcaagggctacaccaaaggcgggcccggccacgaggagccgattccaatggccacgtatgggtggaacctggttaagctacacagcggcaaagacgtgttcttcacgccgcccgagaaatgcgataccctgttatgcgacatcggggagtccagcccgaaccccaccattgaggaaggccggacactccgcgtgctgaaaatggtcgagccgtggctgcgggggaaccagttctgcatcaagatcttaaacccttacatgccgtccgttgtggagacgctggagcaaatgcagcgtaagcatggcggcatgctggttcggaatcctctctcacggaactccacccacgaaatgtactgggtgagctgtggaacgggcaatatcgtgtccgccgtcaacatgacaagccgaatgctcttaaaccgcttcacgatggctcaccgcaagcccacctacgagcgcgatgtggacctcggggcgggaacccgccacgtggctgtagagccggaagtcgccaacctggacattattggccaacggatagagaatattaagcacgagcacaagtccacctggcattacgacgaagacaatccttataaaacgtgggcttaccacgggagctacgaggtcaagccaagcggcagcgcctctagcatggtgaacggggtggtaaagctgctcaccaagccctgggacgttattccaatggtgacacaaatcgccatgacggacacgaccccgttcggccaacagcgcgtcttcaaagaaaaggtagacacccgtacccccaaggctaagcgcgggaccgcccagatcatggaagtgaccgcccgatggctttggggcttcttaagcagaaacaagaagccccggatctgcactagggaggagtttactcgaaaggtcaggtccaacgccgcgattggagcagtgttcgtggatgagaaccagtggaacagcgccaaggaggccgtcgaagatgagcggttctgggatctcgtgcagaaggaacgcgagctgcataaacaagggaagtgtgccacatgcgtttataacatgatggggaagcgagagaagaagctgggggagttcggcaaggccaaggggtcacgagccatctggtacatgtggctcggcgcccggttcctagagttcgaggccctgggtttcatgaacgaggaccactggttcagccgcgagaactctttgagtggggtcgagggcgaggggctgcacaagctaggctacatcctccgggacatttccaagatccccggcgggaacatgtacgctgacgacaccgccgggtgggatacgcgcatcaccgaggacgacctgcagaatgaagcgaagatcacggacattatggaacccgagcacgctctgctcgcaacttctattttcaagctgacctatcagaataaggtggtgcgggtacagcgccccgcgaagaacggaaccgtcatggacgtgatttcccggcgggaccagcgcggcagcgggcaggtcggtacgtatggcttgaatacttttaccaatatggaggcgcaactcataagacagatggagtccgaggggatatttttgcccagcgagctagagaccccgaatttggcagagcgcgtgctggactggctggagaaatacggcgtcgagcggctcaagcgcatggccatctccggggacgactgcgtcgtaaagcccatcgacgaccggttcgccacggcactaaccgccctgaatgacatgggtaaagtgcgcaaagacattccccagtgggagccctccaaggggtggaatgactggcagcaggtcccgttctgctctcatcacttccaccagctcattatgaaggacggcagagagatcgtcgtgccctgtcgcaaccaggacgagctagtgggccgggcccgcgtgagccagggggcaggctggtccctgcgggagactgcctgcctcggcaagagctacgcccaaatgtggcagttgatgtactttcacagaagggatctgcgactcgctgcaaatgccatctgcagcgcggtgcccgtggattgggtgccaacctcacggacaacctggagcatccacgcccaccaccagtggatgacgaccgaggacatgctgtcagtgtggaaccgcgtatggatcgaagaaaacccgtggatggaggacaagacccatgtaagctcctggggcgacgtcccctatctgggcaagcgggaggaccagtggtgcggctcgctcatcggcttaacggccagggccacgtgggcctccaacatccaggtcgctattaaccaggtgagaagattaatcgggaacgaaaactacttagactacatgaccagcatgaagcgctttaaaaacgagggagacccagagggtgccctgtggtga

SEQ ID NO: 24391 - RNA, 9879 nt, synthetic construct
  misc_feature 1..9879: note = derived and/or modified CDS sequence (opt11) from DENV-1__FJ898415__SS-prME
  source 1..9879: mol_type = other RNA
agcgtgaccatgctgctcatgctgatgcccaccgccctggctttccacttaaccacccggggcggggagccccacatgatagtgaccaagcaggaacggggcaaaagcctgctgttcaagacatccgcaggggtcaacatgtgtaccctcatcgcaatggatctgggcgagctctgcgaagacaccatgacttacaagtgtccgcggatcaccgaggctgagcctgatgacgtggactgctggtgcaacgccaccgacacctgggtaacctatgggacctgctctcagacgggtgagcaccggcgggataaacggagcgtggccctcgcaccccacgtgggcctggggctggaaacccgcaccgaaacatggatgagttccgagggcgcctggaagcagattcagcgggtcgagacgtgggctctccgccatcccgggttcaccgtgatcgccctgttcctggcacacgccataggcacctctatcacccagaagggcattatttttattctcttgatgttggttacccccagcatggccatgcgttgcgtcggcataggctcccgcgacttcgtcgaagggctcagcggcgccacctgggtggacgtcgtgctggagcatgggagttgcgtaaccaccatggccaaggacaagcccacgttggacatcgagctcttgaagactgaggtaaccaaccccgcggtgttgcggaaactctgcatagaagccaagatctccaataccacgaccgactcccgatgccccacccagggcgaggccactctgatggaggaacaggacgctaacttcgtgtgccggagaacgtttgtcgacagaggctggggcaacggctgtgggcttttcggcaagggctctctgatcacatgtgccaaattcaagtgcgtaaccaagctggaaggcaagattgtgcagtacgagaacctgaagtactccgtcatcgtcaccgtgcacacaggcgaccagcaccaggtcgggaatgagagcaccgagcatggcaccaccgcgaccataacgccccaggcccccaccagtgagattcaactcaccgactacggtgctctgaccctggactgttcgccccgaacaggcctcgacttcaacgaaatggtgctgctgaccatgaaagagaaatcgtggctcgtccacaagcagtggttcctggacctgccgttgccctggaccagcggggccagcacctcccaggagacgtggaaccggcaggacctgctggtgaccttcaagaccgcgcacgcaaagaagcaggaggtggtcgtcctcggctcccaggagggggccatgcacaccgccttaacgggcgcgaccgagatccaaacctccggcacgacgaccatcttcgccgggcacctgaagtgccgactgaaaatggataagctgaccctgaagggcatgagctacgtgatgtgcaccgggtccttcaaactcgagaaagaggtcgcggaaacgcagcacggcacagtcctggttcagatcaagtacgagggtaccgacgccccctgcaagatccccttcctgacacaggacgaaaagggggtcacgcaaaacggccggctgatcaccgccaacccgatcgtgacggacaaggagaagcccgtaaacatcgaggccgaaccgcctttcggggaaagctatatcgttatcggcgcgggcgagaaggccttgaagctgtcatggttcaaaaaggggagcaacatcggcaagatgttcgaggccaccgcccggggggcccggcgcatggcaatactgggcgacacagcgtgggacttcggctccatcggcggcgtcttcactagcgtggggaagctcgtccaccagatcttcggcacagcctacggggttctattttccggcgtcagctggaccatgaagatcgggatcggtgtcctgcttacgtggctagggctgaactcccgcagcacctctctcagcatgacctgcatcgccgtcggactggtgaccctgtaccttggcgtcatggtacaggcagacagtgggtgtgttatcaattggaaaggccgggagctgaaatgcgggagcggcatcttcgtcacgaacgaggtgcacacctggaccgaacagtacaaattccaggcggactccccgaagaggctgagcgccgccattggcaaggcctgggaggagggggtgtgcggtatccgtagcgccacccgacttgagaacataatgtggaagcagatctccaacgagcttaatcacatcctgctcgagaacgacatgaagttcaccgtcgtggtgggggacgtcgtcggtatcctggcgcaggggaaaaagatgatccggccccagcccatggaacacaagtatagctggaaatcctggggcaaggccaaaatcatcggcgctgacgtgcaaaacacgaccttcatcatagacgggcctaacacgccggagtgtcccgacgaccagcgggcctggaatatctgggaggtcgaggactacgggttcgggatcttcaccactaatatttggttgaagctccgcgacagctacacccaggtatgcgaccatcgcctgatgtccgcggctatcaaggacagcaaggccgttcatgccgatatgggctactggatcgagtccgagaagaacgagacctggaaactggcgcgggcctcgttcatcgaggtcaagacctgcatctggccgaagagccacacgctctggagcaacggcgttctggagtccgagatgatcatccccaagatctacgggggcccgatctcacaacacaactaccgccccgggtacttcacccagaccgccggcccctggcacctggggaagctcgagctggacttcgacctgtgtgagggcaccacagtggttgtagacgagcactgcggcaaccggggcccgtctctccgcaccaccaccgtgacgggaaagacgatccacgagtggtgctgccggagctgcacactgccgccactgcgcttcaagggggaggacggctgctggtacgggatggagatccggcccgtcaaggagaaggaggagaacctcgtgaagtccatggtgtccgctggctccggcgaggtagacagcttcagcttagggctgctctgcatctccatcatgatcgaggaggtgatgcgcagtcggtggtcccgaaaaatgctaatgaccggaactttagccgtgttcctcctgctcatcatggggcaacttacctggaacgacctgatccggctgtgcattatggtaggtgccaacgcgagtgacaggatggggatgggcaccacttacctcgctctgatggccacatttaagatgcgccccatgttcgcagtcgggctactcttccgtcgcctgaccagtcgggaggtactgctcctgaccatcgggctgagcctcgtagcttccgtagaactgccgaactctctggaagagctcggcgacgggctcgcgatgggcattatgatcttaaagctcctcaccgacttccagtcccaccagctgtgggctacgctcctgagcctgacctttataaagaccaccctctccctccactacgcctggaaaactatggccatggtactgagcatagtatccctgttccccctgtgcttgagcaccacctcccagaagactacgtggctccccgtgctgctgggcagcctcgggtgcaagccgttaaccatgttcctgattgcggagaataagatctggggacgcaagtcctggcccctcaacgaggggattatggccgtcggcgtggtgtcgatactgctgtcctccctcctaaagaacgatgtccccctggccgggcccctcatagccggcggcatgctgatagcctgttatgtgattagcgggtccagcgcggacctgtccctcgagaaggccgccgaggtgagctgggaggaggaggccgagcactccggggccagccacaacatcctggttgaggtccaggacgacgggactatgaagatcaaggacgaggagcgggatgataccctaaccatcctccttaaagcgacccttcttgccgtgtccggagtctaccctctgtctatccctgcaactctgtttgtgtggtacttctggcagaaaaagaagcagcgctcgggggtgctgtgggacacccccagcccgcccgaggtcgagcgtgccgtgctcgacgacggcatctaccgcatcatgcagcggggactcttagggcgctcccaggtgggcgtcggcgtgtttcaggagaacgtgttccacaccatgtggcacgtgacgcggggcgccgtgctcatgtaccaggggaagaggctggagcccagctgggcgtccgtgaagaaggatctgatcagctacggcggcgggtggcgtctccagggctcctggaacaccggagaggaggtccaggtgatcgccgtggagccgggtaagaaccccaagaacgtccagaccgcccccgggaccttcaagacgcccgagggcgaggtgggcgccatcgccctagacttcaaacccgggacgagcggcagccccatagtgaaccgcgaggggaagatcgtcggcctctacggcaacggggtggtgaccacctctggcacgtatgtcagcgcgatcgcccaggcaaaggccagccaggaagggcccctcccggagattgaggacgaggtgttccggaagcgcaacctgacaatcatggacctgcaccccggcagcgggaagacccggcgctacctcccggcaatagtgagagaggccatcaagcgcaagctgcggaccctaatcctcgcccccacgagggtcgttgcctccgagatggcagaagcgctcaagggcatgcccatccgctaccagaccacggccgtcaaaagcgagcacaccggcaaggagatcgtcgacctcatgtgccacgccacgtttactatgcgactcctgagccccgtgcgcgtcccaaactataacatgattatcatggatgaggcccacttcaccgatcccagctccatcgccgcgagagggtacataagcacccgagtcggcatgggggaggccgccgccatctttatgaccgccacgccgccgggctctgtggaggcgtttccacagtcgaacgccgtaatccaggacgaggagcgggacatccccgagcgctcctggaacagcggttatgagtggatcaccgacttccctgggaagactgtctggttcgtgccatccattaaaagcggcaacgacatcgccaactgcctgcggaagaacgggaagcgcgtgatccaactctcccggaaaacgttcgacaccgagtatcagaagacaaagaacaatgactgggactacgtcgtcaccacggatatctctgagatgggtgccaacttccgcgcggatcgggtgatcgacccgcgccggtgcctgaagcccgtcattctgaaagacgggccagagcgcgtgatcctcgcgggtcccatgccagttactgtggcttccgccgcccagcggcgcgggcggatcggccgcaaccacaacaaagagggcgatcagtacatttacatggggcagccattaaataacgacgaagaccacgcgcactggaccgaagcaaagatgctgctcgacaacataaacacccccgagggcataatcccagccctttttgagcctgagcgggagaagtccgccgccattgacggggagtacaggctgcgcggagaggcacgaaagacgtttgtggaactcatgcggagaggcgacctgcccgtatggttatcctacaaagtggcttccgaaggcttccagtattcagaccgccggtggtgcttcgacggagagaggaataaccaggtgctcgaggagaacatggacgtagagatctggaccaaggagggtgagcggaagaagctccgcccccggtggctagacgctaggacatacagcgaccccctcgccctgcgagagtttaaggagttcgccgcgggcaggcggtctgtgtccggggacctgatcctcgagatcggtaagctgccgcagcacctgacccagcgcgcccagaacgccctcgacaacctggtgatgctacataatagcgagcagggcgggcgggcctaccgccacgcgatggaggagcttcccgatactatcgagaccttaatgctgctcgccctgatcgcagtgctgaccggcggggtgaccttattttttctatccggccgggggctgggcaaaaccagcatcggcctcctctgcgtgatggcttcaagcgtgctcctctggatggcgtccgtggaaccccattggatcgcggctagcatcattttggagttcttcctgatggtactcctgatccctgagccggaccgccaacggacgccccaggacaaccagctggcctacgtcgtgatcgggctcctgttcatgatcctgaccgtggccgccaacgaaatgggcctcctggagacgaccaaaaaagacctcgggattgggcacgtcgcggtggagaaccaccatcacgcgacgatgctcgacgtggacctgcaccccgcctccgcctggaccctgtacgccgttgcgaccacgattattaccccgatgatgcgccacaccatcgaaaacacaaccgccaacattagcttgacggccatcgcgaaccaggccgcgatcctgatgggtctggacaagggctggcccatctccaagatggacatcggcgtgcccctcctagccctggggtgctacagccaggtgaaccccctcaccctgacagccgccgtcctgatgcttgtggcgcactacgccattattggcccggggctgcaggccaaggcgacccgggaggcccagaagcgcaccgcggccggcatcatgaagaaccctaccgtggacgggattgttgccatcgacctggaccccgtggtgtacgacgccaagttcgaaaagcagctcggacagatcatgctgctgatactctgtacatcccaaatcctgctgatgcggaccacgtgggccctctgcgagagcatcaccctggccaccggccccctgactacgctatgggaggggtccccgggcaaattctggaacactaccatcgctgtcagcatggccaacatcttccgggggtcctacctggccggcgccggcctggcgttcagcttaatgaagtccctagggggtgggcggcgagggaccggggcccagggcgagacgctgggagagaagtggaagcgccagttgaaccagctgagcaaaagcgagttcaacatttacaagcggtccgggataatggaggtcgaccgcagtgaagccaaggagggcctgaagcgcggggagaccacccggcatgccgtgtcccggggcactgctaagttacgctggttcgtggagcggaacctcgtgaagcctgaggggaaagttatcgacttgggctgcggccgcggaggctggagttactactgcgctgggttaaagaaggtgactgaggtgaagggttacaccaagggcggaccaggccacgaagagcccatcccgatggccacctatggatggaatctcgttaaactgcactccggaaaggacgtctttttcacgcctcccgagaaatgtgacacgctgttatgcgacatcggggagtcatcccccaatccgactatcgaggagggcagaaccctgcgcgtgctgaaaatggtggaaccctggctccgggggaaccagttctgcatcaagatcctgaacccctacatgcccagcgtcgtggagaccctggagcaaatgcagaggaagcacggcggcatgctggtgaggaacccgctgtcccgcaacagcacccacgagatgtactgggtctcctgcgggacgggcaacatagtcagcgccgtgaacatgacctccagaatgctgctcaaccgcttcactatggcccataggaagcctacctacgagagagacgtcgacctgggggcaggcacgcgccacgtggccgtggagcccgaggtagccaacctagacatcatcggccagcggatcgagaacattaagcacgagcataagagcacttggcactacgacgaagacaacccctacaagacctgggcctaccacgggtcctacgaagtaaagccgagcggttccgccagctccatggtcaacggggtggtaaagttgctcaccaagccgtgggacgtcatcccaatggtcacgcaaatcgcgatgactgacaccacccctttcggccagcagcgggtgttcaaggagaaggtcgatacgcgcaccccgaaggcaaagcgagggaccgcccagatcatggaggtgaccgcccggtggctgtggggcttcctctcccgcaataagaagcccaggatctgcactcgcgaggagttcacccggaaagtgcgcagcaacgccgcgatcggcgccgttttcgtggatgagaaccagtggaactccgccaaggaggccgtggaggatgagcggttctgggacctggtccagaaagagcgcgagcttcacaagcaggggaagtgcgccacctgcgtgtacaacatgatgggaaagcgggagaagaagctaggcgagttcggcaaggccaaagggagccgcgcaatctggtacatgtggttgggcgcccggttcttggagttcgaggccctgggcttcatgaacgaagaccactggttctcccgcgaaaacagcctgtccggagtggagggtgaggggctgcacaaactcggatacattctgcgcgacatcagcaagatccccgggggcaacatgtacgcggacgacactgccggctgggatacgcgaatcactgaggacgacctacagaacgaggccaaaatcacagacatcatggagcctgagcatgccctcctggccacctccatctttaagttgacgtaccagaataaggtggtgcgagtgcagcgccccgcgaagaacgggacagtcatggacgtgatcagccgacgagaccagcgcggctccggccaggtcggcacctacggcctcaacaccttcacgaacatggaggcacagctgatccggcagatggagagcgaagggatcttctcccctagtgagctggagatccccaacctagcggagcgcgtcctagattggctggagaagtacggggtggagcgtctcaagcgcatggccatctccggagacgactgcgtggtaaagccgatcgacgacagattcgctaccgctctgacggccctgaacgacatgggcaaggtgcgtaaggacgtacctcagtgggagccaagcaaagggtggaacgactggcagcaggtcccgttttgttcccaccatttccaccagctcataatgaaggacggccgcgagatcgttgtgccgtgcaggaaccaggacgaactggtcgggcgggcccgagtgagccaaggggccggctggtccctgcgggagaccgcctgcctcggaaagagctacgcccagatgtggcagctgatgtacttccacaggcgggacctgcgcctcgccgccaacgccatttgtagcgcagtgcccgtcgattgggttcccacgtcccggaccacatggagcatccacgcccaccaccagtggatgaccacggaggacatgctgagcgtatggaatcgggtctggatcgaggagaacccctggatggaggacaaaacccacgtttcctcctggggcgacgtgccttatctggggaagcgggaagaccagtggtgcggcagcctcattggtctgaccgccagggccacctgggcctccaacatccaggtcgccatcaaccaggtgcgcagactgatcgggaacgagaactacctcgactatatgacctccatgaagcgcttcaagaacgagggcgaccccgagggggcactctggtga

SEQ ID NO: 24392 - RNA, 9879 nt, synthetic construct
  misc_feature 1..9879: note = derived and/or modified CDS sequence (opt11) from DENV-1__FJ898416__SS-prME
  source 1..9879: mol_type = other RNA
agcgtgacgatgctgctcatgctaatgccaaccgcgctggcattccacctcactacccgagggggggaaccccacatgatcgtgaccaagcaagagcgcggtaagtcactgctgttcaagactagcgctggggtgaacatgtgcaccctcatcgccatggacttaggcgagctgtgcgaggataccatgacctacaagtgcccccggatcaccgaagctgagcccgatgatgtggactgctggtgcaacgcaaccgacacatgggtgacctacggaacctgtagccagaccggcgagcaccggcgcgacaagcgaagcgtggccctcgcgccccacgtggggctggggctggagactcgcaccgagacctggatgtcctcagaaggagcctggaagcaaatccagcgggtcgaaacctgggcactccgccacccgggattcaccgtgatcgccctgtttctggcgcacgccatcggcacctccatcacccagaaagggatcatattcatcttgctcatgctagttacgccctcaatggccatgcggtgcgtcggcataggctcccgagactttgtggaggggctcagcggcgcgacgtgggtggatgtcgtgctggagcatgggtcttgcgtgaccaccatggccaaggacaagcccacattagacattgagttactgaagaccgaggtcacgaatccggcggtgctgcggaagttatgcatcgaggccaaaatctcgaacaccactacggactcccgctgcccgacccaaggcgaggccaccctgatggaggagcaagatgcgaatttcgtgtgccgtcgcacgttcgtcgaccggggctggggcaacggctgcggactgttcggcaaggggtccctcatcacgtgcgccaagttcaagtgcgtgaccaagctggaaggcaagatcgtacagtacgagaacttgaagtactccgtcatcgtgaccgtgcacacaggcgatcagcaccaagtcggcaacgaaagcacagagcacggcaccaccgcgaccatcacgccccaggcccccacctcggagatccagctcaccgactacggggcccttacccttgattgcagcccccgaacgggcctggacttcaacgagatggtgctgctcactatgaaggagaagtcctggctggtacacaaacagtggtttctagacctcccgttgccctggaccagcggggcctctacttctcaggagacgtggaaccggcaagacctgcttgtgaccttcaagaccgcccacgccaagaaacaggaggtggtcgtgctcggcagtcaggagggagccatgcacaccgccctgaccggggccaccgaaatccagacctccggcaccacgaccatcttcgccgggcatctgaagtgccgcctaaagatggacaaactgactctgaagggcatgtcgtacgtaatgtgtaccgggagcttcaagctcgaaaaggaggtcgcggagacgcagcacggcacagtgctggtgcagatcaaatacgaggggaccgacgctccctgcaagattcccttcagcacccaggacgagaagggggtcacgcagaacggccggctaatcaccgcaaacccgatcgtgaccgacaaagagaagccagtaaacatcgaggccgagccgccgtttggggagtcctacatagtcatcggcgctggcgaaaaggctctgaagctcagctggtttaaaaaaggctccagcataggcaaaatgttcgaggccaccgcccgcggggcgcggcggatggcgatcctgggcgacacggcctgggactttggttcggtaggcggtgtgttcaccagcgtcgggaaactcgtgcatcagatcttcggcacagcgtacggggtactgttctccggcgtcagctggaccatgaagattggcatcggcgtgctgctgacttggctcggcttgaactcccgcagcacctccctgagcatgacatgcatcgcagtggggctcgttaccctgtacctgggagtgatggtgcaggccgatagcgggtgtgtcataaactggaagggcagggagctcaaatgcgggagcggcatcttcgtgacgaacgaggtacatacctggaccgaacagtacaagtttcaggcggactcgccgaagcgcctgagtgcggccatcggcaaggcctgggaggagggggtctgcggcatccggtcggccacccgcctggagaacatcatgtggaagcagatctccaacgagcttaaccacatcctgttggagaacgacatgaagtttaccgtggtagtcggggacgtggtgggcattctcgcgcaaggaaagaagatgattcggcctcagcccatggagcacaagtactcctggaaatcctggggcaaggcaaagatcatcggcgccgacgtccaaaacaccacgttcatcatcgacggtccgaatacaccggagtgccccgatgatcagagagcctggaatatctgggaggtggaggactacggcttcggtatcttcacaactaacatctggctgaagcttcgggacagctacacccaagtctgcgaccaccgcctcatgtccgcagccataaaagatagtaaggccgtacacgctgacatgggatattggatcgagtcagagaagaacgagacctggaaacttgcgcgtgcgagcttcatcgaagtgaagacctgcatttggccaaagtctcacacgctgtggagcaacggtgtgctagagtccgagatgattataccaaagatttatggtggcccgatctcgcagcacaattaccgccccgggtacttcacccagaccgccggcccctggcacttggggaagcttgaactcgacttcgacctgtgcgagggcacgacggtcgtggtggacgaacactgcggaaaccgggggccgtctttacgcaccaccacagtcacgggcaagatcatccatgagtggtgctgccggtcgtgcaccctgccgccactccgcttcaagggggaggacggatgttggtacgggatggagatccgccccgtgaaggagaaggaagagaacctggtgaaatccatggtttcggcaggcagcggcgaggtggactccttcagcttggggctgctgtgcatcagcatcatgatcgaggaagtgatgagaagccggtggtcccgcaagatgctcatgaccggcaccctggccgtcttcctcctcctgatcatgggccaacttacgtggaacgacctcatccggctgtgtatcatggtaggcgccaatgcgagtgaccgcatggggatgggcaccacctacctggccctgatggccactttcaagatgcgcccgatgttcgcagttgggctcctgttccggaggctcacgtctcgggaggtcctgctgctcaccatagggctgagcctggtggcatccgtcgaattaccgaactcacttgaggagctgggcgacggtctcgctatgggcatcatgatcctgaagctgctcaccgacttccagtcccaccaactgtgggccacgttactcagcctgacgttcatcaaaaccacgctgagcctacactatgcgtggaagaccatggccatggtcctgagcattgcttccctgttccccttgtgcctgagcacgacctcccagaagaccacctggctgccagtcctcttgggcagcctgggatgtaaaccactcaccatgttccttattaccgaaacgaagatctggggccggaagtcctggcccctgaacgaggggataatggcagtcggcgtggtcagcattctcttgagctccctgctcaaaaacgatgtccccctggccgggcccctgatagccggcggaatgctaatcgcctgctacgtgatctcgggctctagcgcggacctgtccctggagaaggccgccgaggtgagctgggaggaggaggccgagcactccggcgccagccataacattctcgtcgtggtgcaggacgacggtaccatgaagataaaggacgaggaacgggacgacaccttaacgatactgctcaaggcgacgctgctggccgtctccggcgtttacccactcagcatccccgcgaccttgttcgtgtggtacttttggcaaaaaaagaagcagcggtcaggggtcctgtgggacacgcccagccctccagaggtcgagcgggccgtgttggacgatggcatctatagaatcatgcagcggggtctcttagggcgttcccaggtcggcgttggagtcttccaggagaatgtgtttcacacaatgtggcacgtcacccggggcgccgttctgatgtatcaggggaaaaggctcgagccctcttgggcatccgtcaaaaaggacctaatcagctacggcggcgggtggcggctgcagggctcctggaacacgggtgaggaggtccaggtgatcgccgtggaacccggcaagaacccaaagaacgtgcagaccgctcccgggacgttcaagacacccgagggcgaagtgggcgccatcgccctagacttcaagcccgggacaagcggctcccctatagtcaaccgagagggaaagatcgtgggcctttacggcaatggggtggtcaccacaagcggcacctatgtgagcgcgattgcccaggcgaagaccagtcaggaggggccactgcccgagatcgaggatgaggtctttcgaaagcgcaatctcaccataatggacctacacccgggcagcgggaagactcggcgctacctgcctgccatagtccgggaggctataaaacgcaagctccggacgctgatcctcgcccctacccgcgtggtggcctcagagatggccgaggcactcaagggcatgcccatccgttaccagaccacggcagtaaagtcggagcacaccggcaaggagatcgtagatctgatgtgccacgcaaccttcactatgcggctactctcccccgtgcgcgtcccaaactacaacatgataattatggacgaagcgcacttcacggaccccagctccatcgccgcccggggctacatctctacccgcgtgggcatgggggaggcggctgctatcttcatgaccgcgacgccccccggcagtgttgaggcgttcccgcaaagcaacgctgttatccaggacgaggagcgggacataccggaacgctcctggaactctggatatgagtggatcaccgacttccccggcaagaccgtgtggtttgtgccctccattaagagcggaaacgacattgctaattgcttacggaagaacgggaagcgcgtgatccaactgtcccggaagaccttcgataccgagtaccagaagacaaagaacaacgactgggactatgtggtgaccaccgacatctctgagatgggtgccaacttccgcgccgaccgggtcattgacccgcgccggtgcctcaagcccgtaatactgaaggatgggcccgagcgcgtcatcctggcgggccccatgcccgtgaccgtggcctccgctgcgcagcggcgcgggcggatcggcaggaatcacaacaaagagggcgaccaatacatctacatggggcagccactcaacaacgacgaggaccacgcccactggacggaagcgaagatgttgctggacaacattaacacccccgagggcattatcccggccctgtttgagccggagcgtgaaaagtccgcagccatcgatggggagtaccgcttaagaggtgaggcgcgtaagactttcgtcgagcttatgaggcgcggggatctaccggtgtggctttcctacaaggtggcttccgagggtttccaatacagcgatcgccggtggtgtttcgacggcgagcgcaacaaccaagtcctggaagagaacatggacgttgaaatctggaccaaggaaggggagcggaaaaagctccgaccccggtggttggatgctcgcacgtacagtgatcccctggccctccgagagttcaaagagttcgccgccggtcgccggagcgttagtggcgacctgatcctggaaatcggcaagctcccgcagcacctgacacagagagcgcagaacgccctggataacctcgttatgctgcacaactcggagcagggcgggcgggcataccgccacgccatggaggagcttcctgacaccatcgagaccctcatgctgctggcgctgatcgccgtgcttaccggtggggtgacgctattcttcctctcgggccggggcctgggcaagaccagcatcggcctgctctgcgtcatggcctcctctgtgctgctgtggatggcaagtgtggagccacactggattgctgcgagcatcatactcgagttcttcctgatggtcctgctaatccccgagccggatcgccagcgtacgccccaggacaatcagctggcctacgtggtgatcgggctcctcttcatgatcttgaccgttgccgcaaacgagatgggcctgctcgagacgaccaagaaggatcttggtatcggccacgtggccgtggaaaaccaccaccacgcaactatgctggacgtcgacctccacccagcctccgcctggaccctgtatgccgtggccactacgatcattacaccgatgatgcgccacaccattgagaacacgacggcgaacattagtctgacggccatcgctaaccaggccgccatcctcatggggcttgacaagggctggcctatctccaagatggacataggcgtgccacttcttgcgctggggtgctacagccaggtcaaccccctaaccctcacggccgccgtgctgatgcttgtggctcactacgcaatcattggccctgggctccaggcaaaggctacccgtgaggctcagaagagaaccgcggcgggcattatgaaaaaccctaccgtcgacggaatcgtggccatcgacttagaccctgtggtctacgacgctaagttcgagaagcagctgggccagatcatgctcctgatcctatgcacgtctcagatcctgctgatgcgtactacctgggccctgtgcgagagcatcaccctcgctactggcccgctgaccaccctgtgggagggttccccggggaagttctggaatacaacgatcgcagttagcatggccaacatcttccgggggtcctacctcgcaggcgccggcttagccttcagcctgatgaaatccctcgggggcgggaggcgggggaccggggctcagggcgagaccctgggagaaaagtggaagcgccaactgaaccaactctccaagagtgaattcaacatctataagcggtccgggataatggaggtcgacagaagcgaggcaaaggaaggcctcaagcgcggtgagactacacgccacgcagtctcccggggcactgccaagctacgctggttcgttgagcggaatctggtgaagcccgagggaaaggtcatcgacctcggttgcggccgcgggggctggtcctactactgcgctgggttaaagaaggtgaccgaagtcaaaggctacaccaagggtggccccggccacgaagagcccatcccgatggccacatacggctggaatctcgtcaagctccactccggcaaggacgtgttctttacgccgcccgagaagtgcgataccttactatgtgacataggggagagctcgccaaacccgaccatcgaggagggccgtaccctccgggtgttaaagatggtcgagccctggctgcgagggaatcagttctgcatcaaaatattaaacccatatatgccgtcggtggttgagaccctggagcagatgcagcgcaagcacggcggcatgctggtccgaaacccgctgtcccgtaacagcacccacgagatgtactgggtgagttgcgggacaggaaacatcgtgagcgccgtcaacatgacttccaggatgttactgaatcgcttcacaatggcccatcgcaaaccaacgtatgagcgggatgtggacctcggggcgggcacgcgccacgtcgcggtcgagcccgaggtagccaacctggacatcattggccagcggatcgagaacatcaagcacgagcacaaaagcacctggcactacgatgaggataacccctataagacgtgggcctaccacgggagctacgaggtcaagccgagcggcagcgccagctccatggtcaacggagttgtcaaactgctcaccaagccatgggatgtgatacccatggtgacccagattgccatgaccgacacgactcccttcgggcaacagcgcgtcttcaaggagaaggtggatacccggactccgaaagcgaaacgcgggacggcacagatcatggaggtgacagcccggtggctgtggggattcctgtcccgaaacaagaagccgcggatctgcacacgcgaagaatttacccggaaggtccgcagcaacgccgccatcggcgcggtgttcgtggacgagaaccagtggaattccgctaaggaggccgtcgaggacgagcggttttgggacctcgttcagaaagagcgcgagctccacaaacaggggaagtgtgcaacgtgcgtgtacaacatgatgggcaagcgggaaaagaaactgggtgagtttggcaaggctaaagggtcgcgcgccatctggtacatgtggctcggcgcgcggttcctggagttcgaggccctgggcttcatgaatgaggaccactggttctcccgcgaaaatagcctctccggggtcgagggcgaagggctacataagctgggctacattctccgggacatctccaaaatacccgggggaaatatgtacgccgatgacaccgcgggctgggacaccaggatcaccgaggacgacttacagaacgaagccaagataacggacatcatggagccggagcacgcgttactcgccacgtccatctttaagctcacttaccagaacaaggtggtccgggtccagcggcccgccaaaaacggcacggtcatggacgtgatcagccgcagagaccagcgtggctccgggcaggtcggcacgtatggcctgaacaccttcaccaacatggaggcgcagcttatccggcagatggagtccgagggtatattcctgccttccgagctggagactcccaacctcgcagagcgggtcctggactggctggagaagtacggtgtggagaggctcaagcgcatggccatcagcggtgacgattgcgtcgttaagccgatcgacgaccggttcgcgacagccctgaccgctcttaacgatatgggcaaggtgcgcaaggacatcccccagtgggagccctccaaggggtggaacgattggcagcaggtacccttctgctctcaccacttccaccaactaataatgaaagatggccgagaaatcgtggtcccttgccgcaatcaagatgaactggtcggccgtgcccgcgtctcccagggtgccggttggagcctacgagagacggcgtgcctcggcaagagctacgcccaaatgtggcaactgatgtacttccaccgccgggacctgcgactcgccgcaaacgcgatctgctcagccgtgcccgtcgactgggtccccaccagccggacgacctggtcaatccacgcacatcaccagtggatgaccaccgaggacatgctgtcggtgtggaatcgcgtctggatcgaggagaacccctggatggaggacaagacccacgtgtccagctggggagacgtcccgtacttgggcaagcgagaggaccagtggtgtggttcattaatcggcctgaccgcccgtgccacctgggccagcaacatacaagtggccattaaccaggtgcgccgtcttatcggcaacgagaactacctcgactacatgacgtcaatgaagagattcaagaacgagggcgacccagagggggtgctgtggtga

SEQ ID NO: 24393 - RNA, 9879 nt, synthetic construct
  misc_feature 1..9879: note = derived and/or modified CDS sequence (opt11) from DENV-1__FJ898417__SS-prME
  source 1..9879: mol_type = other RNA
tcggttaccatgcttctaatgttgatgcccaccgcactggccttccacctcacgaccagaggcggggagccccacatgatcgttagcaagcaggagcggggcaagtcactgctgttcaagacctcagccggcgtgaacatgtgcaccctcattgccatggacctgggcgagttttgcgaggacacaatgacgtacaagtgcccccgcatcacggaggccgaacccgacgacgtggactgctggtgcaacgcgaccgacacgtgggtgacctatgggacctgcagccaaaccggagaacaccggcgggataagaggtccgtggccctagcaccccacgtgggtctcgggctggagacgcgcaccgagacctggatgtcctccgagggcgcctggaagcagatccagcgggtcgagacctgggctctgaggcaccccgggtttacggtgatcgccctctttctggcacacgccataggcacctcaatcacccagaaggggatcatattcatcctgctgatgctggtaaccccttccatggccatgcgctgtgtgggaatcggcagccgcgacttcgtggaggggctgtccggcgccacatgggtggacgtcgtactcgagcacgggagctgtgtgactaccatggccaaggataagcctaccctggacatcgagctgctgaagacggaggtcaccaacccggccgtactgcgcaagctgtgcatcgaggccaaaatctccaataccaccacggacagccgttgcccgacccagggcgaagccaccctcgtggaggaacaggacgctaatttcgtctgtcggcgcacgtttgtggacagaggctggggcaacggctgcgggctgttcggcaagggatccctgataacgtgtgccaagttcaagtgcgtgacaaagttggaaggcaagatcgtccagtacgaaaatttaaagtatagtgtgatcgtgaccgtacacaccggcgaccaacaccaggttgggaacgagtccacggagcacggcaccaccgcgaccatcacgccccaggcacccagtacggagatccagctgaccgattacggggccctcaccctggattgcagcccccgcacaggcctggacttcaacgagatggtccttctgacgatgaaagagaagtcctggctggttcacaagcagtggttcctcgacctgccgctgccctggaccagcggagcgtccaccagccaagaaacatggaaccgtaaagacctgctggtgacgttcaagaccgcccacgcgaagaagcaggaggttgtggtgctgggcagccaggaaggcgccatgcatacggccctcaccggagccacagagatccagacaagcggcacgaccactatcttcgcaggtcacctgaagtgccgcctcaagatggataagctcactctgaagggcatgtcctacgttatgtgcaccgggagcttcaagctggagaaagaggtggccgagacacagcacggcacggtactcgtacagatcaagtacgagggcacggacgccccctgcaagatccccttctccacccaggacgagaagggtgtgacccagaacggccggctgatcacggccaacccgatcgtgactgacaaagaaaagcccgtgaacatcgaggccgaaccgcccttcggggagagctacatcgtgatcggcgctggcgagaaggctcttaaattgtcctggttcaagaaggggagctccattggcaaaatgttcgaggccaccgcccgcggggcccggaggatggcgatcctcggcgacaccgcctgggacttcgggagcatcggcggcgtgtttacatccgtagggaagctggttcatcaaatattcggcaccgcctacggggtgctgttcagtggcgtctcctggaccatgaagattgggatcggcgtgctcctgacctggctgggactcaacagccgctccacaagcctgtccatgacctgcattgccgtggggctggtcaccctctacctgggcgtgatggtgcaggccgattcgggatgcgtcattaactggaagggccgggagctgaagtgcggtagcggcatcttcgtaaccaacgaggtacacacgtggaccgagcagtacaaattccaggcggactccccgaaacgcctaagcgccgccatcggcaaggcctgggaagagggggtctgcggcatccggtctgccacgcgacttgagaacatcatgtggaagcagatcagcaatgaactgaaccacatcctcctggagaacgacatgaagttcaccgttgtggtcggggacgtggcaggcatcctggcccaggggaagaagatgatccgtccccagccgatggaatacaagtactcctggaagtcctggggtaaggccaagatcataggcgccgacgtgcaaaacacgacgttcatcatcgacgggcccaatacccccgagtgccccgacgatcagcgggcgtggaacatctgggaggtcgaggactacggcttcgggatcttcaccaccaacatctggctgaaactgagggactcgtatacccaggtgtgtgaccaccgcctgatgagcgcagccataaaggattccaaagcagtgcacgccgacatggggtactggatcgagagcgagaagaatgagacctggaagcttgcacgggcctcatttatcgaggtcaagacctgtatctggcccaagtcgcacaccctatggtccaacggcgtgctggagagcgagatgataatccctaagatttacggtggcccgatctcccagcacaactaccgccccgggtacttcacgcagactgccggcccctggcacctcgggaagcttgagctggacttcgacctctgcgagggcaccacggtagtggtggatgagcactgcggcaaccgggggccctcactacgcacgaccaccgtgaccggcaaaatcatccacgagtggtgctgtcgatcctgcactctgccacccctgcgcttcaagggggaagacggttgctggtacgggatggagatccggcccgtgaaggagaaagaggagaacctggtgaaaagcatggtgagcgccggttcgggcgaggtcgacagcttcagtctgggtctcctttgcatcagcatcatgatcgaggaggtgatgcgctcccgttggagccgcaagatgctgatgaccggcacactcgccgtattcttcctgctgatcatggggcagctcacctggaacgaccttatccggctttgcattatggtcggggcgaacgcctccgaccgcatgggtatggggacgacatacctcgccctgatggccacgttcaagatgcgcccgatgtttgccgtggggctcctgttccgtaggctgaccagccgggaggtgctgcttctgacgatcgggctgtccctagtggcgagcgtcgaactgcccaacagtctggaggaactgggcgatgggctggccatgggcattatgatccttaagctcttgaccgacttccagagccaccagctgtgggccaccctcctgtcactgaccttcataaagacgacattctccctccattacgcctggaagaccatggcgatggtcctgtccattgtgtcactgttccctctctgcctgtctaccacgagccagaagaccacctggctgcccgtgctcctgggctcactggggtgcaagccgctcaccatgttcctgatcgccgagaacaagatctggggtcgcaaaagctggcccctgaacgaggggatcatggccgtcggcatcgtcagcatcctcctgtccgcccttctcaaaaacgatgtccccctggctgggcctctgatcgcggggggcatgctcatagcctgctacgtcatcagcgggtccagcgccgacctgtcgttagagaaggccgccgaggtgagctgggaggaggaggccgagcactccggggcgagccacaatatcctcgtggaggtccaagacgacggaacgatgaagatcaaggacgaggagcgggacgacactctaacgatcctgttaaaggcaacgcttctggccgtttccggcgtttaccctctgagcattcccgcaacactgttcgtctggtacttctggcagaagaagaagcagcgcagtggggtgttatgggatacgcccagcccgcccgaggtggagcgggctgtcctcgatgacggcatctaccgcatcatgcagagaggcctactggggcgttcccaggtgggcgtgggcgtctttcaggagaacgtgtttcacaccatgtggcacgtgacccgcggcgccgttctgatgtaccagggaaagcgcctcgagcccagctgggcctccgtgaagaaggacctaatctcgtacggcggtgggtggcggctgcaaggttcgtggaacaccggagaggaggtgcaagtgatcgccgtggagccaggcaagaatcccaagaacgtgcaaacggcccccggaacgttcaagactagcgagggcgaggtgggagcgatagccctcgacttcaagcccggaacctcaggaagccccatcgtaaaccgcgaggggaagatcgtggggctgtacggcaacggggtcgtgacgacgagcggcacttacgtgtcagcgatagcccaagcgaaggcctcacaggaggggccactgccggagatagaagatgaggtattcagaaagcgcaacctaacgatcatggacctgcaccccgggagtgggaagacgcggcgctacctgcccgccatcgtgcgagaggcgataaagcgcaaactccggaccctgatcctggccccgacccgcgtggtcgcgagcgagatggccgaggccctcaagggcatgccaatacgctatcaaaccacagccgtgaagtctgagcacactggcaaggagatcgtggacctaatgtgtcacgccaccttcaccatgcggctgctcagcccagtccgcgtgccgaactataacatgattataatggatgaggcgcacttcacggacccaagtagcatcgctgcacgggggtatatatccacacgagtcggcatgggcgaggccgccgccatcttcatgaccgcaacgccgcccggcagcgtcgaagccttcccacaatcgaacgccgtgattcaggacgaggaacgcgacatcccggagcgcagctggaactccgggtacgaatggatcacggacttccctggcaagactgtgtggttcgtcccttcaatcaagtccggcaacgacatcgccaactgcctgcggaagaacgggaagcgcgtgatccaactcagcagaaagaccttcgacaccgagtatcagaagaccaagaataacgactgggactacgtggtcaccaccgacatctccgagatgggtgccaacttccgtgccgaccgggtaatcgaccccagacgctgtctcaagccggtcatcctgaaagatgggcccgagcgcgtcatcttagccggccccatgcccgtgaccgtcgccagcgcggcccagcgccgcggtcggataggcaggaaccacaacaaggagggggatcagtacatctacatggggcagccgctgaacaacgacgaagaccatgcccactggacggaggcgaagatgctgctggataacatcaacacccccgagggcatcatccccgccttattcgagcccgaaagagaaaagtcggcggccatagacggggagtaccgcctaaggggcgaggcacgtaaaacctttgtggaactgatgcgccggggggacctcccggtgtggttgagctataaggtggccagcgaaggcttccagtactccgaccgccggtggtgcttcgacggggagcgcaataaccaggtactggaggagaacatggacgtggagatatggactaaggaaggggagcggaaaaaactacgccctcgatggctggacgcacgcacttacagcgaccccctggcgctgcgggagttcaaggagttcgccgccggccgccggtccgtcagcggggacctgatcttagagatcggcaagctcccccagcacctgacccagcgcgcccaaaatgcgctggacaatctcgtgatgttacacaactccgagcagggggggcgggcctatcgtcacgccatggaggagcttccggacaccatcgagaccctcatgctgctggccctcattgctgtgctgacgggcggcgtcaccctgttcttcttaagcggccgggggttaggcaagacctccatcggcctgctatgcgtcatggcgagcagcgtgctactgtggatggccagcgtcgaaccccattggatcgcagcctccatcatcctggagtttttcttaatggtgctgctcatacctgagcccgaccgccagaggaccccacaggataaccaactcgcctacgtcgtcatcgggctcctttttatgatcctgactgtggcggccaacgagatgggcctgctcgagacgaccaagaaggacctggggatcggccacgttgccgtcgagaaccaccaccacgccgccatgctggacgtggacctccaccccgcgtcggcgtggaccctgtacgcggtagccaccacgatcatcacaccgatgatgcgccacaccatcgagaataccacggccaacatctccttgacggcgatcgccaaccaggccgccatcctcatgggcttagacaagggctggccgatctcgaagatggacatcggcgtacccctgctcgcgctgggttgctattcacaggttaaccccctgacgctcaccgccgccgtactcatgctggttgcacactacgcgatcatcggaccagggctccaggcgaaagctacacgcgaggctcaaaagcgcacagccgccggcattatgaagaacccgaccgtggatgggatcgtggcgattgaccttgatcccgtcgtttacgacgccaagttcgaaaagcagttgggccagatcatgctcctcatcctgtgcaccagccagatccttctgatgcgcacgacctgggccctgtgcgagtccattaccttggcaaccggccccctgacgaccctgtgggagggcagcccgggcaaattctggaacaccacaatcgccgtatccatggcaaacatcttccgggggagctacctcgccggcgccggccttgctttcagcttgatgaagagtctcgggggcggccgccggggcacgggagctcagggcgagaccctaggcgaaaagtggaagcgccagctgaaccagctgagcaagtccgagttcaacacctacaagcggagcgggatcatggaggtcgaccgctccgaggccaaggagggcctcaaacgcggggagaccacaaagcacgccgtgtcgcgtggaaccgcgaagttgcgctggttcgtggaacgaaacctcgtcaagccagaggggaaggtgatcgacctgggctgtggccgcggcgggtggtcctactactgtgcagggttgaagaaggtgaccgaggtaaaggggtataccaagggcgggcccggccacgaggagcccatccctatggcgacgtacgggtggaacctagttaagctccacagcggaaaggacgtgttcttcattccgccggagaagtgtgacacactgctgtgtgatatcggcgagagcagccccaaccccacaatcgaagaaggccgcaccctccgggtcctgaagatggtggagccgtggctgcgcgggaaccagttctgtataaagatcctcaacccatacatgccctccgtggtcgagacgctggagcagatgcagcgcaagcatggcggcatgttggtgcgcaaccccctctctcggaactccacccacgagatgtactgggtgagttgcgggaccggcaacatcgtgtccgccgtcaacatgaccagccgcatgttactgaaccgctttaccatggcgcaccgcaagccgacatacgagcgcgacgtggacctgggggccggtacccgtcacgtcgccgtcgagcccgaagtggcgaacctggacataatcggccagagaatcgagaacatcaagcatgaacacaagtccacctggcactacgacgaagacaacccctacaagacctgggcctatcacgggtcttatgaggtaaagccctctggcagcgccagctccatggtgaacggagtcgtgaagctgctcacaaagccgtgggacgtgatcccgatggtcacccaaatcgctatgaccgacacaacgcccttcggccagcagcgggtgttcaaggaaaaagtagacacccgcacgcccaaagccaagcggggaacagcgcaaataatggaggtcacggccaagtggctgtggggcttcctgagccgcaacaagaagccgcggatctgcacccgcgaggagtttacccggaaggtgcgctccaacgccgccatcggtgcagttttcgtcgacgagaaccaatggaacagcgctaaggaggctgtggaagacgagcggttctgggacctcgtgcaccgcgagcgggaactgcacaagcagggcaagtgcgcgacctgcgtctacaacatgatgggcaaacgcgagaagaaactgggggagttcggcaaggccaaagggtcccgggcgatctggtacatgtggctcggcgcccgctttctggagttcgaggccctgggattcatgaatgaggaccactggttctcgcgggagaactccctcagcggggtggagggcgaggggctgcacaagctgggctacatcctccgcgacatctccaagatcccggggggcaacatgtacgccgacgatacggccggatgggacacccggatcaccgaggacgacctgcagaacgaggcgaagatcaccgacatcatggagcccgagcacgccctgctcgcaaagagcatcttcaaactgacgtaccagaacaaggtggtccgcgtgcagcggccggccaagaatggtactgtgatggacgtcatctcccgacgcgaccaacggggcagcggccaggtcggtacgtacggcctgaacacatttacgaatatggaggcccagctcatacgccaaatggaatcagagggaatcttcagcccctccgagctggagaccccaaatctggcgggccgggtgctcgactggctggaaaagcacggggtcgagcgcttgaagcggatggccatctcgggcgacgactgcgtggtgaagcccatcgatgaccgcttcgccaccgctctcaccgccctgaatgacatggggaaggttcggaaggacatcccccagtgggaaccctccaagggctggaatgactggcagcaggtcccattctgctctcatcacttccaccaacttatcatgaaggacggccgcgagatcgtggtcccctgtaggaatcaggacgagcttgtgggtcgcgcgcgcgtgagccagggcgccggatggtccctgcgagagacggcctgcctgggcaagagttacgcccagatgtggcagctgatgtactttcatcggcgggaccttcggctcgcggctaacgccatctgctccgccgacccggtcgactgggtgcccaccagccgcaccacctggagcatccatgcccaccaccagtggatgactacggaggacatgctcagcgtgtggaaccgggtctggatcgaggagaatccctggatggaagacaagacccacatctccagctggggcgacgtgccctacctaggcaagcgcgaggaccagtggtgcggcagtttaatagggctcaccgcacgggccacgtgggccaccaacatccaggttgcaatcaaccaggtacgcagactgatcggcaacgagaactatctggactatatgacctcgatgaagcggttcaagaacgagagcgacccggaaggggccttgtggtaa

SEQ ID NO: 24394 - RNA, 9879 nt, synthetic construct
  misc_feature 1..9879: note = derived and/or modified CDS sequence (opt11) from DENV-1__GQ868612__SS-prME
  source 1..9879: mol_type = other RNA
tccgtaacgatgctcctcatgttgatgccaacggccctcgcctttcacttaaccaccagaggaggtgaaccgcatatgattgtgtccaagcaagaaagaggaaaatcactgttgtttaaaacgtcagcaggcgtcaacatgtgcacattaatcgcgatggacctcggggaactatgcgaagacacaatgacatacaagtgcccaaggataacagaagcggaacctgacgacgtcgactgctggtgcaacgcaacagacacatgggtgacctacgggacatgctcacaaaccggagaacaccgtcgcgataaacgaagtgtcgctcttgcgccacacgtcggactaggtctcgaaacgcgtacggaaacctggatgagttcagagggcgcctggaagcaaatacaaagagtcgaaacatgggccctccggcatccagggttcactgtcatagcactcttccttgcacacgcaatcggcacctcaataacacaaaagggcataatcttcatcctactgatgctcgttacacctagcatggcaatgcgttgtgtaggtatcggatccagagattttgtggagggcctctcgggcgccacttgggtcgacgtagtcttagagcatggctcctgtgttacaacgatggcgaaggataaaccaaccctcgatatcgaactactaaaaaccgaggtcacgaaccccgcggtgctgaggaaattatgcatcgaagcaaaaatatcaaacactacgaccgactcacgatgtccgacacaaggagaagccaccctcgtggaagaacaagatgcaaacttcgtctgccgacgcacatttgtggaccgagggtggggcaacggatgcgggctattcgggaaaggtagccttataacgtgtgcgaaattcaaatgcgtaacaaagctggaaggaaaaatcgtacaatacgaaaatctaaagtacagcgtcatagttaccgtgcacacaggagatcaacaccaggttggaaacgagagcaccgagcacggaactacggcaactatcacgccgcaggctccgaccacagaaattcagctcacggactacggggctctcacgctggactgctcgccacggaccgggctagatttcaacgagatggtgctgctaaccatgaaggagaaaagctggcttgtacacaaacaatggttcctcgacctcccactaccatggacgtccggagcatcgacatcccaagaaacttggaataggcaagacctccttgtcacattcaagacagcacatgctaagaaacaggaagttgttgtactgggaagccaagaaggagcgatgcacaccgcactcactggggctactgaaatacaaacatccggaacaacaacaattttcgccgggcatctgaaatgccgtctcaaaatggataaacttacgctgaagggaatgagctatgtgatgtgcacaggcagcttcaaactcgagaaggaagtagctgaaacacaacacggaaccgtcctcgtgcagataaaatacgaaggaaccgacgctccctgcaaaattccattcagcacacaagatgaaaaaggtgtaacacaaaatggtcggctgataacagccaacccgatcgtaaccgacaaagagaaacctgtaaatatcgaagcagaacctcctttcggagagagctacatcgtaatcggcgctggcgagaaagctctcaaactgagttggttcaaaaagggatcaagtatcggaaaaatgtttgaggcaacagcaaggggagccagacgaatggcgatccttggcgataccgcctgggactttggttcgatcggtggcgtcttcacgagcgtcggtaagttggtccaccaaatcttcggaacagcgtacggagtcctcttttccggcgtgtcctggacgatgaaaattggcataggagtcctactgacctggctcggcctaaatagtaggtcaaccagtctaagcatgacatgcatagcggtaggactggtcacgctttatttaggagccatggtccaagcagacagtggatgcgtcataaactggaaaggcagagagctaaagtgcgggtcgggaatcttcgtcacaaatgaagtacatacgtggactgaacagtacaagttccaagccgacagccccaaaaggttatcagcagcaatagggaaagcatgggaagaaggtgtgtgcggaatcaggagcgccacaagactagagaatatcatgtggaaacagatcagcaacgaactgaaccatatcctgctggaaaacgacatgaaactcactgtcgtggtaggagacgtagcagggatcttaggacagggcaagaaaatgatacgccctcagccgatggagtacaagtactcgtggaaatcctggggaaaagcaaagattataggcgccgacgcacaaaacacgacatttatcatcgacggtcccaataccccagagtgtcccgacgatcagcgggcgtggaacatttgggaagttgaagactatggattcgggatcttcacgacgaatatttggctcaaactccgggacagctatacccaggtctgcgatcaccgcctgatgagtgccgcgataaaagactctaaggcagtacatgcggacatgggatattggatagaatcggagaaaaacgaaacctggaaactagcaagggcatcactgatagaagtgaagacttgcatctggcccaaatcccatacactatggtcaaatggtgtactggaatccgaaatgattatcccaaaaatatacggcggacctatatctcaacataattataggccgggatacttcacacaaacggcgggaccctggcacctgggaaagttagagctagacttcgatctctgtgagggcaccactgtcgtagtggacgaacactgcggcaatagaggcccatcactcagaacgacaaccgtgacgggcaaaataatccacgaatggtgctgcaggagctgcacgctgccacccctccgattcagaggggaagacggctgttggtacggaatggagataaggcccgtcaaggagaaagaggaaaacctcgtgaagtctatggtctcagcaggtagcggggaggtcgactcgttcagcttaggcttgctctgcatatctatcatgattgaagaagtcatgcgtagccgatggtccagaaagatgctcatgaccggtacactagcagtgttcttcctgctaatcatggggcaactcacctggaatgacctaatacgactttgtatcatggttggagcaaacgcaagtgatagaatggggatgggcacgacttacctagctcttatggccaccttcaagatgagaccaatgtttgcagtcggcctacttttccgccgtctaaccagccgagaagtgctattactaacgataggactaagtctcgttgccagcgtcgaacttccgaacagcctggaggagctcggcgacggcttagcaatgggaatcatgatactcaaactactgacggacttccagtcccaccaactttgggccaccttactttcgctaacgtttataaagaccaccttcagcctccactacgcttggaagaccatggcgatggtactaagcatagtaagtttattcccgttgtgcctatcgaccaccagccagaaaacaacatggttgccggtcctgctaggtagcctgggctgcaagccgctaacaatgttcttgatagccgagaacaagatctggggacgcaaatcgtggcctctgaacgaaggaataatggccgtcgggatcgtctcaatcctactatcgagtctcctaaagaacgatgtgcccctcgctgggcccctcatcgctgggggtatgctgatcgcatgctacgtaatatcgggaagctccgccgacctgtccctcgaaaaagcagctgaggtatcatgggaggaagaggccgaacacagcggggcgagtcataacattttagtagaagtccaagacgacgggacaatgaaaatcaaagacgaagaaagggacgacactctgaccatactactaaaagcaactctactagcagtcagcggcgtctacccactatcgatcccggctaccctctttgtgtggtatttctggcagaagaaaaagcaaaggtcaggggtgctctgggacacaccgtccccgccggaggttgagcgagcagtactggacgacggcatttatcgcattatgcaaagaggactcctgggccggagccaggttggagtcggcgtatttcaggaaaacgtattccacacaatgtggcacgtgacaagaggtgctgtccttatgtaccaaggaaaaaggctagaacccagttgggcaagtgtgaagaaagacctgataagctacggcggaggatggagacttcggggatcgtggaacacaggcgaagaggttcaggtcatagcggtcgagccaggcaaaaaccccaaaaacgtccagaccgccccgggcacattcaaaacaccagagggagaagtcggggccattgcgctagacttcaaaccaggaacatcgggtagcccgatagttaatcgagaagggaagatagtgggcttatatggaaacggagtggtcacaacatctggtacgtacgtatcagccatcgcccaagccaaggcctcacaagagggtcccctacctgagatcgaagacgaggtattccggaaacgaaacctcaccataatggacctgcaccctggctcgggcaaaacgcggcgatatctcccagcgatcgtgcgtgaagcaatcaagcggaaactgcgcacgctcatcctggctccgacgcgcgtggtggcaagcgagatggcagaagcactcaaggggatgccgatccgataccaaacgaccgcagtcaaatcggagcatacaggcaaggaaatagtagacttaatgtgtcacgcaacattcaccatgaggctcttgagtcccgtccgcgtacccaactacaatatgataataatggatgaagcacacttcaccgacccaagctcgatagccgccagggggtacatttccacaagagttggcatgggagaggctgcagcgattttcatgaccgcgactccgcccggttcagtggaagcatttccacagagcaatgctgtgatccaggatgaagaacgggacataccagaaagatcatggaactcgggctacgaatggatcacggactttccagggaaaacggtatggtttgtcccctctataaagtcgggcaacgacatcgccaattgtctacgcaagaatggcaagcgggtgatccagctgtcaagaaagacatttgacacagaataccagaaaaccaagaacaacgattgggattacgtcgtaaccacagacatttccgaaatgggtgcaaactttcgcgcggaccgagtgatagaccccagacggtgtctaaaaccggtcatattgaaagatggacccgaacgagtgatcttagcaggacccatgccagtaaccgttgccagcgccgcccaaagacgtggtagaatcggcagaaaccacaacaaagagggtgatcaatatatttatatgggacaacccctaaacaatgatgaggaccacgcccactggaccgaggcgaaaatgctgcttgacaacatcaacaccccagaggggataatcccggctctttttgagccggagagagagaaaagcgccgccgtggacggtgaatatagattgcgcggagaggcccgaaagaccttcgtagagttgatgcgtagaggtgaccttccagtatggctatcctacaaggtggcgagcgaaggattccaatacagcgaccgaaggtggtgcttcgacggagaaagaaacaaccaagtgctcgaggaaaacatggatgttgagatatggaccaaagaaggagaaaggaagaaacttaggccacgatggctcgacgcgcggacatacagtgatccacttgccctgcgggaatttaaagaatttgccgcgggacgacgctcagtgagtggggacctgattttagaaataggtaaactgccacagcacttaactcaaagggcacagaatgcgcttgataaccttgtaatgctgcacaacagcgaacaaggagggcgcgcttaccggcacgcaatggaggagctcccagataccatcgagacgctaatgctgctagcacttatagcagtactaacgggcggggtcacgctatttttcctctccggcagagggctcggtaaaacgagcataggcctgctctgcgtcatggcgagcagcgtcctcctatggatggcgagcgtcgagccccactggatcgcggccagcataattctggagttcttcctgatggtgttgcttataccggagcccgaccggcaaaggacaccgcaggacaaccaattagcttacgtggtcatcggcttactgttcatgatcttgaccgtcgcggctaatgagatgggcctgctagaaacaaccaagaaagacctaggcattggacatgttgcggtagaaaaccaccaccacgcagcgatgctggacgtggatttgcatcccgcctcagcctggaccctatacgctgtcgcgaccacgatcataacgccaatgatgcgacacaccatcgaaaataccactgcaaacatttcattaacagctattgcgaaccaggcagcgatactcatgggtctggacaaaggctggccgatcagcaaaatggatattggagtaccactcctggccctgggatgttactcccaagtcaacccactcaccctgacagctgccgtcctgatgctagtcgcgcactacgcgataataggcccgggactacaagccaaggcaactcgggaggcacagaaaagaactgccgccggaataatgaagaatcccacagtggacggtatcgtagcgatcgatctagacccggtcgtctacgacgccaaattcgaaaaacaactaggccagataatgcttttaatactatgcactagccagattctcctaatgagaacgacttgggcactatgtgagtcgatcacgttagccaccggcccactcaccacgctgtgggaaggaagccccggcaaattctggaataccacaatcgcggtgagcatggccaacatctttagaggaagctacttagccggagcaggcctggccttctctctgatgaaatcactaggaggagggcgacgcggtacaggggcccagggagagaccctcggcgaaaagtggaaacgccaactaaaccaattatcgaagtcagagttcaacacatacaagcgatctgggatcatggaagtggaccgctctgaggcaaaggaaggactaaagagaggggaaacgactaaacacgctgtgtcacgcggaactgccaagctccgctggttcgtagagaggaatttggttaaaccagagggaaaggttatagatctcggctgcggccgaggcggttggtcgtactactgcgccgggctcaaaaaggtcacagaggtaaagggatacacaaaaggtggcccggggcacgaggagcccatacctatggcgacatacggctggaacctcgtgaagctacacagcgggaaagacgtcttctttataccgcccgagaagtgtgacacactcctctgtgacatcggtgagtcatcacccaacccgaccatagaagaggggcgcacactcagggtgctgaagatggtcgagccttggcttagaggaaaccaattctgtattaaaatactgaacccttacatgccatcagtcgtagaaaccctagaacagatgcaacgcaaacatggcgggatgctcgtccgaaacccactctcgaggaactcgacgcacgaaatgtactgggtaagctgcggcacaggaaacatagtcagcgccgtaaacatgaccagtcgcatgcttctcaacagattcacaatggcccaccgcaaacccacctacgaaagagatgtcgacttaggaacagggactagacatgtggcagtcgagcccgaagtggcaaacctggacatcatcggccagaggatagaaaacataaagcacgaacacaagagcacatggcactatgacgaggacaacccgtataagacatgggcctaccatgggtcctacgaagtcaaaccaagcgggtccgcatcatcaatggtcaatggggtggtcaagttactgacgaagccctgggacgtgataccaatggtgacccaaatagcgatgactgacacaacacctttcggccaacagagggtatttaaggagaaggtagacacgagaacacctaaggcgaagcgcggaactgcccagatcatggaagtgacagcacggtggctatggggattcctctcgcgaaacaagaaaccgagaatctgtacccgagaagagtttacaaggaaagtacgaagcaacgcagcaatcggggccgtttttgtagacgagaaccaatggaatagcgcaaaagaagcggtggaagacgaacgcttttgggacctcgtgcacagggagagggagctccacaaacagggtaagtgcgcaacctgcgtatataacatgatggggaaaagggagaagaaactaggagagttcggcaaagcaaagggctccagagctatctggtacatgtggctcggcgcacgcttcctcgagttcgaagctctaggctttatgaacgaagaccactggttctccagagagaacagcctaagcggggttgagggggaaggcctacacaagctcggttatatcctgcgggacatatcaaaaatccccggtggcaacatgtacgcggacgacaccgcagggtgggacacacgaataacagaagacgacctacaaaatgaggcaaagattacagacattatggaacctgaacatgcgcttctcgcaaaagccatattcaaactgacctaccaaaataaagtagttcgcgtgcaacgaccagcgaaaaacgggacggtcatggatgtcatatcacggcgtgatcaacgaggcagtgggcaagtaggcacatacgggctcaacaccttcacaaatatggaggcgcaactcatccgacagatggagtcggaaggcatctttagtccgagtgaattagaaaccccaaacctcgcagagcgcgcccttgactggcttgaaaaatacggagtagagcgtttgaagagaatggctatttcaggagacgactgcgtggtaaagccaattgacgaccgtttcgcaacggccttaaccgctcttaacgacatgggaaaagtgcgcaaagacataccgcaatgggagccatccaaagggtggaacgactggcaacaggtccccttctgcagccaccacttccaccaactcataatgaaagacggacgcgaaatcgtagtaccatgcaggaatcaagacgagctagttgggagagcaagagtgagccagggagccggctggtcgctccgggaaaccgcctgcctaggaaagtcctacgcccagatgtggcaactcatgtatttccataggagggatctgcgactagcagccaacgccatctgcagcgccgtaccggtggactgggtaccaacgtctcggactacatggagcatccatgcacatcatcagtggatgacgactgaagacatgctaagcgtctggaacagagtgtggatcgaggagaacccatggatggaggataaaacccacataagtagttgggaggacgtaccatacctgggcaaacgagaggaccaatggtgcggaagcctcatcggcctcaccgcacgggcgacctgggccactaatatacaggtggcgatcaatcaagtcagacgacttatcggtaatgaaaactatttagattatatgacatcaatgaaacgcttcaagaatgagtcggaccccgaaggagccttatggtga

SEQ ID NO: 24395 - RNA, 9879 nt, synthetic construct
  misc_feature 1..9879: note = derived and/or modified CDS sequence (opt11) from DENV-1__FJ898419__SS-prME
  source 1..9879: mol_type = other RNA
agcgtgaccatgctgctcatgctgatgcccaccgcgctggccttccacctcacaacccggggcggcgaaccccacatgatcgtgagcaagcaggagcggggcaagagcctactgtttaaaacatccgccggggttaacatgtgtaccttaatcgccatggatctaggcgagttctgtgaggacacaatgacctacaagtgtccccgcataacagaggcagagcccgacgacgttgactgctggtgcaacgctaccgacacgtgggtcacctacgggacctgtagtcagacgggggagcaccggagagacaaacgatccgtggccctggcgccccacgtgggcctggggctagagacgcgcaccgagacgtggatgagctccgagggcgcgtggaaacagatccagcgggtcgaaacgtgggctctgcgccaccccggtttcacggtgatcgccctctttctggcgcatgccatcgggaccagcatcacccagaaggggataatcttcatcctgctcatgctcgtgacccccagcatggccatgcggtgcgtcggcatcggctcgcgagactttgtggaaggtctttccggcgccacatgggtggacgtcgtgctcgagcacgggagctgcgtgactaccatggccaaggacaagcccaccctggatatcgagctgctcaagacagaggttacgaacccggcggtgttacggaagctgtgcatcgaggctaagatctccaataccaccaccgacagccgctgcccgacccagggcgaggcgaccctcgtagaggaacaggacgccaatttcgtctgccggcgaaccttcgtggaccgaggttgggggaacggatgcgggctattcggcaaagggtccctgattacgtgcgccaagttcaaatgcgtgaccaagctagagggcaagatagtccagtatgagaacctgaaatacagcgtcatcgttacagtacataccggcgaccagcaccaggtgggaaacgagtccacggagcacggcaccaccgcgaccatcactccccaggctcccagcacggagatccagttgaccgactacggagccttaaccctggactgctctccccggaccggcttagatttcaacgaaatggtcctcctaaccatgaaggagaaatcctggcttgtgcacaaacagtggttcctcgacctgccgctgccctggacctcgggggccagcaccagccaggaaacttggaaccggaaagacctcctggtgacctttaagaccgcccacgcgaagaagcaggaggtcgttgtgctgggctcccaggagggcgcaatgcataccgcactcacaggagcaacggaaattcagaccagcggcaccaccacgatattcgctgggcacttaaagtgccgactgaagatggataagctcaccctgaagggcatgtcttacgtcatgtgcaccggtagctttaagctggagaaggaggtcgcggagacgcaacacggcacggtgctggtccagattaagtacgagggcaccgacgcaccctgcaagatacctttctccacccaggacgagaagggggttacacagaacgggcgtctaatcacggccaacccgatcgtgaccgacaaggagaagcctgtgaacattgaggccgagccgcccttcggggagagctacatcgtgatcggcgcgggcgagaaggcgttaaagctatcctggttcaagaaagggagctccatcggtaagatgttcgaagccaccgcacgcggggcccggcgcatggcgattctcggagacaccgcgtgggactttggtagcatcggcggcgtgttcacgagcgtcgggaagctggtgcaccagatcttcggcaccgcctacggggtgctgttcagcggtgtctcctggaccatgaagatcggaatcggcgtgctgctgacctggctgggcctaaacagtcgatcaacgtccctctccatgacttgcattgccgtggggctcgtcaccttgtacctaggcgtgatggtacaggcagactcagggtgcgtgataaactggaagggccgggaattaaaatgcgggtcgggcatcttcgtaaccaacgaggtgcacacgtggacggagcagtacaaattccaggcggattcaccgaagcgcctcagcgccgcgattggcaaagcatgggaagagggcgtctgcggcatccgctccgccacgcgcttggagaacatcatgtggaagcagatctcaaatgagctgaaccacatcttgcttgagaacgacatgaagttcaccgtagttgtcggggacgtggcgggtatcctggcccaggggaagaagatgattcgcccccagcccatggaatacaaatactcctggaagtcctggggcaaagccaagataatcggcgccgacgtgcagaacaccacgttcatcatcgacggtcccaacaccccggaatgccccgacgaccagcgggcttggaacatctgggaggtggaggactatggcttcgggatcttcacgaccaacatatggctcaagctgcgggactcctacacccaggtctgcgaccaccgattgatgtcagccgccatcaaggactccaaggccgtgcacgctgacatgggctactggatcgagagcgagaagaatgagacctggaagctcgcccgggcttccttcatcgaggtcaagacctgcatctggcccaagtcacacaccctgtggtccaacggtgtgctggagtccgagatgatcatccccaagatctacggaggaccgatctcccagcacaactaccgacccgggtacttcacacaaaccgccggtccctggcacctcgggaagcttgagctggacttcgatttgtgcgaaggcactactgtggtcgttgacgagcactgcggcaatcgggggccgagcctgcgcacgaccaccgtgaccggcaagataattcacgaatggtgctgccggagttgcacgctcccacccctgcgcttcaagggtgaggatggttgctggtacgggatggagatccggcccgtcaaagagaaagaggaaaacctggtcaagagcatggtgagcgccggctccggcgaagtcgacagcttctccctgggactcctgtgcattagcatcatgatagaggaagtgatgcggtcccggtggtcgcgcaagatgttaatgaccggaaccctagccgtcttcttcctgctgattatgggacagctcacgtggaacgacctgatccggctctgcatcatggtaggagcgaatgcctccgacagaatggggatgggcacgacctaccttgccctaatggccaccttcaagatgcgtccaatgttcgccgtgggcctcctgttccggcgcctcaccagccgggaggtcctgctcctgacgatcgggctgtccctggtcgcgagtgtcgagttgcctaactccctggaagaattgggcgacgggctggccatggggatcatgatactgaaactcctgaccgacttccagtcccaccagctttgggccaccctcctgagtctgacgttcatcaagactaccttcagcctccactacgcctggaagactatggcgatggtcctgtccatcgtgtctctgttccctctatgtctgtccacgacgagccagaagacgacctggttgcccgttctcctcggctccctcggatgcaagccgctcaccatgttcctgatagccgagaacaagatctggggccgtaagagctggccccttaacgagggaataatggccgtcggtatcgttagcatcctattaagcgccctgctaaagaacgacgtccccctggccgggcctctgatcgcgggcgggatgttgatcgcctgctacgtcatcagcgggtcctccgcggacctgtcactggagaaggccgccgaggtgagctgggaagaggaggcggagcactcaggcgcctcccacaacatcctcgtggaggtgcaagacgacgggacgatgaaaataaaggatgaggagcgtgacgacactctgaccatcctgctcaaggccaccttactggccgtgagtggcgtgtacccgctcagcatacctgccaccctgttcgtctggtacttttggcagaagaagaagcagcgctccggggtgctgtgggacacgccctccccgcccgaggtggagcgggcagtcctcgatgacggcatctacaggatcatgcagcgcggactactcggaagatcccaagtgggcgtgggggtctttcaagagaacgtgtttcacaccatgtggcacgtgacccgaggcgccgtactgatgtaccagggcaagcgcctcgagcccagctgggccagtgtaaagaaggacctaatcagctacggcggcgggtggcggctgcaaggcagttggaacaccggggaggaggtccaggtcatcgccgtggagcccggcaagaacccgaaaaatgtgcagacggcccccgggacgttcaaaaccagcgagggcgaagtcggtgcgatcgccctcgacttcaagcccggtacatcaggcagccccattgtgaaccgagagggcaagatcgtaggcctgtacggcaacggtgtcgtgacgacctcaggcacctacgtgtcggcgatcgcgcaggcaaaagccagccaggaggggccactgcccgagatcgaggacgaagtcttccggaaacgcaatctcaccatcatggacctgcaccccggctccggcaagacgcggcgctacctgcccgccatagttcgggaggccatcaagcgcaagctccggacactgatccttgccccgacccgcgtcgtcgcaagcgaaatggccgaggccctcaagggtatgcccatccgctatcagacgacggccgtaaaatcagagcataccggcaaagagatcgttgacctgatgtgccacgcaaccttcaccatgcggctgctgagccccgtccgcgtgccgaactacaacatgatcatcatggacgaagcacacttcacggacccgtccagcatcgccgcccgggggtacatctccacccgcgtcggcatgggggaggccgccgcaatcttcatgacagccacgccgcccgggagcgtagaggcctttccccaaagcaacgccgtcatccaggacgaggagcgggacatcccggaacgcagttggaactctggctacgagtggatcaccgactttcccggcaaaaccgtgtggttcgtcccaagcatcaagtccggcaacgacattgcaaattgcctacggaaaaacggcaagcgcgtgatacaattatcacggaagacctttgacaccgagtaccaaaagacgaagaacaacgactgggactacgtggtaacgacggatatatccgagatgggcgccaacttccgcgccgatcgtgtgatcgaccccaggcggtgccttaagccggtgatcctcaaggacgggcccgagagagtcatcctggcaggccccatgcccgtaacggtcgcctctgccgcccagcggcgcgggcggatagggcgcaaccataacaaggagggggaccagtacatctacatggggcaaccgttgaacaacgacgaggaccacgcccactggacggaggccaagatgcttctggacaacattaacacgcctgagggcatcatccccgccttattcgagcccgaacgggagaagtctgcggccatcgacggggagtacagactccggggcgaggcccggaagaccttcgtggagctgatgcgtcgcggggacctcccggtatggctgtcgtacaaagtagccagcgagggctttcagtactccgaccgccggtggtgcttcgatggcgagcgcaacaatcaggtgcttgaggagaacatggacgtggaaatctggaccaaggagggtgagcggaagaagctgcgcccccggtggctggacgcccgtacgtacagcgacccgctcgcgctccgggagttcaaggagtttgccgcgggccgccggtccgtcagcggagacctgatcctggaaatcggtaagctcccgcagcacctgactcagcgcgcccagaacgcgctggacaacttggtgatgttacacaactccgaacagggcggccgggcctaccgccacgcaatggaggagctcccggacaccatcgaaaccctcatgctgctggccctcatcgccgtgctgacgggtggttggaccctgttcttcctctctggccgtggtctaggaaagacctccatcggcctcctctgcgtcatggcgagctctgttcttttgtggatggcgagcgtagagccccactggattgccgcctctatcatattagagttctttttgatggtcctgctaatccccgagcccgaccgccagcggacgccgcaggacaaccagctggcatatgtagtaataggtctcctcttcatgatcctgaccgttgcagccaacgagatgggtctgctcgagaccacaaaaaaggatcttgggataggccacgtcgccgtggagaaccaccaccacgccgcaatgcttgatgtcgacctccatcccgcgagcgcctggaccttgtacgccgtggcgaccacgatcatcacaccaatgatgcgccacaccatcgagaacactactgccaacatatcactgaccgcgatagccaaccaagccgccattctcatggggctggacaaggggtggccgatctcaaagatggacatcggtgtgccgttgctggcactggggtgctactcccaggtgaaccccctgaccttgaccgcggccgttctaatgctggtggcccactatgccatcataggccccggtttgcaggcgaaggccacgcgggaggcccagaaacgcaccgccgccggcatcatgaagaacccaacagtcgatgggatagtggctatcgaccttgaccccgtcgtctacgatgctaagtttgaaaaacagctgggccaaatcatgctccttatcctatgcacatcccaaatcctactgatgcgcacgacctgggccctgtgcgagtcgatcaccctcgccaccgggcccctgacgactttgtgggagggcagccctgggaagttctggaacaccactatcgccgtgagtatggcgaacatcttccgggggagttacctcgccggtgccggtttagctttcagcctgatgaagtccctcgggggcggccgccgaggcacaggcgcccaaggagaaacgcttggcgagaagtggaagcgccagctgaaccaactttctaagtccgagttcaacacctacaagcggtctgggataatggaggtggatcgctcggaagccaaggaaggcctgaagcgcggggagaccacgaagcacgcagtcagcagagggaccgcaaagctgcggtggttcgtggagcgcaacctggtgaaaccggagggaaaggtcatcgacttaggctgcggcagaggcgggtggtcctactactgcgccgggctgaagaaggtgaccgaggttaaggggtacacaaagggcgggcccggccacgaggagcccatccccatggcgacgtacgggtggaatctggtcaagctccattccggcaaggacgtgttcttcatcccgcccgagaagtgtgatacgctgctgtgcgatatcggcgagagcagcccgaaccccaccatcgaagagggccgcaccctccgggtgctcaagatggtcgagccgtggctgagggggaatcagttctgtatcaagatcctcaacccctacatgccctctgtggtggagacactcgagcagatgcagcggaaacacggcggcatgctggtccgtaaccccctcagccgtaactctacccacgagatgtactgggtgagctgcgggaccggcaacatagtgtccgccgtcaacatgaccagccgcatgcttttgaatcggttcaccatggcccacagaaagcctacgtatgagcgcgacgtggacctaggggccgggacccggcacgtggccgtcgaaccggaggtggccaacctggacatcatcggtcagcgcattgagaacattaagcatgaacacaagtccacctggcactacgacgaggacaatccctacaaaacatgggcctaccatggcagctacgaggtcaaaccttcagggtccgcctcatctatggtcaatggggtggtcaagcttctcacgaagccgtgggacgtcatccccatggtcacacagattgccatgaccgacaccacacccttcggacagcagcgggtcttcaaggagaaggtggacacccgcacccccaaagctaagcgagggaccgcgcagatcatggaggtgacggccaagtggctatggggcttcctgtcaaggaacaagaagccgcggatttgcacgcgcgaagagttcacccggaaggtccgatccaacgccgccatcggcgcggtgttcgtggacgagaaccaatggaacagcgcaaaggaggccgttgaggacgagcggttttgggacctagtccaccgcgagcgggaactccacaaacaggggaagtgtgcaacctgcgtgtacaacatgatgggcaagcgcgagaaaaagttaggagaattcggcaaggccaagggttccagagcgatttggtacatgtggcttggggcccgctttctggagttcgaggcactgggctttatgaacgaagaccactggttctcacgcgagaactccctcagcggggtcgagggagagggactgcacaagttgggctacatcctccgcgacatctccaagatcccggggggaaacatgtacgcagacgacacggcgggctgggacacccggattaccgaagacgacctccagaacgaggctaagatcaccgacatcatggagcctgagcacgccctgctcgccaaaagcatcttcaaactgacataccagaacaaggtggtgagagtccagcgccctgccaagaacgggaccgtaatggacgtgatcagccgccgggaccagcgggggagcggccaggtcggcacctacggcctgaacaccttcacgaatatggaggcccagctcattcgacagatggagtccgagggtattttcagcccctcggagctggagacccccaacctggcggggcgggtgctggactggctggagaagcacggggtggagcgcctcaagcggatggcgatcagcggagacgactgcgtcgtcaagcccatagacgaccgcttcgctaccgccctaacggccctgaatgacatggggaaggtgcggaaagacatcccccagtgggagccgtccaagggctggaacgactggcaacaagtccctttttgtagccaccacttccaccagctgatcatgaaggatggccgcgaaatcgtggtgccctgccggaaccaggatgagttggtagggcgcgcgcgggttagccagggcgccgggtggagtctgcgcgagacggcctgtctgggcaagagctatgctcagatgtggcagctcatgtacttccaccggcgcgacctgcggcttgcggccaacgccatttgctccgcagtcccggtggactgggtgccaaccagccgtaccacctggtccatccacgcacaccaccagtggatgacgaccgaggacatgcttagcgtgtggaaccgggtctggattgaggagaacccgtggatggaggacaagacacatatctccagctggggcgacgtaccttacctaggcaagcgcgaggatcagtggtgcggcagtctgatcgggctcaccgcgcgtgccacgtgggccaccaacatacaggtggccatcaaccaagtccgccgcctgataggcaatgagaactacctggactacatgaccagcatgaagcgatttaagaacgagtcggacccggagggggctctctggtga

SEQ ID NO: 24396 - RNA, 9879 nt, synthetic construct
  misc_feature 1..9879: note = derived and/or modified CDS sequence (opt11) from DENV-1__FJ898420__SS-prME
  source 1..9879: mol_type = other RNA
agcgtgacgatgctgctgatgctgatgccgaccgcgctggccttccatctcaccacaaggggaggggagccccacatgatcgtgagcaagcaagagcggggcaagtctctgctgttcaagaccagcgccggggtgaacatgtgtaccctcatcgccatggacctgggagagttatgcgaggacacgatgacgtacaagtgccccagaatcaccgaggccgagcccgacgacgtggattgctggtgcaatgcgaccgacacgtgggtgacctacgggacctgcagccaaacgggcgagcaccgtcgcgacaagaggtccgtcgccttggcaccccacgttggtctggggctggagacgcgaaccgagacctggatgtcttccgaaggtgcctggaagcagatccagcgggtggagacatgggcgctccgccaccccggtttcacggttatcgctttgtttctcgcgcacgccatcggcaccagcataacccagaaggggatcatcttcatcctcctgatgctggtgaccccctccatggccatgcggtgcgtcggcatcgggagccgcgactttgtggagggcctctccggcgcgacgtgggttgacgtcgtgttggagcatgggagctgcgtcaccaccatggccaaggacaagcccaccctggacatcgagctcctgaagacagaagtcaccaaccccgctgtcctccggaagttgtgcatcgaggctaagatctccaacaccaccacggacagtcgctgcccgacacagggcgaggccaccctggttgaagagcaggacgccaacttcgtatgccggagaaccttcgtggaccggggctgggggaacggctgcgggctgttcggcaaggggtccctaatcacgtgcgctaagttcaagtgcgtgaccaaactggaggggaagatcgtccagtacgagaacctgaagtacagcgtcatagtaaccgtccacaccggcgatcaacaccaggtggggaacgagtcaacggagcatggcaccacagcgactatcacgccccaggcccccacgaccgagattcagctaaccgactacggggccctcaccctggactgcagcccccgaacgggcttggactttaacgagatggtcctgctgacgatgaaggaaaaatcctggttggtgcacaaacagtggttcctggacctgcccctcccctggaccagcggcgcaagcacctcccaggagacgtggaaccggcaggacctgctagtgaccttcaagaccgcccacgcgaagaagcaggaggtcgtggtgcttggcagccaggagggcgccatgcacaccgccctgacgggcgccaccgagatccagacctccggcaccacgaccatcttcgccggccacctgaaatgccgcctgaagatggacaagcttaccctgaaggggatgagctacgtcatgtgcaccgggtccttcaaactcgagaaggaggtggcggagacccagcatggcaccgtgctggtccagatcaagtatgagggcaccgacgcgccctgcaagatccccttcagcacccaggacgagaagggggtgacgcagaacggccggctgatcacggccaacccgatcgtgacagataaagagaagcccgtaaacatagaggccgagccgccctttggtgagtcatacatcgtgataggcgcgggcgaaaaggccttaaagctcagttggttcaagaaagggtccagcattgggaaaatgtttgaagctaccgccaggggggcccggagaatggctatcctgggcgacacggcctgggacttcggttccatcggtggtgtgttcaccagcgtcgggaagctggtgcaccaaatcttcggcaccgcatacggggtcctcttctccggcgtcagctggaccatgaagatcggtatcggagttctcctgacgtggctcggcctgaactcccgaagcacctccctgagcatgacctgcatagccgtggggctcgtcaccctgtacctgggcgctatggtgcaggcggactccgggtgcgtgatcaattggaagggccgggaattgaagtgcgggagcggcattttcgttacgaacgaggtgcacacctggacggagcagtataagttccaggccgacagcccgaagcgcctgtccgccgccatcggcaaggcctgggaggagggcgtctgcggcatccggagtgcgacacgcctcgagaacatcatgtggaagcagatctccaacgagctgaaccatatcctcctggagaacgacatgaagctcacagtggtagtgggggacgtcgccggcatcctggggcagggaaagaagatgattcgtccccagcccatggagtacaagtatagctggaagtcctggggcaaggccaagatcatcggggcggacgcgcagaacacgacttttataatcgacggcccgaacaccccggagtgccctgatgaccagcgcgcctggaacatctgggaggtggaggattacgggttcggcatcttcaccacgaacatctggttaaagctgcgggacagctacacccaggtgtgcgaccaccgcctgatgtccgccgccatcaaggacagcaaggcagtccacgcggacatggggtactggatcgagagtgaaaagaacgagacctggaagttagcccgggccagcttcatcgaagtgaagacctgcatctggcccaagtcccacacgctctggagcaacggggtgctggagtccgagatgatcatccccaagatctacggcgggccgatctcacagcacaactaccgccccggctacttcacccagaccgccggaccctggcacctgggccggctcgaactggatttcgacctgtgcgagggcacgacggtcgtcgtagacgagcactgtggcaacaggggcccgtccctcagaaccaccaccgtcaccggaaagatcatccacgagtggtgctgccgcagctgcaccttgccgcctctccggttcagaggcgaggacgggtgctggtacggcatggagatccgccccgtgaaggagaaggaggaaaaccttgtgaaaagtatggtcagcgccggcagcggggaggtggacagcttcagcctggggcttctatgcatatccatcatgatcgaggaggtcatgcgcagccggtggtcccgcaagatgctgatgaccggtaccctcgcggtcttcttcctcctgatcatgggccagctgacatggaacgacctcatccgtctgtgcatcatggtgggggctaacgcctccgaccggatgggcatgggcaccacctatctggccctcatggccacgttcaagatgcgcccgatgttcgccgtgggcctgctgttccggcgcctcacgtctcgggaggtgctgctgctcaccatcggactgagcctagtggcctctgtggagctccccaacagcctggaagagttaggggacggtcttgccatgggcatcatgatcctgaagctgctcaccgacttccagtcccatcagctctgggccactctgctcagccttacgttcatcaagaccaccttctccttgcactatgcgtggaaaaccatggcaatggtcctcagcattgtttccctcttccccctgtgcctcagcacgactagccagaagacaacctggctccccgttctactcgggtcactcggctgcaagccgctgacgatgttcctcatcgccgagaacaagatctgggggaggaaatcatggcccctgaacgagggcatcatggccgtgggaatagtgagcatactgctcagctccctgcttaagaatgacgtccctctcgccggtcccctgatcgcgggcgggatgttaatcgcctgctacgtgatcagcgggagtagcgcagacctctccctggagaaagccgccgaggtgagttgggaggaggaggcggagcactccggggccagccataacatactggtcgaggtgcaggacgacggcacgatgaagattaaggacgaggagcgggacgacaccctcaccatcctcctgaaggccacattactggccgtctccggagtctaccccctgagtatccccgcgacccttttcgtgtggtacttctggcagaagaagaaacagcgctccggcgtgctgtgggacactcccagcccacccgaggtagagcgggcggtgctggacgacggtatataccgcatcatgcagcgggggttactcggccgctcccaggtgggggtcggggtcttccaggagaacgtgttccacaccatgtggcatgtaacgcgaggggccgtgctcatgtaccagggcaagcgcctggaacccagctgggccagtgtcaagaaagacctcatctcgtacggcggcggatggcgtctgcgcgggtcctggaacacgggcgaggaggtccaagtgatagccgttgagcccgggaagaaccccaagaacgtccagaccgcccccggcaccttcaagacccccgagggcgaggtgggggcgatcgccctggatttcaaacccggaacgtcagggtcccccatcgttaatcgggagggcaagatagttggcctctacgggaacggcgtcgtgaccaccagcggaacctacgtcagcgccatcgcccaggcgaaggcctcccaagagggcccgctgcccgagatcgaggacgaagtgttcagaaagcggaacctgacgatcatggatctccaccccgggagcggcaagactcgccggtacctgccggcaatcgtgcgcgaagccataaagcgcaagctgcgtactttaatcctggcccccactcgcgtcgtggcgtccgagatggcggaggccctgaagggaatgccgatccggtaccaaacgaccgccgtcaagagcgaacacaccgggaaggaaattgtcgatcttatgtgccacgcgaccttcactatgcgccttctctctcccgtgcgggtcccgaactacaacatgatcataatggacgaggcgcatttcaccgaccccagctccatcgctgcccgcggttacatttctacccgggtcggcatgggtgaggctgcagcgatcttcatgaccgccacgccgcccgggagcgtggaggcgtttccgcagagcaacgccgtgattcaggacgaggaacgagacatccccgagcggtcatggaacagcggctacgagtggatcactgacttccccggcaagaccgtctggttcgtaccaagtatcaagagcgggaacgatatcgcgaattgcctccgcaagaacggcaagcgggtgatccagttgtcccgcaagacttttgatacggaatatcagaaaaccaagaataacgactgggactacgtcgtgaccaccgacatcagcgaaatgggggccaacttccgggccgaccgtgtgattgacccgaggcgctgtctgaagcccgtcattctcaaggacggccccgagagggtgatcctggccgggcccatgcccgtgacggtcgcctccgctgcgcagcgtcggggccgcataggccgcaaccacaataaggagggggaccagtacatctacatgggacagcccctgaacaatgatgaggaccacgcgcactggaccgaggcgaagatgctcctggacaacatcaacacacccgagggtatcattcccgcccttttcgagccggagcgggaaaagtccgcggccgtggacggcgagtacagattgcgcggggaggcgcgcaagaccttcgtcgagctgatgcggcgaggcgacctgcccgtttggctctcctacaaggtggccagcgagggattccagtacagcgaccgccgctggtgcttcgacggagagcggaacaatcaggtcctggaggagaacatggacgtggagatctggaccaaggagggcgaacgcaagaagctgcggccccgctggctcgacgcgcggacctactctgaccctctggcgcttagagaattcaaggaattcgccgccggccgccgaagcgtgtccggcgacctcatcctggagataggcaagctgccgcagcacctcacgcagcgggcacagaacgcgctcgacaacctggtcatgctccataacagcgagcaaggcgggcgggcataccgacacgccatggaggagttgcccgataccatcgagacgctgatgctcctggccctcatcgccgtgctaaccgggggggtgaccctgttcttcctgtcggggcgcggcctcggcaagaccagcatagggctactgtgcgtgatggcctccagcgtgctcctgtggatggcttccgtggagccccactggatcgctgccagcatcattctggagtttttcctcatggtcctgctgatccccgagccggaccggcagcgcacgccccaagataaccaactggcctacgtggtgatcggcctgctgttcatgatactcacggtcgcggccaacgagatgggtctgctggagaccaccaaaaaggacctcggcatcgggcacgtggccgtggagaaccaccaccacgccgccatgctggacgtcgaccttcaccccgcgtccgcgtggaccctctatgccgtggccacgaccattatcacgccgatgatgagacacactatcgagaacacgactgccaacatcagcttaaccgcgatcgccaaccaggcagccattctgatgggactcgataagggctggcccatatccaagatggacataggggtgccactgctggcgctcggctgctacagccaggtcaatcccctgaccctaacggccgccgtgctcatgcttgtagcccactacgccatcatcggaccgggcctacaggcgaaggccacccgcgaggcccagaaacgaaccgccgccgggatcatgaagaaccccacggtagacggcatcgtggccatcgacctggaccccgtggtctacgacgccaagttcgagaagcagctgggccagattatgctgctcatcttatgcacgagtcaaatcctcctgatgcggaccacctgggccctatgcgaatctatcacgctggccacgggcccgctaaccaccctgtgggagggttctccggggaagttctggaacaccacgatcgccgtgagcatggcgaatatcttcagggggtcctatctggccggcgccggactcgccttcagcctgatgaagtccctgggcgggggccgtcgcggtaccggcgcgcagggtgagaccctgggcgagaagtggaagcggcaactcaaccagctttccaagagcgagttcaacacctacaagagatccggcatcatggaggtggaccggtccgaggcgaaggaagggctcaagcgcggcgagacgaccaagcacgccgtctcccgcgggaccgccaagctgcgctggttcgtggagcggaacctcgtgaagcccgaggggaaggtcatcgacctgggctgcgggcgcggtgggtggagctactactgcgcaggcctcaagaaggtgacagaggtgaaggggtacacgaagggcggccccgggcacgaggagccaattccgatggcgacctacggctggaacctggttaagctgcattccgggaaggatgtctttttcatcccgcccgagaagtgcgacaccctcctgtgcgacatcggcgagagctcccccaacccgaccatcgaggaaggccgtacgctgcgcgtgctcaagatggtggagccgtggctgcgaggcaaccagttctgcataaagatcttaaacccgtacatgccctctgtggtggagacactcgagcaaatgcagcgaaagcacggcggcatgctcgtacggaacccgttgtccaggaatagcacccacgagatgtactgggtctcctgtggcaccgggaacattgtgtcagccgtaaacatgacgtctcgcatgttgctgaaccggttcacgatggctcaccgcaaacctacctacgaacgggacgtggaccttggcaccggcacccgccacgtggccgtcgagcctgaagtggccaacctggacatcattggacagcgcatcgagaacataaagcatgagcataagtctacatggcactacgacgaggacaacccctacaaaacctgggcgtaccacggatcctacgaggtgaagccgagtgggtccgccagcagcatggtcaacggcgtggtcaagctgctgaccaagccgtgggacgttatccccatggtgacccagatcgccatgacggacacaacgcccttcgggcaacagcgcgtcttcaaagaaaaggttgacacacggacaccgaaggccaagcgaggaactgcccagatcatggaggtcaccgcgaggtggttatgggggttcctgtcccgcaacaagaagccccggatttgcacccgcgaggagttcacgcggaaggtgcgcagcaatgccgccatcggggcggtgttcgtggacgagaaccagtggaactccgcaaaggaggcagtcgaggacgagcggttctgggacctcgtgcaccgcgagcgggagttacataagcagggtaagtgcgcgacctgcgtgtacaacatgatggggaagcgcgagaagaagctgggcgagtttgggaaggccaagggcagccgggcaatctggtacatgtggctgggcgcccgcttcctcgaattcgaggccctgggcttcatgaacgaggatcactggttctcccgggaaaacagcttatccggcgtagagggggaaggcctccacaagctagggtatattctgcgcgacattagcaagatacccggcggtaacatgtatgccgacgacaccgcgggttgggacacccgcatcacagaggatgacctccaaaatgaggcgaaaatcaccgacatcatggagccggagcacgcgctgctggccaaggccatctttaagctgacataccagaacaaggtggtcagggtccagcgccccgccaagaacggcaccgtgatggacgttatctcccgccgcgaccagcgggggagcggccaggtcggcacgtacgggcttaatacctttaccaacatggaggcgcagctcatccgccagatggagtccgagggcatcttcagcccctccgaactcgagacgcccaacctcgcggagagagcccttgactggctcgagaagtatggggtggagcggctgaagcggatggccatcagcggcgacgactgtgtggtcaagccgatagacgatcgctttgccacggccctgaccgcgctcaacgacatggggaaggtgcgaaaggacatcccccaatgggaacccagtaagggctggaacgactggcagcaggtgcccttctgctctcaccatttccaccagctgattatgaaagacggccgcgagatcgtcgtaccgtgccggaatcaggacgagctggttgggagggcccgggtctctcagggcgccgggtggagcctccgcgagactgcatgcctgggcaaaagctacgcgcagatgtggcagttgatgtacttccacaagcgggacctcagactggccgcgaacgccatctgctccgccgtgcccgttgactgggtccctacctctcggacaacctggtccatccacgcgcaccatcagtggatgactaccgaggacatgctgagcgtgtggaaccgcgtgtggatcgaggaaaacccctggatggaagacaagactcatatctcctcctgggaggacgtcccgtatctcgggaagcgcgaggaccagtggtgcggatccctaatcggcctaaccgcccgggccacctgggccaccaacatccaggtggccatcaaccaggtgcgccggctcatcggtaacgagaactacctggattacatgaccagcatgaagcggtttaagaacgagtcggatcccgagggggcgctgtggtga

SEQ ID NO: 24397 - RNA, 9879 nt, synthetic construct
  misc_feature 1..9879: note = derived and/or modified CDS sequence (opt11) from DENV-1__FJ898421__SS-prME
  source 1..9879: mol_type = other RNA
agcgtgaccatgctgctcatgctgatgccgaccgccctggcgttccacctcaccacccgcggcggggagccccacatgatcgtctccaaacaggagcggggcaagagcctgctgttcaagacttccgccggggtgaatatgtgcaccctcatcgccatggacctgggcgagctgtgcgaggacacaatgacatacaaatgccccaggatcaccgaggccgagcccgacgacgttgactgttggtgcaacgccaccgacacgtgggtgacctacgggacctgcagccagacaggcgagcacagacgcgacaagcggtccgttgcactcgcgccccacgtggggctggggcttgagacgcgcaccgagacctggatgagctccgagggcgcatggaagcagatccagcgggtcgagacgtgggccctcagacaccccgggttcacggtgatcgcactgttcctggcgcacgccatcgggaccagcatcacccagaaggggattatcttcatcctcctgatgctggtgaccccctccatggccatgcggtgcgtaggcattggcagccgtgactttgtggaggggctctccggcgccacgtgggtggatgtcgtgctggagcacgggagctgcgtgaccaccatggccaaggataaacccactctggacatcgagctcctgaagacagaggtcacgaatcccgcggtgctgcggaagctctgcatcgaggccaagatttccaacaccaccacggacagccgctgcccgacccagggcgaggccaccctggtggaggagcaggacgctaatttcgtctgccggcgcacattcgtggaccggggctggggaaacggctgcgggctgttcggcaaggggtccctcatcacgtgcgccaagttcaaatgcgtgaccaaactggaggggaagattgtacagtacgagaacctgaagtattcagtcatcgtgacagtccacaccggggaccagcatcaggtggggaacgaatccactgagcacggcaccaccgcgaccatcacgccccaggcgcccacgaccgagatccaactcaccgactacggggccctaactctggactgcagcccccgcacgggcctggacttcaacgaaatggtcctgctgaccatgaaagagaagtcctggctcgtgcacaagcagtggttcctagacttgcccctcccctggaccagcggggccagcacgtcccaggaaacgtggaaccggcaagacctcctggtgaccttcaagaccgcccacgcaaagaagcaagaggtcgttgtgctgggcagccaggagggcgccatgcacaccgccctgacgggggccaccgagatccagacatccggaaccacgaccatcttcgccggacacctgaagtgccgtttaaagatggacaagctgaccctaaagggcatgagctacgtaatgtgcaccggatccttcaagttagagaaggaggtggcggagacgcagcacggcaccgtgctggtccagatcaagtatgaggggaccgacgcaccctgcaagatccccttcagcacccaagatgagaagggggtgacacagaacggccggctgatcaccgcaaacccgatcgttaccgacaaggagaagcccgtcaacatcgaggccgagccgcccttcggggagtcctatatcgtgattggcgcgggcgagaaggctctgaagttaagctggttcaagaaggggtcctccatcggcaagatgttcgaggccaccgcccgcggggcccggcgcatggcgatcctgggcgacacggcctgggatttcgggtctatcggcggcgtgttcacgagcgtcgggaagctggtgcaccagatcttcggtaccgcctatggggtcctcttctctggcgtcagctggaccatgaagattgggatcggcgtcctactgacgtggttgggcctgaactcccgctcgacctcccttagcatgacctgcatcgccgtcggtctcgtcaccctgtacctgggagtgatggtgcaggctgactccggatgcgtcatcaactggaagggccgagagctcaagtgcgggtcaggcatcttcgtgacgaacgaggtgcacacttggacggagcagtacaagttccaagcggactcgccaaaacgcctgtccgccgccatcggaaaggcctgggaggaaggggtctgcggcatccggagcgccacccgcctggagaacatcatgtggaagcagatctccaatgagctcaaccacatactgctggagaacgacatgaagttaaccgtggtggtcggggacgtggcgggcatactggggcagggcaagaagatgatccggccccaacccatggagtacaagtatagctggaagtcatggggcaaggccaagatcatcggggccgacgcccagaacacgaccttcattatcgacggcccgaacacgccggagtgtcccgacgaccaacgcgcgtggaacatctgggaagtggaggactacgggttcggcatcttcaccacgaacatctggctgaagttgcgggacagctacacccaggtctgcgaccaccgcctgatgtctgccgccatcaaggacagcaaggcagtacacgccgacatgggctactggatcgagtccgagaagaacgaaacatggaagctggcgagagcaagcttcatcgaagtgaagacctgcatatggcccaagtcacacacgctctggtcaaacggggtcctggagtccgagatgatcatccccaagatctacggcgggccgatcagccagcataactacaggcccggctacttcacccagaccgccgggccctggcacctgggcaaactagagctagacttcgacctgtgcgagggcaccacggtggtggtcgatgagcattgcggaaaccggggcccgtccctccgcaccaccaccgtgacggggaaaatcatccacgaatggtgctgcagaagctgcacccttccgcccctacgcttccggggcgaagacgggtgctggtacggcatggagatccgccctgtgaaggagaaggaggagaacctagtaaagtccatggtgtccgccggcagcggggaggttgactcctttagcctgggcctgctctccatcagcatcatgatcgaggaggtcatgagatcccgctggagccggaaaatgctgatgaccggcaccttggcagtgttcttcctcctcatcatgggtcagctgacgtggaacgacctcatccgcctgtgcatcatggtgggggccaacgcctccgaccgcatggggatgggcaccacctacctggccctcatggcgaccttcaagatgcggccgatgtttgccgtcgggctgctgttccgccggctcacgagcagggaggtgctgcttctcaccatcggcctgtccctggtggcgagcgtggagttaccgaactccctggaggagctgggggacggcctcgccatgggcatcatgatcttaaagctactcaccgacttccagagccaccagctgtgggcaaccctactctccctgacgttcatcaagaccacctttagcctgcactatgcctggaagacaatggcgatggtgttatccatcgtaagcctgtttcccttatgcctcagtacgaccagccagaagacaacgtggctcccggtgctgctcgggtccctggggtgtaagccgcttacgatgttcctaatcgccgagaacaagatatgggggcggaagtcctggcccctgaacgagggaatcatggcagtggggatcgtcagcatcctgctctcgtcactgctgaagaatgacgtgcccctcgccggcccactgatcgccggcggcatgttaatcgcgtgctacgtgatctccggcagctccgctgacttgtcgctggagaaggccgccgaggtctcctgggaggaggaagccgagcacagcggggcttcccacaacatcctggtcgaagtccaggacgatgggaccatgaagatcaaggacgaggagcgcgacgacaccttgacaatcctgctgaaggccacgctcttggccgtcagcggggtgtacccgctgtctatccccgccaccctcttcgtgtggtacttctggcagaagaagaagcaacggagcggcgtcctgtgggacacccccagcccgcctgaggtggagcgcgccgtgcttgatgacggcatctaccgaatcatgcagcgcgggctgctcggcagaagccaggtcggggtgggcgttttccaggagaacgtcttccacaccatgtggcacgttacccgcggggcggtgctgatgtaccagggcaagcggctagagcccagctgggccagcgtcaagaaggacctgatctcctacggggggggctggaggctgcgggggagctggaacacgggcgaggaggtccaggtgatcgccgtcgagcccgggaagaaccccaagaacgtgcagaccgcccccggcacttttaagactcccgagggcgaggtaggagccatagcgctagacttcaagcccggcacatccgggtcgcccatcgtcaaccgagagggcaaaatcgtgggtctctacgggaacggcgtcgtcaccaccagcgggacctacgtgtccgcaatcgcgcaggcgaaggctagccaggaggggccgctgcccgagatcgaggacgaggtcttccgtaagcgcaacctgaccatcatggatctccaccccgggtccggcaagactcggcgctacctgccggccattgtccgggaggccatcaagcgcaagctacgcaccctcatcctggcccccacccgggtggtggccagcgagatggcggaggccctgaagggcatgcccatccgataccagacgaccgccgtgaagtccgagcacaccggcaaggagatcgtggacttgatgtgccacgccaccttcacgatgcggctgctgagcccggtgcgcgtcccgaactacaacatgataatcatggacgaggcccacttcacggacccctccagcatagcggcccggggctacatcagcacccgcgtggggatgggcgaggctgccgccatcttcatgaccgcgacgccgcccgggtccgtggaggccttcccacagtccaacgcagttatccaggacgaggagcgcgacatccccgagcgcagctggaacagtggatacgagtggatcaccgacttccccggcaagaccgtctggttcgtgcctagcatcaagtccggaaacgacattgccaactgcctccggaagaacggcaagcgcgttatccagctgagcagaaaaaccttcgacacggagtatcagaagacaaagaacaacgactgggactacgtggtgaccaccgacatttccgaaatgggagcgaacttcagggccgaccgggtcatcgaccctcgccggtgcctgaagcccgtgatcctcaaggacggccccgagcgcgtaatcctggccgggcccatgcctgtcacggtggccagcgccgcgcagcggcgcggccggatcggacgcaaccacaacaaggagggggaccagtacatctacatgggacagcccctgaacaacgacgaggaccacgcccactggaccgaggccaagatgctcctggacaatatcaacactcccgagggaatcatccccgccctgttcgagccggaacgcgagaagtctgcagcggtcgacggtgagtacagattgcgcggggaggccaggaagacattcgtggaactcatgcgccggggcgacctgcccgtgtggttgagctacaaggtcgccagcgagggcttccagtacagcgaccgccggtggtgcttcgacggggagcgcaacaaccaggtgctggaagagaacatggacgtggagatctggacgaaggagggcgagagaaaaaagctacgcccccggtggctcgacgcccgcacctacagcgatcccctggccctgcgggaattcaaggagttcgcggccgggcgccggtccgtcagcggcgacctcatcctagagattggcaagttaccgcagcacctgacccagcgcgcccagaacgctctggacaatctggtgatgctccacaactccgagcagggcgggcgggcgtaccgccacgccatggaggagctgcccgacactatcgagacgctgatgctcctggccctgatcgccgtgctcaccgggggcgtcaccctgttcttcctctcagggcggggcctaggcaaaacctccatcgggctgctgtgcgtcatggccagctccgtgctcctgtggatggcgagcgtagagccccactggatcgccgcctccattatcctagagttcttcctcatggtactgctaatccccgagccggaccgccagcggacgccccaggacaaccagctagcctacgtggtcatcggcctgctgttcatgatactcactgtggccgcaaacgagatggggctactggagaccaccaagaaggacctcggcatcgggcacgttgcagtcgagaaccaccaccacgccgccatgctggacgtggacctgcaccccgcctcggcatggaccctctacgctgtggccacgaccatcatcaccccgatgatgcgccacaccatcgagaacacgacggccaacatctccctgactgccatagccaaccaagccgccatcctgatgggactcgacaagggctggcccatcagcaaaatggacataggtgtccccctgcttgccctcggctgctattcccaagtcaaccccctgacattgacggcggccgtgctcatgctggtcgcccactacgctattatcggtcccggcctgcaggccaaggcgacccgcgaagcacagaagcggaccgccgccgggatcatgaagaaccccactgtggacggcatcgtggccatcgatctcgacccagtcgtgtatgacgccaaattcgagaagcagctgggtcaaatcatgctgctaatcctgtgcaccagccagattctgctcatgcgcaccacctgggccttatgcgagtccatcactctagccacggggcccctcaccactctgtgggagggcagcccggggaaattctggaacaccacgatcgccgtgtccatggctaacatcttccggggcagctacttggccggcgccgggttggccttcagcttgatgaagtccctgggcgggggccgtcgggggactggcgcccagggcgagaccctcggggagaagtggaagcgccagctgaaccagctgtcaaaatccgagttcaacacctacaagcggagcggcattatggaggttgacaggtccgaggcgaaagaagggctcaagaggggcgagactaccaagcacgccgtgagccgcgggaccgcgaaactgcggtggttcgtggagcgcaaccttgtcaagcccgagggcaaggtgatcgacctgggctgcgggcggggtggctggtcctactactgcgctggactcaagaaggtgaccgaggtcaaggggtacacgaaaggcgggcccgggcacgaggagcccatcccgatggccacctacgggtggaacctagtgaagctgcacagcgggaaggacgtgttcttcatcccgccggagaagtgcgacaccctactgtgcgacatcggcgagtccagccctaacccgaccatcgaagaggggcgcacgctgagggtactcaagatggtggagccctggctgcgcggcaaccagttctgcatcaagatcttaaatccctatatgccctccgtggtcgagacgctcgagcaaatgcagcggaagcacggcggtatgctggtgcgcaatccgctgagtcggaactccacccacgagatgtactgggtgagctgcggaacagggaacatcgtatccgccgtgaacatgacaagccgcatgcttctgaaccgtttcacgatggcccaccgcaagcccacttacgagcgcgacgtggacctggggaccggaacccggcacgtcgccgtggagccggaggtggccaacctcgacatcatcgggcagcgcatcgagaacatcaagcacgagcacaagtccacgtggcactacgacgaagacaacccctacaagacctgggcctaccacggcagttatgaggttaaaccgtccgggagcgcaagctccatggtgaacggcgttgttaaactgctgaccaagccctgggacgtgatccccatggtgacccagatcgcaatgacggacaccacccccttcgggcagcagcgggtgttcaaagaaaaggttgacacccgcaccccgaaggctaagcggggcactgcccagattatggaggtcaccgcacgctggctctggggctttctgagccgtaataagaagccccgcatctgcacccgggaggagttcacgcgcaaagtgcggtccaacgcggccatcggggccgtgttcgtcgacgagaaccagtggaacagcgccaaggaggcggtcgaggacgagcgcttctgggacctggttcaccgggagcgcgagctccacaagcaagggaaatgcgcgacctgcgtctacaacatgatggggaaacgggagaagaagctgggcgaatttggtaaggccaagggctcccgcgccatttggtacatgtggctgggcgcccggttcctcgagttcgaggcgctggggttcatgaacgaggaccattggttcagccgcgagaattcgctgagcggcgtggagggggaaggcctccacaagctgggatacatcctgcgggacatatccaagatccccggcggcaacatgtacgccgacgacaccgccgggtgggacacccgcatcacagaggacgatctccaaaacgaggccaagatcaccgacatcatggaaccggagcacgccctgctggcgaaggccatttttaagctgacctaccagaacaaggtggtccgggtgcagcgacccgccaagaacggcaccgtgatggacgtcatcagcagacgggaccaacgcgggtccggccaggtgggcacgtacgggctgaataccttcaccaatatggaggcccagttaattcggcaaatggagagcgagggcatcttctcccccagcgagctcgaaacgcccaacttggccgagcgcgcgctggactggctcgagaagtacggggtggagcggctgaagcgcatggccatttccggcgacgattgcgtggtgaagccgatcgacgaccggttcgccacggccctgaccgccctcaacgatatggggaaggtccgcaaggacattcctcaatgggagcccagcaagggctggaacgactggcagcaggttcccttctgttcccaccacttccaccagttgataatgaaggacggccgggagatcgttgtgccgtgccgcaaccaggacgaattggtgggacgggcgcgagtgagccagggggctggttggagcctccgggagaccgcctgcctgggcaagtcctacgcccagatgtggcagctcatgtatttccaccgacgggacctccgcttggcggcgaacgccatctgcagcgccgtgccggtcgactgggtgcccacatctcggacgacctggagcatccacgctcaccaccagtggatgaccaccgaggacatgctgtccgtgtggaaccgcgtatggatagaagagaacccctggatggaggacaaaacgcacatctcatcctgggaggacgttccgtacctcggcaagcgcgaggaccagtggtgcggctcgctgatcggcctgaccgcgcgggccacctgggccaccaacatccaggtggccatcaaccaggtcagacggctcatcggcaacgaaaactacctggactacatgacctccatgaagcgctttaagaacgagagcggccccgagggagcgctgtggtga

SEQ ID NO: 24398 - RNA, 9879 nt, synthetic construct
  misc_feature 1..9879: note = derived and/or modified CDS sequence (opt11) from DENV-1__FJ898423__SS-prME
  source 1..9879: mol_type = other RNA
agcgttaccatgttactcatgctgatgcccaccgcccttgccttccatctcaccacgcggggcggggagccccacatgatcgtatccaagcaggagcggggtaagagcctcctgttcaagacctccgccggggtgaacatgtgcactctcatcgccatggacctgggcgagctctgcgaggacaccatgacctataagtgcccccggatcacggaggtggagcccgacgacgtggattgttggtgcaacaccacggacacctgggtgacttatgggacctgcagccagacgggcgaacaccggcgggacaaacgctccgtggccctcgcgccccacgtcggcctggggctggagacgcgggccgagacctggatgagctctgagggcgcgtggaagcaaatccagaaagtggagacctgggccctccgccaccccgggttcaccgtgatcgccctgtttttggcccacgcgataggcacctctataacccagaaggggatcatcttcattctcctgatgctggtcaccccctccatggccatgcgctgcgttggcatcggctcgcgggacttcgtggaggggctgtctggcgccacgtgggtggacgtggtgctggaacacgggagctgcgtcaccaccatggccaaggacaagcccaccctggacatagaactcttaaagacggaggtgaccaaccccgccgtgctacgcaagctctgcatcgaagcgaagatcagtaacacaactacggacagccgatgcccgacccagggcgaggctaccctggtcgaggagcaggacgctaacttcgtatgtcgccggacgttcgtagaccgcggctgggggaatggttgcgggctgttcggcaaggggtccctcatcacctgcgcaaagttcaagtgcgtaaccaagctggagggtaagatcatccagtacgagaacctgaagtactctgtgatcgtgaccgtccacaccggagaccaacaccaggtggggaacgagtccacggagcacggcaccatcgccaccattacgccccaggcgcccacctccgagatccagctcacggactacggggcactgacgctggactgcagcccccgtaccggcctcgacttcaacgagatggtcctgctgaccatgaaggagaaatcctggctcgtgcacaaacagtggttcctggatctgcccctcccctggacgagtggggcctccactagccaggagacctggaaccgtcaggacctgctggtaaccttcaagacggcccacgccaagaagcaggaggtcgtcgtgctcggctcccaggagggcgcgatgcacacggccctgaccggcgccaccgagatccagacaaccgggaccaccacgatcttcgccgggcacctgaagtgccggctcaagatggacaagctgaccctgaagggcatgagctacgtcatgtgcacggggtcgttcaagctcgagaaggaggtggccgagacacagcacgggacggtgctggtccaaatcaagtatgagggtacagacgcgccctgcaagatccccttcagcacccaggacgagaagggggtgacccagaacggccgcctgatcacagccaacccgatcgtgactgataaggagaagccagtcaatatagaggccgagccgcccttcggggagtcctacatcgtgatcggcgccggcgagaaggcgttaaagctcagctggttcaaaaaggggtccagcatcggcaagatgtttgaggccaccgcccgcggggccagacgcatggccatcctgggcgataccgcgtgggacttcggctccatcggtggcgttttcacgtcggtcgggaaactggtgcaccagatcttcggcacggcctacggtgtgctgttttccggcgtcagctggaccatgaagatcgggatcggcgtgctgctgacctggctcggcctgaactcccgcagcacatccctgtccatgacctgcatcgcagtgggtctcattaccctgtacctgggtgtcatggtgcaggccgactccgggtgcgtgattaactggaagggccgcgagctcaaatgcgggtcaggcatcttcgtcactaacgaggtgcacacgtggacagagcaatacaagttccaggccgacagcccgaagcggctgtccgcagccatcgggaaggcctgggaggagggagtgtgcggcatacgcagtgccacccggctggagaacatcatgtggcgacagatctccaacgagctcaatcacatcctgctggagaacgacatgaagttcaccgtcgtggtgggggatgtcgtgggcatactcgcccaggggaagaagatggtgcgaccgcagcctatggagcacaagtacagctggaagtcctggggcaaggcgaagatcatcggcgccgacgttcaaaacaccacgttcatcatcgacgggcccaacaccccggaatgccccgacgatcagcgcgcctggaacatctgggaggtggaggactacggcttcgggatcttcaccaccaatatctggctgaagctgcgggacagctacactcaggtgtgcgaccaccgcctcatgtccgccgcgattaaggacagcaaggccgtccacgccgatatgggatactggatcgaatctgagaagaacgagacctggaagctggcccgggcctccttcatcgaggtaaagacctgcatttggcccaaatcccacaccctgtggagcaatggcgtgctcgagtccgaaatgataatccccaagatctacggaggcccgatcagccagcacaactaccgccccgggtacttcacacagaccgcgggcccctggcacctggggaagctggagctcgacttcgacctttgcgagggcaccaccgttgtggtggacgagcactgcggcaaccggggaccgtctctgcgcacaaccaccgtcaccggcaagatcatccacgagtggtgctgccggagctgcacgctgccgcccctccgcttcaagggggaggatggctgttggtacggcatggagatccggccagtgaaggagaaggaggagaatctggttaagtccatggtaagcgctgggagcggcgaggtggactcattcagcctcgggctgctgtgcatctccattatgatcgaggaggtgatgcgctctcgctggtcccgcaagatgctcatgaccggcaccctggccgttttcttcctgctcatcatggggcagctgacctggaacgatctgattcgatcatgcatcatggtgggcgccaacgccagtgaccgcatggggatgggtacgacctatctcgcgctgatggccaccttcaagatgcgcccgatgtttgccgttggacttctgttccggcgcctgacctcgcgggaggtcctgctcctgactatcggtctgtccctcgtggccagcgtagaacttcccaactccctggaggagctcggcgacggccttgccatgggcatcatgatcctgaaactcttaaccgacttccagagctaccaactctgggcgaccctcctgtccctgactttcatcaagacgacgttcagcctccactacgcctggaagaccatggccatggtgctgagtatcgtgagcctgctcccactgtgcctgtccactacaagccaaaagaccacctggttacccgtcctgctgggctccctcggttgcaagccgctgaccatgttcctgatcgccgagaacaagatctggggccgcaagagctggcccctcaatgaagggatcatggcagttggcatcgtgagcatcctgctgtcaagcctactgaaaaacgacgtccccctggccgggcccctcatcgccggcggcatgctgatcgcgtgctacgtgatctcggggagctccgccgacctgtctctcgagaaggcagccgaggtgagctgggaggaggaggccgagcacagcggcgcctcccacaacattctggtcgaggtgcaggacgacgggacgatgaagatcaaggacgaagagcgggacgacaccctgaccatcctcctgaaggctaccctgttagccgttagcggcgtctacccgctgtccatccccgccaccctgttcgtgtggtatttctggcagaagaagaagcagcggagcggggtgctctgggacacgcccagcccgcccgaggtcgagcgggccgtcctcgacgatgggatctatcgcatcatgcagcggggcctgctgggccgcagccaggtgggcgtcggcgtgtttcaggagaatgtattccatacgatgtggcacgttacccggggcgcagtgctcatgtaccaggggaagcgcttagaaccctcctgggcaagcgtgaagaaggacctgatctcctatggcggcgggtggcggctccaaggcagctggaacaccggggaggaggtacaggtgatcgcggtagagccaggcaagaaccccaagaacgtccagacggcccccgggaccttcaaaacccctgagggggaggtgggagctattgccctggacttcaagcccgggacctcaggcagccccatcgtgaaccgtgagggaaagattgtcggcttatacggcaacggggtggtgacgacaagcggcacctacgtttccgccatcgcccaggccaaggccagccaagaagggccactccccgagatcgaggacgaggttttccgcaagcgcaacctgacgatcatggacctgcaccccggctctgggaagacccgccgctacctcccggccatagtgcgagaggcgatcaagcgtaaactgcggacccttatcctcgcccccacccgcgttgtggccagcgagatggcggaggccctgaagggtatgcctatccgctaccagaccacggcagtgaagtccgagcacaccggccgggagatcgttgaccttatgtgccacgccaccttcaccatgcgcctcctgagccccgtgcgggtgccgaactacaacatgatcatcatggacgaggcccactttacggacccctccagcatcgcggcaagggggtacatctcgacccgggtcggcatgggggaggcggccgccatcttcatgaccgccacgccgcccggcagcgtggaggccttcccacagtccaacgcggtgatccaggatgaggagcgcgatatccctgagcggagctggaactccgggtatgagtggatcactgacttccccgggaagaccgtgtggttcgtgcctagcatcaagtccggcaacgacattgccaactgcctgcgcaagaacgggaagcgggtgattcagctcagccgaaagaccttcgacactgaataccagaagacaaagaacaatgactgggactacgtcgttaccaccgacatctccgagatgggcgccaactttcgggccgaccgagtgatcgacccgcgccgctgccttaagcccgtaatcctgaaagacgggcccgagcgggtgatcctcgcgggccccatgccggtcaccgtggccagcgccgcccagcgccgggggcgcataggccggaaccacaataaagagggcgatcagtacatctacatgggtcagcctttaaacaacgacgaggaccacgcccactggacggaggcgaagatgctgttggacaacatcaacacccccgagggcattatccccgcattgtttgagcctgagcgcgaaaagagcgccgcgatcgacggggagtaccgcctgcggggcgaggcccgcaagaccttcgtggaactcatgcggcgcggcgacctgcccgtctggctgagctacaaggtagcgagcgagggcttccagtactccgaccggcgctggtgtttcgacggcgagcggaacaaccaggtgctggaggagaacatggacgtcgagatttggaccaaggagggggaaaggaagaagctgcggccccgctggctggacgccagaacatacagcgaccctctcgccctgcgcgagttcaaggagttcgccgccggccgccgctccgtgagcggggacctgatcctcgagatcggcaagctaccgcagcacctgacccagcgggcgcagaacgccctcgataacctggtaatgctgcacaactccgagcagggcgggcgcgcctaccggcacgcgatggaggagctccccgacaccatcgagaccctcatgctgctcgcgctgattgccgtcctgacgggcggcgtgaccctcttcttcctgagcggccgcgggctgggtaaaacctccatcggcctcctgtgtgtgatggccagctccgcgctgctctggatggccagcgtcgagccgcactggatcgcggcctccatcatcctggagttcttcctgatggtgctcctgatccccgagcctgaccggcagcgcacgccccaggacaaccagctggcctacgtggtcatcgggctcttattcatgatcctgactgttgccgctaacgagatgggcctcctggagacgaccaagaaggacctggggatcggccacgtcgcggtcgagaaccaccaccacgccaccatgctagacgtggacttgcaccccgcaagcgcctggaccctgtacgccgtcgcgaccaccatcatcaccccgatgatgcggcacaccattgagaacacgaccgccaacatctccctcaccgccatcgccaaccaggccgccatccttatggggctggacaagggctggcccatcagcaagatggacatcggcgtgcctctcctggccctggggtgctactctcaggtgaaccccctcaccctgactgccgccgtgctgatgctcgttgcgcactacgccatcatcggaccggggctgcaggccaaggcgacccgcgaggcccagaagcgcaccgcggccggcatcatgaaaaacccgaccgtagacgggatcgtggccatcgacctggatcccgtcgtgtacgacgccaaattcgagaagcagctcggtcagatcatgctgctgatcctctgcacgagccagatcctgcttatgcggaccacgtgggccctctgcgaatccataacgctggcaacgggtcccctgaccaccctctgggaggggagcccgggcaaattctggaataccacgatagccgtatccatggccaacatcttccgcgggagctacctggccggcgccggcctagcgttcagcctcatgaagtccttggggggtgggcggagagggacgggggcgcagggcgagaccctgggcgagaagtggaagcggcaactcaaccagctgagcaagtccgagttcaacacctacaagcgcagcgggataatggaggtagaccgatccgaggccaaggagggccttcgccgcggggagacgaccaagcacgccgtgagccgcggcaccgcgaagctccgttggttcgtggagcgaaatctggtcaagccggaggggaaggtgatcgacctgggctgcggccgcggcgggtggtcgtactactgcgccggtctgaagaaggtgacggaggtcaaagggtacacaaagggcggccccggacacgaggagcccatccccatggccacctacgggtggaacctagtgaaactgcacagcggcaaagacgtgttcttcatcccgcccgagaaatgcgacactctactctgcgacattggggagtctagccccaacccgacgatcgaggagggccgcaccctgagggtcctgaaaatggtcgagccctggctccgggggaaccagttttgcatcaagatcctgaacccttacatgccctctgtggtcgagaccctggagcacatgcagcggaaacacggaggtatgctggtgcgcaacccgctgagccggaactccacccacgagatgtattgggtgagctgcgggaccggcaacatcgtctccgccgtgaacatgaccagccgcatgttattgaaccgcttcacgatggcccaccgaaagcccacctacgagcgcgacgtggacctgggggcgggcaccagacacgtcgccgtggagcccgaggtggccaacctcgacatcatcggccagcgtatcgagaacatcaagcacgagcacaagtccacctggcactacgacgaggataacccctacaaaacgtgggcctaccatgggtcatacgaggtgaagccctccggcagcgcatcgtccatggtgaacggggtcgtgaagctcctgaccaagccctgggacgtgatcccaatggtcacccagatcgcgatgaccgacacgacccccttcggccagcagcgggtgtttaaagagaaggtggacacacgcaccccaaaggccaagcgaggaacggcccaaatcatggaggtaaccgcccgctggttgtggggcttcctcagccgtaacaagaagccccgcatctgtacccgggaggagttcactcgcaaggtgcggtccaacgctgcgatcggcgccgtgttcgtcgacgagaaccagtggaactccgccaaggaggccgtcgaggacgagcgcttctgggatctggtgcaccgggagcgcgagctgcacaagcaggggaagtgcgcgacgtgcgtctataacatgatgggtaagcgggagaagaagctcggggagttcgggaaggccaaagggtcccgcgccatctggtacatgtggctcggcgcccggttcctggagttcgaggccctcggcttcatgaacgaggaccattggttcagcagggagaactccctgagcggggtggaaggcgaggggctgcacaaactcggctacatcctgcgggacatctccaagatccccggggggaacatgtacgcggacgacacggccggctgggacaccaggattaccgaggatgacctgcagaacgaggccaagatcacggacatcatggagccggagcacgccctcctggccacctcgatattcaaactaacttaccagaacaaggtggtccgcgtgcagcggcctgcgaagaatgggaccgtgatggacgtcattagccgccgggaccagcgcggtagcggccaagtgggcacgtacggacttaacaccttcaccaacatggaggcccaactgatccggcagatggagtctgaggggattttcagccccagtgagctggagaccccgaacttggcggagcgcgtgctggactggctggagaagtacggcgtcgagcgtctcaagcgaatggccatcagcggggacgactgcgtggtgaaaccgattgatgacagattcgccacggctctgacggccctgaacgacatgggcaaggtccgcaaagacatcccccagtgggagccctccaaggggtggaacgactggcagcaggtccccttctgcagccaccacttccaccagttaatcatgaaggacggcagggagatcgtggtcccgtgccgcaaccaggacgagcttgtgggccgggcccgcgtgagccagggggccggatggtcccttcgggagaccgcctgcctcggtaagagctacgcgcagatgtggcagctgatgtacttccaccgccgggacctccgcctggccgcgaacgcgatctgctcagcggtccccgtagattgggtccccaccagccgcacgacctggtccatccacgcgcatcaccagtggatgaccaccgaggacatgctgagcgtgtggaaccgcgtatggatcgaggaaaacccctggatggaggacaagactcacatctcctcctggggcgacgtgccgtacctggggaaacgcgaggaccagtggtgcggctccctcatcggcctgaccgcccgggccacctgggccaccaatatccaggttgcgatcaaccaggtaagacggctgatcgggaacgagaactacctcgactacatgaccagcatgaagcgcttcaagaacgagtccgaccccgagggcgccctgtggtga

SEQ ID NO: 24399 - RNA, 9879 nt, synthetic construct
  misc_feature 1..9879: note = derived and/or modified CDS sequence (opt11) from DENV-1__FJ898424__SS-prME
  source 1..9879: mol_type = other RNA
agcgtgacgatgctgctcatgctgatgcccaccgccctagctttccacttaaccacccggggcggtgagccccacatgatcgtgagcaagcaggagcggggtaagagcctgctgtttaagaccagcaccggggtgaacatgtgcaccctcatcgcaatggacttgggcgagctctgcgaggacaccatgacctacaagtgcccacggattaccgaggtggagcccgacgacgtggactgttggtgcaacactaccgatacctgggtgacctacgggacttgctcgcaaactggcgagcaccggcgcgacaagcggtctgtcgcactcgcgccccacgtgggcctggggctggagactcgggccgagacctggatgagctccgagggtgcctggaagcagatccagaaggtggagacgtgggccctccgtcatcccgggttcacggtgatcgccctgttcctggcccacgccatcggaaccagcattacccaaaaggggatcatcttcatcctcctgatgctggtaactccctccatggcgatgcgctgcgtgggcatcggcagccgggacttcgtggaagggctctccggcgccacctgggtcgatgtagttctggagcacgggtcgtgcgtcaccaccatggccaaggataagcccacgctggacatcgagctcctgaagaccgaggtgaccaaccccgcggtgcttcgcaagctctgtatcgaggccaagatctccaacaccacgaccgacagccggtgccctacccaaggcgaggcgaccctggtcgaggagcaagacgctaacttcgtgtgccgccggactttcgtggaccgcggatgggggaacggctgcgggctgtttggaaagggatccctcattacgtgcgccaagttcaagtgcgtcaccaagctggagggcaagattgtgcagtacgagaacctcaaatacagcgtgatcgtcaccgtgcacaccggcgaccaacaccaggtcggaaacgagagcaccgagcacgggacgaccgccacgatcacgccccaggcccccaccagcgagatacagctcactgactacggcgcgctgaccttggactgcagtccgcggacgggactcgacttcaatgagatggtgctgctgaccatgaaggaaaagtcctggctcgtgcacaaacagtggtttttggacctgcccctcccctggaccagcggcgcctccacctctcaggagacctggaaccgccaggaccttctggtcaccttcaagaccgcccacgccaagaaacaggaggtggtggtcctcggctcccaggaaggcgccatgcacaccgcgctgacgggggccaccgagatccagaccagcggaaccacgaccatattcgccgggcacctgaagtgccgtctcaagatggacaagctgactctgaagggcatgtcctatgtgatgtgcacagggagctttaagcttgagaaggaggttgccgagacgcaacacggtaccgtactggtgcagatcaagtacgaggggaccgacgccccctgcaaaatacccttcagtacccaggacgaaaaaggggtgactcagaacggccgcctgatcaccgcgaacccgatcgtcacagacaaggaaaaacccgtgaacatcgaggccgagccgccatttggagagagctacatcgtgatcggcgccggcgaaaaagccctgaagctcagttggttcaagaaagggagctcaatcgggaagatgttcgaggcgaccgcccgcggggcgcgccggatggcgattctgggcgatacagcctgggacttcgggtcgatcggtggggtctttacctccgtggggaagctggtgcaccagatcttcggcacagcgtacggggtcctgttcagcggcgtgtcctggacaatgaagatcgggatcggcgtcctactcacgtggctcgggctgaactctcgctccaccagcttatccatgacttgcatcgccgtcgggttggtgaccctgtacctgggagtgatggttcaggccgatagcggttgcgtgattaactggaagggccgagagctcaaatgcgggagcggcatcttcgtgacgaacgaagtgcacacctggaccgagcagtacaagttccaggccgactccccgaaacggctgagcgcagcgatcggcaaggcctgggaggagggggtgtgcggaatccgctccgccaccagactagagaacatcatgtggcgccaaatcagcaacgagctcaaccacatcctgttggagaacgacatgaagttcacggtagtcgttggtgacgtcgtcggcatcctcgcccaggggaagaagatgatccggccccaaccgatggagcataagtactcctggaaatcctggggcaaggccaaaatcatcggcgcggacgtgcagaacacgacattcattatcgacgggcctaataccccggagtgccctgacgaccagcgcgcctggaacatctgggaggtggaggactacggtttcgggatcttcacgacgaacatctggcttaaactgcgggactcctacacccaggtgtgcgaccaccgcctcatgtcagccgcaataaaggactccaaagcggtgcacgccgacatgggttactggattgagagcgaaaagaacgagacctggaagctcgcccgcgccagctttatcgaggtgaagacatgcatctggccgaagagccacacgctgtggtcaaacggcgtcctcgagagcgagatgatcatcccaaagatttacgggggcccgatctcccagcacaactaccgccccgggtacttcacccagactgccggcccatggcacctgggtaagctggaactcgacttcgatctgtgtgagggcaccacggtggtagttgacgagcactgcggcaaccgggggcccagtctgcgcaccaccactgtgacgggcaagatcatccacgaatggtgctgtcggagttgtaccctgcctccgctccgcttcaagggggaggatggctgctggtacgggatggaaatccggcccgttaaggagaaagaggagaacctggtcaagagcatggtgtcggccgggtccggcgaggtagacagcttctccctagggctgctatgcatcagcatcatgatcgaggaggttatgcgctcccgctggagccgaaagatgctaatgacaggcaccctggccgtgttcttcctgctcatcatgggccagttaacgtggaatgatttgatccggtcgtgcatcatggtgggggccaatgctagcgaccggatgggaatgggcactacctacctcgcactgatggcaacctttaagatgcggccgatgttcgccgtgggcctgctgttccggcgcttgacctcccgggaggtactgctcttgaccatcgggctgagcctcgtcgcctccgtggagctgcccaactcattagaggagctcggcgacgggttagccatgggcatcatgattctgaaactcttaacagactttcagtcgtaccaactgtgggccactctcctgagcttaacgttcatcaagaccaccttctccctccactacgcgtggaaaaccatggccatggtgctgtccatcgtctccctgctccccctgtgcctgagcacaacctcccagaaaaccacatggttgcccgtgctgctgggctcactcgggtgtaagccgctgacgatgttcctgatcgccgagaacaagatctggggtcgcaagagctggcccctcaacgaggggataatggccgtgggcatcgtatcgatcctgctaagctcactcctgaaaaacgatgtgcccctggctggacccctaattgcgggcggcatgctgatcgcttgctacgtaattagcggatccagcgccgacctgtccctcgagaaagcagcggaagtcagctgggaggaggaggcggaacactccggcgcatcgcacaacatcctggtggaagtgcaggacgacgggaccatgaagatcaaggacgaggagcgggatgataccctgaccatcctactgaaggccaccctgctcgccgtctccggcgtgtacccgctgtcaataccagcgacgctgttcgtgtggtacttctggcagaagaagaagcagaggtctggtgtgctctgggacaccccctcgccgcccgaggtagagcgggctgttctggacgacggcatctaccgcattatgcaacggggcctgctggggcggtcgcaggtcggcgtgggggtgtttcaagagaacgtctttcacacaatgtggcacgtaacccggggtgccgtgctcatgtaccaggggaagagactggagcccagctgggcctctgtcaagaaggacctgatcagctacggcgggggatggaggctccaggggagttggaacacgggtgaagaggttcaggtaatcgccgtcgaacccggaaagaaccccaagaatgtgcagaccgcccccgggaccttcaagactcccgagggtgaggtgggtgcgatcgcgctcgacttcaagcccgggacgtctggctctccgattgtcaaccgcgaagggaaaatcgtgggtctgtacgggaatggggtggtgaccaccagcggcacgtacgtgagcgccatcgctcaggcgaaagcctcccaggaggggccgctgcccgaaatagaggacgaggtgttccggaaacggaacctcacaatcatggacctgcaccccgggagcgggaagactcggcgctacctgccggcgatcgtacgtgaggccatcaagaggaagctgagaaccctgatcctcgcgcccaccagagtggtagcttccgagatggccgaggccctgaagggcatgccgatccgctaccaaacgaccgccgtgaagagcgagcacaccggccgggaaatcgtggacctgatgtgccacgcgacgttcaccatgagactcctgtcccccgtgcgggtcccgaactacaacatgatcataatggacgaggcccactttaccgaccccagctcaatcgccgcgcgcgggtacatctcaaccagggtgggaatgggggaggccgcggctatcttcatgactgccacgccgcccggctccgtggaggccttcccgcagagcaacgcggtaatccaggacgaggagcgggacatccccgagagatcctggaacagcgggtacgagtggatcaccgacttccccggcaagaccgtgtggttcgtgccctccatcaagtcaggcaatgacatcgcgaattgcttacgcaagaacgggaagcgggtcatccagctctctcgcaagaccttcgacacggagtaccagaagaccaagaataacgactgggattacgttgtgacgaccgatatctcagagatgggtgccaacttccgggcggaccgcgtaatcgacccgcggcgctgcctaaagcccgttatactgaaggacgggcccgagagagtcatcctcgccggcccgatgccggtgacggtggcctccgcagcccagcgtcgggggcgcatcggccggaaccataacaaggaaggcgaccagtacatctatatggggcagcccctgaacaacgacgaggaccacgcccactggaccgaagcgaagatgctgctcgacaacattaacacccccgaaggcatcatccccgcgctgtttgagccggagcgcgagaagtccgctgccattgacggggagtataggctgcggggtgaggcccgcaagaccttcgtcgaactcatgcggcgcggggacctgcccgtatggctgtcttacaaggtggcctccgagggcttccagtactcggaccggcgctggtgcttcgatggggagcgaaacaaccaggtcctcgaggagaacatggacgtggagatctggacgaaggagggagagcgcaagaagcttagaccccgctggctggacgcgcggacctactcggaccctctcgctctgcgtgagtttaaggagttcgccgccggtcggaggagcgtttcaggggacctgatcctggagatcggcaaactaccgcagcacctgacgcagcgggcacagaacgcgcttgacaatctggtcatgctgcacaacagcgagcagggcgggcgcgcctaccgccacgccatggaggagcttcccgacactatcgagacacttatgctgctcgcgttaatcgcagtgctgaccggcggggtgacactcttcttcctgtccggcagggggcttggcaagacaagcattggcttactttgcgtcatggcctccagcgccctgctctggatggcctccgtggagccccactggatcgccgcgtcgattatcctggagttcttcctgatggtgttactcatccccgagccggatcggcagcgcacgccccaggacaaccagttggcgtacgtcgtgatcgggctcctgttcatgatactgacggtggccgccaacgagatgggcctcctggagacaaccaagaaagaccttggcattggtcacgtcgccgtggagaaccaccaccacgccaccatgctcgacgtcgatttgcaccccgcctccgcttggaccctgtacgccgtcgccaccaccataatcaccccgatgatgagacacacgatcgagaataccactgcgaacatcagcctcacagccatcgccaaccaggcagcaatcctgatggggctggacaagggctggcccatctccaagatggacattggcgtgccactccttgcgttagggtgctatagccaggtgaaccccctcacgctgaccgccgccgtcctgatgctcgtggcccactacgccatcattggccctgggctgcaggccaaggccacccgggaggcgcagaagcgcaccgccgcgggtatcatgaagaaccccacggtggacgggattgtggccatcgacctggatcccgtagtgtacgacgcgaagttcgagaaacagctcggtcagattatgcttttaatcctctgcacctctcagatcctgcttatgcggacgacctgggccctctgcgagagcatcacgctggccaccggccccctgaccaccctctgggagggaagcccgggaaagttctggaacacgacaatcgcggtatcgatggccaacatcttccgcgggagttacctggccggtgccgggttggccttctccctcatgaagtccttaggtggtgggcgtcgcgggaccggggcgcaaggcgaaaccctgggcgagaagtggaagcggcagctcaaccagctgtcaaagagcgagttcaatacgtacaagcgctccgggatcatggaagtggaccggagcgaagcgaaggagggccttcgccgcggggagaccaccaagcacgctgtgtctcgcggaaccgcaaagctccggtggttcgtcgagaggaatctggtgaagcctgagggaaaagtgatagacctcggctgcggtcgcgggggctggagctactactgcgcggggctgaagaaggtaacggaagttaagggttacactaagggcgggcccggtcacgaggaacccatcccgatggccacctacgggtggaacctcgtgaagctccactccggcaaggacgtcttcttcataccgcccgagaaatgcgataccctgctctgtgacatcggggagagctcccccaacccgacgatagaggaaggccgaacactgcgagtgctgaagatggtggagccctggctgcgcgggaaccagttctgcatcaagatcctgaacccctacatgcccagcgtcgtggagaccctggaacagatgcaacggaagcacggcggcatgctcgtgcgaaacccactctcccggaacagcacccacgagatgtactgggtctcatgcgggaccggcaacatcgtgagcgccgtgaacatgacgtcccgcatgctgttaaaccgcttcaccatggcccatcggaagcccacctacgaacgcgacgtcgacttgggggccggcacccggcacgtggcagtggagcccgaggtcgccaacctggacatcatcggccagcgcatcgagaacatcaagcatgagcacaagagcacctggcattacgatgaggacaatccctacaagacctgggcctaccacgggtcctacgaggtgaagccgagcggcagcgcgtccagcatggtcaacggggtggtgaagctcctgaccaagccctgggatgtcatccccatggtgacccagattgccatgacggataccacccccttcgggcagcagcgggtgtttaaggagaaggtcgacacccgcacgccgaaggcgaagcggggtaccgcccagatcatggaggtgaccgcccgctggctgtggggcttcctctcccggaacaagaaaccccgcatctgcaccagggaggagtttacgaggaaagttcgaagcaacgccgctatcggcgctgtcttcgtggacgaaaaccaatggaactcggctaaggaggccgtggaggacgagcgcttctgggacctcgttcatcgtgaacgcgagttacacaagcaagggaagtgcgcgacctgcgtgtataacatgatgggcaaacgggagaaaaaactcggtgaatttggcaaggcgaaggggagccgcgccatctggtacatgtggctgggcgctcggttcctggagttcgaggccctcggcttcatgaatgaggatcactggttttcgcgcgagaatagcctgtccggggtggagggtgagggactacacaaactgggctacatcctgcgagacattagcaaaatccccgggggcaacatgtacgccgacgataccgcgggctgggacacccgaatcactgaggacgacctgcaaaacgaggccaagatcaccgatatcatggagccggaacacgccctcctggcaacgtccatcttcaagctgacctaccagaacaaggtcgtgcgcgtgcagcggcccgcgcgcaatggtaccgtcatggacgtaatcagccggcgcgaccagcgtggcagtggccaggtcggcacctacggcctaaacaccttcaccaacatggaggcgcagctgatccgccagatggagagcgaggggattttctcccctagcgagctagagacgcccaacctcgccgagcgcgtcctggactggcttgagaagcacggcgtggagcgcttgaaacggatggctatctccggcgacgactgcgtggtgaagccaatcgacgaccgcttcgccaccgccctgtccgctctgaacgacatgggcaaggtgcggaaggacatcccccagtgggagccctctaagggctggaatgactggcagcaggtccccttttgcagtcaccattttcaccagctaatcatgaaagatggccgtgagatcgtcgtcccgtgccgtaaccaggacgagctggtgggccgcgcccgggtcagccagggggctggatggtccctccgcgagaccgcctgcctcggcaaaagctatgcccagatgtggcaactgatgtacttccaccggcgcgacttacggctcgcggccaacgccatctgcagtgccgtccccgtcgactgggtccccacaagccgcaccacctggtccatccacgctcaccatcagtggatgacgactgaggacatgctgagcgtgtggaaccgcgtctggatcgaggaaaacccctggatggaagacaagacgcatatcagcagctggggggacgtcccctacttagggaagagagaggaccagtggtgcggctcgctcatcggcctgaccgcccgcgccacctgggccaccaacatccaggtggccatcaaccaggtgcggcgcctgattgggaacgagaactacctcgactatatgaccagcatgaagcgattcaaaaacgagtcggaccctgaaggcgcgctgtggtga

SEQ ID NO: 24400 - RNA, 9879 nt, synthetic construct
  misc_feature 1..9879: note = derived and/or modified CDS sequence (opt11) from DENV-1__FJ898425__SS-prME
  source 1..9879: mol_type = other RNA
agcgtgaccatgctgctcatgctgatgcccaccgccctggccttccacctcaccacccgaggaggtgagccccacatgatcgtgactaagcaggagcggggcaagtctctgctgttcaagaccagcgccggagtgaacatgtgtaccctcatagcgatggacctgggcgaactgtgcgaggacaccatgacctacaagtgcccccggatcaccgaggcggagcccgacgacgtggattgctggtgcaatgccacggacacctgggtgacctacgggacctgcagccaaaccggcgagcatagacgcgacaaacggagcgtggcgctcgcaccccacgttggcctgggactggagacccgcaccgagacctggatgtctagcgagggcgcctggaaacagatccaaagagtcgagacatgggccctccgccaccccggctttaccgtgatcgccctctttctggcgcacgccatcggcacctccataacccagaaggggatcatcttcattctccttatgctggtgacgccgagcatggccatgcggtgcgtcggtatcgggtcccgcgactttgttgaggggctctcgggcgccacctgggtggacgtcgtgctggagcacgggtcgtgcgtgaccaccatggccaaggacaagcccacgctggacatagagctcctgaagaccgaggtcaccaaccccgcagtactgcggaagctatgcatagaggctaagatctcgaacaccacgacagactcccgctgccccacccaaggcgaggccacattgatggaggagcaggacgccaacttcgtgtgccggcgcaccttcgtcgaccggggctgggggaacggctgcgggttgttcggcaaggggtccctcatcacatgcgccaagttcaagtgcgtgaccaagctggagggcaagatcgtgcagtacgaaaacctgaagtactccgtcatcgtgaccgtgcacacgggcgaccagcaccaggtcgggaacgagagcaccgagcacggcacaaccgcaaccatcacgccacaggcccccaccagtgagatacaacttaccgactacggggccctgacgctggactgcagcccccgcacgggcctcgacttcaatgagatggttctgctgaccatgaaggagaagtcctggctcgtccacaagcagtggttcctagacctaccactcccatggacgagcggggcgagcacctcccaagagacgtggaaccggcaggacctgcttgtgaccttcaagaccgcccatgcgaaaaaacaagaggtggtcgtgctcggcagccaggagggcgccatgcacaccgccctgactggggctaccgagatccagacatccggcaccacgaccatcttcgctgggcacctgaagtgccgcttgaagatggacaagctgaccctgaagggcatgagctacgtgatgtgtactggttcgtttaagctcgagaaggaagtcgcggaaacgcagcacggcaccgtgctggtgcagatcaagtacgagggcaccgatgccccctgtaagatccccttcagtacccaagatgagaagggggtcacgcaaaatggccggctgatcaccgccaacccgatcgtgacagacaaggagaagcccgtgaacattgaggccgagcccccattcggcgagtcctacattgtcatcggtgctggagaaaaggccttaaagctgagttggttcaagaaggggtcctctatcggcaaaatgttcgaggccaccgcccgcggggcccggcgcatggcgatcctgggcgacacggcctgggacttcggctccatcggcggcgtgttcaccagcatcgggaaactcgtgcaccagatcttcggcactgcctacggggtcctcttctccggcgtgagctggaccatgaagatcggcattggtgtgctgctgacgtggttaggcctgaactcacgcagcacatccctgagcatgacctgcatcgccgtggggctcgtgaccctgtacttaggcgtgatggtccaggccgactccgggtgcgtgataaactggaagggcagagagctcaagtgcgggagcggcatctttgtgaccaacgaggtccacacctggaccgaacaatacaagttccaggctgacagcccgaagagattatccgccgccatcggcaaggcctgggaggagggggtatgcggcatccggagcgccacccgcctggagaacatcatgtggaaacagatatcaaacgagcttaaccacatcctgctggagaacgacatgaagttcaccgtcgtcgtgggtgacgtggtcggtatcctcgcgcaaggtaagaagatgattcggccgcaacccatggagcataagtacagctggaaaagctggggcaaggctaagatcattggcgccgacgtacagaacacgacgttcatcatcgacgggcccaacacgccggagtgcccagacgaccagcgcgcatggaatatctgggaggtggaagattacggattcgggatcttcaccacgaatatctggttaaagatgcgggactcctacacgcaggtatgcgaccaccgcctgatgtccgccgccatcaaggactcaaaagcggtgcacgccgatatgggatactggattgagagtgagaagaacgaaacctggaagcttgctcgggcgagcttcatcgaagttaagacctgcatctggcccaagagtcatacgctgtggagcaacggtgtcttagagtccgagatgatcatacccaagatctacgggggcccgatctcccagcacaattatcgccccgggtactttacccagaccgccggcccctggcacctcgggaagctggagctggacttcgacctctgcgagggcaccacggtggtggttgacgagcactgcggaaaccgggggccgtccttgcgcactaccaccgtgacgggtaagatcatccacgagtggtgctgccggagctgcaccctgccacccctgcgattcaagggggaggacggatgctggtacgggatggagatccggcccgttaaggagaaggaggagaacctggtcaaatccatggtgagcgccggcagcggagaggtggactcctttagcctggggctcctgtgcatctccatcatgatagaagaggtcatgcgcagccggtggtcccgcaaaatgctcatgaccggaacattagccgtgttcctgcttctcatcatgggccagctgacttggaacgacctgatccgtctctgtatcatggtaggcgccaacgcgagcgaccgcatggggatgggcaccacctatctggccctgatggctaccttcaaaatgcgaccgatgttcgccgtcgggttgctgtttcggcgcctgacgtcccgcgaggtgctcctgcttaccatcgggctcagcctggttgcctccgtcgagctgcccaacagcctcgaggagctgggcgacgggctggcgatgggcatcatgatcctcaaactgctgacggatttccagtcccaccagctgtgggccaccctcctatccctcacattcatcaagaccaccctgtccctgcactacgcctggaagaccatggccatggtgctctcgatcgtctcacttatacccctgtgcctaagcacgacctcccagaagaccacctggctgcccgtgctgttaggtagcctggggtgcaagccgctgacgatgtttctcatagcggaaaacaagatctggggccgcaagtcctggcccctaaacgaggggataatggcggtgggcgtcgtgagcattctgctcagctccctgctgaagaacgacgtgccactcgccgggcccctgatcgcagggggcatgctgatagcctgctacgtcatcagcgggtccagcgcggacctctcgcttgaaaaggccgccgaggtctcgtgggaggaggaggcagagcactccggcgccagccacaacatcctggtggaggtccaggacgacggaaccatgaagatcaaggacgaggagcgggacgacacactcacgattctgctgaaggcgacactcctggccgtcagtggcgtatatccgctgagtataccggccacgctcttcgtctggtatttctggcagaagaagaaacagcgctccggggtgctgtgggacacccctagcccgcccgaggtggaacgggcagttctggacgacggtatctaccgcatcatgcaacggggcctgctcgggcggtcccaggtgggcgtgggagtctttcaggagaacgtgtttcacaccatgtggcatgtgactcggggcgctgtcctgatgtaccaagggaagcgcctggaacccagctgggcgagtgtgaagaaggacctcatcagctacggcggcgggtggcgtctgcagggttcctggaacactggcgaggaggtgcaggtcatcgccgtggagcccgggaaaaaccccaagaacgtgcagaccgcccccgggacattcaagacccccgagggcgaagtgggcgccatcgccctggacttcaagccagggacgagcggttccccgatcgtcaaccgcgaagggaagatcgtgggcctctacggcaacggcgtcgtgaccacctccgggacatacgtgagcgctatcgcccaggccaaggcctcccaagaaggtccgctgcccgagatcgaggacgaggtctttcggaaacggaacctgacgatcatggacctccaccccggcagcggtaagacccggcgctacctgccggcaatcgtgcgagaagcgatcaagcgcaagctgcggacgctcatcctggcccccaccagagtggtcgccagcgagatggccgaggcgttaaaggggatgccgatccgttaccagacgaccgccgtcaagagcgagcacacaggcaaggagatcgttgacctcatgtgccacgccaccttcacgatgcggctgctatccccagtccgcgtaccgaactacaacatgatcataatggacgaagcccacttcaccgacccctcgtcaatagccgcgcgggggtatataagcaccagagtgggcatgggggaagcagccgccatcttcatgacggcgacgccgcccggttccgtcgaggcgttcccgcagagcaacgctgtgatccaggacgaggagagggacatccccgagcgctcctggaacagcggatacgagtggataaccgacttccccggcaaaaccgtgtggtttgtcccaagcatcaagagtggcaacgacatcgcgaactgcctccggaagaatgggaagcgcgtgatccagctgtcccggaagaccttcgacaccgagtaccagaagaccaagaacaacgactgggactacgtggtcaccacagatatcagcgagatgggtgcgaactttcgcgcggaccgggtgatcgacccccggcggtgcctcaagcccgtgatcctcaaggacgggcccgagcgcgtcattctggccggccccatgccggttacggtcgcttccgccgcccagcggcgcggacggatcggccgcaaccacaacaaggagggagaccaatacatatacatgggtcaacccctgaacaacgacgaggaccacgcgcactggaccgaagccaagatgctcctggacaacatcaacaccccagagggcatcatccccgccctgtttgagccggagcgggagaagtccgcagctattgacggggagtaccgccttcgcggagaggcgaggaagacattcgttgagctgatgcgccgcggggacctgcccgtgtggctctcctacaaagtcgcctcagagggcttccagtacagcgaccgtcggtggtgcttcgacggcgagcgcaacaaccaggtgctcgaggagaacatggacgtggagatttggacgaaggagggggagcggaagaagctgaggccccgatggttagacgcccgaacctactccgaccccttagccctgcgggagtttaaagagttcgccgcaggacgacggagcgtctccggggacctcatcctggagataggcaagctgccgcagcacctcacccaacgcgcccagaatgccctggacaacctggtgatgctccacaacagcgaacagggcgggagggcctatcgccacgcgatggaggagctgcccgataccatcgagaccctgatgctcctggccctgatcgccgtgctaaccggcggggtcaccctgtttttcctctccggccgggggctcgggaagactagcatcggcctgctgtgcgtgatggcctccagcgtactcctgtggatggcatccgtcgagccccactggatcgcggccagcatcatcctggagttcttcttgatggtgctgctgatccccgaaccggaccgccaacggacgccacaggataaccagcttgcgtacgttgttatcgggttgctgttcatgatactcacggttgccgcgaacgagatgggcctgctggagaccacgaagaaggacctcgggatcggtcacgtggctgtcgagaaccaccatcacgccaccatgctggatgtagacctgcaccccgcctccgcctggacgctctatgcggtggcgaccaccattatcactccgatgatgcgacacacgatcgagaataccactgcaaacatcagcctgaccgccatcgccaaccaggccgcgatactgatggggctcgataagggctggcccatctccaagatggacatcggcgtccccttactggctctagggtgctacagccaagtaaaccctctgacgctcaccgccgccgtgctgatgctagtcgcgcactacgccataatcggcccggggctgcaggccaaggcaacccgggaggcccaaaaacgcaccgcggccgggatcatgaaaaacccgacggtggacgggatcgttgccatcgacctcgaccccgtcgtgtatgacgccaagttcgagaagcagctgggtcaaatcatgctcttgatcctttgcacatcccagattttgctcatgcgcaccacctgggccctgtgcgaaagtatcacgctggcgaccggacccctcaccaccctatgggaggggtccccaggcaagttctggaacacgaccatcgccgtgagcatggccaacattttccgggggtcctacctggccggcgccggcctcgccttcagcttgatgaagtccttggggggcggcagacgtggcaccggggcccagggcgaaaccctcggcgagaaatggaagcgccagctaaaccagctttccaaaagcgagttcaacatctataagcggtccgggatcatggaagtggaccgcagcgaggctaaggagggcctcaagcgcggggagacgacccgtcacgccgtgtcccggggcactgcgaagttacgatggttcgtggagcggaacctggtcaagcccgagggtaaggttatagacttaggctgcggccgcggcggctggagctactactgcgccgggcttaagaaggtgaccgaggtcaagggctacacgaagggcggaccaggccacgaggagcccatccccatggctacctacgggtggaatctcgtgaagttacactccgggaaggacgttttctttaccccgcccgagaagtgcgacaccctcctgtgtgacattggcgagagctcccccaacccgacgattgaggagggccggacgctgcgcgtcctcaaaatggtggagccgtggttacgggggaaccagttctgtatcaagatcctgaacccctacatgcccagcgtggtagagactctagagcagatgcagcgtaagcacggcggcatgctggtacgaaacccgctgagccgcaactccacccacgagatgtattgggtgtcctgcgggaccggcaacatcgtctcggccgtaaacatgacctcccgcatgctcctgaacaggttcaccatggcccacagaaagcccacctacgagaaggacgtagacttgggggcgggcaccagacacgtagccgtggagcccgaggtggccaaccttgacattatcggtcagcgtatcgagaacatcaagcacgagcacaagtctacgtggcactacgacgaggacaacccctacaagacctgggcataccacgggtcctacgaggtcaagccgagcggctccgctagcagcatggtgaacggtgtcgtgaagttgctgaccaagccctgggacgtgatccccatggtcacgcagatcgcaatgacggacactacccctttcgggcaacagcgggtgttcaaggagaaagtggacacccgcactccgaaggccaaacggggcaccgtccagatcatggaggttaccgcccgctggctctggggcttcttgtcccggaataagaagccccgcatctgcacgcgggaggagttcacgcgcaaggttcggtccaacgcagccatcggcgcggtcttcgtggacgagaatcagtggaacagtgccaaggaagccgtggaggacgagcgcttctgggacctggtccaaaaggagcgggaattacataagcaggggaagtgcgcgacgtgtgtatacaatatgatgggcaagcgcgagaagaagctgggggagttcggaaaggcgaagggtagccgggccatctggtatatgtggctgggcgcccgtttcctcgagttcgaagctctgggcttcatgaacgaagatcactggttctcccgggagaacagcctgagtggggttgagggcgaggggttacacaaactgggctacatcttacgcgacatctcaaagatccccgggggcaacatgtacgccgatgacaccgcgggctgggacacacgtatcacggaggacgacttacaaaacgaggccaagatcactgacatcatggagccggagcacgccctgctggccaccagcatcttcaagctcacgtatcagaacaaggtagtgcgcgtgcagcggcccgccaaaaacgggacggtcatggacgtgatcagccgccgggatcagcggggctcaggccaagtgggcacctacgggctgaacaccttcaccaatatggaggcgcagttaatccgccagatggaaagcgaggggatcttcctcccctcggagctggaaacgccgaacctggccgagcgggtccttgactggctggagaagtatggtgtggaacgccttaagcggatggccatcagcggggacgattgcgtggtcaagccgatcgacgaccggttcgccaccgccctaaccgcgcttaacgacatggggaaagtgcggaaggacatcccccaatgggagccatccaaggggtggaacgactggcagcaggtccccttctgcagccaccatttccaccagctgatcatgaaggatggcagagagatcgtggtcccctgcagaaaccaggacgaactggtgggccgcgcacgggtctcgcagggggccggctggagcctgcgcgagaccgcctgcttaggcaagagctacgcccagatgtggcagctcatgtatttccacagacgcgacctgcggctggcggccaatgccatctgttccgctgtgcccgtggactgggtccccacgagccgtaccacatggtccatacatgcgcaccaccagtggatgaccaccgaggacatgttgtccgtttggaaccgtgtgtggattgaagagaacccctggatggaggacaagacgcacgtctccagctggggcgacgtgccgtacctaggcaagcgcgaagaccagtggtgcggctccctaatcggcttaaccgcccgggccacctgggccagcaacatccaggtggcaatcaaccaggtccgccgcctaatcgggaacgagaactacctggactacatgacctccatgaagcggttcaagaacgagggcgaccccgagggggcgctctggtga

SEQ ID NO: 24401 - RNA, 9879 nt, synthetic construct
  misc_feature 1..9879: note = derived and/or modified CDS sequence (opt11) from DENV-1__FJ898426__SS-prME
  source 1..9879: mol_type = other RNA
agcgtgaccatgcttctcatgctgatgccgaccgcgctggccttccacctcaccaccagaggcggcgagcctcacatgatcgtgtccaagcaggagcggggcaagagtctgctgttcaagaccagcgccggggtgaacatgtgcaccctcatcgccatggaccttggcgagttctgcgaggataccatgacgtacaagtgtccaaggatcactgaagctgagcccgacgacgtagactgctggtgcaatgccaccgacacctgggtgacatacgggacctgcagccagaccggcgagcaccgaagagacaaacgttccgtggcactggcgccccacgtgggcttagggctggagacgcgcaccgagacctggatgtcttcagagggtgcctggaagcagatccagcgcgtggagacatgggccctacgccatcccgggtttacggtgatagccctcttcctagcgcacgctataggcactagcatcacccagaagggaatcatcttcatcctgctcatgctggtgaccccctccatggccatgcggtgcgtcggcatcggcagccgcgacttcgtggagggactgtccggcgccacgtgggtggacgtcgtactagagcacgggagctgcgtgaccaccatggccaaggataagcccacgctggacatagagcttctcaaaacggaggtcgctaacccagccgtgctgcgcaagctctgcatcgaggcgaagatcagtaacaccaccacggattcccgctgccccactcagggcgaggcgaccctcgtagaggaacaggacgccaatttcgtctgccggaggaccttcgtggaccggggctggggaaacggctgcgggttgttcgggaagggatccctcatcacgtgcgccaagttcaagtgcgttacgaaactcgagggtaagatagtacagtacgaaaacttaaaatacagcgtgatcgtgaccgtccacacaggcgaccaacatcaggtgggcaatgagtccaccgaacatggcacgactgccaccataacgccccaagctcccagcaccgaaatccagctgacagactacggggctctcaccctagactgcagccctcggaccggcctggacttcaacgagatggtccttctgacgatgaaggagaaatcctggctggtgcacaagcagtggttcctagacctgccgctgccctggacgagtggggcctccacgtcacaggagacctggaaccggaaggacctcctggtgaccttcaagacggcgcacgccaagaagcaagaggtcgtagtgctgggctcccaggaaggcgccatgcataccgccttgaccggcgcgaccgagatccagacgagcgggactaccactatcttcgcgggtcacctgaagtgccgcctgaagatggacaagctcacactgaaaggcatgtcgtacgtcatgtgcactggcagctttaagctggagaaggaggtggccgagacccagcacggaactgtgctcgtccagattaagtacgagggcacggacgcgccctgcaagattcccttttccacgcaagacgaaaagggggtaacgcaaaacggccggctgatcacggccaacccaatcgtgaccgacaaggagaagccagtcaatatcgaggcggagccgcccttcggggagtcatacatcgtgatcggcgccggcgaaaaggccctgaagctgtcctggttcaaaaaggggagctccattggcaagatgttcgaggccacagcccgcggggcgcggcgcatggcaatcctcggcgacactgcctgggatttcgggagcatcgggggcgtgttcacctccgtcggcaagttagtacaccaaatcttcggcacggcttacggggtgctgttttcgggcgtctcctggacaatgaaaatagggatcggcgtactcctgacctggttaggcctcaacagccgttccaccagccttagtatgacctgcatcgctgtggggctggtcactctctatctgggcgtgatggtgcaggcggacagcggctgcgtcataaactggaagggacgggagctcaagtgcgggagcgggattttcgtgactaacgaagtgcacacctggaccgagcagtataagttccaggccgactccccgaagcgtctcagcgccgccatcggcaaggcgtgggaggaaggggtttgcggcatcaggagcgcgacccgcctggagaacataatgtggaagcagataagcaacgagcttaatcacatcctcctggagaatgatatgaaattcaccgtggtggtcggggatgtggcaggcatacttgcccaggggaagaagatgattcggccccagcccatggagtacaagtacagctggaaaagctggggcaaggccaagataatcggcgcggacgtccagaacaccaccttcatcatcgatggacccaacactccggagtgccccgacgaccagcgcgcctggaatatctgggaagttgaggactacggtttcgggatattcaccacgaacatttggctcaagctgcgggactcctacacccaggtgtgcgaccatcgactgatgtcggccgccatcaaagattccaaggcggtacatgcggacatgggctactggatcgagagcgagaagaatgagacctggaagctcgcccgggccagctttatcgaagtcaagacctgcatctggcccaagagccacaccttatggagtaacggcgtgctcgaaagcgagatgatcatacccaagatctacggaggcccgatcagtcagcacaactaccgccccgggtatttcacccaaacggccggcccctggcacctggggaagctggagctggacttcgacctctgcgagggcaccacggtcgtggtagatgagcactgcggcaaccgggggccgtccctccggacaacaaccgtgacgggcaagattatccacgagtggtgctgcagatcctgtacactaccgcccctgcgcttcaagggggaggacggctgctggtacggaatggagatccggcccgtcaaagagaaggaggagaacctggtcaagtcaatggtcagcgccggctccggcgaggtcgacagtttctccctgggcctgctgtgtatcagcattatgatcgaggaagtgatgcgctcacggtggtcacgcaagatgctgatgacgggcaccctcgcggtgtttttcctgctgataatgggtcagctcacctggaacgacctgatccggctgtgcatcatggtcggcgccaacgcctccgaccgcatggggatggggaccacgtacctcgccctgatggccacctttaagatgcgccccatgttcgcggtggggttgttgttccggagactgaccagccgggaggtgctgctcctgaccatcgggctgtcactcgtcgccagcgtagagctgccaaactccctagaagaactcggcgacggtttagccatgggcatcatgatcctgaagttattgacggacttccaatctcaccagctgtgggccaccctcctgtccctgaccttcataaaaaccacgttcagcctacactacgcgtggaagaccatggccatggttctgtccatcgtgagcttattccccctctgcctgtcgaccacctctcagaagaccacctggcttcccgtgctcctgggctccctggggtgcaagccgctcaccatgttcctgatagccgagaacaaaatctggggccgcaagtcctggccccttaacgagggcatcatggccgtcggcatcgtgagcatcctcctgagcagcctgctcaagaatgacgtgcccctggcggggccactgattgccggcgggatgctcatagcctgctacgttataagtggcagcagcgccgacctgagcctggaaaaagccgccgaggtgtcctgggaagaggaggcggagcacagcggcgcctcccataacatcctcgttgaggtccaagacgacgggactatgaagattaaggacgaggaaagagatgacacgctgacaatcctgctcaaggcaaccctgctggccgttagcggggtgtacccgctgtccatcccggcaaccctattcgtctggtacttttggcagaagaagaagcagcgcagcggggtactgtgggacacccctagcccgccagaggtcgagcgggcagtcctcgatgacggcatctaccgcatcatgcagcggggccttctcgggaggtcacaggtgggcgtgggggtcttccaagagaacgtgttccacactatgtggcacgtgactcggggtgccgttctgatgtatcaggggaagcgccttgagcccagttgggcctccgtgaagaaggacctgatcagctatggaggtgggtggcgcctgcaaggaagctggaacacgggggaggaggtgcaggtcatcgccgtggagccgggcaagaatcccaagaacgtgcaaaccgcgcccgggacgttcaagacttccgaaggagaagtaggcgcgatcgccctcgacttcaaacccgggacaagcggttctcccattgttaatcgcgaggggaagatagtgggtctgtacggcaacggggtcgtgactacatccgggacctatgtaagcgccatcgcccaggcgaaagcctcccaggaggggcccctgccggagatcgaggatgaagtcttccgaaagcgcaacctcaccatcatggaccttcacccagggagcggaaagacccgccgatatctgcccgccatcgtacgggaggccataaagcgcaaactcaggacgctgatcctggcaccgacccgggtagttgcgtccgaaatggctgaggccttgaagggcatgcccattcgctaccaaaccaccgccgtgaaaagcgaacacacgggcaaggagatcgtggacctgatgtgccacgcaaccttcaccatgcgcctattatccccggtgcgagtgccgaactacaacatgatcattatggatgaagcgcactttaccgacccgagctccatcgccgcacgagggtacattagcactcgcgtaggcatgggggaggcagccgctattttcatgaccgccacgccgcctggctccgtggaggccttcccccagagcaacgccgtgatccaggatgaggagcgggacatcccggagcgctcctggaactctgggtacgagtggatcaccgacttccccgggaagacggtgtggttcgtcccctccatcaagagcggaaatgacatcgctaactgcctgagaaagaacgggaagcgcgtgattcagctatcccggaagaccttcgacaccgaataccagaagaccaagaacaacgactgggattacgtggtcacgaccgacatcagcgagatgggtgccaatttcagggccgaccgggtgatcgaccctcgacgttgcctcaagccggtgatcttgaaagacggacccgagcgcgtcatcctggctgggcccatgcccgtgaccgtggcttccgcggcccagcgccgcgggcgtatcggccgcaaccacaacaaagaaggcgatcagtatatctacatggggcagccattaaacaacgacgaggaccatgcccactggaccgaggcaaagatgctgctggacaacatcaatacgcccgaaggcatcatccccgccctcttcgagcccgagcgggagaagtccgctgcgattgacggggagtaccgcctacgcggcgaagcgcggaagacgttcgtggagctgatgcgccgcggggacctcccggtgtggctgagctacaaggtcgcctccgagggctttcagtacagcgacaggcggtggtgcttcgacggggaacgcaacaatcaggtgctggaagagaacatggacgtggagatctggaccaaggaaggggagcggaagaagctgcggccccggtggttagacgcgcgtacctactccgatccgctggcgctccgggagttcaaagagtttgccgcgggccgccgcagcgtcagtggcgatctgatcctggaaatcggcaaacttccccagcatctgacgcagcgcgcacagaacgctctggacaacctggtgatgctccacaacagcgagcagggcgggcgagcctaccgccacgccatggaggaactgccggataccatcgagacgctcatgctgttagcactcatagccgtgctcaccggaggggtcacgcttttcttcttgtccggccgggggctgggaaagaccagcatcggccttctctgtgtgatggcgtcttcagtgcttctgtggatggcctccgtcgagccccactggatagccgcaagcataatactcgagttcttcttaatggtgctgctcattcccgagccagaccgccagcggaccccgcaggacaaccagctggcgtacgttgttatcgggctcctgttcatgatcctgaccgtggcggccaacgaaatgggcctgctcgagaccacgaagaaggatctggggatcggccatgtggccgtcgagaaccaccaccatgccgccatgctggacgtcgacctccaccccgcgtccgcatggaccttgtacgctgtagccaccaccattatcacgcccatgatgcgccacactatcgagaacaccacggctaacatcagcctcacggcgatcgccaaccaggcggccatattaatggggctggacaagggttggccgatctccaaaatggacatcggtgtacccctgctcgcgctggggtgctacagccaggtgaacccgctgaccctcaccgccgccgtgctgatgctggtcgcccactacgccatcatcggcccagggctccaggctaaggccacccgggaggcccagaaacgcacggccgcaggaatcatgaaaaacccgacggtggacgggatcgtggcaattgacctggaccccgtcgtatacgatgcaaaattcgagaagcagcttggacagattatgctcctgattctatgtacttcccagatcctcttaatgcgcaccacgtgggccctgtgcgagtcgatcacgctcgccacggggccgctgaccacgctatgggaagggtcccccggtaagttttggaacactaccatagcggtgagcatggcgaacatctttagaggaagctatctcgccggcgccggcctggcattttccctgatgaagtccctcggtggcggtcgccgcggcacgggggcgcagggcgagacgctgggggagaagtggaagcgccagcttaaccaattatccaaatctgagttcaatacgtacaagcgaagtgggatcatggaggtcgatcgcagcgaggccaaggagggcctcaagcgcggggagaccaccaagcacgccgtgtcccgcggcacggccaagctacgatggttcgtggaacgcaatctagtgaagcccgaagggaaggtcatcgaccttggctgcggcagaggcgggtggtcatattactgcgcaggacttaaaaaggtgaccgaggtgaaaggttacacgaaaggcgggcccggccacgaggagcctatcccaatggcgacctacgggtggaacctggtgaaactccacagcggcaaagatgtcttcttcatcccacccgagaagtgtgacacgctgctgtgcgacataggggaaagcagtcccaaccccaccatcgaggagggccgcaccctccgggttcttaagatggtggagccgtggctgcgggggaaccaattctgcatcaagatcctcaacccatacatgccctcagtggtcgaaactctggagcaaatgcaacggcgccatggcggtatgcttgttcggaatccactctcgcgcaacagcactcatgagatgtactgggttagctgcgggaccggcaatatcgtcagcgctgtaaacatgacgtccaggatgttgctaaaccgcttcaccatggcccaccgcaagccgacctacgagcgggacgtggacctcggggcgggcacgcgccacgtcgctgtggagcccgaagtggcgaacttggacatcatcggccaacggatcgaaaacatcaagcacgaacacaagagcacttggcactacgacgaggacaacccctacaagacctgggcgtaccacgggtcctacgaggtcaaacccagcgggtccgcctccagcatggtgaatggagtcgtgaagctgctcaccaaaccgtgggacgtgataccgatggtcacgcagatcgccatgaccgatacaacccctttcggccagcagcgagtgttcaaggaaaaggtggacacgcggaccccaaaggccaagcgcgggaccgcgcagatcatggaggtaaccgccaagtggctgtggggcttcctgtcacggaataagaagccgcgcatctgtacgagagaggagttcacccgcaaggtaaggagcaacgctgccatcggcgcggtgtttgtagacgagaaccagtggaatagcgccaaggaggccgtggaggacgagagattttgggatctcgtgcacagagagagagagctgcacaagcaagggaagtgcgcgacctgcgtatacaacatgatggggaagcgggagaagaaacttggagagttcggcaaggccaaggggagccgagcaatatggtacatgtggctcggcgcgcggtttctggagtttgaggcgctgggattcatgaacgaggaccactggttctcccgcgagaacagcctctccggggtggagggtgagggtctgcacaaactgggctacatcctccgtgacatcagcaaaatccccgggggaaatatgtacgccgacgacaccgccggctgggacacgcgcatcaccgaagacgacctgcagaacgaggcgaagataaccgacatcatggagccagagcacgccctgctcgcgaaatcgatctttaagctgacataccagaataaggtggtccgggtgcagcgcccggccaagaacggtacagtaatggacgtcatcagtcgcagagaccagcgcggctcgggccaggtcggcacgtatggcctaaacaccttcacgaatatggaggcccaactcatccgccagatggagagtgaaggtatcttcagccccagcgagcttgagacgcccaacctcgctggccgagtgctcgactggcttgagaagcacggggtcgagcggctaaaacgcatggcaatttccggcgacgactgtgtggtcaagcccattgacgaccggttcgcgaccgcgctcaccgccctgaacgacatggggaaggtccgtaaggacattccgcagtgggagcccagcaagggttggaatgactggcaacaggtgcccttctgcagccaccacttccatcagttaataatgaaggacggtcgggaaattgtggtcccctgccgcaaccaggatgagctagtgggccgcgcgcgtgtttcacagggcgccgggtggagcctgcgggaaactgcctgcctggggaaatcctatgcacagatgtggcagctcatgtactttcataggcgggacctgcgcttggcagctaacgcgatctgcagcgccgtaccggtggactgggtgcccacgagccggaccacctggagcattcacgcccatcatcagtggatgacgacggaagacatgctctccgtatggaaccgcgtgtggattgaggagaacccctggatggaggacaagacccacatcagctcatggggcgacgtaccctatttgggcaagagagaggaccagtggtgcggcagcctgatcgggctcaccgcgcgcgccacgtgggccacgaacattcaggtcgccattaaccaagtgcgcaggctgataggcaacgagaactacctggactacatgaccagcatgaagcgcttcaagaacgagagcgacccggagggggccctctggtga

SEQ ID NO: 24402 - RNA, 9879 nt, synthetic construct
  misc_feature 1..9879: note = derived and/or modified CDS sequence (opt11) from DENV-1__GQ199856__SS-prME
  source 1..9879: mol_type = other RNA
agcgtgacgatgttgctcatgctgatgcccaccgctctggcctttcacttaacgaccaggggcggggaaccccatatgatcgtatcgaaacaagagcgcggcaaatcgttgctgttcaagaccagcgcgggggtgaacatgtgcaccctcgtggccatggacctgggtgagttttgcgaagacacgatgacctacaaatgcccccgcataactgaggctgagcccgacgacgtggactgttggtgcaacgccaccgatacctgggtcacttacggtacttgctcgcaaaccggggagcatcgaagagataagcggtcggtggccctggcgccccacgtgggccttggtcttgagactcgtaccgagacttggatgagctccgagggtgcatggaagcagatccagcgggtggaaacctgggcactgcgccaccccgggttcacggtgatcgccctattcctcgcgcatgccataggcaccagcatcacgcaaaaagggatcatattcatcctactcatgcttgtcacaccctcgatggccatgcgttgcgtgggaatcggctcaagggatttcgtggaggggctgtccggtgccacctgggtcgacgtagttttggagcacgggtcatgtgtcacgaccatggccaaggataagccaaccctggacatcgagttactcaagacggaggtgacaaatcctgcagtgctgagaaagctctgcattgaggcgaaaatatccaacaccaccacggacagccgctgcccgacccaaggcgaggccacgttagtcgaggagcaggacgctaacttcgtgtgccggcgaactttcgttgaccgggggtggggtaacggctgcggcttgtttggaaagggctccctgataacttgtgccaaattcaagtgcgtcaccaaactggaggggaagacagtgcagtacgaaaacctcaagtacagcgtcatcgtcaccgtgcatactggcgaccagcaccaggtcgggaatgagtctaccgagcacggcactacggcaaccattacgccccaagccccgtccaccgagatacagttgacggattacggcgccctgaccttggactgctcaccccgcaccggcttagacttcaacgagatggtgttactgaccatgaaggagaagtcctggctggtgcacaagcagtggtttttagatctacctctgccctggaccagcggggcgtctaccagtcaggagacgtggaaccggaaagatctcctggtgacattcaaaaccgctcacgcgaagaagcaggaggtagtggtgctggggtcgcaggagggagccatgcacaccgccttgacgggggccaccgagatccagacctcggggactacgaccatattcgccgggcacctgaaatgtcgtctgaagatggacaagctcacactgaagggcatgtcctatgttatgtgcaccggttcgttcaagctggagaaggaggtggcggaaacccagcatggcaccgtgctcgtacagatcaagtatgaggggaccgacgccccctgcaaaatacccttctccacccaggacgagaaaggggtcacgcaaaacggccggttgatcaccgccaatcctattgtcaccgacaaggagaagcctgttaacattgaggcagagccgcccttcggcgagagctacatcgtgatcggcgcaggcgaaaaggcactgaagctatcctggttcaagaaggggtcaagcattggcaaaatgttcgaagccaccgcacgcggggcgagacgtatggcgatcctaggagacacggcctgggatttcgggagcatcgggggcgtcttcacgtccgtggggaagctggtacatcagatcttcggcaccgcgtacggcgtccttttcagcggcgtgtcgtggacgatgaaaatagggatcggggtgctcctgacgtggttgggcctcaacagccgctccacaagcctgtccatgacctgcatcgccgtggggctagtgacgctctacctgggcgtgatggtccaagcggacagcgggtgcgtaatcaattggaagggccgggagctgaagtgtgggtcggggatcttcgttacgaacgaggtacacacttggactgaacagtataagttccaagcggactccccgaagcgcctcagcgcagccatcggtaaggcctgggaggagggggtgtgcggcatacgatccgccacccgcttagagaacatcatgtggaagcagatctcgaacgagttgaatcacattctcctggaaaacgacatgaagttcaccgtggtcgtcggggacgtggccgggatcttagcgcaagggaagaagatgatccggccgcagcccatggagtacaaatacagctggaagagttggggcaaagccaagattataggagccgacgtccagaacactaccttcattatcgacgggccgaacaccccggagtgccctgacgatcagcgcgcctggaacatctgggaagtcgaggattatggattcggtatcttcacgacgaacatctggctcaaactgagagattcttatacccaggtgtgcgaccaccgcttaatgagcgccgctatcaaggattccaaagccgtccacgcggacatggggtactggatagaaagcgagaagaatgagacctggaagctcgcgcgggcctcctttatcgaagtgaagacgtgcatctggccaaagagccacacgctgtggtctaacggcgtattagagagtgaaatgatcatacccaagatctacggtggaccgatatcccaacacaactaccgacccggctatttcacccaaaccgccggcccctggcacctcggaaagttagagctggactttgatctctgcgagggcaccactgtcgtggtggacgagcactgcggaaaccgggggccgagcttgcgcaccaccaccgtcacgggcaaaatcattcatgaatggtgttgcagaagctgcaccctgccgcccctgcgcttcaaaggagaggacggctgctggtacggaatggagatccggccagtgaaagagaaggaggagaacctggtgaagtcaatggtcagcgccggctctggagaggtggacagcttctcgctgggcctcctgtgcatcagcatcatgatagaggaggtgatgcgcagtcggtggagccgaaagatgcttatgacgggcacattagcggtcttctttctgctgatcatcgggcagctcacctggaatgacttaatacggctgtgcataatggtgggtgccaatgcttcggaccgcatgggaatgggcaccacctatctggccctgatggccaccttcaagatgcgcccgatgttcgccgtgggcctcctgttccggagactaacgagccgggaagtccttttgcttaccattgggctgtccctcgtggctagcgtcgaactgcccaactccctggaggagctcggcgacgggctggccatgggcattatgatcctgaagctcctgaccgatttccagagccaccagctgtgggccacgctcctgtcccttacattcatcaagactacattctcactccactacgcttggaaaactatggcgatggtgctttccatagtaagcctgttccccctctgtttgagtacaacctcccagaaaacgacttggttacctgtcctactgggatccttgggatgcaagccgctcaccatgtttctaatagcggaaaacaagatctggggccgccgtagctggccgctaaacgagggtatcatggccgttggcatagtatccatcctgctgtccagtctgctcaagaatgacgtccctctcgctggacctctgattgccggcggcatgctcatagcgtgctacgtcatctccgggtcatccgccgatctgagcctggagaaggccgcggaggtgagttgggaggaggaagccgagcacagcggcgcgagccacaacatccttgtcgaggttcaagatgacgggacgatgaagataaaggatgaggaacgggatgacaccttgactatcttactgaaggctaccctgctggccgtgagcggggtatatccgctctccatccccgccacgctgtttgtctggtatttctggcagaagaagaagcagcggagcggggtgctgtgggatacacccagcccgccagaggtggagcgcgccgtactcgacgacggcatctaccggattatgcagcgcggcctgctcgggcggagccaggtcggagtcggcgtgttccaggagaacgttttccacacaatgtggcacgtgacccgcggcgcagttttgatgtaccaggggaaacggctcgagcctagttgggcgtcagtgaagaaggacctcatcagctacggcggagggtggcgcttacagggcagctggaacacgggagaggaggtccaggttatcgccgtcgagcccggtaagaaccccaaaaacgtccagaccgcgccagggaccttcaagacctccgaaggcgaggtaggagctatcgcgctcgacttcaagcccgggacgagcggctcacccatcgtgaaccgggaagggaaaatcgtcggcctgtacggcaatggtgtggtaaccaccagtggcacgtatgtgagcgcaatcgcgcaagccaaggcgagccaggaagggcccctgccagagatcgaggacgaggtgttccgcaagcggaacttaaccattatggacctgcacccaggcagcgggaagacccgacggtacctgcccgccatcgtccgggaggccatcaagcggaagctcagaacactaattttggccccgacccgcgtcgtggccagtgagatggcggaagccctcaaaggtatgcccatccggtaccagacgaccgcagtgaaaagcgagcataccggcaaggagattgtggacctgatgtgccacgccaccttcacgatgcgcctcctttccccggtgcgggtgccgaactacaacatgattatcatggacgaggcccatttcacagatccgagctccatcgcggccagaggatacataagcacccgggtcgggatgggggaagccgccgccatcttcatgaccgcaacacctcccggctccgtggaagccttccctcagagcaacgcagtgatccaggacgaagaaagggatatcccggagagatcctggaactcagggtacgaatggatcacggatttccccggtaagaccgtctggttcgtgccctctataaagagcggcaatgacatcgccaattgcctccgcaagaacggtaagcgagttatccagctgtcccgcaagacctttgacacggagtaccaaaagacaaagaacaacgactgggactacgtggttaccaccgacatcagcgagatgggcgcgaacttccgggccgatcgcgtgatcgacccccggcgttgtctaaagcctgttatccttaaggacggtcccgaacgcgtgattctagctggccccatgcccgtcacagtggcgtctgccgctcagcgccgggggcgcattgggaggaaccacaacaaggagggcgaccagtacatttacatgggccaaccgctgaataacgacgaggaccatgcccactggaccgaggccaagatgctgttggataacatcaataccccggagggtattatccctgcactcttcgagccggaacgagagaagtccgccgcaatcgacggggagtataggctgcggggcgaagcgcgcaagaccttcgtggagttaatgagacgaggggacctcccggtgtggctaagctacaaggtggcgagcgaggggttccagtactccgaccggcgctggtgtttcgatggggagcggaacaaccaggtactggaggagaacatggatgtcgagatctggacgaaggaaggggagcgcaaaaagctaaggccgagatggctggacgcccggacctactcagatcccctggccctcagagagttcaaggagtttgcggccggccggcgctctgttagcggggacctgatcctagagattggcaagctccctcagcatctcactcaaagagcccagaacgccctggacaacctcgtgatgctacacaattcggagcagggcggccgcgcgtaccggcatgccatggaagagttgccggataccatagaaacgctgatgctattggccttgatagccgttctgacaggaggggtgaccctctttttcctctccggccgggggctgggcaagacctccataggcttactatgtgtgatggcctccagcgtcctgctgtggatggcgtccgtagagccgcactggatcgcagccagcatcatcctagagtttttcctgatggtgctgcttatccccgagcccgaccgacagcgcaccccgcaagacaatcagctagcctatgtcgtgatcgggcttctcttcatgatattgacagtggccgcgaacgaaatgggcttgctcgagacgaccaagaaggacctggggatagggcatgtcgccgtggaaaaccaccaccacgctgccatgttggacgttgacctacatcccgcctccgcatggaccctgtacgccgtagccactaccatcatcacacccatgatgcggcataccatagagaacacgacggccaatatctcgctgacagccatcgcgaaccaggccgccattcttatgggcttagataaaggctggcccatcagtaagatggacatcggtgtgccattattggccctgggatgctacagccaggtaaacccactgacccttacggccgccgtcctgatgcttgttgctcattacgcaatcatcgggcccggactccaggccaaggcgactcgcgaggcgcagaagcgcacagctgccgggataatgaagaacccgactgtggacgggatcgtcgccatcgacctggaccccgttgtgtatgatgcgaaattcgagaagcagctgggccagatcatgctgctcatattatgcacgtcccaaatactcctcatgcgcaccacttgggctctgtgtgagagcataaccctcgccaccggccccctgaccacgctgtgggaggggtcaccaggcaagttctggaacaccacgattgccgtcagcatggccaatatcttccggggcagctacctcgcgggagccggcttggcgttctccctcatgaagtctctcggaggagggcggcgcgggaccggcgcccagggcgaaactctaggcgagaagtggaagagacaactgaaccagttatccaagagcgagttcaacacttacaagcgcagtgggatcatggaagtggaccgttctgaggcgaaggagggcctcaagcgcggagagacgaccaagcacgcagtatctcggggcaccgccaagctccgctggttcgtagagcgtaactttgtgaagccagaagggaaagtgatcgatctcggctgcggccgcgggggctggagctactactgcgccggactgaaaaaggttacggaggtgaagggatacacgaagggcgggcccggccatgaagaacccattcccatggccacgtatgggtggaatctagtgaaactgcactccgggaaggacgtattcttcatcccgcccgaaaagtgcgacacgttactgtgcgacattggggagagctcccccaacccgaccatcgaagaaggacggaccctgcgcgttttaaagatggttgaaccctggttacgggggaaccagttctgcataaagatcctgaacccgtacatgccgtctgtcgttgagactctagagcgtatgcagcggaaacacggcggaatgcttgtaagaaatcccctgagccgtaacagcacccacgagatgtattgggtctcgtgcgggaccggcaacattgtttcagcggtgaacatgacctcccgcatgctactgaatcgcttcacgatggcccaccggaaaccgacctacgaacgcgatgttgacctcggggcaggcacgaggcacgtggccgtggagcccgaggtagctaatctcgatatcatcgggcagcgcatcgaaaacataaagcatgagcacaagctcacctggcactacgacgaggacaacccttataaaacgtgggcgtatcacgggagctacgaagtgaagccgtctggcagcgcgtcgtccatggtcaacggggtggtgaagctgctcaccaagccgtgggacgtgatccctatggtgacccagatagcaatgacggacacgacccccttcggccagcagagggtgttcaaggagaaggtcgatacccgcacccccaaagccaagcggggaacagcccagatcatggaggttactgcgaagtggctatggggattcctcagccgcaacaagaagccccggatctgcacgagggaagaatttactcgtaaggtgcgctccaatgcggctatcggcgcagtgttcgtagacgaaaaccagtggaactccgctaaggaggctgtggaggacgagcggttctgggacctagtgcatcgcgagcgggagctgcacaagcagggtaaatgcgccacgtgcgtgtacaatatgatgggtaaacgcgagaagaaactcggtgagttcggcaaggccaagggctctcgcgctatatggtacatgtggttaggagcgaggttcctggagttcgaggccttgggcttcatgaacgaagatcattggttcagccgagaaaattcgctcagtggcgtcgaaggagaggggctgcataagttgggatacatactgagggacatctccaagattccagggggaaacatgtacgcggatgacacagccggttgggacacccgaatcactgaggacgacctccagaacgaagccaagatcacggacatcatggagccggagcacgctctgctagccaaaagtatctttaagctaacttaccagaacaaagtcgtgcgcgtgcagcgcccggccaagaatgggaccgtcatggacgtgatttcccggcgcgaccagcgggggagtggccaggtgggcacctacggcttgaacacgttcactaacatggaggcgcagctcatccgccagatggagtcagagggcatcttcagcccctccgaactggagacccccaacctggccggtcgggttttagattggctagagaagcacggggtggagcgccttaagcggatggcgatcagcggcgacgattgcgtagtcaagccgatagacgaccgcttcgccaccgccttgacagccctgaacgacatgggtaaggtccggaaagacatccctcagtgggaaccctccaagggctggaatgactggcaacaggttcccttctgtagccaccacttccaccagctcatcatgaaggatggtcgcgagatagtcgtgccctgccggaatcaggacgagctcgttgggcgagcccgagtaagccaaggcgcggggtggtccctccgcgaaacagcctgccttggtaagagttacgcccagatgtggcagctcatgtatttccaccggcgagacctgcggctggcggccaacgccatatgttccgcggttccggttgactgggtccccactagcaggacaacgtggtcgatacacgcacaccatcagtggatgaccacagaggacatgttaagcgtgtggaacagagtttggatagaggagaacccctggatggaggacaagacccacatctcgagctggggcgacgtcccctacctgggcaagcgcgaagaccagtggtgcggctcgctcatcggtctcacggcccgcgcgacctgggccaccaacattcaagtcgccataaaccaagtgcggcgccttatcggcaacgagaactacctggattacatgacgtctatgaaacggtttaagaacgagtcggatccggagggcgccctctggtag

SEQ ID NO: 24403 - RNA, 9879 nt, synthetic construct
  misc_feature 1..9879: note = derived and/or modified CDS sequence (opt11) from DENV-1__FJ898427__SS-prME
  source 1..9879: mol_type = other RNA
agcgtgacgatgctgctgatgctgatgcccaccgccctggcattccacttaaccacacggggtggcgagccccacatgattgtcaccaagcaagagcggggaaagtcgctgctgttcaagacatccgcgggagtgaatatgtgcacattaatcgctatggatctgggcgagttatgcgaagataccatgacctacaaatgcccacgtatcaccgaggccgagccagacgacgtggactgctggtgcaacgccacggacacctgggtaacatacgggacctgtagccagaccggcgagcaccggcgggataagcggagcgtggcacttgcgccgcacgtgggcttagggctggagacccgaacggagacctggatgtcgagcgagggcgcctggaagcagatccagagagtggagacgtgggccctcagacacccagggttcacggtaatagcccttttccttgcgcacgcaatcggtacttccataacccagaagggtatcattttcatcctcttgatgctggtgacccccagtatggccatgcggtgcgtcggcatcggctcccgcgacttcgtggagggattgtcgggcgcaacctgggtggacgttgttctggagcacggctcctgcgtgaccaccatggccaaggacaagcccacccttgacatcgaactcctgaaaaccgaggttaccaaccccgcggtgctgcgcaagctttgcattgaggctaagatcagcaacaccacaacagacagccgttgccccacccagggcgaggccacgctgatggaggagcaggatgcaaatttcgtgtgccggagaaccttcgtcgatcggggctggggaaatggctgcgggctgtttgggaaggggtcactcataacgtgcgccaagttcaagtgcgtgaccaagctggaaggtaagatcgtgcagtacgagaacctgaaatacagcgtcatcgtgacggtccacacgggcgaccagcaccaggtcggtaacgagagcaccgagcacggcaccaccgcgacgatcacaccccaggcccccacctccgaaatccaattgaccgactatggcgcattaaccctggactgcagcccccggacgggtctagactttaacgagatggtgctactaacaatgaaggaaaagagttggctcgtccacaagcagtggttcctggacttaccgttaccctggactagcggcgctagcacctcacaggagacgtggaaccgtcaggaccttctggtgacctttaaaactgcccacgcgaaaaagcaggaggtggtagtgctcggaagccaggagggtgctatgcacaccgccttaacgggggccaccgaaatccagacctcgggcaccactaccatattcgccggccacctgaagtgccgcctcaagatggacaagttgaccctaaaggggatgtcgtacgtaatgtgcaccggttctttcaagctcgagaaggaggtcgcggagacgcagcacggcaccgtgttagtccagatcaagtacgagggcactgacgccccctgcaagatcccctttagcacccaggacgagaagggggtcacgcagaacggccggctgatcacagccaatccaatcgttaccgacaaggaaaagccggtcaatatcgaggctgagccgccttttggagagtcatacatcgtcatcggagcgggcgagaaggccctcaagctctcatggttcaagaaggggtcaagcatcggcaagatgttcgaggccacggctcgcggggcacgccgcatggcgattctgggggacacggcttgggactttggatccgtcggtggcgttttcacgagcgtcgggaagctggtgcaccagatatttggtaccgcctacggcgtcctgttctccggcgtcagctggacaatgaagatcggtatcggcgttttgctgacctggcttggactgaactcgcggtccacctcactgtcgatgacctgcatcgccgtgggcctcgtcaccctgtacctgggcgtgatggttcaggccgacagtgggtgcgttatcaactggaaaggccgggagctcaagtgcggcagcggtatattcgtgacaaacgaggtgcacacttggaccgaacagtataagttccaggcggatagcccgaagcgcttgtccgcagccataggcaaggcctgggaggaaggagtctgcggcattcggagcgccacccgccttgagaacataatgtggaagcagatctccaacgagctcaaccacatcctgctggaaaacgacatgaagttcaccgtggtggttggtgacgtggtaggcatcctcgcacaaggaaagaagatgattcgtccccagcctatggaacataagtatagctggaagtcctggggaaaggccaagatcatcggcgcggacgtgcaaaacacgacgttcatcattgacgggccgaacaccccggaatgtccggacgaccagcgtgcctggaacatatgggaagtggaagactacggctttggaatcttcaccacgaatatctggctgaagttacgggactcatacacgcaggtatgcgaccaccgcctcatgtctgccgcaatcaaggacagcaaggccgtacacgccgacatgggctactggatcgagtctgaaaagaacgaaacctggaaattagcccgcgccagcttcatcgaggtgaagacttgtatatggccaaagtcacatacgttgtggtctaacggcgtgcttgagtccgagatgatcatccctaagatctacgggggcccgatctcgcaacacaactaccgccccggatacttcacccagaccgcaggcccctggcacctggggaagctggagttggacttcgatctgtgcgagggcacaacggtagtcgtggacgagcactgcgggaacagggggccgtctctgcgcaccactaccgtcacgggtaaaatcatacatgagtggtgctgccgaagctgcaccctgccgccgttgcgcttcaagggcgaagacggatgctggtatggcatggagattcggcccgtgaaggaaaaggaggagaacttggttaaatccatggtgagcgccggcagcggagaggtggactccttcagtctgggactgctgtgcatttccattatgatcgaggaagtgatgcgcagccggtggtcacggaagatgttaatgaccggaacactcgcggtcttcctgctactgatcatggggcagctcacgtggaacgacctcatccggctgtgcatcatggtgggtgcaaacgccagcgatcgcatgggaatgggaaccacgtacctggccctcatggcaacctttaagatgagaccgatgttcgctgttgggctgttatttcggcgcctcacgtcccgagaagtcctgcttctcacgatcggcttgagcctggtagcctccgtcgagctccccaactcactggaagaactaggagacggcctcgctatgggcatcatgatcctgaagcttcttactgattttcagagccaccagctctgggccaccctcctttcactgacgttcatcaagaccacgttgtcgttgcactgcgcttggaaaaccatggccatggtgctaagcatcgcgtccctgttccctctctgcttgagcactacctcacaaaagaccacctggctgcccgtgctgcttggcagcctcggctgcaaaccgctaactatgttcctgatcacagagaccaagatatggggccgcaagtcctggccacttaatgaggggatcatggccgtcggcgtggtgagcatcctcttgagcagcctgctcaaaaacgacgtcccacttgccgggcccctcattgcaggcggtatgctgatagcctgttatgtcatctctgggtccagcgcggaccttagcctggaaaaggcagctgaagtgagctgggaggaggaggccgaacatagtggcgccagccacaacatcctcgtggtcgtgcaggacgatgggaccatgaaaataaaagacgaggagcgcgacgacaccctgacgatcctgctcaaagcgaccctgcttgccgttagcggagtctacccgctcagcatccccgccaccttgtttgtgtggtatttctggcagaagaagaaacagagatcaggggttctctgggacaccccctcgccacctgaagtggagcgcgcggtgctggacgacggcatctaccgcatcatgcaacggggcctcctcgggcgatcccaggttggcgtaggggtgttccaggaaaacgtctttcatacgatgtggcacgtgactagaggagcagtgctgatgtaccaggggaagcgcctcgagccctcctgggcgtcagtcaagaaggacctgatctcctacggtggcgggtggcgcttgcagggctcctggaacacgggtgaggaggtccaggtcatcgcggtagagcccggaaagaaccccaagaacgtgcagaccgcccctgggacgtttaagacccccgaaggggaggtcggcgccatcgctctagatttcaagccggggaccagcggatcccccatcgtcaaccgcgaggggaaaatagtaggtctctacggcaatggcgtggttacaacgtcgggcacctacgtcagcgcgattgctcaggccaaggcttcccaagaggggccgctgccggaaatcgaggatgaggtatttcggaagcgtaacctcaccataatggacctgcaccccggctccgggaaaacccgccgctacctgccggcgatcgtccgggaagccatcaagcggaagctacgcacgctgatactcgcccccacccgagtggtggccagcgagatggccgaggcactcaaaggcatgccaatccgctaccagaccaccgcggtcaagagcgagcacacggggaaggagatcgtggacttgatgtgccacgccactttcaccatgcggctactctccccagtacgcgttccgaactacaacatgatcattatggacgaggcccacttcaccgatccaagctccatcgccgcgcggggatacatcagcacgcgcgtgggcatgggggaggccgccgccatctttatgaccgccacgccgcccggctcagtggaggccttcccacagtctaatgcggtcatccaggacgaggagcgagacatacctgagcgatcctggaactccgggtacgaatggatcacggacttcccggggaagacagtgtggttcgtcccctctattaagtccggtaacgacatagccaactgcctgcggaaaaacgggaaacgcgtcatccagctgtcccggaaaaccttcgacaccgaataccagaaaaccaagaacaatgactgggactacgtggtgactacagacatctcggagatgggcgccaatttccgcgcggaccgggttatcgatccgcgccgatgcctaaagcccgtgatcctgaaggacggacccgagcgagtcatacttgccggcccaatgccggtcactgtagcgtctgcagctcaacgaagggggcggatcggccgcaaccacaacaaagaaggcgaccagtacatatacatggggcagcctctcaacaacgatgaggaccacgcccactggaccgaagccaaaatgttactggacaatatcaatacccctgagggcatcatccccgccttgttcgagcccgaacgggagaagtccgccgcaatcgacggggagtatcgtctgcgcggtgaggcacggaagacattcgtagaactgatgcgccgcggggacctccctgtatggctgtcatacaaggttgccagcgaaggattccagtacagcgaccgccggtggtgtttcgatggagaaagaaacaaccaagtcctggaggagaacatggatgtggagatttggactaaggagggggagcgtaagaaacttagacctcggtggctggatgccaggacgtactccgaccccctggctcttcgggaatttaaggaattcgccgcgggccggcgcagcgtgtcaggcgacctgatactggagatcggaaaacttccacagcacctgacccagcgcgcccagaacgccctggacaatctcgtcatgctccacaatagcgaacagggcgggcgagcgtaccgtcacgcaatggaggaactgccggacactatagagacgctcatgttactggccctaatcgccgtgctcacgggcggcgtgacactcttctttctcagtggccgaggtctcggtaagacaagtattggactgctctgcgtcatggcatccagtgttctcctgtggatggcttccgtggaaccgcactggatcgctgcctcgatcattttggagttcttcctcatggtactgctcatccccgagccggatcgccaacggacgccccaggacaaccaactggcctacgtggtcatagggttgctgtttatgatcctgaccgtcgccgccaacgagatgggcctgctggaaacgactaaaaaggatctggggatcggccacgtggctgtggaaaaccatcaccacgctaccatgttggacgtcgacctccatcccgcctccgcatggaccctgtatgctgtggcgaccaccatcatcaccccgatgatgcgtcatacgattgagaacaccacggctaacatcagcctgactgcaatcgccaaccaggctgccatcctcatggggctcgacaagggctggcccatatcgaagatggacatcggcgtacccctgctagccctgggatgctacagccaggtcaacccgttaaccctaacggccgcggttctgatgctggtggctcattacgccataatcggccccggacttcaggccaaagccacaagagaggcgcagaaacgaaccgcggccggtataatgaagaaccctaccgtcgacggaattgtggccatcgacctggatccagtggtttacgacgctaaattcgagaaacagctcggacagataatgctcctcattctgtgcacctcccagatcttgctgatgcgcacgacatgggccctgtgcgagagcataaccctagcgaccggccctctcacgaccctgtgggaggggtctccaggcaaattttggaataccacgatcgcagtgagcatggccaacatatttcgcggctcctacctcgccggcgccggactcgcgttctccctgatgaagagcctcgggggcgggcgccgtggcacgggggcccagggcgagactctgggcgagaagtggaagcgccagctgaatcagctcagtaagagcgagttcaatatttacaaacggtcaggtatcatggaggtggaccgcagtgaagccaaggagggccttaagagaggggagaccacccgccatgccgtttcccgggggacggcgaagctgcgctggtttgtggaacggaacttggtaaagccagaagggaaggtcatcgacttaggctgcggacgcgggggatggagctactattgcgccgggctaaagaaagtaaccgaagtgaaaggatacaccaagggggggcccggacatgaagagcccatacctatggcaacctacggatggaacttggtcaaacttcactccggcaaggacgtgtttttcacgcccccggagaagtgcgacaccctcctgtgcgatatcggggagagctcccccaacccgacaatcgaggagggccggacactcagagttttgaagatggtcgagccgtggctgcgggggaatcagttctgcatcaagatcctcaacccgtacatgcccagtgtcgtcgagaccctggagcagatgcaacgaaagcatggcggtatgctggtccggaaccctttgtcccgcaattccacgcacgaaatgtattgggtatcatgcgggaccggcaacatcgtttctgccgtcaacatgacctcccgtatgctgctgaaccggttcaccatggcacacaggaaacctacctacgagcgtgatgttgatctcggggcgggtacgcgtcacgtggccgtagagcccgaggtcgcaaacctggacatcatcggccagaggatcgagaacataaagcacgaacacaagagcacctggcactacgacgaggacaacccctacaagacctgggcgtaccacgggtcctacgaggtcaagccgagcggctccgccagctcgatggtcaacggcgtggtgaaacttctaacgaaaccctgggacgtgatcccaatggtaacccagatcgcgatgacagacacgacgccctttggccagcagcgagtatttaaagagaaagtggatacccggacccccaaagccaaacgcggtactgcgcagatcatggaagtgacggctcggtggctgtggggttttctgagtagaaacaagaagccccggatctgcactcgcgaggaattcactcggaaggttcgtagcaacgccgctatcggcgctgtctttgtggacgagaaccaatggaactccgccaaggaggcagtcgaggatgagaggttctgggaccttgtccaaaaggagcgcgaactgcacaaacaggggaagtgcgcgacctgcgtgtacaacatgatggggaagagagagaagaagctgggggagtttggtaaggcaaaggggagtcgcgctatctggtatatgtggttgggcgcccggttcctggagttcgaggccctggggttcatgaacgaagaccactggttcagtcgcgaaaacagcctctccggtgtagagggggaagggctgcataagttgggttatatcctccgggatatcagcaagatccccgggggcaacatgtatgcggacgacacggccggctgggacacccgcatcaccgaggacgacctgcagaacgaagctaagatcaccgacatcatggagccggagcatgccctgctcgccacgtccattttcaagttgacctaccagaacaaggttgtaagggtacaacgccccgctaagaacggcaccgtgatggacgtgataagccgccgggaccagagaggtagcggccaggttggaacctacggattgaacactttcaccaacatggaagcccaattaattcggcagatggagtcagaggggatcttcctgccctccgagctagaaacgcccaacctagcagaacgcgtattggactggttagagaagtacggagtggaaagacttaagagaatggccattagcggtgatgactgtgtcgtcaagccaatcgacgatcggttcgccaccgcgctgactgcactgaacgacatgggcaaggtccgcaaggacatcccccagtgggagccatccaaagggtggaacgattggcagcaggtccccttctgcagccatcactttcaccagctcatcatgaaggacggcagggagatcgttgtgccgtgcagaaaccaggacgagctggtcgggagagcccgcgtgagccagggggcgggctggagcctgcgggagaccgcctgcctaggcaagagctacgcgcagatgtggcaactcatgtatttccaccgccgggacttacgtctcgccgcaaacgccatttgttccgcggtgcccgtcgactgggtgccaacgtcacggaccacgtggagtatccatgcacatcatcagtggatgaccactgaggacatgcttagcgtgtggaaccgcgtatggatcgaggagaacccttggatggaggacaaaacccacgtgtcctcctggggcgacgtgccctatctgggcaaacgggaggaccaatggtgtggctccttaatagggctgaccgcccgcgccacgtgggccagcaacatacaggtagcgattaaccaggtgcgccggttgatcggaaacgagaactacctcgattatatgacctcgatgaagcgtttcaagaacgagggcgaccccgagggggccctgtggtaa

SEQ ID NO: 24404 - RNA, 9879 nt, synthetic construct
  misc_feature 1..9879: note = derived and/or modified CDS sequence (opt11) from DENV-1__JF937599__SS-prME
  source 1..9879: mol_type = other RNA
agcgtgaccatgttactcatgctgatgccaacggccttggcctttcatctgaccgcccggggcggagagccccatatgatcgtgagcaagcaggagcggggcaaatctctgctgtttaagacaagcgccggcgtaaacatgtgcaccctcatcgccatggacctgggcgagttctgcgaggataccatgacctacaagtgcccaagaatcaccgaggctgagcccgacgacgtggactgctggtgcaacgccaccgacacctgggtgacctacggaacctgcagccagacaggcgagcaccggcgggataagaggtcggtggcgttagccccacatgtcggcttggggctcgagacccgcacggaaacttggatgtcctccgagggcgcctggaagcagatccagagggtggagacctgggccctccgccaccccggattcaccgtgatcgcattatttctggcccacgccatcggtacaagcatcacacagaaggggatcattttcatcctgttaatgcttgtgaccccctctatggcaatgaggtgcgtcggtatagggagccgggattttgtggaggggctttccggcgcaacctgggtcgatgtcgtcttagaacacggatcctgcgtgacgacaatggcaaaggacaaacccacgctggacatagagcttctcaaaaccgaggtcacgaatccggccgtgttgcggaagttgtgcatagaagcgaagatctctaacaccaccaccgacagccgctgcccgacccagggcgaggccacgctcgtggaggagcaggacgctaacttcgtctgtcggcgcacctttgtggataggggctgggggaatgggtgcgggctgtttggcaaggggtcactgataacgtgcgcgaagttcaagtgcgtgacgaaactcgagggcaaaatcgtgcagtacgagaacctgaagtattcggtgatcgtgaccgtacacaccggggaccaacaccaagttgggaacgaatccaccgagcacggcacaaccgcaaccatcacgccccaggcaccctccaccgagattcagctgacggactacggggccctcaccctggactgcagcccccggaccggcctagacttcaacgagatggtccttttaaccatgaaggagaaaagctggctcgtccacaaacagtggtttctcgacctgcccctgccctggaccagtggggcgtccacgtcacaggagacctggaatcgccaggacctcttagtgacctttaagacggcacatgctaagaagcaggaagtcgtagtgctcggctcccaggagggagccatgcacacggccctcactggggccaccgaggttcagacgagcggcacaacaacgatattcgccgggcacctgaagtgccgcttgaagatggacaagctcacgctcaagggtatgtcttacgtcatgtgcaccgggtccttcaagctggagaaggaagttgccgagacccagcacggcaccgtgctggtgcagatcaaatatgagggcacggacgcgccgtgtaagatccccttctccacccaggacgaaaaaggagtgacccaaaacggccgactcatcactgccaacccgatcgttaccgataaggagaagcccgtcaacatcgaggctgaaccaccctttggggagagctacatagtgatcggcgccggcgagaaggcccttaagttatcttggtttaaaaaggggtcatcgatcggcaagatgttcgaggccaccgcgagaggggcgcgtagaatggccatccttggcgacaccgcctgggacttcgggtcaataggcggcgtattcacaagtgttgggaaactagttcaccagatattcggcacggcctacggggtgctgttctcaggagtgagctggaccatgaagatcggtatcggggtgctcctaacatggctcggcctcaactcccgctccaccagcctgtccatgacgtgcatcgccgtcgggctggtaaccctctaccttggcgtgatggtacaggccgactccgggtgcgtgatcaactggaagggccgggagttgaaatgcgggagcggcattttcgtgaccaacgaggtccacacatggacggaacaatacaagttccaggcggactctccgaagaggctctctgcagccatcggcaaggcctgggaggagggggtgtgcggcatacgatccgcgactcggctggagaacatcatgtggaagcagatatcgaacgagctgaaccacatcctactggagaatgatatgaagctgacggtggttgtaggggacgtggccgggatcctcgcccagggtaagaagatgatccgtccgcaacccatggagtacaagtactcctggaaatcctggggtaaggcaaaaataataggagcggacgtccaaaacaccacctttatcatcgacggacccaacactccggagtgccccgacgatcagcgggcctggaacatctgggaagtggaagattacggtttcgggatcttcaccacaaacatctggctgaagctgcgagactcctacacccaggtttgtgaccacaggttaatgtccgcagccatcaaggactccaaagccgtccacgcggacatgggttattggatcgagagcgaaaagaacgagacgtggaagttggcccgggccagttttattgaagtgaagacctgcatatggcccaagagccataccttatggtcgaacggagtgctcgagagtgaaatgattattccaaagatctacgggggcccgatcagtcaacacaattaccgcccaggttactttacccagacggccggcccgtggcacctggggaagctagaactcgattttgacctgtgcgaggggaccacggtagtggtggacgaacattgcggaaacagagggccgagcctccgcaccacgaccgtcaccggcaaaatcatccacgagtggtgctgccggagctgcaccctcccgcctctcagatttaaaggggaggacggctgctggtacgggatggagatccgcccagtaaaggagaaagaggagaacctggttaagtccatggtcagcgccggctccggtgaagtggacagtttctccctcgggctgctatgtatcagcatcatgatcgaggaggtgatgagaagtcggtggagccgcaagatgctgatgacgggcaccctggccgtcttcttcctgctcatcatggggcagctgacttggaacgacctgatccgcctctgcatcatggtgggcgccaacgcctccgaccgcatgggcatgggcaccacgtatctggccctcatggccacctttaaaatgcgaccgatgttcgctgtgggcttactcttccggcgcctgaccagcagagaagtcctcctcctgaccatcgggttgtccctggttgcgagcgtcgagttacccaacagcctcgaggagttgggcgacggcctggccatgggcataatgatcttgaaactgctgaccgattttcagagccatcaactctgggccaccctgctgtccctcacctttataagaacgacgttcagcctgcactacgcgtggaaaaccatggccatggtgctgtccatcgtaagcctcttccccctctgtctgtccactaccagccagaagacgacctggctcccagtgcttctgggcagcctcgggtgtaaaccattaaccatgttcctgattgcagagaacaagatctggggccgcaagagctggcccctcaacgaagggattatggctgtaggcatcgtcagcatattgctgtccagcctccttaagaacgacgttcccctggccgggcctctcatagccggcggaatgctgatagcctgctacgtgatcagcgggagctccgcagacctgagtttggagaaggcagcggaggtgtcctgggaagaagaggcggagcacagcggtgccagccacaacatcctggtcgaagtgcaggacgacggcactatgaaaatcaaggacgaagagcgcgacgacacgctgaccatcctgctgaaggccaccctcctcgcggtgagcggcgtctaccccctgtccatccccgccaccctattcgtgtggtacttttggcaaaagaagaaacagcggagcggggtgctctgggacacccccagtccgccagaggtcgaacgcgcggtgctggatgacggtatctatcggataatgcagcgcggcctgttgggtcggtcgcaagtgggggtcggggtgttccaggagaacgttttccacacaatgtggcacgttaccaggggcgccgtgctcatgtatcaagggaagcgtctggagccctcctgggcctcagtaaaaaaagacctgatctcctatgggggggggtggcgcctccagggcagctggaacaccggtgaggaagtccaggtcatcgccgtcgagcccggcaagaatcctaagaacgtccagaccgccccagggacgttcaaaacctccgagggcgaagtgggcgcgatcgcactcgactttaagcccgggaccagcgggagcccgatagttaaccgggaaggcaaaattgtcggtctgtatggcaatggggtcgtgaccacttccggtacctacgtcagcgccatcgcccaggcgaaggcttcccaggaggggcccctcccggagatagaagatgaggtatttcgcaagcggaaccttactatcatggacctgcaccccggttcggggaagacccgccggtacctccccgctatcgtacgagaggccatcaagcgacgcctgcggacgctcatacttgcccctacccgggtcgtggcctccgagatggcagaggccctcaagggcatgcccattcgctatcagacaacagccgtaaagagcgagcacacgggcaaggagattgtagacctgatgtgccacgccacgttcaccatgcggttactgtcccccgtgcgcgtgcccaattacaacatgatcatcatggacgaggcccactttaccgacccgagctccatcgccgcgcgcggatacataagcacgcgcgtcggaatgggggaagccgcagcgatcttcatgacagccaccccgcccggctccgtcgaggccttcccccagtctaacgccgtgatacaggacgaagagcgcgatatacctgagcgctcctggaacagcgggtacgagtggatcaccgactttcccggcaaaactgtctggttcgtgcccagcatcaagagcggcaatgacatcgcaaactgtcttaggaagaacggaaagcgcgtgatacagctatcgagaaaaacattcgacaccgagtaccagaagaccaagaacaacgattgggactacgtcgtaaccaccgacatcagcgagatgggcgcaaacttccgcgctgaccgcgttatcgacccccgccggtgcctgaagccggttatcttaaaggatgggcccgagcgcgtaattctcgctggccccatgcccgtgacggtggcgtccgctgcccaacggcgcgggcggataggtcgcaaccacaataaggagggcgaccagtatatctatatgggccaaccgctgaacaacgacgaggatcacgcccattggaccgaggccaaaatgctgctcgacaacataaacacgccggagggcatcatccccgctttattcgaacccgagcgcgaaaagtccgcagctatcgacggggagtatagactgcgtggcgaggcccggaagaccttcgtggaactcatgcgccgcggggacctgccggtctggctgtcgtacaaggtggcatccgagggtttccagtacagtgacagaaggtggtgctttgacggagagcgcaacaaccaggtgctcgaggagaacatggacgtcgagatctggaccaaggagggggagcgtaagaagctgcgtccccgttggctagacgcccgcacctactctgacccgctcgcgctgcgggaatttaaggagttcgccgccggccgccgtagcgtgtccggcgatctcatcctcgaaataggcaaactgccccagcacctgacgcagcgcgcccaaaacgcactcgacaacctggtgatgctccacaatagcgagcagggcgggcgggcctacaggcacgccatggaggaactcccggataccatcgaaacactgatgttgttggccctgattgccgtcctgaccggcggggtgaccctcttcttcctttccggccggggactgggtaaaaccagcatcgggctattatgcgtgatggcctcgtctgtcctgctctggatggcctctgtcgaacctcactggatcgccgccagcattatcctggagttcttcctgatggtgctcctgatccccgaacccgaccgccagcggacaccgcaagacaaccagctggcatacgtcgtgatcgggcttttatttatgatcctcaccgtggcggccaacgagatgggcctcctggagaccacgaaaaaagatctaggcatcggccacgtggccgtggagaatcatcaccacgccgccatgttggacgtggacctacatcctgcgtccgcctggacactgtacgccgtagcaaccaccatcatcacgccgatgatgcgtcacaccatagagaacactacagccaatatcagcctcaccgcgattgccaaccaggctgctatcctgatgggcctggacaaggggtggccgatctccaagatggacatcggcgtaccattattagcgttagggtgctactcccaggtcaaccccctcaccctaacggcggccgtactgatgctcgtggcccactatgccataatcggacccggcttacaggcaaaggccacccgcgaggcccagaaacggacggccgcggggatcatgaagaaccctacagtggacgggatcgtcgcgatcgatctcgaccccgtggtgtacgacgccaagttcgagaagcagctcggccagataatgttgctgattctatgcacctcccagattctgcttatgcgaaccacttgggccctatgcgagtccatcaccctggccacgggtcccctgaccacactgtgggaaggctcccctgggaagttctggaacacaaccatcgccgtcagcatggcgaacatctttcgtggaagctatctagccggcgccggcttagccttcagtttaatgaagtccttaggtggcgggagaagagggactggggcgcagggcgagacacttggtgagaagtggaaacgccagctcaaccagctatccaagcctgagttcaacacgtataagcggagcgggatcatggaggtggaccgcagcgaagccaaagagggcttaaagcgcggagagaccaccaagcatgcggtgagccgcggaacagccaagctcagatggttcgtcgagaggaacctagtgaagcccgaagggaaagtaattgatctggggtgcggccgcgggggatggtcctattactgcgctgggctgaagaaagtaaccgaggtgaagggctacaccaaaggcgggcccggccacgaggaacccatacctatggcgacctatgggtggaatctcgtcaagctccacagcggtaaggacgtctttttcatcccgccggagaagtgcgacactctgctgtgtgacatcggggaatccagccccaatccgactatcgaagagggccgaaccctgcgggtgctgaagatggtggaaccgtggttgcgcgggaaccagttttgcatcaagatccttaacccctatatgccctcagtcgtcgagaccctggagcaaatgcagcgaaagcacggaggcatgctagtgcgaaacccgctttcgcgcaattccacgcacgagatgtactgggtcagctgcgggacgggtaacatagtgtccgcagtcaacatgaccagcaggatgttgctcaaccgcttcaccatggcccacagaaagccgacctacgagcgagacgtcgacctgggggccggcacgcgccacgtcgccgtcgagcccgaagtcgcgaacctagacatcatcggccaacgcattgagaacatcaagcacgaacacaagtccacatggcactacgacgaggacaacccttacaagacttgggcctaccatggttcgtacgaagtgaagccgtccggcagcgcctcgtccatggttaacggggtggtgaaactcctgaccaagccctgggacgtcattcccatggttacgcagattgccatgaccgacaccaccccgttcgggcagcagcgggtgtttaaggagaaagttgacacgcgcaccccgaaggctaagcggggaaccgctcagatcatggaagtgaccgccaagtggttatggggattcctcagccggaataagaagccccggatttgcacacgcgaggaattcacgcggaaggtgcgctcgaacgctgccatcggcgctgtcttcgtggacgaaaaccaatggaatagcgcaaaagaggccgtggaggacgaacggttctgggatctggtccaccgcgagcgggagctgcacaagcaggggaagtgcgcgacgtgcgtttacaacatgatgggcaagagagagaagaagctcggagagttcggcaaagccaagggctcccgggcgatctggtacatgtggttaggtgcccgcttcctggagttcgaggcgctcggcttcatgaatgaggaccactggttttcgagggagaactccctgagcggggtggagggagaggggctccataagctcggctacatattgcgcgacatctccaagatacccggagggaacatgtacgccgacgacactgccggctgggacacacggatcaccgaggacgacttgcagaacgaggccaagattaccgacattatggagccggagcacgccctgctggccaagagcatcttcaagctgacctaccagaacaaggtcgtacgcgttcagcgccccgccaaaaacggtacggttatggacgttatttcacggcgcgaccaacggggcagcggacaggtgggcacctacggtttaaacacctttaccaacatggaggcccagctaatccgccaaatggagtccgaagggatcttcagcccctccgagttagaaacgcccaacttggcgggccgggtgctggactggctggagaagcatggggtggagcggctcaagcggatggcgatcagcggcgacgactgcgtagtcaagccgatcgacgacagattcgcaaccgccctgaccgccctcaacgacatggggaaagtgaggaaggacatcccccaatgggaaccctccaaggggtggaacgactggcaacaggttcccttctgtagccaccacttccaccagcttatcatgaaggacggccgtgagatagtcgtaccgtgccggaaccaagacgagctggtggggcgtgcgcgggtcagccagggcgccggatggtcccttcgcgagaccgcctgcctcgggaagagctacgcccagatgtggcagctgatgtacttccaccggcgtgatttacggctcgcagcaaacgcgatctgctctgccgtacccgtcgactgggtccccacgtcgcgcaccacttggtccatccacgcccaccaccaatggatgaccacggaggatatgctgagcgtgtggaaccgggtatggattgaagagaacccatggatggaggataagactcacgtctctagctggggagatgtaccgtacctgggcaagcgagaggatcaatggtgtggctccctcatcggccttaccgcgcgcgcaacctgggctaccaacattcaggtggccatcaaccaagttcggcgactgctcggcaatgaaaattacctggattacatgacaagcatgaaacggttcaaaaatgagtccgacccggaaggggccctgtggtga

SEQ ID NO: 24405 - RNA, 9879 nt, synthetic construct
  misc_feature 1..9879: note = derived and/or modified CDS sequence (opt11) from DENV-1__FJ898431__SS-prME
  source 1..9879: mol_type = other RNA
agcgtgaccatgctgctcatgctgatgcccaccgccctggctttccacctgacgacccggggcggggaaccccatatgatcgttagcaagcaggaacgcggcaagagcctgctgttcaagaccagcgccggggtgaacatgtgcacgctcattgcgatggacctgggtgagttctgcgaagacacaatgacgtacaagtgcccccgcatcaccgaggcagagcccgacgacgtggactgctggtgcaatgccaccgacacgtgggtgacctacggaacctgcagccaaaccggcgagcatcggcgtgacaagcggtccgtggccctcgcgccccacgtgggcctcggcttagaaacaagaacagaaacttggatgagctccgagggcgcctggaagcagattcaacgggtggagacctgggccctgcgtcacccggggttcacggtgatcgccctcttcctggcgcacgccatcgggaccagcatcacccaaaaagggatcatcttcatcctgctcatgttagtgactccttcgatggccatgcggtgcgtcggcatcggcagccgcgacttcgtggaggggttatcaggcgccacgtgggtagacgtcgttctcgagcacggcagctgcgtgaccaccatggccaaggacaagcccaccctggacattgagctgctcaaaacggaggtaacaaacccggcagttctgcggaagctctgcatcgaggcgaagatctcaaacaccacaacggacagccgctgcccgacccagggcgaggccaccctagtggaggaacaggacgcaaactttgtctgccgacgcaccttcgtggatcgcggctgggggaacggctgcgggctgttcggcaaggggtccctgatcacgtgcgcaaagttcaagtgcgtaaccaagctcgagggcaaaaccgtccagtatgagaacttgaagtacagcgtgatcgtcaccgtccatacgggcgaccaacaccaggtgggcaacgagtccaccgaacacggaacgaccgctacaataacaccccaggctcccagcacggaaattcagctgaccgactacggggcccttaccctggactgcagcccccggacgggtcttgacttcaacgagatggtcttgctgactatgaaggagaagtcctggctggtgcacaagcagtggttcttagacctcccgctgccctggacgagtggggcgagtaccagccaagagacgtggaaccggaaggacctcctggtgaccttcaagaccgcccacgcgaaaaagcaggaggtcgtcgtgttaggctcacaagagggcgccatgcacaccgccctcacgggtgccacggagatccaaaccagcggcaccacgaccatattcgccgggcacctgaagtgccgcctgaagatggacaagctcactctgaagggcatgtcctacgtcatgtgcaccgggagcttcaagctggaaaaagaagtggcggagacgcagcacgggaccgtgctcgtccaaatcaagtacgagggcaccgacgccccttgtaagatccccttctccacccaggacgaaaagggcgttacgcagaacggccggcttatcaccgccaacccgatcgtaaccgacaaggagaagccggttaacatcgaggcggagccgccattcggagagagctacatcgtaatcggcgcgggcgagaaggccctgaagctgtcatggttcaagaaggggagctccataggaaagatgttcgaggccaccgcccgcggggcccggcgcatggcaatcctcggcgacacggcctgggacttcgggagcatcggtggggtgttcacctccgtggggaaactggtgcaccagatatttggcacggcttacggcgttctgttcagcggcgtctcctggaccatgaagatcgggattggagtgcttctgacgtggctgggtctgaactcgcgcagtacctctttatccatgacctgcatcgccgtggggctggtcaccctctacctgggcgttatggtgcaggccgacagcgggtgcgtcattaactggaagggccgggaactgaagtgcgggagcggcatcttcgtgaccaacgaagtgcacacctggaccgagcagtacaagttccaggcggactcaccaaagcgcctcagcgcggccatcggcaaggcctgggaggagggagtctgcggtatccggtccgccacccgcctggagaacatcatgtggaagcagatcagcaacgagctgaaccacatcctcttagaaaacgatatgaagttcaccgtggtggtcggtgacgtggcgggcatcttagcccaggggaagaagatgatccggccccagccgatggagtacaagtactcctggaagtcttggggcaaagccaagatcatcggggcggatgtgcagaacacgacgttcatcatcgacgggcccaacaccccggaatgcccggatgaccagcgcgcgtggaacatctgggaggtcgaggactatggcttcgggatcttcacgacgaacatttggctcaagctgcgggactcctacacccaggtgtgcgaccaccgccttatgagcgccgccatcaaggacagtaaggccgtgcacgccgacatgggctactggatagagagcgagaaaaacgagacctggaagctggcacgggcctccttcatcgaagtcaaaacctgcatctggcccaagagccacacgctgtggtccaatggcgtgctagagagcgagatgatcattcccaagatctacgggggcccgatctcccagcacaactatcgccccggatacttcacccagaccgccggcccctggcacctcgggaagctggagctggacttcgatctctgcgagggtaccacggtggtcgtggacgagcattgtggcaaccggggacccagcctgcgcaccaccaccgtgacaggtaagatcatccacgagtggtgctgccggtcttgtacactgccgcccctgaggttcaagggggaggatggctgctggtacgggatggagatccggcccgtcaaagaaaaagaggagaacctggtaaagagcatggttagcgccggctccggggaagtagacagcttctccctggggctgttatgtatcagcattatgatcgaagaggttatgcgcagccggtggtcacgcaagatgctgatgaccggcaccctagctgtgctgttcctattgatcatggggcagctgacgtggaacgacctgatccggctctgcatcatggtcggcgcgaacgcctccgataggatggggatgggcaccacctacctggccctgatggcaacctttaagatgcgtccgatgttcgccgtgggcttgctgttccgacgactgacatcacgggaggtgctcctcctgaccatcgggctctccctggtcgcgtcggtggagctgcccaacagcctcgaggagttgggtgacgggctagccatgggcatcatgatcctcaagctgctgaccgacttccagagccaccagctctgggccaccctgctgagtctcacgttcattaagaccactttcagcctgcattacgcctggaagaccatggcaatggtcctgtccatcgtgagcctcttccccctttgcttgtccacgacctctcagaagaccacctggctccccgttctgctgggctccctcggttgcaagccgctgacgatgttcctgatcgccgagaataaaatctggggccgcaagagctggcccctaaacgagggcatcatggccgtcggcatcgttagcatcctgctatccagcctactgaagaacgatgtcccccttgcagggcccttaatcgcaggcggcatgctgatcgcctgctacgtcatctccgggagctccgcggacctgtcactcgagaaggccgcagaggtttcctgggaagaggaggccgagcatagcggcgcgtcccacaatatcctagtggaagtccaggacgacgggaccatgaagattaaagacgaggagcgggatgataccttgaccatacttctgaaggcaaccctcctcgccgtgagcggcgtgtatcctctgagtatccccgccacgctctttgtgtggtacttttggcagaagaagaagcaacgcagcggggtgctctgggatacccccagcccgcccgaggtggaacgggccgtattagacgacggcatctaccgcatcatgcagcgaggtctgctgggtcgcagccaggtgggcgtgggggtcttccaggaaaacgtgtttcacacaatgtggcacgtaacacggggcgccgtcctaatgtaccaggggaaacgcctggagccctcctgggccagtgtgaagaaagacctgatctcctacggcggcggctggcggctccaaggctcttggaacacgggggaggaggtgcaagtcatcgcagtagagcccggcaagaaccccaagaacgtgcagaccgcccccggaactttcaagacctccgagggcgaggtgggcgccattgcgctggacttcaagcctggtacgagcggctcccccatagtgaatcgcgaggggaagatagtgggactgtacggaaacggggtcgtgaccacatccggcacgtacgtgtccgccatcgcccaggccaaggcgtcccaggaggggccactcccggagatcgaagacgaggtcttccggaagcgcaacctgacgatcatggatcttcaccccggcagcgggaagacacggcgctacctcccggccatcgtccgtgaagctatcaagcgcaagctgcggaccctcatcctcgccccgacacgcgtggtcgcctccgagatggcggaagccctgaagggcatgcccatccgctaccagacgaccgccgtcaaaagcgagcacactggcaaggagatcgtggatctgatgtgtcacgccaccttcacgatgcggctcctgtcccccgtacgcgttcccaactacaacatgatcatcatggacgaggcccacttcaccgacccgagctccatcgcggcccgggggtacatcagcacccgagtgggcatgggcgaggctgccgccatcttcatgaccgcgacgccgcccggttccgtcgaggccttcccccaatctaatgctgttatccaggacgaggagcgggacatccctgagaggtcctggaactcagggtacgagtggatcaccgacttccccggcaagaccgtgtggttcgttccctcaatcaaatcaggcaatgacatcgccaactgccttcggaagaacggcaagagggtcatccagctctcccggaagacattcgacacggagtaccagaaaaccaagaacaacgattgggactacgtggtcaccaccgatatctcagagatgggcgctaacttccgcgccgacagggtgatcgaccccaggaggtgcctgaagccggtgattctgaaagacgggccggagagggttatattagccggccccatgcccgttacggtcgcctccgccgcgcagcggcgcgggcggattgggcgaaatcacaacaaggagggcgaccagtacatctacatgggtcagccgctgaataacgacgaggaccacgcccattggaccgaagccaagatgctgctcgataacatcaacacccccgagggcatcatccccgccctgtttgaacccgagcgcgagaagtccgccgcgatcgacggggagtatcgcctgcgcggcgaagcacggaagaccttcgtcgagcttatgcgccgcggggacctgccggtttggctgagctacaaggtcgcttccgagggcttccaatatagcgaccgccggtggtgcttcgatggcgagagaaacaaccaggtgctcgaggagaacatggatgtggagatctggacgaaggagggggagcggaaaaagctgcgacctcgatggctagacgcccgcacctactccgaccccctcgccctgcgggagtttaaggagttcgcggccggccgccggagcgtgtccggagacctgatcctcgaaatcggcaagttacctcagcacctgacccagcgcgcacagaacgccctcgacaacctggtgatgctgcacaatagcgagcagggcgggcgggcgtaccgccacgccatggaagaactccctgataccatcgagacgctgatgctgctcgctctgatcgcagtgcttaccggtggtgtcaccctcttcttcctgtccggtcgaggtctgggcaagaccagcattggcctcctgtgcgtaatggcctccagcgtgctgctctggatggcgtccgtagaaccccactggatcgccgccagcatcatcctggagttcttcctgatggtgctcctgatccccgagcctgaccgacagcggaccccgcaggataaccaactggcctacgtagtcatcgggctcctctttatgattctgaccgtggctgcgaacgaaatgggcctcctggaaacaacaaagaaggatctgggtattggccacgtggcggtcgagaaccaccaccacgccgccatgttagacgtggatctgcaccccgcctcggcgtggaccctgtacgcggtggctacgaccatcatcacacccatgatgcgtcacacgatcgaaaacacgaccgcaaacatcagcttaactgccatcgcaaaccaggccgccatcctgatggggctggacaaaggctggccgatctcaaagatggacatcggcgtccccctcctggccctggggtgctacagccaggtgaaccccctcacactaacagctgccgtcttaatgctcgtcgcccactacgcaatcatcggccccggtctgcaggccaaggcgacccgagaagcccagaaacgcaccgccgcaggcataatgaagaacccgacggtggacgggatcgtagccatcgacctggacccagtcgtgtacgacgcgaagttcgagaagcagctcggccagatcatgctgctgatcctctgcacgtcccagatcctgctgatgaggaccacctgggccctctgcgagagcatcacccttgcaactggccccctgaccacactctgggaggggtcccccgggaagttttggaacaccacgatcgctgtgagcatggccaacatattccgtgggagctacctggcgggcgccggcctagccttttccctcatgaaatccctcgggggcggacgccgggggacaggggcccagggcgagaccctgggcgagaagtggaagcgccaactcaaccagctgtcgaagtctgagttcaatacctacaaacggtccgggatcatggaggtcgacaggagcgaggccaaggagggcctgaaacgcggggaaacgaccaagcacgccgtgtcccgcgggacggccaagctccggtggttcgtggagcgcaacctggtcaagccggaggggaaggtaatcgacctgggctgtggccggggcgggtggtcgtactattgcgccgggctgaagaaggtgaccgaggtcaagggttacacaaagggcgggcccgggcacgaggagcccattcccatggctacgtacgggtggaatctcgtgaaacttcactccggcaaggacgtgttcttcatcccgcccgagaagtgcgacaccctgctctgcgacatcggggaaagctcccccaacccaaccatcgaggagggtagaacgctgcgggtactaaagatggtggagccgtggctccgcggaaaccaattttgcatcaagatcctgaacccttatatgccctccgtggtggagaccctggagcagatgcagcggaagcatggcggcatgctcgtgcgcaaccccctgtcccggaactcgacccacgagatgtactgggtgtcctgcgggactggcaacatcgtcagcgcggttaacatgacctccaggatgctgctcaaccggttcacgatggcccaccgcaagccgacctacgagcgcgacgtcgacctgggggccggcacccggcacgtcgccgtggagcccgaggtggctaacctggacatcattggccagcgcatcgaaaacattaagcacgagcacaagtcaacttggcactacgatgaggacaacccctacaagacctgggcgtaccacgggtcttatgaggtcaagcccagcggcagcgcctcctccatggttaacggggtagtaaaactcctgactaagccgtgggacgtaatccccatggtcacccaaatcgccatgacagacacgacccctttcggtcaacagcgggtgtttaaggagaaggtggacactaggacccccaaagcaaagcgggggaccgcccagataatggaggtcacagcgaaatggctgtggggcttcctcagtaggaacaagaagccacggatctgcacgcgcgaggagttcacccggaaggtgagaagcaacgcagccatcggcgccgtgttcgtcgacgagaaccagtggaactccgcgaaggaggccgtggaggacgaacggttctgggaccttgtgcaccgcgaacgcgagctgcataaacaggggaagtgcgccacgtgcgtatataacatgatgggaaagcgcgagaagaagctcggggagtttggcaaggccaagggaagccgggcaatctggtacatgtggttgggcgcgcgcttcttagagttcgaggccctaggctttatgaatgaggaccactggttcagtcgggagaacagcctgagtggggtagagggcgaggggctgcacaagctcggctacattctgcgcgacatcagcaagatccctggtggaaacatgtacgccgacgacaccgccggctgggatacccggataaccgaggacgacctgcagaacgaggccaaaatcactgacatcatggagcccgagcatgcgctcttagccaagtccatcttcaagctgacttaccagaacaaagtggtccgcgtgcagcggccggccaagaacggtacggtcatggatgtcatctcacgccgcgaccagcggggctccggccaggtgggcacttacggcctcaacacgttcaccaacatggaggcacagctgatcagacagatggagtccgaggggatcttctccccctccgagctggagaccccaaacctcgccggccgggtattagactggctggagaagcacggggttgagcgcctcaagcggatggcgatatccggggacgactgcgttgtgaaacccatcgacgaccggtttgccaccgccctgacggccttgaacgatatggggaaggtccggaaagacatcccgcaatgggagcccagcaaggggtggaacgactggcagcaggtcccgttctgcagccaccacttccaccagctcatcatgaaggacgggcgcgagatcgtggtgccctgccggaaccaggacgagcttgtgggtcgcgcccgggtatcccaaggcgcggggtggagcctgcgcgagaccgcctgcctcggtaagtcctacgcccagatgtggcagctgatgtacttccaccggagagacctgcggctcgctgcgaatgccatctgtagcgccgtaccggtggactgggtgcccacctccaggactacgtggagcatacacgcccaccaccagtggatgaccactgaagacatgctttccgtctggaaccgtgtctggattgaggagaacccctggatggaggacaagacccacatctcttcctggggcgacgtgccctacctgggcaagcgcgaggaccagtggtgcggcagcctcataggactgacggcacgggcgacctgggccactaacatccaggtggctatcaaccaagtccggcgcctgatcggcaacgagaactacctcgactacatgaccagcatgaagcggttcaaaaacgagagcgacccggagggggccctttggtga

SEQ ID NO: 24406 - RNA, 9879 nt, synthetic construct
  misc_feature 1..9879: note = derived and/or modified CDS sequence (opt11) from DENV-1__GU131678__SS-prME
  source 1..9879: mol_type = other RNA
agcgtgaccatgctgctcatgctcatgcccacggccctggccttccacctcaccactcggggcggagaaccgcacatgatcgtgagcaagcaggagcggggcaagagcctgctgtttaagacctccgcgggggtgaacatgtgcaccctgatcgccatggacctgggggagttgtgcgaggacaccatgacctacaagtgccctcgcatcaccgaggccgagcccgatgacgtagattgctggtgcaacgccaccgacacgtgggtgacttatgggacatgctcccagaccggcgagcaccggcgggagaagcggtccgttgccctcgcgccccacgttggtctcgggttggagacgcgcaccgagacatggatgtcttccgagggcgcctggaagcagatccagcgggtcgagacctgggccctccgccaccccgggtttacggtgatagccttgttcctagcgcacgccatcggcaccagcatcacccagaaggggatcatcttcatccttctgatgttagtcacaccctctatggccatgcggtgcgtaggtattggctctagggacttcgtcgaggggctcagcggcgccacgtgggtcgacgttgtgttagagcacgggagctgcgtgaccaccatggctaaggacaaacccaccttggacatcgagcttctaaagacggaggtcaccaaccccgcggtcctgcggaagctctgcattgaggcaaagatctcaaacaccacgacggacagccgctgcccgacccagggcgaggcaaccctggtggaagaacaggacgctaacttcgtctgcaggcgcaccttcgtggaccggggatgggggaacgggtgcgggctgttcggtaaggggtccctactgacgtgcgctaagttcaagtgcatgaccaagctagagggcaagatcgtgcagtacgaaaacctcaagtactctgtcatcgtgaccgtgcacacaggcgaccagcaccaggtaggaaacgaatccacggagcacggcacaaccgcgaccatcacgccccaggcccccacaacggagattcaactgaccgactacggggcccttacccttgactgtagcccccgcacgggcctggacttcaacgaaatggtgctgctcaccatgaaggagaagtcctggctggtccacaaacagtggttcctggacctaccgctgccctggaccagcggggcctctacctcccaagaaacgtggaaccggcaggacctgctagtgacattcaaaaccgcccatgcgaagaagcaggaggtggtcgtactgggctcccaggaaggcgccatgcacaccgccctgacgggtgccaccgagatccagacctccggcaccacgacgatcttcgccgggcacctcaagtgccgcctgaaaatggacaagctgactctcaagggcatgagctacgtgatgtgcaccggatcattcaagctggagaaagaggtcgcggagacgcagcatggcaccgtgctggttcagatcaagtacgaggggaccgacgccccctgcaaaatcccctttagcacccaggatgagaagggggttacgcagaacggtcggttaatcaccgccaacccaatcgtaaccgacaaggagaagcccgtgaacatcgaggccgagcctccattcggggagagctatattgtcatcggcgcgggcgagaaggccctcaagctgagctggtttaagaaagggtccagcatcggcaagatgttcaaggccaccgccagaggggcccggcggatggctatcctgggcgacactgcctgggatttcgggtcgatcggcggcgtgttcaccagcgtgggtaagctcgtccaccagatcttcggcaccgcctacggggtgctgttctccggcgtgtcgtggaccatgaagatcgggatcggcgtcctgctcacgtggcttggtctgaactcccgcagcaccagcctctccatgacctgcatcgccgtagggcttgtcaccttatacttaggcgtcatggtgcaggccgactccggatgcgtcatcaattggaagggccgggagctaaagtgcgggtctggcatcttcgtcacgaacgaggtgcacacctggaccgagcagtacaagtttcaggcggatagcccgaaacgtctttctgcagccatcggcaaggcctgggaggagggggtgtgcggcatccggagcgctactcgcctcgagaacatcatgtggaagcagatctccaatgagctgaaccatatcctgctcgagaacgacatgaagttcacagtcgtggtaggggacgttgcgggcatcctggtacaaggaaagaagatgatccgtccccagcccatggagtacaagtacagctggaaaagctggggcaaggccaagatcatcggcgccgacgttcagaactctacgttcataatcgacgggcccaacaccccggagtgcccggacgaccagcgcgcctggaatatctgggaggtcgaggactacggcttcgggatcttcaccaccaacatctggctgaaacttcgtgactcctacacccaggtgtgcgaccatcgtctgatgagcgcggctatcaaggactcaaaggccgtgcacgccgacatgggatactggatcgagagtgagaaaaacgagacctggaaacttgcccgcgcgtctttcattgaggtaaagacctgcatatggccaaagagccataccctctggtctaacggagtgctggagagcgaaatgatcataccgaagatccatgggggccctatctctcagcataactaccgccccgggtatttcacccagacagccggcccctggcacttgggtaagctcgagctggacttcgacctgtgcgagggcaccacagtggtcgtggacgagcactgcggcaaccgggggccgagcttacgcacgaccaccgttacaggcaagatcatccacgagtggtgctgccggagttgcactctacctcccctgcgcttccgcggggaggatggctgctggtacgggatggaaatccgacccgtcaaggagaaggaggaaaaccttgtcaagagtatggtgagcgcaggatcaggcgaggtcgacagtttcctgctggggctcctgtgcatatcaataatgatcgaggaggtgatgcgcagccgctggtcccggaagatgctgatgaccggtacactcgccgtgttcttcttattaatcatggggcagctcacttggaacgacctgatacggctgtgcattatggtgggcgcgaacgcgagcgaccgcatgggaatgggcacgacctacctcgccctgatggccaccttcaagatgcggccgatgttcgcggtggggctcttgtttcgccggctaacctcccgcgaggtgctgctcctgacgatcgggctgtccctagtcgcttccgtggagctgcccaactcactggaggagctcggtgacgggttggcgatgggtatcatgatcctgaagctcctgactgatttccagtcctaccagttatgggccaccttgctgagcctgaccttcatcaagacgaccttctccctccactacgcctggaagaccatggccatggtcctgtcaatagtatccctgttccccctctgcctgagcaccacatcccagaagaccacctggctgccggtgctcctgggcagcttagggtgcaaaccgctcacaatgttcctaattgcggaaaacaagatctggggccgtaagtcctggccgctgaacgaagggatcatggccgtgggcatcgtgtctatcctcctgagttctcttttaaagaatgacgtgcccctggccgggccactgatcgccggcgggatgctcatcgcctgctacgtcatctctgggagcagcgcggacctgtccctggagaaggccgccgaggtgagctgggaggaagaggcggagcactccggcgctagccacaacatcctcgtggaggtgcaggatgacggtacgatgaagatcaaggacgaggagcgcgacgacaccctgaccatcctgctcaaagcgaccctgctggccgtgtctggtgtttacccgctctccatacccgccaccctattcgtctggcacttctggcaaaagaagaaacaacggagtggagtactttgggacacgcccagtccgcccgaggtggagcgcgccgtcctggacgacggcatctacagaatcatgcagcgcggcctcttggggcggtcccaggtgggcgtgggggtctttcaggagaacgtcttccataccatgtggcacgtgacgagaggcgcggtcctgatgtaccaggggaaacggctcgagcccagctgggcatctgtgaagaaggacctaatcagctatggcggcggatggagattccagggctcctggaacaccggggaggaggtgcaagtcattgccgtggagcccggcaagaaccccaaaaacgtgcagaccgcccccgggaccttcaagacacccgagggcgaggtcggcgccatcgccctagacttcaagcccgggaccagcggctccccaatagtgaatagagagggtaagatcgtgggtctctacggcaacggggtggtgacgacatctggaacctatgtgtcagcgatcgcccaggccaaggcctcccaggaggggccgctccccgagatcgaggacgaggtcttcagaaagcggaacctgacaattatggacttacatccaggcagcgggaaaacgcgccggtacctgccggccatcgtgagggaggccatcaagcggaagctgcgcaccctcatcctggctccgaccagagtggtcgcctccgagatggccgaggcgctaaaaggtatgcccatccggtaccagaccacagccgtcaagtctgagcacacgggcaaggagatcgtggacttaatgtgtcacgccacattcaccatgcgcctgctgtctcctgtccgagtgccgaattacaacatgatcatcatggacgaggcccacttcacagaccccagctccatcgcggcgagagggtacatcagcaccagggtgggcatgggggaggctgccgcgatcttcatgaccgccacgcctcccggctccatggaggcgttcccgcagagcaatgccgtcattcaggacgaggagcgcgacatccccgagcggtcctggaatagcgggtacgagtggatcacagatttcccaggcaaaacggtgtggtttgtgccttccatcaaggccggcaacgatatcgccaactgcctcaggaagaacgggaagcgagtcatccagctgagccgcaagaccttcgacacagaatatcagaaaacgaagaacaacgactgggattacgttgttaccaccgacatctccgagatgggcgcgaacttccgggctgaccgcgttatcgacccgcggagatgtcttaagcctgtcatcctcaaggacgggcccgagcgagtgattttagccggcccaatgccggtgaccgtcgccagcgccgcgcagcgcagggggcgcatcggccggaaccccaataaggagggcgaccagtacatatacatggggcaacctctgaacaacgatgaggaccacgcccactggacggaggccaagatgctcctggacaacatcaacacccccgagggcattatcccggccctcttcgagccagagcgcgaaaagtccgctgcaatagatggtgagtaccgcctccggggcgaggcccgaaagaccttcgttgagctgatgcggcgcggcgacctgcccgtgtggttgagctacaaggtggcgtccgaggggttccagtactccgaccggcgctggtgcttcgccggcgagcggaataaccaggtcctggaggagaacatggacgttgagatctggaccaaggagggtgagcgcaagaaactactccctcgctggctggacgccaggacgtacagcgatccgctggccctccgggagttcaaggagttcgccgccggacgccggagtgtgagcggggacctgatcctcgagatcggaaagttaccccagcaccttactcagcgcgcccagaacgcactggataacctcgtcatgttacacaactccgagcagggcgggcgtgcgtatcgccacgccatggaggagctccccgacaccatagagacgctcatgctgctggccttaatcgcagtcctgacaggcggggtgacgctgttcttcctcagcggtaagggtctgggcaaaacgtctataggattattgtgcgtgatggccagctccgtcctgttatggatggggagcgtggagccccactggatcgccgcctccatcatcctcgagttcttcctgatggtcctgctcatcccggagcccgatcggcagcgcacaccacaagacaaccagctagcatacgtggtcatcggcttgctgtttatgatcctgactgttgccgcaaacgagatggggttattggagacgaccaagaaggacctgggcatcggccacgtggctgtcgagaaccatcaccacgccgccatgctggacgtcgacctccacccggcgagcgcttggaccctgtacgcagtggccaccaccatcatcacccccatgatgcggcacaccatcgaaaacaccacggccaatatctccctgaccgcaatcgcgaaccaggccgccatcctaatgggtctggccaaaggctggcccatctcgaagatggacataggagtgccactactcgcgttgggttgctactcccaagttaaccctttaaccctcacggccgccgtgctgatgctggtagcccattatgccatcattggccccggccttcaggcgaaggccactcgagaggcccaaaagcggacggccgccgggatcatgaaaaatcccaccatcgacggtattgtcgcaatcgacctggaccccgtggtgtatgacgccaagttcgagaagcagctcggtcagatcatgctcttaatcctatgcaccagccagatattgctgatgcgcacgacctgggccctgtgcgagtccataaccctcgccaccgggccgttaacgaccctgtgggagggcagccccgggaagttctggaataccaccatcgccgtcagtatggcgaacatcttccgcggcagctacctcgctggcgccggactggctttcagcctgatgaagtccctaggcgggggccggcgcgggactggcgcccagggcgagaccttaggggagaagtggaagcggcaacttaaccagctcagcaagtccgagttcaacacctacaagcgctctgggatcatggaagtggaccggtccgaagccaaggaggggttaaagcggggcgagaccactaagcacgccgtgagccgggggcccgccaagctgcgatggttcgtcgagcggaccctcgttaaccccgagggcaaggtgatcgccctgggctgcgggcggggcgcgtggtcctactactgcgccgggcttaagaagggcaccgaggtcaaggggtacaccaagggcggcccggggcacgaggagcccatccccatggccacatatggctgggacttagtgaaacttcacagcgggaaggacgtgtttttcattcccccggagaagtgcgacacccttctttgcgacatcggcgagtccagccccaaccccacgatcgaggagggtcggactctccgcgtcctgaagatggtggagccctggctgcggggcaaccagttttgcatcaagatcctcaacccctatatgccctctgtagtcgagaccctggagcagatgcagcgcaagcacggcgggatgctggtgagaaacccactaagccgcaacagtacacacgagatgtactgggtgagctgcggcaccgggaacatagtctccgccgtaaatatgaccagccggatgctgctaaaccgctttaccatggcccaccgcaagccaacgtacgagcgcgatgtggaccttggcgccggcacgcgccacgtcgccgtggaccctgaggtggccaacctggacatcatcgggcagcggatcgagaacatcaaacacgagcacaagtccacctggcactacgacgaggacaacccctacaagacctgggcctatcacggaagctacgaggttaagccctccgggtcagctagcagcatggtgaacggcgtggtcaagctgttgacgaaaccctgggacgtaatcccgatggtcacccagatcgcgatgaccgataccacgccgttcgggcagcagcgcgtgttcaaggagaaagtggacactcggacccctaaggcaaagcgcgggaccgcccaaattatggaggtcactgcccggtggctgtggggtttccttagccgcaacaagaaaccaaggatctgcacacgcgaggagttcacccggaaggtgcgctcaaacgcggccatcggggccgtgttcgtcgatgagaatcagtggaactccgccaaggaggccgtggaggacgatcgcttctgggacctcgtccatcgcgagcgggagctgcacaagcagggcaaatgcccgacctgcgtctacaacatgatggggaagagagagaagaagctgggcgagttcgggaaggcgaagggctcccgacccatctggtatatgtggctcggcgcccgctttctggagttcgaggctctggggttcatgaacgaggatcactggttcagccgggagaactccctcagcggcgtggagggggaggccctacacaagctgggttacatcctccgcgacatctccaagatccccgggggcaacatgtacgccgacgacacggcgggctgggacacccggataaccgaggatgacctgcagaacgaggggaagatcacagacatcatggagccggagcacgccctgctcgccaagagcatcttcaaactgacttaccagaacaaggtggtccgcgtgcagcggcccgccaagaatggcacagtaatggatgtcatcagtcgccgtgaccagcggggcagcggccaggtagggacctacgggctgaataccttcacgaacatggaggcccagctcatcaggcagatggaatccgaggggatcttcctgccgaacgagctggagacacccaaccttgcggggcgggtgctggactggctggaaaagtacggcgtcgagcgccttaagcggatggccatcagcggggacgactgcgtggtgaaaccgatcgacgaccgcttcgccaccgccctgaccgccctgaacgacatgggcaaggtccggaaggacatcccccagtgggagcctagtaaaggctggaacgactggcagcaggtccccttttgctcccaccatttccatcagctcataatgaaagacgggcgcgagatcgtggtcccgtgccggaaccaggatgagctggtgggcagagcgcgggtgtcccagggggcaggctggacgctccgcgagactgcctgcttaggcaagagctacgcccagatgtggcagctgatgtacttcccgcggcgcgcactgcggctcgccgccaacgccatctgttccgccgtccccgtggactgggtgcccaccagccgcaccacatggagcatccacgcacaccaccagtggatgaccactgaggacatgctgtcggtctggaaccgggtgtggatcgaggagaacccgtggatggaggataagacccgcatcagctcctgggaagacgtgccttacctgggcaagagagaggaccagtggtgcggcagcctcatcggcctgacgccccgggccacctggcccaccaatattcaggtcgccatcaaccaggtgcgacggttgatcggcaacgagaactactccgactatatgacgagcatgaaacgcttcaagaacgagtcagagccggagggcgccctctggtga

SEQ ID NO: 24407 - RNA, 9879 nt, synthetic construct
  misc_feature 1..9879: note = derived and/or modified CDS sequence (opt11) from DENV-1__GU131679__SS-prME
  source 1..9879: mol_type = other RNA
agcgtgaccatgctgctgatgctgatgcccaccgccctggccttccacctcacaacccggggcggggagccccacatgatcgtgtccaaacaggagcggggcaagtctctgcttttcaagacctccgccggcgtgaacatgtgcaccctcatcgccatggacctgggcgagttctgcgaggatacgatgacctataagtgcccccgcatcaccgaggccgagccagacgacgtggactgctggtgcaacgccaccgacacgtgggtcacctatgggacttgtagccaaacgggcgagcaccggcgggacaagcggtccgtggcgctggcgccccacgtgggcttaggtctggagacgcgcacggagacatggatgtcttctgagggcgcctggaagcagatccagcgtgtcgagacctgggcccttcgccaccccgggttcacggtgatcgccctcttcctggcgcacgccataggcaccagcatcacccagaagggaatcatcttcatactgctcatgctggtgacccccagcatggccatgcggtgcgtcggcatcggttcccgcgacttcgtggaagggctgtccggcgccacgtgggtggacgtcgttctcgaacacgggagctgcgtgactaccatggccaaggacaagcccaccctggacatcgagctgctcaaaacggaagtaactaaccccgcggtgctgcgcaagctgtgcatcgaagccaagatctccaacaccaccacagacagcagatgcccaacccagggcgaggccactctcgtggaggagcaggacgccaatttcgtctgccggagaacttttgtggaccgggggtgggggaacggctgcgggctttttggcaaggggtccctgatcacctgcgcaaagttcaagtgcgtgaccaagctcgagggcaagaccgtccagtacgagaaccttaaatactcagtgatcgtgaccgtccacacgggagaccagcaccaggtggggaacgagtccaccgaacacggcaccaccgcgaccatcacgccccaggcccccagcaccgagattcagctgaccgactatggggccctcaccctggactgcagcccccggacgggcctggacttcaacgagatggtcctcctgaccatgaaggagaaggcctggctagtgcacaagcagtggtttctcgatctcccgctgccctggaccagcggtgccagcacctcccaggagacgtggaaccggaaggatctcctggtgaccttcaagaccgcgcacgccaagaagcaggaggtcgtggtattaggcagtcaggagggcgccatgcacaccgccctcacaggggccaccgagatccagacctccggaacgacgaccatctttgctgggcacctgaagtgccgcttaaagatggacaagctcaccctgaagggcatgagctacgtgatgtgcaccggttccttcaagttagaaaaagaggtggccgagacgcagcacggcaccgtgctcgttcagatcaagtatgagggcaccgacgctccctgcaagatccctttcagcacccaagacgagaagggggtgacgcaaaacggccggctgatcaccgccaacccgatcgtgaccgacaaggagaagcccgtcaacattgaagctgaaccgcccttcggggagtcatacatcgtgatcggtgccggcgagaaagccctgaagctgtcctggttcaagaaggggtcctcgatcggcaagatgttcgaggccaccgctcgcggggcgcggcgcatggccatcctcggcgacacggcctgggacttcgggtccattggcggcgtgttcaccagcgttgggaagctggttcaccagattttcggcaccgcttacggggtcctgttttccggcgtcagctggaccatgaagatcgggatcggcgttctgctgacgtggttagggttgaactcccggagcacctccctgagcatgacctgcatcgccgtggggctggtcaccttgtacctcggcgtgatggtgcaagcggactccggctgcgtcatcaactggaagggtcgcgagctgaaatgcggcagcggcatctttgtaacgaacgaagtgcatacgtggaccgagcaatacaagttccaggcggactccccgaagcgcctctccgccgccatcggcaaggcctgggaggagggggtctgcgggatccggagcgcgacacgcctggagaacatcatgtggaagcagatctccaacgagctgaaccacattctcttggagaacgacatgaagttcaccgtggtggtcggggacgtggcgggcatcctggcccaggggaaaaagatgataagaccccagcccatggagtacaagtactcttggaagtcctggggcaaggccaagatcatcggcgcggacgtgcagaatgccacgttcatcatcgacgggcccaacaccccggagtgccccgacgaccagcgcgcctggaacatctgggaagtcgaggactacggcttcgggatattcaccaccaacatctggctcaagttaagggacagttacacccaggtgtgcgaccaccgcttgatgagcgccgcgatcaaggacagcaaggcggtccatgccgacatgggttactggattgaatctgagaagaacgagacctggaaacttgctcgtgcctctttcattgaggtcaagacctgcatttggcccaagtcccacaccttgtggagcaacggtgtgctggagtccgagatgataatacccaagatctacgggggcccgattagccagcacaattatcgcccggggtatttcacacagaccgccggcccctggcacttggggaagctggagctggacttcgacctctgcgagggcaccaccgtggtcgtggacgagcactgcggaaaccgagggccatccctgcgcacgaccaccgtgaccggcaagatcatccatgagtggtgctgccggagctgtacgctaccgcccctgcgcttcaagggggaggacggctgctggtacgggatggagatccggcctgtcaaggagaaggaggaaaacctggtgaagtccatggttagcgcgggcagcggcgaagtcgactccttcagcttggggctcctctgcatctccatcatgatcgaggaagtgatgcgctcgcggtggagtcgcaagatgctgatgaccggtaccttggccgttttcttcctgctgatcatggggcagctcacctggaatgacctgatccggttgtgcatcatggtcggcgcaaacgccagcgaccgcatggggatgggcacgacgtacctcgccctgatggcaaccttcaagatgcgtccgatgttcgccgtggggctcctgttccggcgcctgacctcacgggaggtgctgctcctgacgatcgggctcagcctcgtcgcgtccgtggagctgcccaacagcctggaggagctcggcgacgggttagcgatgggcatcatgatcttgaagctcctgaccgactttcagtcgcaccagctgtgggcgaccctcctgagcctgaccttcatcaagacaaccttctccctccactacgcctggaaaaccatggccatggttctgagcatcgtttccctgtttcccctgtgcctgagcaccacgtcccagaagaccacttggctgcccgtgctcctaggcagcctggggtgcaaaccgctcaccatgttcctgatcgccgagaacaaaatctggggccgcaagtcctggcccctgaatgaggggatcatggccgtcgggatcgtaagcatactgcttagcagtctgctcaagaacgacgtgcccttagcggggcccctgatcgccgggggaatgctcatcgcctgctatgtcatcagcgggtccagcgccgacctgtccctggagaaggccgcagaggtgagctgggaggaggaggccgagcactccggcgccagccacaacatcctcgttgaggtccaggacgacgggacgatgaagatcaaggatgaggagcgggacgacatgcttacgatcctgctcaaagccaccctgctggccgtgtccggcgtgtaccccctctccatccccgcgaccctgttcgtctggtacttttggcagaagaaaaagcagaggtcgggggttctgtgggacaccccctccccgcccgaggtggagcgggccgtcctcgacgacggaatctaccgcatcatgcaacggggcctgctggggcgctcccaggtcggggtgggtgtcttccaggaaaacgtgttccacacgatgtggcacgtgacgcggggcgccgtcctgatgtaccaggggaagcgactcgagccctcttgggccagcgtgaagaaggacctgatcagctacggcggtgggtggcggctgcagggctcctggaacaccggggaggaggtccaggtgatcgcagtggaacccgggaagaaccccaagaatgtgcagaccgcgcccgggacattcaaaaccagcgagggcgaagtcggagccatcgcccttgacttcaagcccgggacctcaggctcacccatcgtgaaccgcgaggggaaaatagtgggcctgtatggcaacggggtcgtgaccacttcaggcacctacgtgtccgcgatcgcgcaggccaaggctagccaggaggggcccctgccggagatcgaggacgaggtcttccggaagcggaacctcaccatcatggacctgcacccaggctccgggaagacccggcgctacctgcccgccatcgtgagagaggccatcaagcgcaagttgcgaacgctgatcctggcgccgacgcgcgtggtcgccagcgagatggccgaggccctcaagggcatgcccatccgctaccagaccaccgccgttaaatccgaacacacgggcaaggagatcgtggacctcatgtgccatgcgaccttcaccatgcggctgctcagccctgtcagggtgcccaactacaacatgataatcatggacgaggcccacttcaccgacccttccagcatcgccgcccggggctacatctcaacgagggtgggcatgggggaggcagcggccatcttcatgaccgccacaccgcccggcagcgtcgaggccttcccccagtccaacgcggtgatccaggacgaggagcgggacatcccggagcgcagctggaacagtgggtatgagtggatcaccgacttccccggcaaaacggtgtggttcgtcccctcgatcaagtccggcaacgacatcgccaactgtctgcggaagaacggtaagcgcgtgatccagctgtctcggaagaccttcgacaccgagtaccagaagaccaagaacaacgactgggactacgtggtcacgacagacatctccgagatgggcgccaatttccgcgccgaccgggtgattgacccccgccggtgccttaagccggttatcctgaaggacgggcccgagcgcgtcattttggccggccctatgcccgttaccgtcgcgtcggccgcccaacggcgcgggcggatcggccgcaaccacaacaaggagggtgaccagtacatctacatggggcagccgctcaacaacgacgaggaccacgcccactggaccgaggccaagatgctgctggacaacatcaacacgcccgaggggatcatacccgccttgttcgagcccgagcgggagaagtccgccgcgatcgatggggagtaccgccttcgcggcgaagccagaaagaccttcgttgagctgatgcgccgcggggacctcccggtgtggctaagctacaaggtcgccagcgagggcttccagtattccgaccgacggtggtgctttgacggcgagcgcaacaatcaggtgctggaagagaacatggacgtggagatttggaccaaggagggggagaggaagaaactgagaccacggtggctggacgcgcgcacctacagcgaccccctggccctccgggaattcaaggaattcgccgccggccgccggtccgttagtggggacctgatcctggagataggcaagctcccccagcacctgacgcagagagcgcagaacgccctggacaacctcgtgatgctacataattccgagcagggcgggcgggcctaccgccacgccatggaggagctgccggacaccatcgagaccctcatgctgctcgccctcatcgcggtcttgaccgggggagtcacgctgttttttctcagcggccgggggctgggcaagacctccatcgggctgctctgcgtgatggcctcctccgtactgctgtggatggcaagcgtcgagccccactggatcgccgcctccatcatcttagagttcttcctgatggtgctgctcatccccgagcccgaccgacagagaaccccgcaggacaaccagctggcgtacgtggtcatcgggctcctcttcatgatactgaccgtggccgccaacgagatgggcctgctcgagaccacgaagaaagacctagggataggccacgtggctgtcgagaaccaccaccacgcagcgatgctggacgtggacctccatcccgccagcgcctggaccctgtacgccgtggccaccaccataatcacgcccatgatgcgccacaccatcgagaacaccaccgctaacatctccctgacggccatcgccaaccaggccgcgatcctcatgggactggataagggctggccgatcagcaagatggacatcggcgtcccactgctcgctctggggtgctactcccaggttaaccccctgaccctaaccgccgccgtcctgatgctggtcgcccactacgcgatcataggccccgggctccaggccaaggccacgcgggaggcccagaagcgcacggccgcgggcataatgaagaacccgactgtggacgggatcgtggccattgagctggaccccgtcgtgtacgacaccaagtttgaaaagcagctgggccagatcatgctcctgatcctgtgcaccagccagatcctcctgatgcgcacgacctgggcactgtgcgagtccatcaccctcgctaccggccccctgacgaccctgtgggaggggagccccggtaaattctggaacaccaccatcgccgtgagcatggctaacatcttccgggggagctacctcgccggagccggcctggccttcagtctgatgaagtccctcggaggcgggcgccggggcacgggagcgcagggcgagaccctgggcgagaagtggaagcgtcagctgaaccagctcagcaagtccgagttcaacacctacaaaagaagcggaatcatggaggtcgaccgctccgaggcaaaagagggactgaagcgcggggagaccacgaagcatgccgtgagccgcggcaccgcaaagctgcggtggttcgtggaaaggaacctggtcaagccggaggggaaggtaatcgacctgggctgcggtcgtggcgggtggtcctactactgcgcagggctgaagaaggtgaccgaggttaaggggtacaccaagggcgggcctggccacgaggagcccatccccatggcgacgtacgggtggaatctggtcaagctccacagcggcaaggacgtgttcttcattccgcccgagaagtgcgacacccttctgtgcgacatcggcgagtccagccccaatccaaccatcgaggagggccgcaccctccgggtcctgaagatggtggagccgtggctaagggggaaccagttctgcataaagatcctcaatccctatatgcccagcgttgtcgagacgcttgagcagatgcaaaggaagcacggcggcatgctggtacgcaatcccctcagtcggaacagcactcatgagatgtattgggtgagctgcggcaccggaaacatcgtcagcgccgtgaacatgacctcccgcatgctgctgaaccggttcaccatggcccaccgcaagccgacgtatgagcgcgacgtggacctcggggccggcacgcggcacgtcgccgtggagccggaggtggcgaaccttgacatcatcggccagagaattgagaacatcaagcacgagcacaagtccacttggcactacgatgaagacaacccctacaagacctgggcctaccacgggtcctacgaagtcaagccctccgggagcgccagctccatggtgaacggagttgtgaagctcctcacgaagccgtgggacgtgatccccatggtcacccagatcgccatgaccgacaccactcctttcggccagcagcgggttttcaaggagaaggtggacacccgtacccccaaggctaagcggggtaccgcgcagataatggaggtcaccgcgaagtggctgtggggctttctgagccgaaacaaaaagccacggatctgcacccgtgaggaattcacccggaaggtacgctccaatgccgccatcggcgcggttttcgtcgacgagaaccagtggaacagcgcaaaggaggccgtggaggacgagcggttctgggatctcgtgcaccgcgagcgggagctgcacaagcagggcaagtgcgcgacctgcgtgtacaacatgatgggcaaacgcgagaaaaaactgggggagttcggcaaggcaaaaggcagccgtgccatctggtacatgtggctcggcgcccgctttctggagtttgaggccttaggtttcatgaacgaagaccactggttcagccgtgagaactccctcagcggggttgagggcgagggtctacacaagctgggctacatcctgcgcgacatctccaagatccccgggggcaacatgtatgccgacgacacagccggctgggacacccggatcaccgaggacgacctgcagaacgaggcgaagatcaccgacatcatggagccggagcacgccctactcgccaagtcaatcttcaagctgacataccagaacaaggtagtccgcgtgcagagaccggccaagaacggtaccgttatggacgtcatttcccgccgagaccagcggggcagcggccaggtgggcacctacgggctgaacaccttcacgaacatggaggcccaactcatccgccagatggagtccgaaggtatcttcagcccctccgagctggaaacccccaacctggcgggcagagtgctggactggctggagaagcacggggtcgagcgcctgaagcgaatggccatatccggagatgactgcgtagttaagcccatcgacgaccgtttcgccaccgccctcaccgccctgaatgacatggggaaggtccggaaggacatcccgcagtgggagccctccaaaggctggaacgactggcaacaggtccccttctgctctcaccacttccatcaactgatcatgaaggacggacgcgagatcgtggtcccctgcagaaaccaggacgagctcgtggggcgcgcgcgggtgagccagggggctgggtggtccctgcgcgagacggcctgcctgggaaagagctacgcccagatgtggcagctcatgtacttccacaggcgcgacctgcggctagcggccaacgccatctgctccgccgtcccggtggactgggtgcccaccagccgcaccacctggtccattcacgcacatcatcagtggatgacgaccgaggacatgttgagcgtctggaaccgggtctggatcgaggagaacccttggatggaggacaagacccacatctccagctggggcgacgtgccctacctaggcaaacgcgaggaccagtggtgcggctccctgatcgggctcaccgctcgggcgacctgggcaaccaacatccaggtcgccatcaaccaggtgcgccgcctgatcggcaacgagaactacctggactacatgaccagcatgaagcgattcaagaacgagatcgacccggagggggccttatggtga

SEQ ID NO: 24408 - RNA, 9879 nt, synthetic construct
  misc_feature 1..9879: note = derived and/or modified CDS sequence (opt11) from DENV-1__GU131680__SS-prME
  source 1..9879: mol_type = other RNA
tccgtgactatgctgctgatgctaatgcctacagccctggcttttcacctcacaacccggggcggggagccacacatggtagtcagcaagcaggagcggggcaaaagcctgttgttcaagaccagcgccggggtcaatatgtgcacgctgatcgcgatggacctgggcgagttgtgcgaagacactatgacatacaagtgcccccggatcaccgaggccgagcccgacgatgtggactgctggtgcaacgccaccgacacctgggtgacgtacgggacctgcagccagacaggcgagcaccgtcgcgaaaagagatctgtggccctcgcgccgcacgtgggcctgggcctggagacgcggacggagacgtggatgagctcggagggcgcctggaagcagatccaacgggtggagacttgggcgctccggcaccccgggttcacagttatagccctgttcctggcgcacgcaatcggcaccagcatcacccagaaggggatcatctttatcctcctgatgctggtcaccccatcaatggccatgcggtgcgtaggcattggctctcgggacttcgtggagggtttgtccggcgccacgtgggtcgacgttgtgctggagcacgggagctgcgtcaccaccatggccaaggacaagcccaccttggacattgagctcctaaagacagaggtgaccaaccccgcggtactgagaaagctctgcatcgaggcaaagatctccaacacgaccactgactcccgctgcccgacccaaggggaagccaccctggtcgaggaacaggacgccaactttgtatgtcgacgaactttcgtcgaccgaggatgggggaacggttgtgggcttttcggcaaggggagcctcctgacgtgcgccaagttcaaatgcgtcaccaagctggagggaaagatcgtgcagtacgagaatctcaagtacagcgtgatcgtcaccgtgcacaccggagatcaacatcaggtcggaaacgagagtacggagcacggcaccaccgcgaccatcaccccccaggctcccacgacagagatccagcttaccgactacggggccctaaccctcgactgcagcccccgaacaggcctcgacttcaacgaaatggtcttactcaccatgaaagagaagtcctggctggtgcacaagcaatggttcctggatctccccctgccgtggaccagtggtgcgtctacctcccaagagacgtggaaccggcaggacctgctcgtcaccttcaaaaccgcccacgctaagaagcaggaagtggtggtgttaggcagccaggagggtgccatgcacactgccctcaccggggccactgagatccagaccagtggaaccacgaccatcttcgctgggcatctcaaatgccgcttgaaaatggataagcttaccctcaaggggatgagctacgtgatgtgtacgggctccttcaagctggagaaagaggtggcggagacacagcacggcaccgtactggtgcagataaagtacgagggcactgacgcgccctgtaaaatccccttcagcacccaggacgaaaagggtgtgacgcaaaacgggcgcctgatcaccgccaacccgattgtcacagacaaggagaaacccgtgaacatcgaagccgaacccccgttcggggagtcctacatcgtgatcggcgctggcgagaaggcccttaagctaagctggtttaagaaggggtccagcatcggaaagatgttcgaagctaccgcccgcggggcccggcgcatggcaatcctgggcgacacggcctgggactttggctccatcggtggggtgttcacaagcgtggggaagttggttcatcaaatattcggcaccgcctacggggtactgttctccggcgtgtcttggaccatgaagatcgggattggcgtgttattaacttggctgggcctgaactcccgcagcacctccctgagcatgacctgcatcgccgtcggtctggtgaccctgtacctcggcgtgatggtgcaggccgactcggggtgcgtgatcaactggaagggcagggaactgaagtgcggttctggcatcttcgtgacgaacgaggtccacacatggaccgagcagtataagttccaggcggacagccctaagcgcctgtccgctgctatcgggaaggcatgggaagaaggggtgtgcggcatccggagcgccaccaggcttgagaacatcatgtggaagcagatctccaatgagctgaaccacatattacttgaaaatgacatgaagttcactgtcgtcgtgggcgatgtggcgggcatcctggtccaagggaagaagatgatccggccccagccaatggagtacaagtacagctggaagtcctggggcaaggccaagattatcggggcggatgtgcaaaacagcacgttcatcatcgacgggcccaacacccccgagtgccccgacgaccagcgagcctggaacatctgggaggtggaggattacggcttcggaatcttcacgaccaacatttggctaaaactccgggactcttacacgcaggtctgcgaccaccggctgatgagcgcggcaatcaaggacagtaaggccgttcacgccgatatgggctattggattgaaagcgagaaaaacgagacctggaagctggcgagggcctcctttatcgaggtgaagacctgcatatggcccaagagccacaccttatggtccaacggggtcctagagagcgagatgatcattcccaaaattcacggggggcctatctcccaacacaactatcgcccggggtactttactcaaaccgccggaccctggcacctggggaagctcgaactggatttcgatctgtgcgaggggaccaccgtagtggtcgacgagcactgtggcaaccgggggccctcattgcgaacgaccactgttaccggcaagatcattcatgagtggtgctgtcggtcctgtacgctgccgcccctgagatttcgcggggaggacggctgctggtacgggatggagatcaggcccgttaaggaaaaggaagagaacctcgtcaaaagcatggtgagcgccggctccggcgaggtggactccttctccctggggctgctctgcatatcgatcatgatagaggaggtaatgcgctcccgctggtcgcggaagatgctgatgaccggcacgctcgccgtgttcttcctactgatcatggggcaactaacttggaatgacttgatacgcctgtgcattatggtgggcgccaacgcgtccgatcgcatgggaatgggtaccacctacctggccctcatggccacgttcaagatgcgaccaatgttcgccgtcggtctattgttccgccgtctgaccagccgagaggtgctgctgctcacgatcgggctctccctggtcgcctcggtggagttacccaactccctggaagagctgggcgacgggctggcgatgggcattatgattctgaagctgctcacggacttccagtcctaccagctgtgggccacactgctgtccctgaccttcatcaagactaccttctcgctgcactatgcttggaagacaatggcgatggttctctccatcgtcagcctgtttccactgtgcctctccaccacgtcacagaaaaccacctggctgcccgtgcttctcggctcccttggatgtaagccgctgaccatgtttctcattgcggagaataagatctgggggcggaagtcatggcccctgaacgagggtatcatggccgtaggtatcgtcagcatcctgctctctagcctgctgaagaacgacgtgccgctcgccgggcccctgatcgctggcggcatgctgatagcttgctacgtgatctcaggctcctccgcggacctcagcctggagaaggccgcggaggttagctgggaagaggaggcagagcatagcggcgcctcccacaacatcctagtggaggttcaggacgacggaacaatgaagattaaagatgaggagcgggatgacaccctcacgatcctgctcaaggccacgctcctggccgtcagcggcgtatatccgctgtcaatccccgcaacactcttcgtctggcacttctggcagaagaagaaacagcgaagcggggtcctatgggacacgcccagcccgcccgaggtggagcgtgccgtgctggacgatggcatctaccggatcatgcaacgcggactgctcgggcggtcccaagtcggcgtgggggtcttccaagagaacgtcttccataccatgtggcatgtaacccgcggcgctgtgctgatgtatcagggcaaacggctggagccgtcgtgggcgagcgtcaagaaggacctaatctcctacggcggcgggtggcggttccagggctcatggaacaccggggaagaggtgcaagttatcgcggttgagcccggtaagaatcccaaaaacgtgcagacggcccccgggacgttcaagacgcccgagggggaagtgggcgccatcgcacttgacttcaaacccggtacctccggcagccccatcgtcaacagagagggcaagatcgtgggcttgtacgggaacggggtcgtcaccacctcgggcacgtacgtctcggcgatcgcccaggccaaggcctcccaggaggggccgctccccgaaattgaggacgaagtgttccgcaagcggaacctgaccatcatggacttacaccccggcagtgggaaaacacgccgctatctcccggcgatagttcgggaagccatcaaacggaagctgcggaccctgatactcgcgcccacacgcgtcgtggccagcgagatggccgaggcgctgaaggggatgcccattcggtaccagactacggccgttaagtccgagcacacaggcaaagagatcgtggatctgatgtgccacgccaccttcacgatgcgcctcctgagccccgtgcgagtaccgaattacaacatgatcataatggacgaggcacactttaccgacccctcctcgatcgccgctcgcggttacatctcgacccgggtggggatgggggaagctgccgctatctttatgaccgccactccacccggcagcatggaggccttccctcagtccaacgccgtgattcaggacgaggagcgcgacatccccgagcggagctggaacagcggatacgagtggataacggatttccctgggaagaccgtctggttcgtacccagcattaaggccggcaacgacatcgccaattgcctgaggaagaacgggaaacgggtaatacaactctcacgcaagaccttcgacaccgagtaccagaagactaagaacaacgattgggactacgtcgtgaccacagacatcagcgagatgggtgcgaacttccgggccgaccgcgtgatcgacccccggcgctgcctgaagcccgtcatcctaaaagacgggcccgagcgtgtgatcttggctggcccaatgccggtcactgtggcctccgctgcacagcgccgggggcgcatcgggcggaaccacaacaaggagggcgaccaatacatctacatgggacagcccctgaacaacgacgaggaccacgctcactggaccgaagccaagatgctactagacaacataaacacccctgaaggtataatacccgctctgttcgagccggagcgcgagaagtctgccgcgatcgatggggagtaccgcttgcggggcgaggcccgcaagaccttcgttgagctcatgagacgcggagatctgcccgtctggctgagttataaagtggcgtctgagggattccaatacagcgaccgccgctggtgcttcgacggcgagcgtaataaccaggtattggaggaaaacatggacgtcgagatatggacaaaggagggggaacgaaagaagttacggccgcgatggctggacgcccggacgtattccgacccgctcgcccttcgtgaattcaaggaattcgctgctggccggcgctcggtgtccggggacctgatcctcgaaatcggcaagctgccccagcacctgacccagcgcgcgcagaacgccctcgataatcttgttatgctgcataattcggagcaaggcgggagagcgtaccgccacgccatggaggagctccctgacactatcgagaccctgatgctgctcgcgctgatcgcagtcctgacgggaggggtgacccttttctttctgtccggcaaaggcctgggcaaaacgagcatagggcttctctgcgtgatggcaagcagcgtccttctatggatggcctccgtggagccccactggatcgcggccagcatcattctggaattcttcttgatggtgctcctgatcccggagcccgatagacagcggacgccccaggacaaccaactcgcctacgtcgtgatagggctcctgttcatgattctgacggtggccgccaatgaaatgggcctcctggagacgactaagaaggacctgggcatcggccacgtggccgtggagaaccatcaccacgcagccatgcttgacgtggacttacaccccgcctcggcgtggactctgtacgccgtcgccacgacaatcatcaccccgatgatgcgccacaccatagagaatacgacggcgaacataagcctcactgccatcgcgaaccaggccgcgatcctgatggggctggacaaagggtggcccatctccaagatggatatcggggtcccactcctggccctggggtgctacagccaggtaaacccactcaccctgaccgccgcagtgctgatgttagtggcccactacgccattatcgggccggggctgcaagccaaggcgacgcgggaggcacaaaagcgcaccgccgccgggatcatgaaaaaccccaccatcgacggtatcgttgcaatcgatctggatcccgtcgtgtacgacgcgaagttcgaaaagcagctcggacagatcatgttactaattctgtgtacctcccagatcctgctgatgcgaacaacctgggccctgtgcgagagcatcaccctggccaccggccccctgacgacactctgggaggggtccccgggcaagttctggaacacaaccattgccgtgtccatggccaatatctttcgggggtcttaccttgctggggcaggcctggccttcagcctcatgaagtccctagggggcggccggcgggggacgggtgcccaaggcgagaccctcggtgagaaatggaaaaggcagctcaaccagctgagcaagagcgagttcaacacttacaaaagatccgggatcatggaagtcgaccgcagcgaggcgaaagagggccttaagcgaggggagaccacaaagcacgcggtctcgcgcggtactgcgaagctccggtggtttgtggagcggaacctagtcaagcccgagggtaaggtgatcgacctaggttgcggccgcgggggttggtcttactactgcgccgggctgaagaaggtgaccgaggtgaagggctacactaagggcggtcccggccacgaggagcccatcccaatggccacgtacggatggaacttagtgaaattacactccggcaaggacgtgttttttatccctcccgaaaagtgtgatactcttttatgcgatattggggagtcgtcccccaacccgaccatcgaagagggacgaaccctgcgggtcctgaagatggtagagccctggctcaggggtaaccaattctgcatcaagatcttaaacccatacatgcccagtgttgtcgaaacattggaacagatgcagcgcaagcacggcggcatgctcgtgcgcaacccactgagtaggaacagcacccacgaaatgtattgggtttcttgtgggaccggcaacatcgtcagtgcggtgaacatgacctcccgcatgctgctcaaccgctttaccatggcccacagaaagccgacgtacgaacgcgacgtggacctgggggccggcacgcgccacgtcgccgtcgagcccgaagtggccaatctggatatcatcggccagcgcatcgagaacatcaagcacgagcacaaaagcacctggcattacgacgaggacaatccctataagacgtgggcgtatcatgggagctacgaggtcaaaccgagcggctccgccagcagcatggtcaacggagtcgtaaagctcctgacgaagccctgggacgttatacccatggtcacccagatcgcgatgaccgacacgacgcccttcggccagcagcgggtgtttaaagagaaggtggacacccgcaccccgaaggccaagcgggggaccgcgcagatcatggaggtaaccgcgcgatggctgtggggtttcctctcgcggaacaagaagccccggatttgcacccgtgaggagttcactcgcaaggtgcgttccaacgccgccatcggcgcagtgttcgtggacgagaaccagtggaactccgcaaaggaggccgtggaggatgaccgcttctgggatctcgtgcatcgggaacgcgaactgcacaaacaggggaagtgcgcgacctgcgtctacaacatgatgggcaagcgggaaaagaagctcggcgagttcggcaaggccaaggggagccgtgccatctggtacatgtggctgggcgcacgatttctggagtttgaagctctcggctttatgaatgaggaccactggttttccagagagaatagcctgtccggggtggaaggcgaagggttgcataaactcggctacatcctgcgtgacatttccaagatccccggtggcaacatgtacgccgatgacacagccggctgggacacacggattaccgaagacgacctgcaaaacgaggccaagatcaccgacatcatggagccggaacacgcgctgctagccaagtccatcttcaaattgacgtaccagaacaaagtggtacgagtgcagcgtcccgccaagaacggtactgtaatggacgtcatcagccgccgggaccagcgcggcagtggccaggttggtacctatggcctcaacaccttcacgaacatggaagcccagttaatccggcagatggagagtgaggggatattcctgcctaacgagctcgagaccccgaacctggcgggtcgcgttttagactggctcgaaaagtacggggtagagaggctgaagcgcatggcaatctccggtgacgactgtgtggtcaaacctatcgacgaccggttcgcgaccgcccttaccgccctgaatgacatgggtaaagtccgcaaggacatcccgcagtgggagccctcaaaaggctggaacgactggcagcaggtccctttctgctctcaccacttccaccagctgatcatgaaggacggccgggagatcgtggtcccgtgccgcaaccaggacgagctggttgggcgtgcccgcgtgagccagggtgcggggtggtcccttcgagagacggcgtgcctgggcaagtcctacgcccagatgtggcagctgatgtacttccatcgccgggacttacggctggccgccaacgccatttgcagcgccgtaccagtagactgggtcccgacatcccggacgacctggagcatccatgcgcaccaccagtggatgacgaccgaggacatgctgtccgtctggaatagggtctggatcgaggaaaacccctggatggaggacaagacccggatcagcagttgggaggacgtgccctacctcggcaaaagggaagaccaatggtgcggctccctgatcggcctgacggcacgcgcgacttgggccacgaacatccaggtcgccataaatcaggtgaggcggcttatcggcaacgaaaactactccgactacatgaccagcatgaagcgtttcaagaacgaatccgaacccgagggcgccttatggtag

SEQ ID NO: 24409 - RNA, 9879 nt, synthetic construct
  misc_feature 1..9879: note = derived and/or modified CDS sequence (opt11) from DENV-1__GU131681__SS-prME
  source 1..9879: mol_type = other RNA
tcggtgactatgctcctcatgctaatgccgacagcccttgcgttccacctaacaaccaggggaggcgaaccccatatgatagtgacaaaacaagaacgcggtaaatcgctgctgtttaaaacttctgccggggtaaacatgtgcacccttattgccatggacctaggagaattgtgcgaagataccatgacatacaagtgcccgaggattacagaagcagaacccgacgacgtggattgctggtgcaatgcgactgacacatgggtcacctacggaacatgcagtcaaaccggcgaacaccgacgcgacaaaaggagcgtggccctcgcaccccacgtaggcctaggcctcgaaactcgtacagaaacctggatgtcttcagaaggggcgtggaagcagatccagagggtagagacatgggctctccggcaccctggcttcactgtgatagcacttttcctcgcgcacgcgataggcacctctattacacaaaagggtatcatattcatcctactaatgctcgtcacgccctctatggccatgcggtgtgttggaatagggagccgagatttcgtagaggggctaagtggagcaacgtgggtcgacgtagtactggaacacggatcttgcgtgacaacaatggcaaaagataaaccaaccctagacatagagctcctcaagacggaggtaacgaacccggccgtgctaaggaaactttgtatagaggcaaagatcagtaacacgacaaccgactccagatgtccgacgcaaggagaggcaacccttatggaggaacaagacgcaaacttcgtgtgtagaaggaccttcgttgaccgcggctggggaaacggctgtggtttattcgggaagggaagtctaatcacgtgtgcaaagttcaaatgcgtgacgaaactcgaaggaaaaatcgtccagtacgaaaatttgaaatactccgtcatagtcaccgtccacacaggcgaccaacatcaggtggggaacgagagcacggaacacgggacgaccgctacaattacaccccaagcgcctacaagcgaaatacaactgacagactacggagcgctcacgcttgattgctcaccgagaaccggcctcgactttaatgaaatggtattgttaacgatgaaggaaaagtcgtggctagtccataagcaatggtttctcgaccttcccctcccgtggacgtcgggagcgtccacctcacaagagacctggaaccgccaagacctcctggtgacattcaaaacagcgcacgcaaagaaacaagaagttgtagtacttggcagtcaagagggcgccatgcacacggccttaacaggagccaccgaaatacaaactagcggcaccaccacaatattcgctggtcatctcaagtgtcgactcaaaatggacaaactgaccctaaaaggaatgtcttacgtcatgtgcaccggttccttcaaacttgaaaaagaagtggcggaaacccagcacggtaccgtcctggtccaaatcaaatacgaagggacagacgccccatgcaaaataccatttagcacacaggatgaaaagggagtaacgcagaacgggcgacttattaccgcgaaccccatcgtgacagataaagaaaaaccggtcaacatagaagcggagcccccgttcggagaaagctacatagttataggcgcaggagaaaaagcgttaaagttgagttggttcaagaaaggaagcagtattggaaagatgttcgaagcaactgcccgcggtgcaaggaggatggcgatcctaggcgacacggcgtgggacttcggttccataggcggagtcttcacctccgtcggcaaactcgtacatcagattttcggtacagcctacggtgtactcttttcaggagtctcgtggaccatgaaaattggcattggagtactcctaacctggctcggcctcaactcacggtcaacatccttatcaatgacttgcatagccgttggccttgttacactctacctgggagtcatggtgcaggcagacagtggatgtgtgattaactggaaaggaagagaattgaaatgcggtagcggaatctttgtgacaaatgaagtgcatacctggaccgaacaatacaaattccaagcagacagccccaagcgcctcagtgcagctatcggaaaggcctgggaagaaggtgtgtgcggaatacgaagcgctacacgcctagaaaatatcatgtggaagcaaataagtaacgagctgaatcacatactgctcgagaatgacatgaaattcactgtggttgtcggcgacgtagtaggcatcctagcgcaagggaagaaaatgataaggccacagccgatggagcacaagtatagctggaaaagctggggaaaggcaaagattatcggggccgacgtccaaaacacaacattcataattgatggccctaacacaccggagtgccccgacgatcagcgggcctggaacatatgggaagtcgaagattacgggttcggaatctttacaacaaacatctggttaaaattaagagactcgtacactcaagtctgcgaccaccgactgatgtcagcagccataaaggacagtaaagcggtacacgcagacatggggtattggatcgaatcagagaagaacgaaacatggaaactcgcgcgagcgtcctttatagaggttaagacgtgcatatggccaaagagccacaccctgtggagtaacggagtccttgaaagcgaaatgattattccgaagatctatggagggccaatctcgcagcacaattaccggcccggctacttcacccaaaccgcagggccctggcatctaggaaaacttgaactagacttcgatctctgcgaaggcacgaccgtagtagtagatgaacactgcggcaaccgaggtccgagcctgcgcacaacaaccgtaaccggcaagattatacatgagtggtgctgcagatcctgcaccctaccacctttgcgattcaagggggaagacggctgctggtacggcatggaaattagacctgtaaaagaaaaagaagaaaatctagtgaaatcaatggtgtcggcaggaagcggagaagtagatagcttctcacttgggttactctgcatctccataatgatcgaggaagtgatgaggtcaagatggagtaggaaagtactcatgactggcacgcttgcagtattcctactactcataatgggccaactaacatggaacgacctcatcagactatgtatcatggttggcgccaatgccagcgacagaatgggcatggggactacgtacctagcgttaatggctacctttaaaatgagaccaatgttcgcggttggcctgctgttccgacgactgacaagccgcgaagttttactcttgacgatagggctcagcctagtagcctcagtagagctcccaaactcactcgaagaactaggggacgggttggccatgggcatcatgatactcaaactattgacagacttccaatctcaccaactgtgggctacactgctatcacttaccttcataaagacaacgctgtcattacactacgcttggaagacaatggcaatggtgctatcgatagtatccctattccccttatgtctctcgactacttcccaaaagacaacgtggctcccagtccttcttggatccctcggatgcaagcccctcacaatgttcctcatagctgaaaacaaaatctggggacggaagtcatggcctctcaatgagggcataatggccgtgggggtcgtcagcatcctcctaagttcacttttaaagaatgacgttccactcgctggaccgctgattgcgggcgggatgctcatcgcatgctacgtaatatcggggtccagtgctgacctttcacttgagaaggcggcagaagtaagctgggaagaggaggccgaacacagcggagcctctcataatatcctggtcgaagtccaggacgacgggacaatgaagataaaagacgaagaaagggatgacacgctcaccatcttactcaaggcaacactactggctgtctcgggagtctacccactaagcatcccagcaaccttattcgtatggtacttctggcagaaaaagaaacagcgaagcggggtgctctgggataccccctctccacccgaggtagaacgtgcggtactggacgatggcatctaccgaatcatgcagcggggactacttggcaggtcccaagtcggcgtaggcgtgttccaagagaacgtattccacacgatgtggcatgtcacacggggagccgtcctaatgtatcaaggtaaacgactagaaccatcatgggccagcgtcaaaaaggaccttatatcgtatggaggaggctggaggctacagggcagctggaataccggcgaagaagtgcaagttatcgccgtagaaccaggcaagaaccccaaaaacgtacagacagcaccagggaccttcaaaacacccgagggcgaagtgggcgctatcgcacttgatttcaaaccgggtacatccgggagcccgattgtaaatcgggagggtaaaatagtaggattatacggcaatggcgtcgtaacaacatcaggcacgtacgtcagcgctatcgcacaggcaaaggcttcacaagaggggccactaccggaaatcgaggacgaagttttccgtaagaggaacctgacgatcatggatctgcaccccggatcagggaagaccagacgatatctaccagccatcgtaagagaagcgataaaacgtaaactacgtacactgatactcgcccctacccgggtagtcgcgtcagagatggcggaagccctcaaagggatgcccatccgctaccagacaaccgcggtcaagtcggaacacacgggaaaagagatagtggaccttatgtgccacgcgaccttcaccatgcgcctcctatcacccgtacgcgtccctaattacaacatgattatcatggacgaagcccacttcacagacccaagtagcatcgcagcacgcgggtacatctcaaccagagttggcatgggtgaagccgccgcaatttttatgacggcgaccccgcctggttcagttgaagcatttccccaatccaatgcggtcatacaggacgaggagcgcgacatacccgagcgcagctggaatagcggatacgaatggatcactgacttccccggtaagacagtttggttcgtgccaagcattaaatccggaaacgatatagcaaattgcttgcgcaaaaacggcaaacgtgtgatacaactgagcagaaagacgtttgacactgagtaccagaaaacgaaaaacaacgactgggactacgtagtcacaacggacatcagtgagatgggagccaatttcagagccgatcgcgttatagaccctcgacgatgtctaaagccggttatcctcaaagacggcccagagagggtgattctcgccggacccatgccggtgacagtcgccagcgctgcgcaacgccggggacgaatcggccgcaaccacaacaaagaaggcgaccaatacatctacatgggccaaccattaaacaacgacgaggaccatgcccattggaccgaagcaaaaatgcttctggacaacataaatacacccgaagggataatacccgctctcttcgaacccgaaagagaaaagagtgccgcaatcgacggcgagtatcgactacgcggagaagcccgcaaaaccttcgtcgaactgatgcggagaggcgatctaccagtctggcttagctataaggtagcatcagaaggcttccaatactccgacagacgatggtgtttcgacggggagcgtaacaaccaagtacttgaggaaaacatggacgtcgagatctggacgaaggaaggagagagaaagaaactacgacctaggtggctggatgccagaacatactcagaccctcttgcccttcgggagtttaaagagttcgcagcaggcagacgctcagttagcggggacctaattctagaaattggcaaattgccacaacaccttacacagcgagcacaaaacgccttggataacctcgtaatgcttcacaacagtgagcaaggcggccgagcctacaggcacgcgatggaggagctacctgatacgattgaaactctgatgctgctagccttaatagcagtccttacgggcggggtaacgctattctttctgagcgggcgggggctcggaaaaacctcgataggactgctctgcgtcatggcatcatccgtactactttggatggcatcagtggaaccacactggatagcggcaagcataattctggagttcttcctgatggtgctcctaattccggagcctgatcgacaacgcaccccacaggacaaccagttagcgtacgtagtaatcggactcctcttcatgatcctcacagtggccgccaacgaaatgggactacttgagacaaccaagaaagacctgggaatcggacatgtggcagtggagaaccaccaccatgctactatgctagatgtggatctacacccggcctcggcatggactctatacgcggtagcgacaacaataatcacacctatgatgagacacactattgagaataccaccgcaaatatcagtctcacagcgatcgccaaccaagcagccatattaatgggcctggacaaggggtggcctatctcgaagatggatatcggcgtacccttgctagcgctgggatgttactcccaggtaaacccactaacgttaactgcagcagtgctgatgctggtagcgcactacgccatcatcgggcccgggctccaggcgaaagcaacgcgcgaagcgcagaagcgaacagcggccggaataatgaaaaaccctacggtagacggcatcgtcgcgatagacttagaccccgtcgtgtatgacgccaagtttgaaaaacaacttgggcagataatgttgttaatactatgcacgtctcaaatacttcttatgagaacgacgtgggcgttatgtgaatcaataacactagcgaccggcccgctcaccaccctatgggagggctcaccggggaagttctggaacaccacaatagcagtcagcatggccaacatatttcgagggtcatatcttgcaggggcaggactagcattctcactcatgaaaagtctaggaggaggacgccgagggactggcgcccaaggagaaacccttggagaaaaatggaaacgccaattaaaccagttaagtaagtccgagttcaatatctacaagcgctcaggcattatggaggtagaccgaagtgaggccaaggaaggactaaagagaggagaaaccaccagacacgcggtctcccgaggaaccgcaaagctgcgttggttcgtagaacgaaatctggttaagccggaaggaaaagtgatcgatctagggtgcggacggggaggatggtcatattactgcgccggtctcaagaaagtgaccgaggtcaaaggctacacaaaaggaggtccaggccacgaggagccaatcccaatggctacgtacggatggaatctggtgaagctccacagcggaaaagacgtcttcttcacaccacccgaaaaatgcgatacgttgttatgcgacattggagaaagtagcccaaacccgaccatcgaggaaggacgaactctaagagttttaaaaatggtcgaaccatggttacggggaaaccaattctgtataaagatcttgaatccgtacatgccttcagtcgtagaaacgctcgagcaaatgcaacgaaagcacggcggaatgctggtccgtaacccattatcacggaactcaacacacgagatgtactgggtgagctgcggcacaggaaacatagtaagcgccgtgaacatgacgtcccgcatgttgttaaataggtttacaatggcgcataggaagccgacatacgaacgagatgtagatctaggagcaggcactaggcacgtggcggtggaacctgaagttgcaaatcttgatattatagggcaacggatcgaaaacatcaaacacgaacacaaaagtacttggcattacgacgaagataacccgtataaaacatgggcatatcacggttcctatgaggtgaagccaagtggatccgccagtagcatggtaaacggagtggtaaaactgctgacgaaaccgtgggacgtgataccgatggtaacgcaaatagctatgaccgacacgaccccgtttggccagcaaagagtcttcaaagaaaaagtagacacgcgaactccaaaggcaaaaagaggaacagcgcagataatggaagtcacagcccgctggttgtgggggttccttagccggaacaaaaagcctcgcatatgcacgagagaagagttcactcgaaaagtccgtagtaacgcggcaataggggcagtattcgttgacgagaaccaatggaacagcgcaaaagaggcggtggaggacgagcgattctgggacctagtacaaaaagagcgtgaattgcacaagcagggcaagtgcgcaacctgcgtatacaacatgatggggaaaagagagaagaaactgggggagttcggaaaagcgaaaggatcacgggcgatctggtacatgtggctgggcgcgcggtttctagagttcgaggcattaggctttatgaacgaggatcactggttcagccgcgaaaattccctctcgggagtcgaaggtgaggggcttcataagctcggctatattctacgagacataagcaagatcccagggggcaatatgtatgcggacgataccgctggctgggacacccgcataaccgaagatgacctgcaaaacgaggccaaaataacggacatcatggagcccgaacatgctttactagctacaagcatcttcaaacttacataccaaaacaaagtagttagagtccaacggcccgcaaagaacggcactgtaatggatgtcatttcgagacgggaccaacgaggctctggacaagtcgggacatatggcctcaacacttttaccaacatgggtgctcagctgatccgacaaatggagtcggaaggtatcttctccccatcggagctagaaatcccaaatctagcggaacgagtgctggactggctggagaaatacggggtggagcgcctgaaacgcatggcgataagcggagacgattgcgtcgtaaaacccatagatgaccgcttcgcgacagctctcacggcgctgaacgacatgggaaaagtaagaaaagacgtccctcaatgggagccctctaagggatggaatgactggcagcaggtcccattctgcagtcaccactttcaccaattaataatgaaagacggcagagaaattgtggtgccatgccgaaaccaagatgagctagtcggtagggcaagagtaagccaaggcgccggatggagtctccgagagaccgcctgcctaggaaagagctacgcacagatgtggcagctaatgtatttccaccgacgcgatctacgcctggctgcaaacgccatctgctcggcagtgccagtcgactgggtaccaacatcgaggactacatggtcaatacacgcccatcaccaatggatgaccactgaagacatgctttcggtgtggaaccgcgtgtggatcgaagagaacccttggatggaggataaaacgcacgtatcctcctggggcgacgtaccgtacttgggaaagagagaagatcaatggtgcggcagcctaattggcctgaccgcacgggcaacgtgggcaagtaacatacaggtagcaataaatcaagtcagacggctgataggcaatgagaattacctcgactacatgacatcgatgaagcgtttcaagaacgaaggcgatccggagggagccctgtggtaa

SEQ ID NO: 24410 - RNA, 9879 nt, synthetic construct
  misc_feature 1..9879: note = derived and/or modified CDS sequence (opt11) from DENV-1__GU131682__SS-prME
  source 1..9879: mol_type = other RNA
tctgtgaccatgcttcttatgctgatgcctaccgctctggcgttccacctgaccacccgtggcggcgaaccccacatgatcgtatccaagcaggagcggggcaagagcttattgttcaagaccagtgccggggtgaatatgtgcaccttaatcgcgatggatttaggcgagctgtgcgaagacacaatgacgtataagtgtccccggatcactgagactgagcccgacgatgtggactgctggtgcaatgcaaccgacacctgggtaacctacgggacctgctctcaaacgggggaacaccggcgggacaaacggtcggtagccctcgctccccacgttgggctggggctggaaactcgcactgagacctggatgagctccgaaggcgcgtggaagcagattcaacgagttgaaacgtgggcccttcgtcatcctgggttcactgtgattgccctgttcctggcacacgtaatcggcaccagcatcacccagaaggggatcatcttcatcttgctgatgctggtcacgccctctatggcgatgcgttgcgtgggcatcggctcccgcgacttcgtcgaaggactctccggcgccacctgggtagatgtcgtcttggaacacggtagctgtgtcaccaccatggccaaagataaacccacgctggacattgaactgctgaagaccgaggtgacaaaccccgccgtcctccggaaactctgcatcgaagccaagatcagtaacacgacgaccgacagccgctgcccgacccagggagaagcaaccctggtagaggaacaagacgccaacttcgtgtgtcggcgcacgttcgtggatcggggctggggtaacggatgtgggctattcggcaaggggtcccttatcacgtgcgccaagttcaagtgcgtcaccaagctggaaggcaagatcgtacagtatgaaaacctgaaatacagcgtaatcgtgaccgtacacacaggcgatcagcaccaagtaggaaacgaaagcaccgagcacggcaccactgccaccatcacgccccaggcccccaccacagagatacaactcactgattacggggcgctgacgctggactgcagcccacgcactggcttggactttaacgaaatggtgctgttaaccatgaaggaaaaatcctggctcgtgcacaagcagtggtttctggacctgcccctgccctggaccagtggagcaagcacctcccaagaaacgtggaatcggcaggacctgctggtcaccttcaagactgcccacgctaagaaacaggaggtcgttgtattgggcagccaagagggcgccatgcacacagctctgaccggggccaccgagatccaaacctctgggacgaccaccatcttcgccgggcacctgaagtgccgcctcaagatggacaagttgaccctgaagggcatgagttacgttatgtgtacaggctcctttaagctggagaaggaagtggcggagacccagcatggcactgtactggtgcaaatcaagtacgagggcactgacgcgccctgcaaaattccttttagcacgcaggacgagaagggggtgacccagaacggccggctcatcactgcgaatccgattgtcaccgacaaagagaagcccgtgaacatcgaggccgaaccgcccttcggagagtcctatatcattatcggagccggggagaaagccctgaaactgagctggtttaagaaggggagctccatcggcaagatgttcgaggctacggccagaggggcccgacgcatggcgatcctgggagatacggcctgggacttcggttccataggcggggtttttacaagcgtagggaagctggtgcatcagatcttcggcaccgcctacggggtactgttctccggagtaagctggaccatgaagatcgggattggcgtgctgttgacctggttgggactgaattcgcgcagcacctccctgagcatgacatgtatcgcagtagggttagtcacactatatctgggcgtcatggtccaggccgactccgggtgtgttatcaactggaaaggcagggagctcaagtgtgggtcaggcatcttcgtaacgaacgaggtgcacacctggaccgaacaatataagttccaggcagacagcccgaagcgcctgtccgcggccatcggcaaggcctgggaggagggggtctgcggtattcgatctgcaacccgcctggagaacatcatgtggaagcaaatctcaaatgagttgaaccacatcctgctggagaacgatatgaagttcacggtagtggttggggatgtagcaggcatcctcgctcaggggaagaagatgatccggccgcaacccatggaacataagtacagctggaagtcctggggcaaggcgaagatcattggcgctgatgtgcagaacacgactttcataatcgatgggcccaatacgccagaatgcccagatgatcagcgcgcgtggaacatctgggaggtagaagactacgggttcggcatcttcacgaccaacatttggttgaagctgagagatagctatacccaggtctgcgaccatcgcctcatgtctgccgccatcaaggatagcaaggccgtacacgccgacatgggctactggatcgagtcagaaaagaacgagacctggaagctggcccgagctagcttcatcgaagtcaagacgtgcatttggcctaagtcccataccctatggagcaacggtgttcttgaatctgaaatgatcatccccaagatttacgggggcccgatctcacaacacaattacagacccgggtatttcacgcagaccgcaggcccctggcacctaggcaagctggagttggacttcgacctgtgcgagggcactaccgtggtagtggatgagcactgcggcaatcgcggtccctccctccgcaccaccacggtgacgggtaagatcatccacgaatggtgctgtcggagctgcaccctgccgcccctgcgctttcgcggggaagatggctgctggtatgggatggagatccgacctgtcaaggaaaaggaggaaaacctggtaaagagcatggtgtcagccggaagcggagaagtcgattccttcagcctggggctgctatgcatatccatcatgatcgaggaggtgatgcggagcagatggtcccgaaagatgctgatgaccggcacgctagccgttttcttcctgctgatcatggggcagctcacatggaacgacctaatcagactatgcattatggtcggcgcgaacgcctcagaccgcatggggatgggcaccacctacctggcgttgatggccactttcaagatgcggccgatgttcgccgtcggcctcctttttcgccggctgaccagccgggaggtgttgttacttaccatcggactcagcctggtcgcctccgtggagctgcccaatagcttagaggaactcggagacggactggcgatgggtattatgatcctcaagctactcaccgattttcagtcacaccagctctgggcgacgctgctgagcctaacattcattaagaccaccttttctctgcactacgcgtggaaaacgatggccatggtgctgagcattgtgtccctcttccccttgtgcctgagcacgacatcccagaagactacgtggctgccagtgttgttgggcagcttagggtgtaaaccactgactatgttcctcatcgccgagaacaagatatggggcaggcgctcctggcccctcaacgaaggaatcatggctgtcggcatagtaagcatcttgttgtccagcttactgaagaacgatgtgcctctggccggacccctcatcgcgggcggtatgttaatagcctgttacgtgatcagcggatcttcggcggacctgtccttagagaaagccgcggaagtgagctgggaggaggaggccgagcactccggcgcgagccacaacatcctggtggaagtccaagacgacggtactatgaaaatcaaggacgaggaacgggacgacacgctgaccatccttctaaaagccacactgctggcggtctccggcgtgtatccgctgagcatccccgcgaccttgttcgtctggtacttctggcaaaagaagaagcaacgatcaggtgtgctctgggacacccccagcccccccgaggtagagagagccgtcctggacgacggcatttaccgcatcatgcagcggggcttgctcgggcgctcccaggtgggtgtgggggttttccaggagaacgtgttccacaccatgtggcacgtaactcggggcgcggtgttaatgtaccaggggaaaaggttagagccctcatgggcctccgtgaagaaagacctgataagctacggcggaggctggcggctccagggctcctggaacactggcgaggaggtgcaggtaatcgcggtggagccggggaaaaaccctaagaacgtgcaaaccgcacccgggaccttcaaaacgcccgagggagaggtcggggctatcgccctcgatttcaagccaggaacctccgggtcccccatcgtgaaccgcgaggggaaaattgtgggcttatacggcaacggcgtcgtcaccacgagcggcacttatgtcagtgccatagcacaagccaaggcctcccaggaagggccactcccggagatagaagacgaggttttccggaagcgcaacctgaccattatggatctacaccccgggagcgggaaaacacggcgctacctcccggccatcgtacgtgaggccatcaagagaaagttacgcactctgatactcgcccccacgcgtgtagtagcctccgagatggccgaggccctgaagggcatgcccatccgctatcagacaaccgcggtgaagagtgagcataccggcaaggaaatcgtggacctcatgtgccacgctactttcaccatgaggctcctgagtccggtccgcgtacctaactacaacatgataatcatggacgaggcacatttcaccgatccaagctccatagccgcgcgggggtacatcagtacacgcgtgggtatgggggaagcggccgccatcttcatgacggccacgcccccggggtccgtcgaggcattcccgcaaagcaacgcggtgatacaggatgaggaacgggacatccccgagcgttcctggaacagcgggtatgaatggatcacggatttcccgggtaaaaccgtgtggtttgtcccctccattaagagcggcaacgacatcgccaactgtctgcggaaaaacggaaagcgcgtaatccaactttcccggaagacgttcgacaccgagtaccagaaaacaaagaacaacgattgggattacgtggtcacgacggatatcagcgagatgggcgcaaatttccgcgccgacagagtgatagacccccgccggtgcttgaagcccgtcatcctgaaggacgggcccgagagagtcatactggcgggccccatgccggtgaccgttgcctccgcagcgcaacgccgagggcggatcggccgcaatcacaacaaggagggtgaccagtacatctatatggggcagccgctgaacaacgacgaggaccatgcacattggacagaagcgaagatgctgttggataacatcaacacccccgagggtatcattcccgccctgttcgagccggagcgcgagaagtccgccgccatcgacggtgagtaccgcctacgcggtgaggctaggaagacgttcgtagagctcatgcgaagaggggacctgcccgtgtggctgagttacaaggttgcgagcgagggcttccagtacagcgaccgaaggtggtgctttgacggtgagcgcaacaaccaggttcttgaggagaacatggacgttgagatttggaccaaggagggggagcggaagaagttgcgcccccgatggttagacgcaagaacgtatagcgatcccctcgccttaagagagttcaaggaattcgccgccggccggcggagcgtcagcggggacctgatattggaaatcggaaaactgccgcagcacctgacacaacgagcgcagaacgcgctcgacaacctggtgatgctgcataacagcgaacagggcggccgggcctaccgccacgcaatggaggagctccccgatacgatcgagaccctgatgctgctggcactgatcgccgtgttgaccggcggggtcaccctcttcttcctgtccggccgggggctgggaaagacaagcataggcctactgtgtgtgatggcctccagcgtgctgctctggatggcctccgtagagccgcactggatcgccgcgagcatcattctggaattcttcctaatggtgctcctgatccccgaaccggatcggcaacggactccccaggacaaccagctggcctacgtcgtaattgggctactatttatgatcctgacggtcgcggcaaacgagatgggattactagagacaacgaagaaagacctcgggatcggccatgtggccgtcgaaaatcatcaccacgcggccatgcttgacgtggatctgcacccggccagcgcctggacgctatacgcagtggccaccacgatcatcaccccaatgatgagacacacgatcgagaacaccaccgcaaatatttcactcaccgccattgccaaccaggccgcgatcttaatggggctggataaaggatggcccatctcaaagatggacatcggcgtccctttactggctctggggtgctacagccaagtgaacccgctcacgctgaccgccgccgtgctgatgttagtcgcgcactacgccatcatcggaccgggcctacaggccaaggccaccagagaagcccagaagaggacggcggccggcatcatgaagaatccgactgttgacgggattgtggccatcgacttagatcccgttgtgtatgacgctaaattcgagaagcagctcggccagataatgttgttaatcctctgcacctcgcagatcctgctgatgcgcacaacctgggccctctgtgagagcataacgctggcgaccggccccctgaccaccctctgggaagggtccccgggcaagttctggaatacaaccattgccgtgagcatggcgaacatctttcggggaagctacttggccggcgctggcctggccttcagcttaatgaaatccctgggcggcgggcgccgggggacaggcgcccagggggagaccttaggcgagaagtggaagcgccagctgaatcagctgtctaaatcagagttcaacacttacaaaaggtctggcattatggaggtcgacaggagcgaagctaaggaaggcctcaagcgtggggaaacaaccaaacacgcggtgagtcggggcactgcgaaactccggtggtttgtagagcgaaacttggtaaagcccgagggcaaggtgatcgacctggggtgcggtcgcgggggctggtcttactactgtgctgggttgaaaaaggtaacagaagtcaaagggtacaccaagggcggccccggccacgaggagcccatcccgatggctacctacgggtggaacctcgtgaagcttcactccggcaaagatgtgttcttcattccacccgaaaaatgcgacacacttctctgcgacattggagagagctcccccaacccgacgatcgaggagggccgaaccctgcgggtcttaaaaatggtggagccgtggctccgcgggaaccagttttgcatcaaaatccttaacccctatatgcccagcgtggtcgagactttggagcaaatgcagcgtaagcatggcggcatgctcgtacgtaatccgctgagcaggaacagcacccatgaaatgtactgggtgagctgcgggaccggcaacatcgtgagcgcagtgaacatgacgtcccgcatgttactcaaccgcttcaccatggctcacaggaagcccacttacgagcgcgatgtagatttaggggcgggaacccggcacgtcgccgtggagcccgaggtagccaacttagacatcataggacagcggatcgagaacattaaacacgaacataagtccacgtggcactacgacgaagacaatccgtataagacctgggcataccacgggtcgtatgaggtgaagccgagcggctcggcaagcagcatggtgaacggtgtcgtgaaactcctgaccaagccctgggacgtaatccccatggtcacgcaaattgcgatgacagacacaaccccttttggccagcagcgcgtgttcaaagagaaagtcgacacgcgaaccccgaaggccaagagggggaccgcccagatcatggaggtcacggccaagtggctgtggggcttcctcagccgcaacaaaaaaccccggatctgcacccgcgaggagttcacgcgaaaggtgaggtcgaacgcagcgattggagccgtattcgtggacgagaatcaatggaactccgccaaagaggccgtggaggacgagcggttctgggacctggtgcacagggagcgagagctgcataagcaggggaagtgcgcgacttgcgtctacaatatgatgggtaagcgggagaagaagctcggggagttcgggaaggccaaggggtcgcgcgctatttggtatatgtggctaggcgcccgcttcctggagtttgaagccctcggcttcatgaacgaggaccactggttctcccgagagaatagcctgtccggggtggagggcgagggtcttcacaaactcgggtacatcctgcgagacatcagcaaaatacctggtggcaatatgtacgcggacgacaccgccgggtgggacaccagaatcacggaggacgacctacagaacgaagcgcgaataaccgacattatggagcctgagcacgccctcctggccaaatccatattcaagctgacataccagaacaaggtcgttagagttcagcggcctgcgaaaaacggtaccgttatggacgttatctcgcgccgagaccagagagggtcaggacaagtggggacgtacggcctcaataccttcaccaatatggaggcgcagctgatcaggcagatggaaagcgaaggtatcttctccccctccgagctcgagacccccaatctcgccgaacgcgtgctagactggctagagaagtatggcgtcgagcgcttgaagcgcatggctatctccggggacgactgcgtcgtgaagccaatcgacgaccggtttgccacagccctgaccgctctgaacgatatgggtaaggttcgcaaggatattccccagtgggagcccagcaaggggtggaacgattggcagcaggtccccttctgctctcaccacttccatcagctcataatgaaagacggccgggaaatagtcgtcccgtgccgtaatcaagacgagcttgtgggtcgggcccgtgtcagtcagggtgccggctggagcttgcgggagacagcctgtctcgggaagtcctacgcgcagatgtggcagctaatgtactttcaccgccgggacctccgtcttgctgccaacgccatctgcagcgctgtccccgtggactggatacccacgtcccgaacgacctggagcatccacgcccaccaccagtggatgaccaccgaagacatgctgtccgtgtggaaccgtgtctggatcgaggaaaacccctggatggaggacaagacccacatctcatcctggggcgacgtaccctatctgggtaagagagaggaccagtggtgcggctcactcatcggccttaccgccagagctacctgggccacaaacatccaggtggcgatcaatcaggtccgtcggctgatcgggaacgaaaactacctcgactacatgacttcaatgaagcgcttcaagaacgagtctgatcccgagggtgccctgtggtga

SEQ ID NO: 24411 - RNA, 9879 nt, synthetic construct
  misc_feature 1..9879: note = derived and/or modified CDS sequence (opt11) from DENV-1__GU131683__SS-prME
  source 1..9879: mol_type = other RNA
agcgttactatgttgttgatgcttatgcccaccgcccttgccttccacctcacgacccggggcggggaaccccacatgatcgtgtcgaaacaggaaaggggcaagagcttgcttttcaagactcccgctggggtgaatatgtgcaccctcatcgccatggacctgggggaactctgcgaagacactatgacatacaagtgcccccggatcaccgagaccgagcccgacgatgtggactgctggtgcaacgccacggacacctgggtgacctacgggacctgcagccagacgggcgagcaccggcgggacaaacgcagcgtggcactcgcgccccacgtcggtctggggctggagacccgcaccgaaacctggatgagctcagagggcgcctggaagcagatacagcgtgtcgagacgtgggccctgcgacaccccgggtttaccgtgatcgccctgttcctggcccacgcgatcggcacttccataacccaaaagggaatcatcttcatcttattaatgctcgtgacgcccagcatggccatgcggtgcgtcggcatcggctcccgcgactttgtcgaggggctcagcggagctacctgggtcgatgtcgtgctcgaacacggctcttgcgtgaccaccatggccaaagataagcccacgctcgacatcgagctacttaagaccgaagtcaccaacccggccgtgctgcggaagctctgcatcgaggcgaagatctccaacaccacgaccgacagtcgatgccccacccagggggaggccaccctggtggaggagcaagacgccaatttcgtctgccgtcgcacgttcgttgatcgggggtgggggaacggctgcgggcttttcggcaaggggagcctcatcacgtgcgcaaagttcaagtgcgtgaccaagctggagggcaaaatcgtgcagtacgagaatctgaagtactccgtgatcgtaaccgtccacacgggggaccaacaccaggtggggaacgagagcaccgagcacgggaccacagcaaccatcacgcctcaagcgcccacgaccgagattcagctgactgactacggtgcgttaactctggactgctccccgcgcacaggcctcgacttcaacgaaatggtcctgctgactatgaaggagaagtcctggctcgcacacaagcagtggttcctcgacctgcccctcccctggacctccggggccagcacgagccaggagacgtggaaccggcaggacctgttggtgacctttaagaccgcccacgcgaaaaagcaggaggtggtcgtgctcggatcacaggagggtgccatgcatacggcgctgactggggccaccgagatccagacgtctggcacgaccacgatttttgccggacacctgaagtgtcgcctcaagatggataagctgaccttgaagggcatgagctatgtgatgtgtaccgggagcttcaagctcgagaaggagctggcggagacgcagcacggcacggtcctggtgcagatcaagtacgagggcaccgacgccccctgcaagatcccgtttagcacgcaggacgagaagggggtaacccagaacggacggttgatcaccgcaaaccccattgtcacggacaaagagaagcccgtgaacatcgaggctgaaccaccattcggggaaagctacattgtgatcggtgcgggtgagaaggccctcaagctgagttggttcaagaaggggagctccatcggcaaaatgttcgaagccacggcccgcggggcccggcgcatggcgatcctgggtgataccgcctgggacttcgggagcatcggaggcgtctttacctcagccgggaagctagtacaccaaatctttggcaccgcctatggggtactcttctcgggtgtctcctggaccatgaagatcggcatcggagtactactaacgtggcttggcttaaacagccgctccaccagcctctccatgacctgcatagccgtggggctggtaacgttgtacttgggcgttatggtgcaggcggacagtggttgcgtgattaactggaagggccgggagctgaagtgtgggtcaggcatcttcgtcaccaacgaggtgcatacgtggaccgagcagtacaagttccaggccgactccccgaagaggctgtcagccgccattgggaaagcctgggaggagggggtctgcggcatccggagcgcgactcgcctcgaaaacatcatgtggaagcagataagcaacgagctgaaccatatcctgctcgagaacgacatgaagttcaccgtggtggtcggggacgtggccgggatcctggcccaggggaagaaaatgattcggccccagcctatggagtataagtactcctggaagtcctggggcaaagccaagatcatcggcgccgacgtgcaaaacacaaccttcattatcgatgggccgaacacgcccgagtgtccggacgaccagcgcgcatggaacatctgggaggtggaggactacggcttcggcatcttcactaccaacatctggctgaagttgcgggattcctatacccaggtgtgcgaccaccgcctgatgagcgccgccatcaaggactcgaaggccgtgcacgccgacatgggttattggatagagagcgagaaaaacgagacctggaagctggcccgggccttcttcatcgaggtcaagacctgcatttggccgaagtctcacacgctgtggagcaacggcgtgctggagagtgaaatgatcatcccgaagatctacgggggccccataagccaacataactaccgtcccgggtacttcacgcagaccgccgggccgtggcacttgggcaagctcgagctggacttcgacctgtgtgagggcacgaccgttgtcgttgatgaacactgcggcaaccggggcccctccctccgcaccaccacggtgaccggcaagatcattcacgagtggtgctgccggagctgcacgctaccgccgctgcgctttcgtggcgaagatggctgctggtacgggatggagattcggccggtcaaggagaaggaggagaacctcgtgaaatccatggtgagcgccggctccggcgaggtcgacagcttcagcctgggcctgctttgcatatccatcatgatcgaggaggttatgcgtagtaggtggtcccggaagatgctgatgaccggcacgctagcggtgtttttcctcctgatcatggggcagctgacatggaatgacctaatcagactttgcattatggtcggcgccaacgctagcgaccgcatgggaatgggcaccacctacttggccctaatggccacgttcaagatgcggccaatgtttgcggtgggcctacttttccgccgcctaacctcccgcgaggtcttgctgctcactattggactgagcttggtcgcatcggtagagctccccaactcattagaagaactaggagacgggctcgccatgggcatcatgatcctgaagctgctcacggatttccagtcccaccagctttgggccacgctgctcagcctgaccttcatcaagacgaccttctcactgcactatgcgtggaagacgatggccatggtgctcagcatcgtctccctatttcccctgtgcctcagcaccacgagccagaagacgacgtggctgccggtgctgctcgggagcctggggtgcaagcccctgactatgttcctcatcgcagagaacaagatctggggtcggcgctcctggcccctgaacgaggggatcatggctgtcggcatagtcagcatccttctcagcagcctgctgaaaaatgacgtaccactcgcagggcccttaatcgcaggcggcatgctgatcgcctgctacgtcatcagcgggtctagcgccgacctctccctggagaaagctgctgaggtgagctgggaggaggaggcggagcattccggcgccagccataatatcctggtcgaagtccaagacgacgggaccatgaagatcaaggacgaagaacgggatgacaccctcaccatactcctgaaagccactctcctggccgtgtccggtgtctaccccctgtcaattcccgccaccctattcgtctggtacttttggcagaagaagaaacagcgctctggggtgctgtgggacactcccagtccacccgaagtggaacgagccgtcctggatgacggcatctataggatcatgcagcggggtctgctcgggcgcagccaggtgggcgtaggagtcttccaagaaaacgttttccacaccatgtggcatgtgacgcggggcgctgtccttatgtaccaggggaagcgcctggagcccagctgggctagcgtgaagaaggatctcatctcatatggcgggggatggcggctgcagggtagctggaacaccggcgaagaggtgcaggtcatcgccgttgagcccggcaagaacccgaagaacgtgcaaactgcaccggggaccttcaagacgcctgagggcgaggtcggcgcgatcgctctggatttcaagcccggaaccagcggatccccgatcgtgaaccgcgaggggaagatcgtgggcttatacggcaatggggtcgtgaccactagcggcacgtacgtgagcgccatcgcacaggcaaaggccagtcaggaggggcccctgcccgagatcgaggacgaggtcttccgcaagcgcaacctcacgatcatggacctgcacccgggctccgggaaaacacggcgctacctgcctgccatcgtgcgggaggccatcaagcgcaaacttcgcactctaatattggccccaactcgggtggtcgcgtcggagatggccgaggcgctaaaaggcatgcccatccgctaccaaaccaccgcggtcaagtcggagcacaccggcaaggaaatcgtagacctcatgtgccacgcgacgtttacgatgcggttactgtcccccgtccgcgtacccaactacaatatgatcatcatggacgaggcacatttcaccgatcccagctccatcgccgcccgcgggtacattagtacccgagtgggcatgggcgaggccgccgcgatttttatgacggctacgccacccggctccgtcgaggccttccctcaaagcaacgcggtgatccaggacgaggagagggacatccccgagcgctcctggaactccggatatgagtggatcaccgatttccccggcaagaccgtgtggttcgtcccgtccatcaagagcggcaacgacatcgcgaactgcctccggaagaacgggaagcgcgtaatccagctgtctaggaagactttcgataccgagtaccagaagaccaagaacaacgactgggactatgtggtaaccacggatatcagcgagatgggcgccaacttccgtgccgaccgggtgattgaccccagacggtgcctcaagcccgtgatattgaaagacgggcctgagcgcgtgatcttagccggtccgatgcctgtgaccgtggccagcgcggcccaaaggagagggaggatcggtcgcaaccacaacaaggagggagatcaatacatctacatggggcaacccctgaacaacgacgaagaccatgcacactggaccgaggccaaaatgctcttggacaacatcaacactccggagggcatcatcccggccctgtttgagccagaacgcgagaagtccgctgccatcgacggggagtaccgcttacgaggcgaagccagaaagacgttcgtcgagctgatgcgccgcggagatctgcctgtgtggctctcctataaagtcgcctctgagggcttccagtactccgaccgccggtggtgcttcgacggcgagcgaaacaatcaggtcctggaggaaaacatggacgtcgagatctggaccaaagagggggagcgtaagaagctgcgcccgaggtggctcgacgcgagaacctacagcgacccgcttgcgctgcgcgagttcaaagagttcgccgccggccgccggagcgtgtccggtgacttaatcctggagatcggtaaactgccccagcacctcacccaacgcgcacagaacgcgctggacaacttagtgatgctgcacaactcggagcagggcgggcgggcctaccgccatgccatggaggagctccccgatacgatagagaccctgatgctcctggcgctgatcgccgtgctcaccggcggggtcaccctgttcttcctgtccggacgggggcttgggaagaccagcatcggactcctgtgtgtgatggcctccagcgtgctcctgtggatggcgagcgtcgagccccactggattgccgcgagcataatcctggagttctttctcatggtactgctgattccggagccagaccgccagcggacgccgcaggacaaccaactcgcgtacgtggtcatcgggttgctgttcatgatcttaacggtggcggcaaacgagatgggcctgcttgagaccaccaaaaaggacctcgggattggccacgtcgcagtagagaatcaccaccacgccgccatgctggacgtggacctgcacccggcgtccgcctggacgctctacgccgtggcaaccaccattatcaccccaatgatgcgccacacgatcgaaaataccaccgccaacatcagcctgaccgcgatcgctaatcaggccgccattctgatggggttggacaagggctggcccatctccaagatggacattggcgtccccctgctggcattgggctgttattcacaagtgaacccgttgacgctgaccgccgctgtgctcatgttggtcgctcactatgcaatcatcggccccgggttgcaggcgaaggccacccgcgaggctcaaaagagaaccgccgccggcatcatgaagaatcccacggtggacggaatagttgcgatcgacctcgacccagtcgtttacgacgccaagttcgagaagcagctgggccagataatgctgctcattctgtgtacgtcccagattctgctcatgcgaactacctgggccctgtgcgagagcatcacactggcaacaggcccgctcaccacattatgggaggggtcccccggaaagttttggaacacgaccatcgcggtatcaatggcgaacatctttcgggggtcttatctggcgggcgccggcctcgccttttcccttatgaaaagtctcggaggcgggcgcagaggtacaggggcgcaaggagagaccttgggcgagaagtggaagcgccagctgaatcagctgagcaaaagcgagttcaacacctataagcggtccggtataatggaggtcgaccgcagcgaggctaaagaaggcctcaagagaggggagaccaccaaacacgccgtaagtcgcggcactgccaagctgcggtggtttgtggaacgcaatctggtaaagcccgagggaaaggttatcgacctgggctgcggcagaggtgggtggagctactactgcgccgggctgaagaaggtgacggaggtcaaggggtacaccaagggcggccccggccatgaggagcctatccccatggctacctacgggtggaaccttgtgaagctgcactccggcaaggacgtgtttttcatccctcccgagaagtgcgacaccctgctatgcgacatcggggagagctccccaaaccccaccatcgaggagggccgcactctgcgagtcctaaagatggtcgagccctggctgcgcgggaaccagttctgcatcaaaattctaaacccctacatgccgagcgtagtcgagacgctcgaacagatgcagcggaagcacggcggaatgctggtgcgcaaccccctgtccagaaattcaacccacgagatgtactgggtgtcctgcgggaccggaaatatcgtcagcgccgtgaacatgacgtcacgcatgctcctgaaccgctttactatggcgcaccggaagcccacctacgagcgcgacgttgatctgggggccggcacccgacacgtcgccgtggagccagaggtggcgaacctcgacatcattggccagcgcatcgagaacatcaagcacgaacacaagagcacgtggcactacgacgaggacaacccatacaagacatgggcctaccacggatcctacgaggtcaagcccagtggctccgctagcagtatggtgaatggggtggtcaagctgctgaccaaaccctgggacgttatccccatggtcacccagattgccatgacggataccaccccgttcggccaacagcgggttttcaaggagaaagtggacacccgcactcccaaggccaagcgggggacggcgcagattatggaggtcaccgccaagtggctttggggcttcctgagccgcaacaagaaaccacgtatatgcacccgcgaggagttcacccggaaggtgcgcagtaacgccgccattggcgcggtattcgtggacgagaaccagtggaactccgccaaggaggctgtggaagacgagcgcttttgggacctggttcaccgcgaacgagagctccacaagcaagggaagtgtgcgacctgcgtgtacaacatgatgggcaagcgggaaaagaagttgggggagttcggcaaagccaaggggtctcgggcaatctggtacatgtggctgggcgcccgcttcttggagttcgaggccctgggcttcatgaacgaggaccactggttctcccgggagaacagcttatccggcgtggagggcgaggggctccacaagctgggctacatccttcgtgacatctcaaagatccccgggggcaatatgtacgccgacgacaccgcaggatgggacactcggatcacggaggatgatctccaaaacgaggcgcgcatcactgacatcatggagcccgagcatgcgctgctggcaaagtccatcttcaagctaacctatcagaacaaggtggttcgcgtgcagcggcccgccaagaatgggaccgtgatggacgtcatcagccgccgggaccagcgcggctccggacaggtgggaacgtacgggctgaacacattcacgaacatggaggcgcaactcatcaggcagatggagagcgagggaatcttctcccccagcgagctcgagactccgaacctggcggagcgagtcctcgactggctcgagaaatatggcgtcgaacgactgaagcgcatggccatcagcggggacgactgcgtagtgaaaccaatcgatgatcggttcgccaccgccctaaccgctttaaatgacatgggcaaggtccgcaaggacatcccccaatgggagcccagcaaggggtggaacgattggcaacaggtcccattctgctcccaccatttccaccaactcatcatgaaggacggtcgggagatagtggtcccctgccgcaaccaggacgaactggtaggtcgcgcgcgcgtgagccagggggccggatggtcactccgggagaccgcctgcctaggcaagagctacgcccagatgtggcagctgatgtacttccatagacgggacctccgcttagcggcaaacgcaatctgcagcgcagtccccgtcgactggatccctacctcccggacgacatggagcatccacgcccaccaccagtggatgaccaccgaggacatgctgtcagtgtggaaccgcgtttggatcgaggaaaacccgtggatggaagacaagacgcacatcagttcctggggagacgttccatacttaggtaagcgcgaggaccaatggtgcggcagcttaatcggtctcaccgctcgggccacctgggccacgaacatccaggtcgccatcaaccaggtccgacggctaatcgggaacgagaactatctggactacatgacctccatgaagcgcttcaaaaacgagtctgaccccgaaggcgctctgtggtga

SEQ ID NO: 24412 - RNA, 9879 nt, synthetic construct
  misc_feature 1..9879: note = derived and/or modified CDS sequence (opt11) from DENV-1__GU131684__SS-prME
  source 1..9879: mol_type = other RNA
agcgtcaccatgctgctgatgctgatgcccaccgccctggccttccacctcacgacccgcggcggggagccgcacatgatagtgagcaagcaggaacggggcaagtcgttactattcaagactagcgcaggtgttaacatgtgcaccctcatcgccatggacctgggtgagttctgtgaggacacgatgacctacaagtgcccccgcatcaccgaggccgagcccgacgacgtcgactgctggtgtaacgccaccgacacgtgggtaacctacgggacctgctcacagactggggagcatcggcgcgacaagcgctcggtcgcgcttgcgccccatgtgggcctggggctggagacgcgcactgagacgtggatgagctcggaaggcgcctggaagcaaatccagcgggtggagacctgggcgctgcggcatcccgggttcacggttatcgccctcttcctggctcacgctatcggcacctcaatcacgcagaaagggatcatcttcatactcttgatgctggtgactccctccatggcaatgaggtgcgtcggcatcggcagccgggacttcgtggaggggctgtccggcgctacgtgggtggacgtcgttctggagcatgggtcatgtgtgaccacgatggccaaggacaagcccacgttggacatcgagctgttaaagacggaggtaaccaacccagctgtcttgcggaagctgtgcatcgaggccaagatcagcaacacgaccactgactcaagatgcccgacacagggcgaggccaccctcgtggaggagcaggacgccaacttcgtctgccgacgtaccttcgtggaccgcggctggggtaacggctgcgggctattcggcaagggatcactgattacgtgcgcaaaattcaaatgtgtgaccaagctcgagggcaagatcgtacagtacgaaaacctgaagtacagcgtgatcgtgaccgtacacaccggtgaccagcaccaggtgggaaacgagtctactgagcacggcaccaccgctaccatcacgccccaggccccatctactgagatccagctaaccgactacggggccctcaccctagactgcagcccccgcaccgggctggactttaacgagatggtactcctgactatgaaggagaaaagttggctggtgcataagcaatggttcctcgacttgcctctgccttggaccagcggagctagcaccagtcaggagacttggaatcggcaagatctgctagtcacctttaagaccgcccacgcgaagaagcaggaggtcgtggtgctaggttcccaagagggcgccatgcatactgcgctcacaggggccacggagatacaaaccagcggcacgaccaccatctttgccgggcacctgaagtgccgcctgaagatggacaagctgaccctgaagggtatgtcatacgtcatgtgcaccgggagcttcaaactggagaaggaggttgcggaaacccaacacggcactgtgctcgtccagatcaaatacgaggggaccgacgccccgtgtaagattcccttctccacccaggacgagaaaggagtgacccagaatggccggctgatcacagccaacccgatcgtgacagacaaggagaagccagtcaacattgaggcagaaccgccctttggtgagagctacattgtgattggcgcgggcgagaaagccctaaagctgtcctggtttaagaaggggagctccattggcaagatgttcgaggccaccgcccggggggcgcgtcgcatggcgatcctcggcgacacagcctgggacttcgggtctatcggcggcgtgtttacgtccgtcggtaagctcgtgcatcagatctttggtactgcctacggggtgcttttcagcggcgtctcgtggaccatgaagattggtatcggagtgctcctgacttggcttggcctaaacagccgctccacgagcctctccatgacctgcatcgccgtgggcttagtcaccctctacctgggcgttatggtgcaagccgacagcggttgtgtgattaactggaaggggcgggagctgaagtgcgggagcggcatctttgtgacgaatgaagtgcacacgtggaccgagcaatacaaattccaggcggactccccgaagcgcctcagcgccgctatcggcaaggcctgggaggagggggtctgcggcatacggtccgccacccgcctggagaacataatgtggaagcagatctctaatgagctgaatcacatactcctggagaacgacatgaagctgaccgtggtcgtcggggacgtggctgggatcctcgcccaagggaagaagatgatccggccccagcccatggaatacaagtattcctggaagtcttggggaaaggcgaagataatcggtgcggacgtgcagaataccacgttcatcatcgacggacccaacaccccggaatgtcccgacgatcagcgcgcgtggaacatctgggaggtcgaggactatggattcggtattttcaccacgaacatttggctgaagctgcgggattcctatacccaagtgtgcgaccatagactcatgagtgcagctatcaaagactccaaggccgtgcacgccgacatgggctactggatcgaaagcgagaagaacgagacctggaagctagcgagggcgtcatttatcgaagtaaaaacctgtatctggccaaagagccacaccctgtggtccaacggcgtgctggagagcgagatgataatccccaagatctacgggggcccgatatcgcagcacaattaccgccctgggtacttcactcaaaccgccggcccctggcatctggggaaactagaattggatttcgacctgtgcgagggcaccaccgtagtcgtggacgagcactgcggcaaccggggcccgagccttcgcaccaccaccgtgaccggcaaaatcatccacgaatggtgctgccggtcctgtacgctgccgccgctccgcttcaagggggaagacggttgctggtacgggatggagatcaggcccgtcaaggagaaagaagagaacctggttaagagcaaggtgagcgccgggtcaggcgaggtcgactccttctctctcgggctgctgtgcatcagcatcatgatagaggaggtgatgcgctcccgatggagtaggaagatgctcatgaccggcaccctggcggtcttttttctgctcatcatggggcagctgacctggaatgacttaattaggctctgcatcatggtcggcgcgaacgcgagtgaccgaatggggatgggcaccacctacctggccctgatggccacctttaagatgcgcccgatgttcgccgtagggctcctgttcaggcgcttaaccagccgggaagtgcttctgctcacgatcgggctctccctagtagcgagcgtagagctgcccaactccctcgaggagctgggcgacgggctagccatgggaataatgattctcaagctgctgaccgacttccagtctcaccagctctgggctaccctgctgtccctcacatttatccgcacgaccttctccctgcactacgcctggaagaccatggcgatggtgctgagtatcgtgtccctcttcccattatgcctatctaccacgagccaaaagactacctggctccccgtgctgctgggaagtctcggctgcaagccgcttaccatgttcctgatcgcagagaacaagatttggggccgcaagtcttggccgctcaatgagggcattatggccgtcggcatcgtgagcattctgctatccagcttgctgaagaacgacgtgcccctggccgggccgctcatcgccggcggcatgctgatcgcgtgctacgttatcagtgggtcttccgccgacctgagcctggagaaggccgccgtcgtgtcttgggaggaggaggccgagcatagcggcgcctcccacaacatcctggtcgaagtgcaggacgacggcacgatgaagatcaaggacgaggagcgcgacgacaccctcacaattctccttaaagcaaccctgctcgccgtgagcggcgtgtacccgctcagcattcccgcgactttatttgtgtggtacttctggcagaagaagaagcagcggagtggggtgctctgggatacgcctagcccgcccgaggtcgagcgcgccgtgctcgacgatggcatctaccgcatcatgcagcgcggcctgcttgggcgaagtcaggtgggcgtcggagtgttccaggagaacgtattccacacaatgtggcacgtaacccgcggcgcggtgctcatgtaccaggggaagcggctggagcccagctgggcaagcgtgaagaaggatctgatctcgtatggtggcgggtggcgcctccagggcagctggaacaccggggaggaggtccaggtgatcgccgttgagcccggcaaaaaccccaagaacgtccagacggccccaggcaccttcaagacctccgagggcgaggtgggcgccatcgcgctagatttcaagccaggcacctccggtagccctattgtgaaccgggagggaaagatcgtcggcctgtacggcaacggggtcgtaaccacctccggcacatacgtcagcgccatagcacaggccaaggccagtcaggagggacctctcccggagatcgaggatgaagtctttcgaaagcggaatttgaccattatggacctgcacccgggcagcgggaagactcgtcgttaccttccggctatagtgcgcgaggcgatcaagcgtaaactgcgcaccctgatcctcgccccgacacgcgttgtggcgtccgagatggcggaggccctgaagggcatgcccataagataccagactacagccgtcaagtccgagcacaccggcaaggagatcgtcgacctgatgtgccacgcaacgtttaccatgcgcctcctctcccccgtgcgggtgcccaactacaatatgatcattatggacgaggcccacttcacagacccgtcctccatagccgcccgcgggtacattagcaccagggtcggtatgggggaagccgccgccatctttatgaccgccacgccgcccggttccgtggaggcattcccccagagcaacgccgtcatacaggacgaggaacgcgacatacctgagcggagttggaacagcgggtacgagtggatcacagactttccgggcaagaccgtctggttcgtgccctccatcaaatcaggtaacgacatcgccaactgtctgcgcaaaaacgggaagcgggtgatccagctctcccgcaagacgttcgacaccgagtatcagaagacgaagaacaatgactgggactacgtggtgacgactgacatctctgagatgggcgcgaacttcagggcagaccgcgtaatcgacccccgtcgctgcttgaagccggtgatcctgaaggatgggcccgagcgggtgatcctcgccggtcccatgcccgtaaccgttgcatccgcagcgcagcgccggggccgaatcggccggaaccacaataaggagggcgaccagtacatctacatgggacagccgctgaacaacgacgaagaccacgcccactggacggaggcgaaaatgctcctcgacaatattaacactccagagggcatcatccccgccctgttcgagcccgagcgcgagaagtccgctgccatcgatggggagtaccgcctgcggggagaggcccgcaagacctttgtggagctcatgcggcgcggggatctgccggtctggctgagctacaaggtggcgtccgaaggctttcagtacagcgaccggcgctggtgctttgacggagagcggaacaaccaggtgcttgaggagaacatggatgttgaaatctggaccaaggagggggagcgcaagaagctgcggccccgctggttggacgcccggacgtattccgaccccctcgccctgcgcgagttcaaggagttcgcggccggccggcgcagcgtgtccggggacctgatcctcgagatcggcaaactgccccagcacctgacccaacgggcccagaatgccctcgacaacctcgtgatgctgcacaactcggagcaagggggacgcgcgtacaggcacgccatggaggagctccctgacaccatcgagaccctgatgctgctcgccctgatcgccgtacttacaggcggagtgactctgttctttctatccggccgtgggctgggcaagactagcatcggcctcctctgcgtgatggcatcctcagtcctgctctggatggcttcggttgagccccactggatcgccgctagcatcattctggagttcttcctgatggttctcctgatccctgaacccgatagacagcgcaccccgcaggacaaccagctggcctacgtcgtgatcggccttctcttcatgatcctgacagtggccgcgaatgagatgggcctccttgagacgaccaagaaagacctggggatcggccatgtcgccgtggagaatcatcatcacgcggccatgctcgacgtcgatctccaccccgcctcggcgtggacgttatacgccgtcgccactaccatcattacccccatgatgcggcataccatcgagaacaccacggccaacatctcattgaccgccatagcgaatcaggccgccatcttaatggggctggacaagggttggccgatctctaagatggacatcggcgtccccctcttagccctgggttgctacagtcaggttaaccccctgactttaaccgcggccgtcctgatgctagttgcacactacgccatcatcggacccgggctgcaggctaaggcgacgcgcgaggcgcagaaaaggaccgctgccggcatcatgaagaaccccacagtggacgggattgtcgcaatcgacctggatccggtggtgtatgatgcgaagttcgagaagcagttaggccagatcatgctgctgatcctctgcacatcccaaatccttttaatgagaacgacctgggccttatgtgagagcattaccctggccaccggccccctgacgaccttgtgggaggggtcccccggcaagttctggaatactaccatagcagtcagcatggccaatatattccgcgggagctacctagccggcgccggcctggcgttctcgctcatgaagtccctcggtggcggtcggcgggggacgggggcccagggcgagaccctgggagagaagtggaagagacagctcaaccagctctcgaagagcgagttcaacacttacaagcgctcggggatcatggaggtggacagaagcgaggcgaaggagggtctgaagcgcggggagaccacgaagcacgccgtgagccggggcacagccaagctccgatggtttgtcgagcggaacctcgtcaagccggagggtaaggtgatcgacttgggatgcggccgcggggggtggagctactactgcgccgggctgaagaaggtcaccgaggtaaaaggctacaccaagggcgggcccggccacgaggaacctatccccatggccacgtatgggtggaacctcgtcaagctgcattccggcaaagacgtcttctttatcccacccgaaaaatgcgacacccttctctgcgacataggggaaagctcccccaaccctacaatcgaggagggccggactctgcgcgtgctgaagatggtcgagccgtggctccgggggaaccagttttgcattaagatcctgaacccctatatgccgagcgtcgtcgagacgctggaacagatgcagcgcaagcacggtggcatgctcgtacggaaccccctatccagaaacagtacccacgaaatgtactgggtctcctgcgggaccggcaacatcgttagcgcggtaaatatgacctcacgcatgctcctcaaccgattcacgatggcccaccgtaagccgacgtacgaacgggacgttgacctgggtgcaggcacacgccatgtggccgtagagcccgaggtcgcgaatctcgacatcatcggtcagcggatcgagaacatcaaacacgagcataagtcgacctggcactacgacgaggacaacccctataagacctgggcgtaccacgggtcctacgaggttaagcccagcggtagcgcgtcctctatggtcaatggggtggtgaaactcctgacgaaaccgtgggacgtcatacccatggtgactcagatcgcgatgaccgacaccacgcccttcggccagcagcgcgtgttcaaagaaaaagtggacacccggacaccaaaggcaaagagggggactgcccagataatggaggtgaccgcgaagtggctgtggggctttctctcccggaacaaaaagccgcgcatctgcacccgggaggagttcacccgcaaagtgcggagcaacgcggccataggcgcagttttcgtcgacgaaaaccagtggaactctgcgaaggaggcggtggaggacgaaagattctgggacctggtccatcgggagcgcgagctacataagcaagggaagtgcgccacctgcgtatacaacatgatgggcaagcgggagaagaagcttggcgagttcggcaaggccaaggggagccgcgccatctggtacatgtggctgggcgcgcgattcctggagttcgaagccctcggttttatgaatgaggatcactggttctcccgcgagaacagcctgtccggggtggagggcgaggggctgcataagctcggctacatcctgcgggatatctcaaagatccccgggggcaacatgtatgctgatgatacggccgggtgggacacacgcattaccgaggacgacctacagaatgaggccaagatcactgacatcatggagccagagcacgcgcttctcgccaagtccattttcaagctgacttaccagaataaagtagtgcgggtgcaacgaccagccaagaatggtaccgtaatggatgtgatctcacgtcgggatcagcgcggctccggccaggtgggcacttacgggctcaacaccttcacgaacatggaggcccaactgattcggcagatggagtcagaagggatcttctcccctagcgagctggagaccccaaacctcgctggccgcgtacttgactggctggaaaaacacggggtagagcggctcaagcgcatggccatctccggcgatgattgcgtggtcaagcccatcgacgaccgcttcgccacagcactgaccgccctgaatgacatggggaaagtccgcaaggacattccgcagtgggagcctagcaagggctggaacgattggcagcaggttcctttctgctctcaccacttccaccagctcatcatgaaagacggccgggaaatcgtagttccctgccgcaaccaggacgaactggtgggtcgagctcgcgtctcccaaggcgcggggtggtccctgcgggaaacggcctgcctcggcaagagttacgcccaaatgtggcagctgatgtactttcaccgccgtgacctgagactcgccgctaatgccatctgcagcgccgtgcccgtggactgggtccccacgagtagaaccacatggtcgatccacgcccaccaccagtggatgacgacagaagacatgctgtccgtctggaaccgcgtgtggatcgaggaaaacccctggatggaggacaagacccacatcagctcttggggcgatgtcccctacctagggaagcgggaggaccagtggtgtggtagcctcatcgggctcaccgcccgcgcgacctgggctacgaacatacaagtggccatcaaccaggtgcgcagactgttgggcaacgagaactacctggactacatgacctccatgaagaggttcaagaacgagagcgaccctgagggggccctgtggtga

SEQ ID NO: 24413 - RNA, 9879 nt, synthetic construct
  misc_feature 1..9879: note = derived and/or modified CDS sequence (opt11) from DENV-1__GU131685__SS-prME
  source 1..9879: mol_type = other RNA
agcgtgaccatgctgttaatgctgatgcccacggccctggccttccaccttaccacacggggcggcgagccccacatgatcgtctcaaagcaggagcggggcaagtccctgctgttcaagacctcggccggggtgaatatgtgcacgctcatcgccatggaccttggtgaactgtgcgaggacaccatgacctacaagtgccctcgcatcaccgagacagagcccgacgacgttgactgttggtgcaacgctacggacacctgggtgacttacgggacctgctcacagacgggcgagcatcggcgcgacaagcggtccgtggccctcgcgccccacgtaggcctggggctggagacccgcaccgagacctggatgagctccgagggcgcctggaagcagatccagagggtagaaacgtgggcccttcgtcaccccggtttcacagtaatcgctctgttcctagcccacgcgataggcacaagtataacccagaaggggatcatcttcatactcttgatgctagttacgccctccatggccatgcggtgcgtgggcatagggagccgggacttcgtggaggggctttccggggccacctgggttgacgtcgtgttggagcacgggagttgcgtgaccaccatggccaaggacaagcccacgctggacatcgagcttctgaagaccgaggtcaccaaccccgccgtgctgcggaagttatgcattgaggcgaagatctccaacaccacaaccgacagccgctgcccgacccagggcgaggccacgctggttgaggagcaggacgctaactttgtctgcaggaggactttcgttgaccgtggctggggtaacggctgcgggctgtttgggaaggggtcgctaatcacgtgtgccaaattcaagtgtgtgacaaagctggagggcaaaatcgtgcagtacgagaacctcaagtatagtgtgattgttacagtccacacgggtgaccagcaccaggttgggaacgagtccaccgagcacgggaccaccgctaccatcacgccgcaggcgcccaccaccgagatccagctcaccgattacggtgccctgacgctggactgcagccctaggacaggcctcgatttcaacgaaatggtcctactgaccatgaaagaaaagtcatggctcgtgcacaagcagtggttccttgaccttcccttgccatggacgagcggggcgagcacatcccaggagacctggaaccggcaggacctgttggtgacgttcaagaccgcccacgcgaagaagcaggaggtcgtcgtgctcggcagccaggagggcgcgatgcacacggccctgaccggggccaccgagatccagacctctggcacgactaccatcttcgccggtcacctgaagtgcagattaaagatggagaaactgaccctcaaggggatgagctacgtcatgtgcacggggagtttcaaactcgagaaagaggtagcggagacgcagcacggtactgtgctggtacagatcaaatatgagggtaccgatgcgccctgcaaaatcccgttcagcacgcaggacgagaagggggttacccaaaacggccgtctgatcaccgccaaccctatcgtgacagacaaggaaaaacccgtcaacatcgaggcagagccgccattcggtgagagttacatcgtaatcggcgccggcgaaaaggcgctcaagctcagctggtttaagaaaggttctagcatcgggaagatgttcgaagccacggcccggggagccagacgaatggccatcttgggggacactgcctgggatttcgggtccatcggcggcgtcttcacctcagtcgggaagctgatccaccagatcttcggcaccgcatacggagtcctcttttccggcgtcagctggacgatgaaaatcggtattggcgtcttgcttacctggctgggtctgaactcccgcagcaccagcctgagtatgacctgcatcgcagtggggctagtgaccctgtacctgggcgtaatggttcaggccgactccgggtgcgtgatcaactggaagggccgagaacttaaatgcggaagcggcatctttgtcaccaacgaagtgcatacctggaccgagcagtacaagtttcaggccgatagcccgaagcgcctgtcggcggccatcggcaaggcctgggaggagggggtttgtggtatccggagcgccacccgcctggaaaacatcatgtggaagcagatctccaacgagctcaaccacatcctgctcgagaatgggatgaagttcacggtggtggtgggtgacgtggccgggatccttgcgcaaggcaagaagatgatccggccccagcccatggaatacaagtacagctggaagtcctggggcaaggccaagatcatcggggccgatgtgcagaacaccaccttcatcatcgacggccccaacacccccgagtgcccggacgaccagcgcgcctggaacatctgggaggtcgaggactatgggtttgggatattcacgaccaacatctggctaaagctacgggactcatacacacaggtgtgcgaccataggctcatgagcgcagccatcaaagactcaaaagctgtgcacgccgacatgggctactggatcgagagcgagaaaaacgagacctggaagctggcacgggcgtcattcatcgaggtgaagacgtgcatctggcccaagtcccacaccctgtggagcaacggggtcctcgagtccgagatgattatcccgaagatttacggcggacccatcagccagcacaactaccgcccaggctactttacccagactgctgggccctggcatctgggcaaactggagcttgacttcgacctatgtgagggtacgaccgtggtagtcgacgagcactgtggtaaccggggcccgtccctgcgcactacgacggtgaccgggaagatcatccatgagtggtgctgccgatcgtgcaccctgccgcccctccggttccggggtgaagatgggtgctggtacgggatggagatacgccctgtcaaggagaaggaggagaatctggtcaaatccatggtgagcgccgggagcggcgaggtggactccttcagcctcggcctgttgtgcatctcaataatgatcgaggaggtcatgcgatcccgctggtcccggaagatgctcatgaccggaacgctggccgttttcttcctgctcatcatgggccagctgacatggaacgacctgatccgcctgtgcatcatggtgggggccaacgccagcgaccgcatgggcatgggcaccacctacctggcccttatggccacgttcaagatgcggcctatgttcgccgtcggcctcctgttccgccggttaacctcccgcgaggtgctcctgttgaccatcgggctctctctggtggcttcggtcgagctgcccaatagcttggaggaactgggcgacggtttagcaatgggcatcatgatcctcaaactgctgacggacttccagtcccaccagctctgggccacgctgctgagcctcaccttcatcaaaaccaccttttctctgcactacgcctggaagacgatggcaatggtcttgagcatcgtctccctcttccccctgtgcctgagcaccaccagccagaagaccacgtggctccccgtgctcctggggtctctcggttgtaagcctctgaccatgttcctgatcgctgagaacaagatttgggggcggcgctcctggcccctcaatgaaggcatcatggccgtggggatagtcagcattctgctgagctccttgctgaagaacgacgtgcccttggccggccccctcatcgccggcggaatgctgatcgcctgctatgtgattagcggctccagcgcggacctgtcactcgagaaggcggccgaggtcagctgggaggaggaagccgagcactcaggagccagccacaacatcctggttgaggtacaggacgacggaacaatgaagatcaaggatgaggagcgggacgacaccctgaccatactactgaaggcaacgctgctcgccgtcagtggggtgtacccgctgagcattcccgcaaccttatttgtttggtatttctggcagaagaaaaagcagcgctccggcgtcctctgggataccccctctccgcctgaggtggagagagccgtgttggacgacgggatctaccggataatgcaaagagggctgctgggccgcagccaggtgggggtgggcgtgtttcaggaaaacgtcttccacacgatgtggcatgtgacgagaggggccgtgctcatgtaccagggcaagcgccttgagcccagctgggcttccgtcaaaaaggacctgatctcatacggcggaggctggcggctccaggggtcctggaacaccggagaggaggtccaagtgatcgccgtcgagcccgggaaaaacccaaagaacgtgcagacggcccccgggactttcaagacgcccgagggcgaagtgggtgccatcgccctggacttcaagcccgggaccagcgggtcccccatagtcaatcgcgagggcaagatcgtgggcctgtacgggaacggcgtggtcaccaccagcggaacgtacgtgagcgcgatcgcccaggccaaggcctcccaggaggggcctctccctgaaatcgaggacgaggtgttcaggaagagaaatctgacgatcatggacctacaccccgggagcggcaagacccgccgctacctcccggcgatcgtccgggaagctataaagcgcaagctacgcaccctaatcctcgcccccaccagagtggtggcctcggaaatggccgaggcgcttaagggcatgcctatccgctaccaaaccacggccgtgaagtccgagcacacggggaaggagatagtggacctgatgtgccacgctactttcaccatgcgtctcctgtcccccgttcgcgtgccgaattacaacatgatcatcatggacgaggcccacttcacagacccctcttcgatcgccgcgcggggctacattagcacccgcgtggggatgggcgaggccgccgccatcttcatgacagccacgccgcctgggtccgtcgaggctttcccgcagtcaaacgccgtcatccaggatgaggagagggacatcccagagcgctcttggaatagcggctacgagtggatcaccgacttccccggcaagaccgtatggtttgtgccctccatcaaaagcgggaacgacatcgccaattgcctgcggaagaacgggaagcgcgtgatccaactctcccggaagacgtttgacaccgagtaccagaagaccaagaataacgactgggattacgtcgtgacgacggacatcagcgagatgggcgccaacttccgcgcggaccgggtcatcgacccgagacgatgcttgaagcctgtgatccttaaggacggccccgagcgcgtgatcctcgcagggccgatgccggttaccgttgcctccgccgcacagcggcgcggacggatcggtcggaaccacaacaaagagggggaccagtacatctacatgggccaacccctgaacaacgacgaagaccacgcgcactggaccgaggcaaagatgctgctggacaacattaacaccccagaggggatcatccccgccctcttcgagcctgagagagagaaatccgccgcaatagacggcgagtatagactgcgcggggaggcgcggaagacgttcgtagagcttatgcgccgcggcgacctgcccgtgtggctgtcgtacaaagtcgcctcagaaggcttccaatacagcgaccgccggtggtgcttcgacggtgagcgcaacaaccaggtcctcgaggagaacatggacgtggagatatggaccaaggaaggcgaaagaaagaagttgcgtccacggtggttggacgcccgcacctactccgaccccctcgccctgcgggaatttaaagagtttgccgctgggcgccggagcgtgtccggtgacctaatcctcgagattggcaagctgccgcaacacctgactcagcgcgcccaaaatgccctcgacaacctggttatgctacacaacagcgaacagggcgggcgggcctaccgccacgccatggaagagttgcccgacaccatcgagacgctgatgctactcgccttaatcgccgttctgaccgggggcgttactctctttttcctgtccgggcgcggtctgggaaagacctctatcggactcctgtgcgtcatggcatcctctgtgctgctctggatggcctcggtcgaaccccactggatcgccgccagcatcatcctggagttctttttgatggtcttacttatccccgaacccgaccgacagcgaacgccccaggacaaccagctggcctatgtggtgattggcctactgttcatgatcctaaccgtcgccgccaatgaaatggggctcttagagaccaccaagaaggacttaggcatcggtcacgttgcggtcgagaaccaccaccacgccgcgatgcttgatgtagacttgcaccccgcctccgcctggacgttgtatgcggtggccaccaccatcataaccccgatgatgagacacaccatcgaaaacactacggcaaacatcagcctcaccgccatcgccaaccaggcggccattcttatgggcttagacaaaggctggcctatctccaagatggatatcggggtgcccctcctggccctgggatgctatagccaggtgaatcccctcacgctgacagctgctgtactgatgctagtggcacactatgccatcatcgggccgggcctccaggccaaggcaacccgtgaggcacagaaacggaccgccgccgggatcatgaaaaaccccacggtcgacgggatcgtggccatcgacctagaccccgtcgtctatgacgctaagttcgagaaacaactgggccagatcatgctgctgattctctgcacttctcagatcctactaatgcgcactacgtgggcgctctgtgagagtatcacgcttgcgaccggacccctcaccaccctctgggagggcagcccggggaagttctggaacacgaccattgccgtaagcatggcgaacattttccggggctcctatctggccggggcggggctggccttcagcctcatgaagtcactgggtgggggccgccgggggacaggcgctcaaggggagaccctgggggaaaaatggaagcgccagctcaatcaattatcaaagagcgagttcaacacgtacaaacggtccgggataatggaggtggaccgcagcgaagccaaggaggggctgaagcggggcgagaccaccaagcacgcggtctcccgcgggaccgcaaaactccggtggttcgtggagcgcaaccttgtgaagcccgagggaaaggtcatcgaccttggctgcgggcgcggcgggtggagctactactgtgccggcttaaagaaagtgaccgaggtgaaagggtacaccaaagggggccccgggcacgaggagcccatcccgatggccacgtacggctggaatctggtgaagctgcactctgggaaggacgtgttcttcatcccgcccgagaagtgcgacaccctgctctgcgatatcggcgagagctccccaaatccgacgatcgaggaggggcgaaccctgcgggtgctgaagatggtcgagccctggttgcgcggtaaccagttttgcatcaaaatactgaacccctatatgccatccgtggtggagaccctggagcagatgcagcgcaagcacggcgggatgctcgtccgcaatccgttgtccaggaactcaacccatgagatgtactgggtgtcctgcgggaccgggaacatcgtcagcgctgtcaacatgacgtcccgcatgctgctcaacagattcacaatggctcaccggaagcccacgtacgaaagggacgtggatctgggtgccggcacccggcacgtggccgttgaacctgaggtggccaacctggacatcatcggtcagcggatcgaaaacatcaagcacgaacacaagtccacgtggcactacgacgaggacaatccctacaagacctgggcctaccacggttcctacgaggtgaagccgagcgggagcgcgagcagtatggttaacggcgtggtcaagctcctgactaagccctgggacgtcatccctatggtgacacagatcgccatgacggataccacccccttcgggcaacagagggtgttcaaggagaaggtggacacccgtacgccaaaggccaagcggggcaccgcgcagatcatggaggtgaccgccaagtggctctggggcttcctctcccgcaacaagaaacctcggatctgcacccgcgaggagttcacgaggaaggtccggagcaacgcggccatcggggccgtgttcgtggatgagaaccagtggaactccgccaaggaagccgtcgaggacgagcgtttctgggatctggtgcaccgcgagcgggagctgcacaagcagggcaagtgcgcgacttgcgtttacaacatgatggggaaacgcgagaagaagctcggcgagttcgggaaggccaagggcagccgggccatctggtacatgtggctcggcgcccgcttcctggaatttgaagcgctcgggttcatgaatgaagaccactggttttcccgagagaacagtctgtccggcgttgagggggaaggtctacacaaactcgggtacatcctgcgtgacatatcgaagataccgggcggaaacatgtacgccgacgacaccgccggatgggacacccgcataacggaggacgacctgcagaacgaggcccgcatcaccgacatcatggagccggagcatgccctcctggcgaggtctatcttcaaactgacctaccagaacaaagtggtccgggttcagcgccccgccaagaacggcaccgtcatggatgtgatcagccggcgcgaccagcgtgggtccggccaggtcggcacttacgggctcaacacctttaccaatatggaggctcagctgatccgacaaatggagagcgaaggcatcttctccccctcggagctggagacgcccaacctcgccgagcgggttctggactggcttgagaagtatggagtagagcgccttaagcggatggcgatctccggcgatgactgcgtcgtgaagccgatcgacgacaggttcgcaacggcccttaccgccctgaatgacatgggtaaggttcgaaaagacatcccccagtgggagccaagcaagggatggaacgactggcagcaggtccccttctgctcccaccatttccaccaactcattatgaaagatggccgcgaaatagtggtgccgtgcaggaaccaggacgagctggtcggccgcgcccgggtgagccagggcgccgggtggagcctgagagagaccgcgtgcctcggcaaatcctacgcgcagatgtggcagctgatgtactttcaccggcgtgatctgcggctcgcggccaacgcgatctgcagcgcagtccccgtcgactggatcccaacgtctcgcacgacctggagtatccacgcccatcaccaatggatgacaaccgaggacatgctgagtgtatggaaccgtgtgtggatcgaggagaatccctggatggaggacaagactcacatctcttcctggggagacgtcccatacctgggcaaacgggaggaccagtggtgcggcagcctcatcgggctgaccgcccgcgcgacctgggcgaccaacatacaagtagccatcaaccaggtgagacgcctgatcggtaacgagaactacctggattacatgacctccatgaagcggttcaagaacgagagcgatcccgagggagccttatggtga

SEQ ID NO: 24414 - RNA, 9879 nt, synthetic construct
  misc_feature 1..9879: note = derived and/or modified CDS sequence (opt11) from DENV-1__GQ868614__SS-prME
  source 1..9879: mol_type = other RNA
tcagtgactatgctgcttatgcttatgcccaccgccctggccttccatctcacaacccgtggcggagagccacacatgattgtgaccaagcaagagcggggcaagagcctactcttcaagaccagtgcgggggtgaatatgtgcaccctcatcgccatggacttaggcgagctgtgcgaggacaccatgacctacaagtgcccacggatcacagaggccgagcccgacgacgtggactgttggtgcaacgcaaccgacacctgggtgacctatgggacttgcagccagacgggtgaacatcggcgcgataaacggagcgtggcgctcgcgccccacgtgggcctggggctggagaccaggaccgagacatggatgagcagtgagggggcctggaagcagatccaacgggtcgaaacgtgggccctccgtcaccctgggttcaccgtgatcgccctgttccttgcccacgccatcggcacctccatcacccagaaggggataatcttcatcctcctgatgctggtgacgcccagcatggccatgcggtgcgtcgggatcggctcccgcgacttcgtggaggggcttagcggcgccacgtgggtggacgttgtccttgagcatgggtcttgcgtaaccaccatggccaaggacaagccgacgctggacatagaactcttgaaaactgaggtcaccaaccccgctgtgcttcggaagttgtgcatcgaggctaagatctccaataccacaaccgactcccgatgcccgacgcagggcgaggccaccttaatggaggagcaggacgcgaacttcgtttgccgtcgcaccttcgtggaccggggttggggtaacggctgcgggctgttcggtaagggctcgctcatcacttgcgccaaattcaagtgcgtcaccaaactagaaggcaagatcgttcagtacgagaacctgaagtactctgtaatcgtcaccgtgcacacgggcgaccagcaccaggtcgggaatgagagcaccgagcacggcaccacagcaaccatcacgccccaggcccccacgtccgagatccaactcaccgattacggggccctgaccctggactgcagcccgcgcacgggcctggactttaatgagatggtactgcttaccatgaaggaaaaatcctggctagtccacaagcagtggttccttgacctgccattaccctggacgagtggggccagcacatcccaagagacgtggaaccgacaagaccttctggtgactttcaaaacggcccacgcgaagaagcaggaggttgtagtgctcggcagccaagagggcgccatgcacacggccctgactggggcgacagaaatccagacatccggcactacgaccatcttcgcagggcacctgaaatgccgcctcaagatggacaaattgacattaaaaggcatgagctacgtgatgtgcaccgggcccttcaagctggagaaggaagttgccgagacgcaacacggtaccgtgctggtgcagattaagtatgaggggacggatgcgccctgcaagattcccttctccacccaagacgagaagggtgtcattcagaacggccggctgattacggccaaccccattgtgaccgacaaggaaaaaccagtgaacatcgaggccgagcccccgttcggggagagctacatcgtcatcggtgtgggagagaaagctctgaagctctcctggttcaagaaggggagctccataggcaagatgttcgaggccaccgccagaggggcccggcgcatggccattctgggcgacactgcgtgggacttcgggagcattggcggcgtattcacgtccgtcgggaagctggtgcaccagatcttcggtgccgcatacggggttcttttcagtggcgtgtcttggaccatgaagattggcatcggcgtactgctgacatggctgggtctgaacagccgatccacctctctgtccatgacgtgtatagcggtgggcctcgtcacactctacttgggcgttatggtgcaagccgacagcgggtgcgtaatcaactggaagggccgggaactcaagtgcgggtccggaatcttcgttacgaacgaggtgcatacttggaccgaacaatataagttccaggcggacagccccaagcgcctgagcgccgccataggcaaggcctgggaagagggggtttgcggaatccggagcgtgacccgtctagaaaacatcatgtggaagcagatcagcaacgagcttaaccacatcttactggaaaacgatatgaaattcaccgtggtcgtgggggatgtcgtgggcatcctcgcccagggcaagaagatgatcagaccccagcccatggagcacaagtattcctggaaatcctggggcaaggcgaagatcatcggggccgacgtgcaaaacaccacgttcatcatcgacgggcctaacacgcccgagtgcccagatgaccagagggcctggaacatctgggaagtggaagactacggcttcgggatctttaccaccaatatatggctgaaactgcgggactcttacacccaggcctgcgatcaccgcctcatgtccgcggccatcaaggactccaaggcggtccatgccgacatgggctactggatcgagtcagagaaaaacgaaacatggaaactggcacgggcgtccttcatcgaagttaagacctgcatctggccaaagagccacaccttgtggtcaaacggggttctcgagagcgagatggtcatcccgaagatctacggcgggccgatctcccagcacaactaccgccccgggtacttcacccaaacggctgggccgtggcacctgggaaagctggagctcgactttgacctatgcgagggcaccaccgtggtggtagatgagcactgcggtaaccgggggcctagcctgcggaccacgaccgtgaccggcaagatcatccacgaatggtgttgtcgtagctgtaccctgcctcccctccgtttcaagggtgaggacggttgctggtatgggatggaaatccggcccgtaaaggagaaggaggagaatttagtcaagagcatggtgagcgccggcagcggcgaggtagacagctttagcctcgggctactgtgcatctctataatgatcgaggaggtaatgaggtcccgctggagccgcaagatgctcatgacaggcacactggccgtgttcctcctccttatcatggggcagctgacctggaacgacttaataagactgtgcatcatggtgggggccaacgcctcagaccgcatggggatgggaaccacgtacttagccctcatggccacctttaagatgcgccccatgttcgccgtcggactgctgtttcgacgtctcacttcgcgggaggtgttgctcctaaccatcggcctctcgcttgtcgctagcgtggagctgcccaattccctggaggagctaggtgacgggctcgccatgggcatcatgatcctgaagctgttgacggacttccagtcgcaccaactgtgggccaccctcctctccctgacctttatcaagaccacgctaagcctacactatgcctggaagaccatggccatggtgctgtccattgtcagcctgttccccctctgtttatcaacaacgtcccaaaagacgacctggctgccggtattgctcggatccctgggctgcaagcccttgaccatgttcctcatcgcggagaacaagatatggggcagaaagagctggcccctgaatgaggggatcatggccgtgggagtagtgtccatcctactgtcttctctgctcaaaaacgacgtgccactggccggtccgctgatcgccggaggcatgcttatcgcctgttacgtcatcagtgggagttccgcggacctgtcgctcgaaaaagccgccgaggtgtcctgggaggaggaagccgagcacagcggggcgtcccacaacatcctggtcgaggtccaagacgacggtaccatgaagatcaaggacgaagaacgggatgatacgctgactattctgttaaaggctacccttctggccgtgagcggcgtgtatcccctctcaattcctgccaccctgttcgtatggtacttctggcagaagaagaagcagcgctccggcgtgctgtgggacactcccagcccgcccgaggtagagcgggccgtcctggacgatggcatctatcgcatcatgcagcggggccttctgggccgcagccaggtgggcgtgggggtcttccaagagaacgtctttcacacgatgtggcacgttacacggggcgccgtcctgatgtaccagggaaagcggctcgaaccatcctgggcgtccgtgaagaaggacctgatctcctacggcggagggtggcgtctgcaagggagctggaacaccggggaggaggtgcaggtcattgcagtagagcccggcaagaacccgaagaacgtgcagaccgcccccgggacgttcaaaacccccgaaggggaggtcggtgccatcgccttggacttcaagcccgggacgtccggcagcccgatcgtcaaccgggaggggaagatcgtgggcctttacggcaacggggtagtgacaacgtccggtacctatgtgagcgcgattgcccaggccaaggcctctcaggagggtccgctgccagagatcgaggacgaggtcttccggaaaaggaacctaactatcatggacctgcacccggggagcggtaaaaccaggcgctacctgcccgcgatagtgcgggaggccatcaagcgcaagttacggacgctgattctggcacctacacgcgtggtcgccagtgagatggcagaggcactcaaaggcatgcccatccgctaccagacaacggcggtgaagtccgagcacacgggaaaggagatagtggatttaatgtgccacgccaccttcacgatgcgtctgctcagcccagtccgcgtgcccaactacaacatgattatcatggacgaggcgcacttcaccgacccctccagcattgccgcccgggggtacatttccacgcgcgtcggaatgggagaggccgccgccatcttcatgacggccacgccgcccgggagcgtcgaggcgttcccccagtccaatgctgtaattcaggacgaggagcgggacatcccagagcgctcctggaactccgggtacgagtggatcaccgacttcccaggaaagacggtgtggttcgtccccagcatcaagagtggcaacgacatagccaattgtctgcgtaagaacggcaaacgcgtgatccaactttcgcggaagactttcgacaccgagtaccagaagacgaagaacaacgactgggactatgtggtcacaaccgacatctccgaaatgggcgccaacttccgggctgaccgtgtgatcgacccccgccggtgcctcaagcccgtaatcctgaaggacgggcccgagcgagttatcttagctggtccgatgcccgtgaccgtcgccagcgccgcccagcggcgcgggcggatcggccgcaaccacaacaaagaaggggaccagtacatctacatggggcagcccttgaacaatgacgaagaccacgcgcactggacggaagcaaagatgctgctggacaatatcaacacgcccgagggcatcatcccggcccttttcgagccggagcgagagaagtccgccgctatcgatggggagtaccgcctccggggtgaagcgaggaagactttcgtggagctgatgcgccgcggggacttgcccgtgtggctctcatacaaagttgcctcagagggtttccagtacagtgaccgccggtggtgtttcgacggcgagcgcaacaatcaggtgctggaggagaacatggacgtcgagatatggaccaaggagggggagcggaaaaagctccgcccccgctggttggacgcccggacctacagcgacccgttagctttgcgggagtttaaagagttcgcggcgggccgccggagcgtaagcggggatctgatcctggagatcggcaagctcccgcaacacctgactcaacgcgcccaaaacgccttggataacctggtgatgctgcataactccgagcagggcgggcgggcgtatcgccacgctatggaggaactgcccgacaccatagagaccttgatgctgctggccctcatcgccgtgctgacgggcggtgtcacgctgttcttcctcagcggccgcgggctaggtaagacctcaattggcttactgtgcgtgatggccagctctgtgctgctgtggatggcaagtgttgagccacactggatcgcggcaagtattattctcgagttcttcctgatggtactcctcattccggagcccgaccgccagcggacccctcaggacaaccagctggcctacgtggtcatcggcctcttgttcatgatcctgaccgtcgccgcgaacgagatgggcctgctcgaaaccacgaagaaggatttgggcatcggccacgtggcagtcgagaaccatcaccatgccaccatgcttgatgtggacctccacccggcttcggcctggactctatacgccgtagcgactacaatcatcacccctatgatgcgccacacgatcgaaaataccacggccaacatttccctgactgcgatcgccaaccaggccgctatcctcatggggctggataagggctggccaatatctaagatggacattggcgtccctctgcttgctttaggttgctactctcaggtgaaccctctgactctgaccgccgccgtactgatgctggtcgctcactacgcgattatcggccccgggctccaggctaaggccacgcgagaggcccagaaacgcaccgcggccggcattatgaagaaccccactgtcgacgggatcgtagctatagacctggatccagtcgtttatgacgccaaattcgagaagcagctgggacagatcatgttgctgatcctgtgcactagccagatccttctgatgagaacgacctgggctctgtgcgagtccataaccttggcgaccggcccgctgacaaccctatgggagggctcgccgggcaagttctggaacaccaccatcgccgtgtccatggctaacatcttccggggtagctacctagccggagctggcctggcgttctcactaatgaagtccctcgggggcgggcgacggggcaccggggcccagggcgagaccctgggggagaagtggaaacgccagctgaatcagctctcgaaaagcgagttcaacatttacaagcggagcggtatcatggaggtcgaccgcagtgaggccaaggaagggctgaaacgcggtgaaacgacccgacatgccgtgagccgcgggacggcaaaactgcgctggttcgtggagagaaacctggtcaagcccgaagggaaggtgatagatctcggctgcggccgcgggggctggtcttattactgcgccgggctgaagaaggtcactgaggtgaagggctacacaaagggcgggcccggccacgaggaaccgatcccaatggcaacctacgggtggaatctggtaaaacttcactccggcaaggacgtgttcttcacgcctcctgagaagtgtgacaccctgctgtgtgacatcggggagtccagtccgaaccccaccatcgaggagggccggactctaagagtcctgaagatggttgagccatggctgcggggtaaccagttctgcatcaagatcctcaatccctacatgccgagcgtagtcgagacgctcgagcagatgcagcgcaaacacggaggaatgctggtgcgtaaccccctcagccgcaattctacgcatgaaatgtactgggtatcgtgcgggaccggcaacatcgtctccgccgtgaacatgacctcaaggatgctactgaaccgcttcaccatggctcaccgaaagcccacgtacgagcgggacgtagacttgggtgcgggcactcgccacgtagccgtggaacccgaggttgcgaacctggacatcatcggacagcggatagagaacattaagcatgagcacaagagtacctggcattacgacgaggacaacccgtacaaaacctgggcgtaccacggcagctacgaggtaaagccatccgggagcgcatccagcatggtcaacggtgtcgttaagctactcacaaagccgtgggatgtgatccccatggtcacccagattgcgatgactgataccacgccattcggacagcagcgcgtgttcaaggagaaagtggacacgcggacccccaaggccaagcgcgggaccgcccagatcatggaggtcacggcccggtggctgtggggctttctgagccgcaataagaaacctaggatctgcacccgcgaggagttcacacgaaaggtgcgctccaatgcagcgattggcgccgtgttcgtcgacgagaatcaatggaactcagctaaggaggcagtggaggacgagagattctgggacctcgtccagaaggagcgcgaactgcacaagcaggggaagtgcgcgacgtgcgtctataacatgatgggcaagcgggagaagaagttgggggagtttggcaaggccaagggttcccgcgctatctggtacatgtggttgggcgcgcggttcctggagttcgaggcactaggcttcatgaacgaggaccactggttctctcgcgagaactcacttagcggggtggagggagagggcttgcacaagctgggctacatcctcagagacatctccaagatccccggcggcaacatgtacgcggacgataccgccggctgggacacccgtatcacagaggacgacctgcagaatgaggccaagatcacggacatcatggagcccgagcacgccctgcttgccacgagcatcttcaagctgacctatcagaacaaggtagtccgggtccaacgccccgcgaagaatggaactgttatggacgtcatctcacgccgggaccaaagaggcagcggccaggtgggcacatacggactgaatacgttcaccaacatggaggctcagctcatccggcaaatggagtccgagggaatatttctgcccagcgagctggagacaccgaacctggccgaaagagtgctggactggctggagaagcacggcgttgaacggctcaaacggatggcgatctctggcgacgactgtgtggtgaagcccatcgacgaccggttcgccaccgccctgacggctctgaatgacatgggtaaggtacgcaaagacatacctcagtgggagcccagcaaagggtggaatgactggcaacaggtcccgttctgctcccaccacttccatcagctgatcatgaaggacggtagagagatcgtggttccctgccgcaaccaggacgagctggtagggcgagcaagggtaagccagggggctggctggtctctgcgggagaccgcctgcctcggcaagtcttatgcgcagatgtggcaactgatgtacttccacagacgtgacttacgcctcgccgctaatgccatctgcagcgctgtccccgttgactgggtgcccaccagccggacaacttggtcaatacacgcccatcaccagtggatgaccaccgaggacatgctttccgtttggaatagagtatggatcgaggaaaacccgtggatggaggacaagacccatgtcagcagctggggcgacgtcccgtacctgggtaagcgggaggaccagtggtgtggctcactaatcggcctcacggcccgagctacttgggcgtccaacatacaggtggcgatcaaccaggtgcgccggctgattgggaacgaaaactacctagactacatgaccagcatgaagcgctttaagaacgaaggagaccccgagggcgccctgtggtaa

SEQ ID NO: 24415 - RNA, 9879 nt, synthetic construct
  misc_feature 1..9879: note = derived and/or modified CDS sequence (opt11) from DENV-1__GU131688__SS-prME
  source 1..9879: mol_type = other RNA
agtgtgaccatgctactcatgctgatgcccaccgccctagcctttcatttaacgacccggggcggggagccccatatgatcgtgagcaaacaggagcggggcaagagcctcctgttcaagacttccgccggtgtgaatatgtgcaccctgatcgcgatggacctgggcgagttctgtgaggacaccatgacctacaagtgcccccgcatcaccgaggccgagcccgatgatgttgactgctggtgcaacgccaccgacacttgggtaacctacgggacctgcagccagacaggtgaacatcggcgggataagcgtagtgtcgcgctggcgccccatgtgggcctcgggctggaaacgcgcaccgaaacctggatgtcctcggagggggcatggaagcagatccaacgggtcgagacctgggccctgcgccatcccgggttcacggtgattgccctcttccttgcccacgccataggaaccagcatcacccagaaagggatcatcttcatcctgctcatgctggtgaccccctccatggccatgcggtgcgtgggcatcggtagcagggacttcgtggaagggctgtccggcgccacgtgggtagacgtagtgctcgagcacggaagctgcgtgaccaccatggccaaggacaagcctaccctggatatagagctgctcaagacggaggtcaccgaccccgcggtgctgagaaagctgtgcatcgaggccaagatctccaacaccaccactgacagccgctgcccgacgcagggcgaggccaccctcgtggaagagcaggacgccaactttgtctgtcggcgcaccttcgtggaccggggatggggtaatggctgcgggcttttcggcaagggctccctgatgacgtgcgccaagtttaaatgcgtcaccaagctcgagggcaagatcgtccagtacgaaaacctgaagtatagcgtgatcgtgaccgtgcacacgggagaccagcaccaggtggggaacgaatccacggagcacggcaccacagcaaccataacgccacaagcccccagcacggagatccagctaaccgattacggggccctcacactggactgcagccccagaaccggcctggacttcaacgagatggtgctcctgacgatgaaggaaaagtcctggctggttcacaagcaatggttcctagacctgccgctgccctggaccagcggggcctctacctcacaagagacctggaatcggaaggacctcctggtcacgttcaagaccgcgcacgcgaagaagcaggaagtagtggtgctggggagccaggagggcgccatgcacacagccctcaccggggccacggagatccagacaagcggcacaaccacgatcttcgccggacacctgaagtgcaggctgaagatggacaaattaacactgaaggggatgtcatacgtcatgtgcaccgggtcctttaaactagagaaggaggtggcggaaacccagcacggcacggtgcttgtccaaatcaagtatgaaggcacagacgccccctgcaagatccccttcagtacccaggacgagaagggagtaacccagaacggccggctgatcacagcaaacccaatcgttactgataaggagaagccagttaacatcgaggccgagccacccttcggggaaagctacatcgtgataggagcgggcgagaaggctctgaagctctcttggttcaaaaaggggagctccatcggcaagatgttcgaagccaccgcacgcggggcccggcgcatggcgatcctcggggacaccgcctgggacttcgggagcatcgggggggtgttcacgtcagtcggaaagctggtgcaccagatcttcggtacggcctacggggtgcttttcagcggcgtctcgtggaccatgaaaatcgggatcggcgtgctcctgacctggttaggactaaatagccgctccacgagcctgtccatgacctgtatcgccgtggggctggtaaccctctacctgggcgttatggtgcaggccgacagcgggtgcgtcatcaactggaagggccgggagctgaagtgcgggagcggcatcttcgtgaccaacgaggtgcacacttggaccgagcagtacaagtttcaggcggattcccctaaacgcctcagcgcagctataggaaaggcctgggaggagggtgtctgcggcatcaggtccgccaccaggctggaaaacatcatgtggaaacagatctcaaacgagctgaaccacatcctcctggagaacgacatgaagttcaccgtagtggtcggcgacgtggccggcatcctggcccaagggaaaaaaatgattaggccccagcccatggaatacaagtactcctggaagtcctggggcaaagcaaaaattatcggcgccgacgtgcagaacactacgttcatcatcgacgggcccaacacccctgagtgccccgacgaccagcgcgcatggaatatctgggaagtcgaggactacggcttcgggattttcaccaccaacatctggcttaagctgcgggacagttacacccaagtgtgcgatcaccgcctgatgagcgccgcaataaaggacagcaaggccgtgcatgccgacatgggttactggatcgagagcgagaagaacgagacctggaagttggcgagagccagcttcatcgaggtcaagacctgcatctggcccaagagccacactctttggagcaacggcgtgctcgagagcgagatgatcatccccaagatctacgggggcccgatatcccagcataactaccgccccgggtactttacgcagaccgcaggcccctggcatctcgggaagttagagctggatttcgacctctgcgagggcaccaccgtggtcgtagacgagcactgcggcaaccgggggcctagcctgcgcacgaccaccgtgaccggcaaaatcatccacgagtggtgctgtcggtcctgcacgctgcccccactgaggttcaagggggaggacggctgctggtacgggatggagatccggcccgtcaaagagaaagaggagaacctggtcaagagcatggtgagcgccggctccggcgaggtagacagcttctcccttgggctcctgtgcatcagcatcatgattgaggaggtgatgcgctcgcggtggtccagaaagatgctgatgaccggcacactcgccgttttcttcctgctgatcatggggcagctcacctggaacgacctgatccggctatgcatcatggttggcgcgaatgccagcgatcgcatgggcatgggcacgacctacctcgccctgatggccacctttaagatgcgaccgatgttcgccgtggggctcctgttccggcgactgaccagccgggaggtcctgctcctgacgatcggtctgtccctcgttgcgagcgtcgagctgcccaactccctggaggagttgggcgatgggctggcaatgggcatcatgatcctgaagctcctgaccgacttccaaagccaccagctgtgggcgaccctcttatccttaactttcatcaagacgacgttcagtctccactacgcctggaaaaccatggcgatggtcctttccatcgtgagcctgttccccctctgcctatccaccacgtcacagaagaccacctggctgcctgtgctcctgggctccctagggtgcaagccgctcaccatgttcctgatcgccgaaaacaagatctggggccgcaagagctggccgctgaacgaggggatcatggccgtcggtatcgtgagcatcttattgtccgccctgctcaagaacgacgtgcccctggccgggcccctgatcgcgggagggatgctcatcgcctgctatgtcatctcgggctccagcgccgacctgtccctggagaaggccgccgaggtgagctgggaggaggaggccgagcacagcggcgccagccacaatatactcgtggaggtccaggacgacgggacgatgaagatcaaggacgaggagcgggacgataccctgactatactgctcaaggccactctgctggccgtgtctggggtgtacccgctcagcattcccgccacgctgttcgtctggtacttctggcagaagaagaagcagcggtcaggggttctgtgggacacgcccagcccgccggaggtagagcgggcggtcctcgacgacggaatctaccgcatcatgcagcggggcctgctgggaagatcacaggtgggcgtgggggtcttccaggagaacgttttccataccatgtggcacgtaaccaggggcgccgtgctgatgtaccaggggaagcgcctagaacccagctgggccagcgtgaagaaggacctgatcagctatggcgggggctggagactgcagggctcctggaacaccggggaggaggtgcaggtcatcgccgttgaacctggcaagaatcccaagaatgtgcagacggcccccgggacctttaagaccagcgaaggcgaggtcggggcgatcgcccttgacttcaagcctgggacctcgggcagccccatcgtgaaccgcgaggggaagattgtgggcctgtacggcaacggagtcgtgacgacgagcgggacctacgtgtccgccatcgctcaagcgaaggccagccaggaggggcccttaccggagatcgaggacgaggttttccggaagcgcaacctcaccatcatggacctgcatcccggctccggaaaaactcggcgctacctgcccgccatcgtgcgggaggccatcaagcgaaagctcaggaccctgattctggccccgacccgcgtggttgcgagcgagatggcagaggccctgaaggggatgcccatccgttaccagaccacggccgtgaaatccgaacacaccggcaaggaaatcgtggacttgatgtgtcatgccacattcaccatgaggctgctttcccccgtccgcgtgcccaattacaatatgattatcatggatgaggcgcacttcaccgacccgtccagcatcgccgcccgggggtacatctcaacccgcgtgggcatgggggaggccgccgcgatcttcatgaccgccacgccccccggctctgtcgaagcctttccccagtccaacgccgtgatccaggatgaggagcgggacataccggagcgcagctggaactccgggtacgaatggatcacggacttccccggaaagaccgtttggttcgtccccagcatcaagtccggcaacgacatcgctaattgcctacggaagaacggtaagcgcgtgatccaactgagtcgtaagaccttcgacaccgaataccagaagacgaagaacaacgactgggactacgtggtaaccaccgacatatccgagatgggcgccaacttccgcgccgatcgggtgatcgatccccgacggtgcctcaagccggtgatcctgaaggacgggcccgaaagagttatcctggccggccccatgcctgtgaccgtcgccagcgcggcgcagcggcgcggacggatcggccgcaaccacaacaaggagggggaccagtacatttacatggggcagccgcttaacaacgatgaggaccatgcccactggacggaggcaaagatgctgctggacaacattaacacccccgagggcataatccccgccctcttcgagcccgagcgggagaagtccgcggcgatcgatggggagtaccgcctgaggggagaagctcggaagaccttcgtggagcttatgcgccgaggggacctcccggtctggctgtcctacaaagtcgccagcgagggcttccagtactccgaccgccggtggtgcttcgacggtgagagaaacaaccaggtgctggaggaaaacatggacgtagagatatggaccaaggaaggggagcgtaagaagctccgcccccggtggctggacgcccgcacgtacagcgaccccctggcgctaagagaattcaaggagttcgccgccggccgccggtccgtgagtggggatctaatcttagagatcggcaaattacctcagcacctgacgcaacgcgcccagaacgcgcttgacaacctcgtgatgctccacaacagtgagcaaggtgggagagcataccgccacgccatggaggagttaccggacacgatagaaacactcatgctgctggccctcattgccgtgctaacgggcggggtgaccctgttctttctctccggtcgggggttgggcaagacctccatcggcctgctttgcgtgatggcgagcagtgtcctgctttggatggccagcgtcgagccccattggatcgccgcttccattatcctcgagttcttcctgatggtgttactcatccccgagcccgaccgccagcggaccccgcaggacaaccaactagcctacgtggtcatagggctgctcttcatgatcctgacggtggcggcaaatgagatgggcctgctggaaacgaccaagaaggacctggggatcggccacgtggcggtcgagaaccatcatcacgccgccatgctggacgtggacctccaccccgcgagcgcctggacactgtacgccgtggccacaacgatcatcaccccaatgatgcgtcataccatcgagaacaccacggccaacatcagcctgaccgcgatcgccaaccaggctgccatcctcatggggctggacaagggctggccgattagcaagatggacatcggggtccccttgctcgcgctggggtgttacagtcaggtgaaccccttgaccctcactgcggccgttctgatgctagtcgcacactacgccatcatcggccccgggctccaagcgaaggccacacgggaggcccagaaacgcaccgcggccggcataatgaaaaacccgacggtagacgggatcgtggcgatcgacctggaccccgtcgtgtatgacgccaaattcgagaagcagctgggccagattatgctcctgatcctgtgtactagccagatcttgctcatgcgcactacgtgggcgttatgcgagtccatcacactcgccacgggccccctgacgaccctgtgggagggaagccccggaaagttctggaacaccaccatcgccgtgtccatggcgaacatctttcgggggtcttacctcgccggcgccggcctggccttcagcctgatgaagtcactcggtggcgggcgtcgcggcacgggggctcagggcgagaccctgggcgagaagtggaagcgtcagctgaaccaactcagtaagtccgagttcaacacatacaagcggagcgggataatggaggtagaccgctccgaggccaaggaggggctgaaacgcggtgagaccacgaagcacgccgtgagccgcggcaccgccaagctgcggtggttcgtagagcgcaatctcgtcaagccggaggggaaagtgatcgaccttggctgcggccgaggggggtggtcctactactgcgccggcctgaagaaggtaaccgaggtcaaggggtataccaagggcggccccggccacgaagagcccatccccatggcgacgtatgggtggaacctggtgaaactccatagcggaaaggacgttttcttcatcccgcccgagaagtgtgacactctgctttgcgacatcggggagtccagccctaaccccaccatcgaggagggccgcaccctccgggtcctgaagatggtggagccgtggctgcgcggaaaccagttctgcatcaagatcttgaacccctacatgcccagcgttgtcgagacacttgagcaaatgcaacggaagcatggcggcatgctggtgcgcaatcccctctctcggaactccacccacgagatgtactgggtgagctgcgggaccggaaacatcgtctccgccgtgaacatgactagccgcatgctgctgaaccgtttcactatggcccaccgcaaacctacgtacgagcgcgacgtggacctcggggcaggcacccgtcacgtagcggtagagcccgaggtggcgaacctggacatcataggtcagaggatagagaacatcaagcacgagcacaagtctacgtggcactacgacgaagataacccgtacaaaacatgggcctaccacgggagctacgaggtcaagcccagcggcagcgcctcttccatggtgaacggtgtcgtgaaactgctcacgaagccgtgggacgtgatccccatggtaacccagatcgccatgaccgataccacgcccttcggccagcagcgggtgttcaaggagaaggtggacacccgcacccccaaagccaaacgggggacggcgcagatcatggaggtcacggccaagtggctgtgggggttcctttcacgcaacaagaagccaagaatctgcacccgcgaggagttcacccggaaggtgcgctccaacgccgccatcggggcggtgttcgttgacgagaaccaatggaacagcgccaaagaggccgtggaggacgaacggttctgggacttagtgcaccgcgagcgtgagctgcataagcaggggaagtgcgcgacctgcgtctacaatatgatgggcaagcgcgagaagaagctgggggagttcggcaaggccaaggggtctcgggccatctggtacatgtggcttggcgcccgcttcctggagttcgaagccctgggctttatgaacgaggatcactggttcagcagagagaactccctcagtggtgtagagggcgaggggcttcataagctgggttatatcctccgtgacatctccaagatccccggtggcaacatgtatgccgacgacacggcaggatgggacactcggatcacggaggacgacctgcagaacgaggctaagatcaccgacatcatggagcccgagcacgccctgctcgccaagagcattttcaagctgacgtaccagaacaaggtggtacgcgtgcagcggccggcaaagaacgggacggtgatggacgtcatctcccgccgcgaccagcggggcagcgggcaggtgggcacctacggcctgaataccttcacgaacatggaggcccagctcatccgccagatggagtcggaggggatcttctccccctccgagctggaaacccccaacctggcgggccgggtgctcgactggctggagaagcacggggtcgagcgcctgaagcggatggccatcagcggcgatgactgcgtggtgaagcccattgacgaccgctttgccgccgccctcaccgcgctgaacgacatgggtaaggtccggaaggatatcccccagtgggagccctccaagggctggaatgattggcagcaagtcccattctgctcacaccatttccatcagctaatcatgaaggacggccgggagatcgtggtcccctgccggaaccaagacgagttggtggggcgagcccgggtgagccagggagccgggtggtccctgcgcgaaaccgcctgcctgggtaagagctacgcgcagatgtggcagctcatgtatttccaccgacgcgacctccggctggcggccaacgctatctgcagcgccgtgccagtggattgggtgcctacctcccgcaccacctggtccatacacgcgcaccaccagtggatgacgacggaggatatgctcagcgtctggaaccgggtctggattgaggagaatccctggatggaggacaagacccacatatccagctggggcgatgttccctacctgggcaagagagaggaccagtggtgcggttccctgatcgggctcaccgcccgggccacctgggcaacgaacatccaagttgccatcaaccaggtgcgccgcctgatcggcaacgagaattacctggactacatgacctcgatgaagcggttcaaaaacgagtccgacccggaaggggcgctctggtga

SEQ ID NO: 24416 - RNA, 9879 nt, synthetic construct
  misc_feature 1..9879: note = derived and/or modified CDS sequence (opt11) from DENV-1__GU131689__SS-prME
  source 1..9879: mol_type = other RNA
tcggtgacgatgttcctaatgctcatgcccaccgccctagcttttcacctgaccacaagaggtggagaaccgcacatgatcgtgtctaagcaggaacgtggcaagagccttctgtttaagaccagcgccggggtgaacatgtgcacattgatagccatggacctcggggaattctgcgaggatacgatgacgtacaaatgccctcggatcaccgaggccgaacccgacgacgtggactgctggtgtaacgccaccgacacctgggtgacgtacggcacctgcagtcagactggggagcaccggcgggacaaaaggtccgttgccctcgcgccgcacgtgggcctggggctcgaaacgcgcacagagacctggatgagctccgagggggcctggaagcaaatccagagggtcgagacatgggcccttcgccatccgggttttacggtgatcgcactgttcctggcacatgctatagggaccagcatcactcagaaggggattatcttcatcctgctgatgctcgtaacccccagcatggccatgcgatgcgttggtatcgggagtagggacttcgtagaggggctgagtggcgccacgtgggtagacgtcgtgctggagcacggcagctgcgtgaccaccatggcaaaggacaagcctaccctcgacatcgaactgctgaagacggaggttaccaacccggcggtgctccggaagttatgcatagaggccaagatatccaacacgactacggactctcgctgtccgacccagggggaggctacgcttgtcgaagagcaggatgcgaacttcgtctgtcggagaaccttcgtggaccgcggctgggggaacggctgcggcttgttcggaaaagggtccctgatcacatgcgccaaattcaagtgtgtgacaaagctggagggcaagatcgttcaatacgagaacctcaagtacagtgtgatcgtgaccgtgcataccggcgatcagcaccaggtgggcaacgagtctactgagcacggcaccaccgcgactatcacgccccaagcccccagcacggagatccagctaaccgactatggggccctgaccctcgattgctctccccggaccggactggactttaatgagatggtgctgctcaccatgaaagagaaatcctggctggtgcataagcaatggttcctggacctcccgttaccctggaccagcggggcctccaccagtcaggagacgtggaaccggcaggacctgctagtgacatttaagaccgcgcacgcgaagaagcaggaggtggtcgtgctgggctcccaggaaggcgccatgcacaccgcactgacgggggccacggagatccagaccagcggaaccaccacgatttttgccgggcacttgaagtgccgcctgaagatggacaagctgacactcaagggcatgtcctacgtcatgtgcaccggaagcttcaaacttgagaaggaggttgcggagacccagcatggcacagttctggttcagatcaagtacgagggaaccgacgctccttgtaagatccctttctccacccaggacgagaagggtgtgactcagaacggccgactcatcactgccaacccgatcgtcaccgacaaagaaaaacccgttaacatcgaggccgaaccaccattcggagaatcgtacatagtcataggtgcaggtgaaaaggccctgaagctgagctggttcaagaagggcagctccattgggaagatgttcgaggccaccgcccgcggagcccggaggatggcgatcctgggcgatacagcctgggatttcgggagcataggcggagtgttcacgtccgtcgggaagctcgtgcatcagatcttcggcaccgcctacggggtgctgtttagcggcgtctcttggaccatgaaaataggaattggtgtgctgctaacatggctgggcctgaatagccgctccacgagcctatccatgacatgcatcgccgtcgggttagtcaccctttacctaggcgtgatggtgcaggccgacagcggatgcgtcatcaactggaagggccgtgagcttaagtgcgggagcggtatcttcgtgaccaatgaggtgcacacgtggaccgagcagtacaagttccaagcggattcccccaagaggctgtccgccgcgatcggaaaggcttgggaggaaggggtgtgtggcatccgttccgccacgcgtctcgagaacatcatgtggaagcagattagtaatgagctgaaccacatcctgctcgaaaatgacatgaaactaacagtagtggtcggggacgtggccggcattctcgcccaggggaagaaaatgatccggccccaacccatggaatacaagtactcctggaaaagttgggggaaggcgaagatcatcggcgccgacgtgcaaaacacaacattcataatcgacgggcccaacacgccggaatgccccgacgaccaacgagcgtggaacatatgggaggtcgaggactacggctttgggatcttcactaccaacatatggctcaaactacgggactcctacacccaagtgtgcgaccatcgactgatgagcgcagccataaaggattccaaagctgtgcatgccgacatggggtactggatcgagagcgaaaaaaacgagacgtggaaactggcgcgggcctccttcatcgaagttaagacgtgcgtgtggccaaagtcccacaccctctggtccaatggcgtgctggagagcgagatgatcatacccaaaatatatgggggcccaatctcacaacacaactaccggcccgggtacttcacccagaccgccggcccatggcaccttggcaagctggaactggacttcgacctctgcgagggcaccaccgtcgtggtcgacgagcattgcggcaatagggggccgagcttgcgcaccaccacggtcaccggcaagataattcacgagtggtgctgtcggtcctgcacgctgccgcccctgcgtttcaagggggaggacgggtgttggtacggcatggagatccggcccgtaaaggaaaaagaggagaacctggtcaagagcatggtcagcgccggatccggtgaggtcgatagcttctccctgggtctcctgtgcatcagcatcatgatagaggaagtaatgcgctcccggtggagccgaaagatgctgatgacgggcaccctagcggtgttcttcctcctgataatggggcagctcacctggaatgacctgatccggctatgcatcatggtgggggcgaacgccagcgaccggatggggatgggcacgacttacctcgccctaatggccactttcaagatgcgaccgatgttcgcggtggggctcctattccggcgattaacgagccgggaggtcctgctgctgacgatcgggctatccctagtcgcaagcgtcgaactgcccaactccctggaggaacttggcgacggtttagccatgggcatcatgatactgaagctcctcacggacttccagagccaccagctgtgggcaaccttgctgtcactgaccttcataagaacgactttcagcctccactacgcctggaaaacaatggcgatggtgctgtctatagtcagcctgttccctctctgcctgtccactacgagccagaagacgacctggctacccgtcctcttaggcagtctggggtgtaaaccgttaaccatgttccttatcgccgagaataagatctggggccgcaaaagctggcccctgaatgaggggatcatggccgtgggcattgtttcaatcctcctgtccagcttactcaagaatgacgtacccctggccggtcctttgatagccggcggtatgctcatcgcatgctatgtgatctccggaagctccgccgacttgagtctcgagaaggccgccgaagtgtcctgggaggaggaggcagagcatagcggtgcgtctcacaatatactcgtggaggtgcaggacgacgggacgatgaagatcaaggatgaagaacgagacgacacacttaccatcctcttaaaggccaccctgctcgccgtgagcggtgtctatcctctctcaatacccgcgaccctgttcgtgtggtatttttggcagaagaagaagcagaggtccggagtgctgtgggatacgcctagcccgcccgaggtcgagcgcgctgtgttagacgacggcatctaccggatcatgcagcgcggcctgcttgggcgatctcaggtgggcgtcggggtattccaggagaacgtcttccacaccatgtggcacgtcaccaggggcgcggtgctaatgtaccaggggaaacgactggaacccagctgggcatcggtgaagaaggacctgatcagttacggcggcgggtggaggctgcagggcagctggaataccggggaggaagtacaggttatcgccgttgagcccggcaagaaccccaaaaatgtccaaactgcccccgggaccttcaagacctccgagggcgaggttggggcgatcgctctcgatttcaagcccgggacaagcggaagccccattgtgaaccgggaagggaagattgtcggcctgtacggcaacggggtagtgacaacctccggcacctacgtcagcgcaatcgcccaggcgaaggcgtcccaagaggggcccctgccggagatcgaagacgaggtcttccgaaagcggaacctaacaatcatggacctgcaccccggctctgggaaaacgcgccgctatctacccgccatagtgcgcgaagccatgaagcggcgcctccgcaccctgatcctagcgccaacacgggtcgtggcctccgagatggcggaggcactgaagggtatgcctatcaggtaccagaccacggccgtcaagtccgagcataccggcaaggagatagtcgatcttatgtgccacgccacatttaccatgaggctcctctctcccgtccgcgtgcccaactacaacatgatcatcatggatgaggcccacttcacggaccctagcagtatcgcggcaagagggtacatcagtacccgcgtgggcatgggggaggctgccgcgatattcatgaccgcgacgccacccggctccgtggaggcctttccccagagcaacgccgtgatccaggatgaagagcgggacatccccgagcgctcttggaacagcggctacgaatggataacggacttccccggcaagaccgtctggttcgtgccctccatcaagtcgggcaacgacatcgcaaattgtctgcggaagaacggaaagcgcgtcatccagctaagccggaagaccttcgacaccgagtaccagaaaacgaaaaataacgactgggattacgtcgtgaccaccgacattagcgagatgggcgcaaacttccgcgccgaccgggtgattgaccccaggcggtgcctcaagccggtgatcctgaaggacgggccggagcgcgtaatcctggcagggcccatgccggtgaccgtcgcctccgccgctcaacggcgcgggcggatcggacgaaaccacaacaaggagggcgatcagtacatctacatgggccagccgttaaacaatgatgaggaccacgcccactggacggaagccaagatgttactggataacataaacacccccgaaggcatcatccccgccctcttcgagcccgaacgcgaaaaaagtgccgcgatcgacggtgagtaccggctgcgcggcgaggcccggaagaccttcgtggagctaatgcgcagaggggacttgcccgtctggttaagctacaaggtggcctccgagggcttccagtatagcgacagacggtggtgcttcgatggcgagcgcaataaccaggtgctggaggagaacatggacgtagagatctggacgaaggagggggagcggaagaaattgcgcccccggtggctggatgccaggacgtactccgaccccctggccctcagggagttcaaggagtttgcggccggccgccggagcgtttccggggacttaatcctggaaatcggcaagctcccacagcatctgactcagcgcgcccagaatgcattggacaacctcgtcatgttgcataatagcgagcaaggcgggcgggcgtaccgccacgccatggaagagcttcctgacacaatcgagaccttaatgctgcttgccttgatcgctgtcttgacggggggggttacgctgttcttcctctcaggcagagggctgggcaagaccagcatcggcttgctctgcgtgatggcctcgtcggtcctactgtggatggcgtcggtagagccccactggatagccgcctccatcatcctcgaattctttctgatggtgctgctcatccccgagcctgaccgccagcgaaccccgcaggacaaccagctggcatacgtcgtgatcggactcctcttcatgatactgaccgtagccgccaatgaaatgggtctgctcgaaactaccaagaaggacctcggtataggccacgtagctgtagaaaaccaccatcacgctgcaatgctggatgtggacttacatcccgcgtccgcgtggactttatacgctgtcgccacgacaattatcacccccatgatgcgacataccatcgagaacaccactgccaacatcagcctgactgccatagcgaaccaagcagctatcctcatggggctggacaagggctggccgatatccaaaatggacattggtgtccccctgctggctctggggtgctacagccaagtgaaccctctcactctgactgcagcagtcctaatgctggtggcccactacgccatcattgggcccggcctccaagccaaggcgacccgtgaggcgcagaagcggacagccgccggaatcatgaagaacccgaccgtggacgggatcgtcgccatcgacctggaccccgttgtgtatgacgcgaaattcgagaagcaactgggccaaatcatgctcctgatcttgtgcacctcccagatcctcttgatgaggacgacctgggccttgtgcgaaagcatcaccctcgccaccggcccccttaccaccctttgggagggttcccccggcaagttttggaacacgacgatcgcggtcagcatggccaacatattccgggggagttacttggcgggggccggactggccttctctctgatgaaaagtttggggggcgggcgcaggggcacgggggcgcagggcgagacattaggggagaagtggaagcgccagctgaaccagctctccaagagcgagttcaacacctacaagcgttccgggatcatggaggtggaccgcagtgaggcgaaagagggactgaagcgcggcgagactactaagcacgcagtgagccgcggcactgcaaagctacggtggttcgtcgaaaggaacctggtgaaaccggaggggaaagtgatcgacctaggctgtggccgcggcggatggagctactactgcgctgggctgaagaaggtcaccgaggtgaagggatacacgaagggcgggcctggccacgaggagcccattcccatggccacgtacgggtggaacctagtaaaactccactccggcaaggatgtctttttcatccctcccgagaagtgtgacaccctcctatgcgatatcggggagagctcccccaatcccaccatcgaggagggccgaacacttcgggtgctgaagatggtcgagccgtggctgcgcgggaaccaattctgcatcaagatcctcaacccctacatgcctagcgtagtggagacgctggagcagatgcaacggaagcatggcggcatgctggtacgcaacccgctctcccggaatagcacccatgaaatgtactgggtctcctgcgggaccgggaacatcgtaagcgcggtcaatatgacctcccgtatgctgctcaaccgctttacgatggcacataggaagccgacgtatgagcgcgacgtcgacctcggggccggcacacggcacgtggccgtggagcccgaagaggccaatcttgacatcatcggccagcgcatagagaacatcaagcacgagcacaagagcacctggcactatgacgaggacaacccttataagacctgggcgtaccacgggtcctacgaggtcaagcccagtggctctgctagcagcatggtgaacggggtggtcaagctcctcacgaagccgtgggacgtaatccccatggtcacccagattgccatgaccgacaccacgccctttgggcagcagagagtgtttaaggagaaggtcgatacccgcacccctaaagccaaacgggggaccgcccagatcatggaggtcacggcgaaatggctatggggattcctgtcccgaaacaagaagccgcggatttgcaccagagaggagtttacacggaaggtacgatcaaacgcggccatcggcgccgtgtttgtcgatgagaatcaatggaattccgcgaaggaagccgtggaggacgagcggttctgggatctcgtccaccgcgagagggagctgcacaagcagggcaagtgcgcgacctgcgtctataatatgatgggcaagcgtgaaaagaagctgggcgagttcggcaaggcaaaggggagccgagccatttggtatatgtggttaggtgcgagattcctggagttcgaggccctggggttcatgaatgaggaccactggttctccagggagaactcactctccggcgttgagggagaggggttacacaagctcggttatattcttcgcgacatcagcaagatcccggggggcaacatgtacgccgacgacacggcgggctgggatacaagaatcaccgaagacgacctgcagaatgaggcgaaaatcaccgatataatggagcccgaacatgcgcttctagcaaagtccatctttaagctgacgtaccagaacaaggtagtcagggtccagcgcccggctaagaacgggaccgtgatggatgtgatcagccgtcgcgaccagcgcggctccggacaggtaggcacctacggccttaatacattcacaaacatggaggcccaactaatccgccagatggagtcggaggggatcttctcccccagcgagttagagacgccaaatctggcagggagggtactcgactggctggaaaagcacggtgttgagcgcctaaagcggatggctatctccggtgacgactgcgtggtgaagcctatcgacgatcgcttcgcaaccgcactcaccgccttgaacgacatggggaaggtccggaaagatataccgcagtgggagccgtccaagggctggaacgattggcagcaggtccctttttgcagccatcacttccaccagctgatcatgaaggacggccgcgaaatcgtggtcccctgccgcaaccaggacgagcttgtggggcgcgcccgtgtgtcccagggcgcgggttggagcctgagagagacggcttgcctgggtaagtcctacgctcagatgtggcagctcatgtacttccatcgcagagacttacgtttggcagcgaacgccatctgcagcgccgtcccggtggactgggtgcccactagccgcaccacctggagcatccacgcccaccaccagtggatgacgaccgaggacatgctcagtgtctggaacagagtgtggatcgaagaaaatccatggatggaggacaagacacacgtgtcttcctggggggacgtcccctacctgggcaagcgagaggaccagtggtgcggcagtctgatcggcctcacggcccgcgcgacgtgggccaccaacatccaggtagccatcaaccaggtacgacggctgctgggcaacgaaaactacctcgactacatgacctccatgaagcggttcaagaacgagagcgacccggaaggggccctgtggtag

SEQ ID NO: 24417 - RNA, 9879 nt, synthetic construct
  misc_feature 1..9879: note = derived and/or modified CDS sequence (opt11) from DENV-1__GU131690__SS-prME
  source 1..9879: mol_type = other RNA
agcgtaaccatgttgctgatgctgatgccaacggctcttgcgttccacctaactacccggggcggggaaccccacatgattgtgagcaaacaggagcggggtaagagcctgctgttcaagacaagcgccggggttaatatgtgcaccctcatcgcgatggatctaggcgaactgtgcgaagacacgatgacctacaaatgtcccagaatcaccgagaccgagcccgacgacgtggactgttggtgcaacgccacggacacctgggtgacctatggaacctgcagccagacgggggagcaccggagggacaagcggtccgtggctctcgcgcctcacgtgggcttggggctggagacacgcactgagacctggatgagctccgaaggagcgtggaagcagatccagcgcgtcgaaacatgggccctgcgtcaccctggtttcaccgtgattgccctgttccttgcacacgcgatcggcacctcgatcacccagaaaggtataatatttatcttactaatgttagtgacgccctcgatggccatgcgctgcgtcggaattgggagccgagacttcgtcgagggactatccggcgccacctgggtggacgtggtcctggagcacggaagctgcgtcacaaccatggccaaggacaagcccacgctggacatcgaacttttaaagaccgaggtcacgaaccccgccgtcttgcgaaagctctgcatcgaggccaaaatttccaacaccacgaccgacagccgctgtccaacccagggtgaagccaccctggtagaagaacaggacgccaacttcgtctgccgtagaactttcgtggacagaggctgggggaacggctgcggactgttcggtaagggcagtctcattacatgcgccaaattcaagtgcgttaccaagttagaaggcaagatcgtacagtatgagaacctgaagtactccgtcatcgttacggtccacacgggcgatcagcaccaggtagggaacgaatctaccgaacacgggaccaccgccacgatcacgccccaagcgcccaccaccgagatacagctcaccgattacggggctctaacgcttgattgcagccccaggaccggcctagacttcaacgagatggtgctactgacaatgaaagagaagtcatggctcgtgcacaaacaatggttcttggacctccccctcccatggaccagcggggcaagcactagccaggagacctggaaccggcaggatctactggtgacgtttaagaccgcccatgccaagaagcaagaagtcgtggtgctggggtcccaagagggcgcaatgcatacggcccttaccggagctaccgagatacagacctccggcacaaccaccatcttcgccgggcacctaaagtgccgcttaaaaatggacaaactgaccctaaaaggaatgagctacgtcatgtgcactgggtcctttaaactcgaaaaggagctcgcagagacgcagcacgggacagtgctggtgcaaataaaatatgagggcaccgacgcaccctgcaagatccccttcagcacgcaagacgagaagggggtcacacagaatgggcggctaatcacagcgaaccctatcgtaaccgacaaggagaagcccgtgaatatagaggctgagccgccgttcggggaatcttatatcgttattggagccggagagaaggcgcttaagctgtcgtggttcaagaaagggtcctcaatcgggaagatgttcgaagccacggccaggggcgcccggaggatggccatcctgggtgacaccgcgtgggacttcgggtccatcggaggcgtatttaccagcgtgggtaagctcgtccaccagatcttcggcacagcgtatggggtgcttttctccggagtcagctggacgatgaagatcgggatcggcgtattgctcacgtggctcggcctgaactcccgcagcacgtcccttagcatgacatgcatcgccgtaggtctggtgacgctctacctcggagtaatggtgcaggccgactccgggtgcgtgatcaactggaagggccgggagctcaagtgcgggagcggcatcttcgtcacgaatgaggtgcatacctggacagagcaatacaagttccaagcagacagcccgaagcgcctgtccgcggccataggcaaagcgtgggaggaaggggtctgcggcatccggagcgtgaccagactcgaaaacattatgtggaagcaaatatccaatgaactgaaccacatactgctcgagaacgacatgaaattcacggtggttgtgggagatgtggcggggatcctggcccagggaaagaagatgattcgtccccaacccatggaacataagtacagctggaagtcttggggaaaggccaagattatcggcgccgacgttcagaacacaacgtttattattgacggccccaacacaccggagtgtcccgacgatcagagagcctggaacatctgggaagtcgaggactatggcttcgggatattcacgaccaacatctggctcaagctccgtgacagctacacccaggtttgcgaccaccgcctcatgtccgccgcgatcaaagatagcaaggccgtacacgccgatatgggctactggatcgaatccgagaagaacgaaacatggaaacttgcgcgtgcgtcttttatcgaggtcaagacctgtatttggccgaagtcccacacgctctggagtaatggcgtattggagtccgaaatgatcatccccaagatctatggaggccctatcagccaacacaactaccgccccggatattttacacagaccgcgggcccatggcacctggggaagttggagctggactttgacttatgcgaaggcacgacagtggtcgtggacgagcactgcggcaatcggggcccgtccctgcgcactaccacggtgaccggcaaaataatccatgagtggtgctgcagaagctgtaccctgccgcccctgagattccgcggggaggacggatgctggtacgggatggaaatccggcccgtcaaggagaaggaggaaaacttagtgaagagtatggtgtccgcgggcagcggggaggtcgattccttcagcctagggctcctctgcatatccatcatgatcgaggaggtgatgcgcagccgatggtctcgaaagatgcttatgacgggtacgctggccgtgtttttcttgctgatcgtggggcaactgacctggaacgacctcattcgcctgtgcatcatggtcggcgccaacgcaagcgaccgtatggggatgggcactacctacctggcgctcatggccactttcaagatgcggcctatgttcgccgtgggtttgctgtttcgccggctcacatcccgcgaagtcctactgctcaccatcgggctgtctctggtggcgagtgtggagctcccaaacagcctggaggagctgggagacgggctggccatgggcatcatgatcttgaaactgctcaccgacttccagtcacatcagctttgggcgaccctgctgagcttaactttcatcaaaaccaccttcagcctacattacgcctggaagaccatggcaatggtgctcagtgtagtctccctgttccccctttgcctctcaactacctcccagaagacaacttggctgcctgtgctgctgggcagcctggggtgcaaaccgctgaccatgttcctaatcgccgagaataagatctggggccgccgctcctggccgttaaacgagggaattatggcggtgggcattgtgtctatcctactcagctctctgctgaagaacgatgtccccctcgccgggcccctgatcgccggcggcatgctgattgcgtgctacgtgatctcggggagcagcgcggatctcagtctggaaaaggccgcagaggtcagctgggaggaagaggccgaacattcaggtgcctcccacaacatcctggtagaggttcaggacgacgggaccatgaagatcaaggacgaggagcgggatgataccctcaccatactgctgaaagcgaccctcctggcggtctctggcgtgtacccgcttagcatcccggccaccctcttcgtgtggtacttctggcagaaaaagaaacagcgctccggggtgttgtgggacacgcccagccctcccgaggtggagcgggccgtgttagacgacggaatatatcgcatcatgcagcggggtctgttagggcgctcgcaagtaggggtgggggtgttccaggagaacgtattccacacgatgtggcatgttacacggggtgccgttctgatgtaccaggggaagcgcctcgagccgtcgtgggcgtccgtgaaaaaggacctgatctcgtacggaggcggctggcggctacagggctcctggaacaccggtgaggaagtccaggtcatcgcggtggagcccgggaagaaccccaagaacgtgcaaacggcccccggcaccttcaagacgccagagggagaggtgggtgcaatcgcgctggactttaagcccggtacgagcgggtcgcccattgtcaaccgcgagggtaagatagtgggcttgtatggcaatggggtggtcaccacatccggtacgtacgtgagcgccatagcgcaggcaaaggcgtcacaagaggggccgctgcccgaaatcgaggacgaggtgttccggaagagaaacttgaccatcatggacctgcaccctggcagcgggaaaaccaggaggtacttaccggctatagtccgggaagcgatcaagcgcaagctgcgcaccttaatcttagcccccacgcgtgtcgtggcctccgagatggcagaggcactgaagggcatgcccatacgctaccagaccaccgctgtcaagagcgagcacactggcaaggagatcgtggacctcatgtgtcacgccacattcaccatgcgtctgctgtcccccgtgagagtgccgaactataacatgataatcatggacgaggcccacttcaccgaccctagctccatagccgcacgggggtacatctcaacccgtgtcggaatgggggaggccgcggccattttcatgacggccaccccgcccggctccgtggaagcctttccacagtcaaacgcggtgatacaagacgaggaacgagacatccccgagcgctcctggaacagcgggtatgaatggataaccgattttccaggcaagaccgtttggtttgtgccgtccattaagagcggcaacgacatcgccaactgcctccggaagaacgggaaaagggtcattcagctttcccggaaaacgttcgataccgaataccagaagacaaagaacaacgattgggattacgtggtgaccacggacatatcagagatgggcgccaatttccgggcagaccgggtgattgacccgcgacggtgcttaaagcccgtgatcttaaaagatggcccggagagagtcattctcgcggggccgatgccggtaacggtggcgtccgccgcacagcggcgtgggcggatcggccgcaaccataacaaggaaggtgaccaatacatctacatggggcagcccctgaacaacgacgaggaccacgcacactggaccgaagcgaaaatgttgttagataacatcaacacacccgaaggtatcattcccgcactgtttgagcccgaacgcgaaaaatccgctgctattgacggggagtaccgactccgcggcgaggcacgtaagacgtttgttgaactgatgcgccgcggggacctgcctgtctggctttcctacaaagttgcgagcgaaggcttccagtacagcgacagacggtggtgcttcgatggcgagagaaacaaccaggtcttagaagagaacatggacgtcgagatctggacgaaagagggggagcggaagaagctgcgcccacgatggctcgacgcgcggacctatagcgacccactggccttacgggagttcaaagaatttgcagcaggccgccgatcggtgtccggcgacctcatactcgagatcggcaagttgccgcagcacctcacccagcgagcgcaaaacgccctggacaacctcgtcatgctccacaacagcgagcagggcgggcgagcttacagacacgctatggaggaactgcccgacactatcgagaccttgatgctcctcgctttaatcgccgtactgactggcggggtgacactcttcttcctgtccggccggggactaggcaagactagcatcggcctcctgtgcgtgatggcatcctccgtgctactgtggatggcatctgtagaaccccattggatcgctgcgagcatcatcctggagttctttttaatggttctgctgatccccgaacctgaccgccaacggacaccccaagacaaccagctcgcctacgtggttattgggctgctttttatgatcctgactgtagccgccaacgagatgggcttgctggaaaccaccaaaaaggacctcggtatcggccacgtggcagtggagaatcaccaccacgcggccatgctggatgtcgacttacaccccgcctccgcctggactctatacgcggtagcaaccacgatcatcacgccgatgatgagacacacgatcgagaacaccaccgccaatatcagcctgaccgccatcgccaaccaagcggccatcctgatgggtctcgacaagggctggcccataagtaagatggacatcggcgtgccccttctggcacttggttgctatagccaggtcaacccgctgacgctgaccgccgccgtgctcatgctggtggcgcactatgccattataggcccggggcttcaggcaaaggctacccgcgaagcccagaagcggactgccgctggcatcatgaagaaccctacggtcgatgggatcgtggccatcgacctcgatccggtggtatacgatgccaagttcgaaaagcaactgggtcaaatcatgctacttattctgtgtacatcacagattctgcttatgcgcaccacctgggctctgtgcgagtcaatcacgctggcgaccggccctctcaccaccctttgggaggggtcgcctgggaagttctggaacactactatagcagtgtcaatggcaaacatcttccgggggtcctatctagccggcgccggcctcgcgttcagcctgatgaagtccctaggagggggccgccggggtacaggcgcacaaggcgaaacgctcggagagaagtggaagcggcaactgaaccagctttccaagagcgagttcaacacgtacaaacgttccgggatcatggaagttgaccgctcagaggccaaggagggcctgaaacgcggggaaacgaccaagcatgccgtctcgcgcggtaccgcgaagctgaggtggttcgtggagcgcaacctggtgaagccagagggtaaggtcatcgacctgggctgcggaaggggcgggtggtcgtattactgcgccggactcaagaaagtcacggaggtgaagggctatacaaagggcggcccaggccacgaggagcccataccgatggcgacctatgggtggaacctggtgaagctgcactcgggcaaggacgtgttcttcatcccgcccgagaagtgcgacaccctgctgtgcgacattggggagagctcccccaacccgacgattgaggagggccgcacactgagggttctcaagatggtcgaaccctggctgcgcggtaaccagttctgcataaagatcctgaacccatatatgccgagcgtggttgagaccctcgagcagatgcagagaaaacacggcggcatgctggttagaaaccctctgtcccggaactccacccatgaaatgtactgggtctcttgcggtacaggaaacatagtgtctgccgtcaacatgacttccaggatgctcttgaaccgcttcaccatggcccatcggaagcctacctacgagcgcgacgtggacctgggggcgggaacccggcacgtggccgtggagcccgaagtcgccaacctcgacatcatcggacaacgtatagaaaacataaagcacgaacataagtccacgtggcactacgacgaagacaacccatacaaaacatgggcgtatcacggctcttacgaggttaagccatcgggatccgccagctctatggtcaacggagtggtaaaattactgacaaagccctgggatgtcatacccatggtgacgcagattgccatgacggacactacgccctttggccaacagcgagtcttcaaggagaaggtggacacaaggaccccgaaggcaaaacgggggaccgcccagatcatggaggtgacagcgaagtggctctggggtttcctatctaggaacaagaaaccgcgcatttgcaccagagaggagttcacgcggaaggtccgcagcaacgcagcgatcggcgcggtgtttgtggacgagaaccagtggaactccgccaaggaagccgtcgaggacgaacggttctgggatctggtacatcgcgagcgcgagctccacaagcagggaaaatgtgcgacgtgcgtgtacaacatgatggggaaaagagagaagaagctgggcgagttcggcaaggcgaaagggagccgggccatctggtacatgtggctaggcgcacgcttcctcgagttcgaggctctgggcttcatgaacgaagatcattggttttcgcgagagaacagcctgtccggtgtcgagggagaagggttgcataaactgggctacatcctgcgggacataagcaagatccccgggggcaacatgtatgcggacgacaccgctggctgggatacgaggataactgaggacgacctgcagaacgaagcacgtatcaccgacattatggaaccggagcacgcgctgctagccaagtcaattttcaaactaacctaccagaacaaggttgtgcgcgtccagcgtcccgctaagaacggtaccgtcatggacgtgatctctaggcgggatcagcgcgggagcgggcaagttggcacttacggtctgaataccttcaccaacatggaggcccagctgatcaggcagatggagtcggaggggatcttcagtcccagcgagctcgagacacccaacctggctgaaagggttctggattggctagaaaaatatggcgtggagcgtcttaagcgcatggccatctccggggacgactgcgtagtgaagccaattgatgaccgtttcgcaacggcgttaaccgctctcaacgacatgggaaaggttcgcaaggacatcccccagtgggagcctagcaagggatggaacgactggcaacaggtgcccttctgctctcaccacttccaccagctgatcatgaaggatggacgggagatcgtggtaccctgccgcaatcaagacgagctagtaggccgggccagagttagccagggggccggctggagcctccgggagacagcctgtctgggtaagtcctacgcgcaaatgtggcagcttatgtatttccacagacgggacctgcgtctcgccgccaacgccatttgtagcgcggtccctgtagattggatcccaacatcccggacgacctggtctatccatgcccaccaccagtggatgacgacagaggacatgttaagcgtgtggaacagggtgtggatcgaagagaacccatggatggaggacaaaacgcacatctcgtcctggggcgacgttccctacctcggcaagcgtgaggaccagtggtgcgggagcttaatcggcttaaccgcgcgggccacttgggctaccaacatccaggtggcgatcaaccaggtcaggcggctcatcggtaacgagaactacttggactacatgacctccatgaagcgctttaagaacgaaagcgacccggagggagccctgtggtag

SEQ ID NO: 24418 - RNA, 9879 nt, synthetic construct
  misc_feature 1..9879: note = derived and/or modified CDS sequence (opt11) from DENV-1__GU131695__SS-prME
  source 1..9879: mol_type = other RNA
agcgtgacaatgctgctaatgttaatgcccaccgcgctagccttccacctcactaccagaggcggggagccccacatgatcgtgagcaagcaggagcgtggcaagtcacttctgttcaagacctccgccggagtgaatatgtgcactcttatcgccatggacttgggcgagctgtgcgaggacaccatgacctacaagtgccctagaatcaccgagaccgagcctgacgacgtggactgctggtgcaacgccaccgacacctgggtgacctacgggacctgcagccagacgggcgagcatcggagagacaagagatccgtggccctggcgccccacgtagggctaggcctggagacacgcactgagacctggatgagctccgagggcgcctggaagcagatacaacgcgtcgagacctgggccttgcgccacccagggttcaccgttatcgccttattcctggcccacgcgataggcacctctatcacccagaaagggattatcttcatcttattgatgctggtgacgccttccatggccatgcggtgcgttggtatcggctcccgcgacttcgttgagggactttccggcgcgacgtgggtggatgtcgtcctggagcatgggtcctgcgtaaccacgatggccaaggacaagccgacgctagacatagaactgctgaaaaccgaagtcactaaccccgccgtgcttcggaaactctgcatcgaagcgaagatctccaataccacgaccgacagccgctgcccgactcagggcgaggcaaccctggtggaggagcaagacgccaacttcgtctgccggcgaacgttcgttgaccgcggctgggggaacggctgcggattgttcggtaaggggtccctcataacgtgtgccaaattcaaatgcgtcaccaagctggaggggaagatcgtacaatacgagaacctgaagtacagcgtgatcgtgaccgtccacacgggcgaccaacaccaggtgggtaacgagtctaccgagcacggcaccacagccacgatcactcctcaagctcccaccaccgagatccagctcaccgactacggggccctgacgctggattgtagcccacggaccggcctcgacttcaacgaaatggtcctgctgaccatgaaggagaagtcctggctcgtgcacaagcagtggttcctcgacctacccctgccttggaccagcggggccagcacaagccaggagacctggaaccggcaggacctcctggtgaccttcaagaccgcccacgccaagaagcaggaggtcgtggtgctcggcagccaggagggcgcgatgcacactgcccttacgggggccaccgagatccagacctctggcaccaccaccatcttcgccgggcacctcaagtgtcgcctcaagatggacaagctgaccctgaagggcatgagctacgtcatgtgcaccgggtccttcaagttagagaaggaggttgcggagacccaacacgggactgtgctggtccagatcaagtacgaaggcactgacgcgccctgcaagatccccttcagcacgcaagatgaaaaaggggtgacccaaaacggacggctcattaccgccaacccgatcgtgacggacaaggaaaagcccgtgaacatagaggccgaaccccccttcggggagtcctacatcgtgatcggcgccggggagaaagcgctgaagctcagctggttcaagaagggctcctcgatcggcaaaatgtttgaagcgacggcccgcggtgcccggagaatggcaatcctaggcgacacggcgtgggattttggatccataggcggcgtgttcacctccgtcgggaagttagtgcatcagatctttggcaccgcctacggggtcctcttctccggggtctcttggacgatgaagatcgggatcggcgtgctcctgacctggctcggtctcaattcccgcagcacctcactgtccatgacctgcatcgccgtcgggctcgtcaccttatacctcggtgtgatggtacaggccgatagcgggtgcgtcattaactggaaaggccgggagctcaaatgcgggagcggtattttcgtaaccaacgaggtccacacctggaccgagcagtacaaattccaggcggatagcccgaagcgcctttccgcggccatcggcaaagcctgggaggagggggtctgtggcattcggagcgccacccgcctggagaacattatgtggaagcagatctccaacgagctcaatcacattctgctggagaacgggatgaagttcacggtggtagtaggcgacgtggccgggatcctcgcgcagggcaagaagatgatacgtccccagcccatggaatacaagtacagctggaagtcctggggcaaggccaagataatcggggccgacgtgcagaacaccacgtttatcatcgacggccccaacaccccggagtgccccgacgaccagcgcgcctggaatatctgggaagtcgaggactatgggtttggcatcttcactaccaacatatggttaaagctgcgggattcctatacccaggtttgtgatcatcgcctcatgtccgcggcgatcaaggacagcaaagccgtgcacgcggacatgggctactggattgagtccgagaagaatgagacctggaagctggcacgggcgagctttatagaggttaagacgtgtatctggcctaagagtcacaccctctggagcaatggggtactcgagtccgaaatgatcattcccaagatctacggggggccgatctcacagcacaactacagacccggctactttacccagaccgccgggccctggcacctgggcaagctggagctcgacttcgacctctgcgagggcaccactgtcgtagtggatgaacactgcggcaaccggggtccttccctgcgcaccaccacggtgaccgggaagattatccacgagtggtgttgccggacgtgcacgcttccgcccctccgcttcagaggcgaagacggatgctggtatggcatggagatccgacccgttaaagagaaggaggagaatctcgtcaagtcaatggtgtccgcgggcagcggggaggttgacagcttctcccttggcctgctgtgcatctccataatgatcgaggaggtgatgcggtcccgctggagccggaagatgctcatgacggggactcttgcagtgttctttctgctcatcatgggccagctcacttggaacgacctgatacgtctctgtatcatggtcggcgccaacgcgtccgaccgcatgggcatgggtaccacttacctggccctgatggccactttcaagatgagacctatgttcgccgtaggcctcctgtttcgccggctgaccagccgagaagtgttgctgctgactatcgggctctcactggtcgccagcgtggagcttcccaacagtctggaagagctcggggatggcctggcgatgggcatcatgattctcaagctgctgacagatttccagagtcaccagctctgggccaccctgctaagtttgacctttatcaagaccacgttcagcctgcattacgcctggaagaccatggccatggtcctgagtatcgtgagcctctttcccctgtgcctgtccaccaccagccagaagacgacctggcttcccgtgctgctggggtccctcggctgtaagccactaaccatgtttttaatcgcagagaacaagatctggggacggcgcagctggcccctcaacgaggggataatggcagtagggatcgtgtcaatcctgctgtctagcctcctcaagaacgacgtgcccctggctggccccctcatcgccggcggtatgctcatcgcttgttacgtcattagtggcagctccgccgacctgagcctggagaaggctgccgaggtttcctgggaagaagaggccgagcacagtggggcgtctcacaatatcctagtggaggtacaggacgacggcacgatgaagatcaaggacgaggagcgggacgacaccctgacgatcttactgaaggcgaccctcctggcggtgagcggtgtatacccgctgagtatcccggccaccctgttcgtctggtacttctggcaaaagaagaagcagcggagcggcgtgctctgggacacccccagcccgccagaagtggagcgggccgtcctcgacgacggcatctatcgcattatgcaacgcgggctgctgggccgcagccaggtaggggttggcgtcttccaggagaacgtgttccacacgatgtggcacgttacccgcggcgctgtcctcatgtaccagggcaagaggttagagccctcctgggcgtcggtgaaaaaggaccttatcagctacgggggaggctggcggctccagggaagctggaacaccggcgaggaggtgcaagtcatcgccgtggaacccgggaagaaccccaaaaacgtgcagaccgcccccggcacgttcaagacccccgagggcgaagtcggggcgatcgccctggacttcaagcccggcacctccgggagccccatcgttaaccgcgagggcaagatcgtgggcctgtacgggaacggcgtcgtgaccacgtcggggacctacgtgagcgcgatcgcgcaggccaaggcatcacaggagggaccgctccctgaaatagaagacgaggtgttcagaaagcgaaacctgaccatcatggatttacatcccggttccggcaagacccggcgttacctcccggctatcgtgagagaggctataaagcgcaagctgcgcacgctgatccttgcccccacccgggtggttgcaagcgagatggccgaggcgctgaagggcatgcccatccgctaccagaccaccgccgtcaagtccgagcacaccgggaaggagatcgtggacctgatgtgtcatgcaaccttcacgatgcgtttgctgtcgcccgtacgcgtgccgaactacaacatgattatcatggacgaggcccactttaccgatccgtcaagcatcgctgcgaggggctacatctccactcgcgttgggatgggagaggccgccgccatcttcatgaccgccacaccgcccggaagcgtcgaggcgttcccgcagtccaacgccgttatccaggacgaggaacgggatatcccagagcgcagctggaattctggctacgagtggatcaccgacttccccggcaagacggtgtggttcgtccccagcatcaagagcggtaacgacatagccaactgcctgcggaagaacggcaagcgcgtaatccagctcagccggaagacctttgacaccgagtaccagaagaccaaaaataacgactgggactacgtggtcacaaccgacatcagtgaaatgggggccaattttcgcgcggaccgggtgatcgacccgcggcggtgccttaagccggtgattctgaaggacggcccggagcgcgtcatcctcgccggtcccatgccggtgaccgtggccagcgccgcccagcggagaggccggatcggccgcaatcacaataaggagggagaccagtacatttacatgggccagcccctgaacaacgatgaggaccacgcgcactggaccgaggccaagatgctgctcgacaatatcaatacgcccgagggtatcatccccgccctgttcgagccggagcgcgagaagtccgccgccatcgacggggagtaccgtttacgcggggaggcgagaaaaacattcgtggagctcatgcgccgtggcgatctgcccgtgtggttaagttataaggtcgccagcgagggcttccagtattcagacagacggtggtgcttcgatggggaaaggaacaaccaggtgctcgaggagaacatggacgttgaaatctggaccaaagagggtgagcgaaagaagctgcgcccaagatggctggatgcccgcacctacagtgatcctttagcgctgcgagagttcaaggagttcgccgcgggacgcaggtccgtaagcggcgacctgatccttgagatcggcaagctgccgcagcacctgacgcagcgcgcccagaacgcgttagacaacctcgtaatgctgcataacagcgagcagggcgggcgggcctaccgccatgccatggaagagctccccgacaccatcgagaccctaatgttgctggccctgatcgccgtgctcaccgggggcgtcaccctgttcttcctgagtggtcggggactgggcaagacgtccatcggcctcttgtgcgtgatggccagtagcgtgctgctctggatggccagcgtcgagccccactggatcgcggcctccatcatcctcgagttcttccttatggtgctcctcatacccgagccagatagacagcggacgccccaggacaaccagcttgcctacgtggtgatcggcctgctgttcatgatcctgaccgtggccgccaatgagatggggctcctcgagaccacaaagaaggaccttggaatagggcacgtggcggtcgagaaccaccaccacgcggccatgctcgacgtggacctgcaccctgcctcggcttggacgctgtacgccgtggccaccaccatcatcacaccgatgatgcgccatacgatagagaacaccaccgcaaacatctccctcacggccatagccaaccaggcggccatcttgatgggcctggataagggctggcccatcagcaagatggacatcggtgtccccctcctggccctgggctgttactcccaggttaaccccctcaccctgaccgccgcggtgctaatgcttgtcgcccactacgccattatcgggccgggcctgcaggcaaaggccacccgggaggcgcagaagaggactgccgccgggatcatgaagaacccaacggtggatggaatcgtcgccatcgacctcgatcccgtagtgtacgacgccaaattcgagaagcagttgggccagatcatgttgctgatcctctgtaccagtcagatccttctgatgcgcaccacgtgggcgctctgcgagtccattaccctggcgacagggcccctgaccacactctgggaaggcagcccggggaagttctggaacaccaccatcgccgtctccatggccaacatcttccggggctcctatctggctggcgcagggcttgccttctccttaatgaagtccctgggcggaggccgccggggcaccggcgcccagggtgagacactgggtgaaaagtggaagcgccaattgaaccaactgagcaagtccgagtttaatacctacaagcggagcggcatcatggaggtagaccgatctgaggccaaggaggggctgaagcggggcgagacgaccaagcacgcggtatcccgcgggacggccaagttgcggtggttcgtggagagaaaccttgtcaagcccgagggcaaagtcatcgacctgggctgcgggcggggcgggtggtcatactactgcgcaggactgaagaaggtgaccgaggtgaaggggtacaccaagggcggccccgggcacgaggagcccattccaatggccacctacggctggaatctcgtgaaattgcacagcgggaaggacgttttcttcatcccgcccgagaagtgcgacacgctgctctgtgacataggcgagtcttcgcctaacccgaccatcgaggaaggtcgcacccttcgtgtactgaagatggttgaaccctggctccgtggcaaccagttctgcatcaagatcctgaacccatacatgccctccgtggtcgaaaccctggagcaaatgcagcggaagcacgggggcatgctcgtacgcaaccctttaagccgaaattccacccacgagatgtattgggtgagctgtggaacggggaacatcgtctccgccgtgaacatgaccagccgcatgctcttaaatcgcttcactatggcgcatcgcaagcccacctacgagagggacgtggacctgggtgccggcacgcggcacgtggccgtggaacccgaggtggccaacctggacatcatcgggcagcgcatagagaacattaagcacgagcacaagtccacctggcactatgacgaggacaacccttacaagacctgggcgtaccacggaagttacgaggtaaagccgtccgggtccgcgtctagcatggtgaatggcgtcgttaagcttctgactaagccatgggacgtgataccaatggtcactcagatcgccatgaccgacaccacaccctttgggcagcaacgggtgttcaaggagaaggtggacacgagaacccccaaggccaaacggggcaccgcccagatcatggaggtcaccgccaagtggctgtggggcttcctctcaagaaacaaaaagcccagaatctgcaccagggaagagttcacccggaaggttcgctccaacgcggccatcggtgccgtctttgtcgatgagaaccagtggaatagcgccaaggaagcagtggaggacgaacggttctgggacctggtgcacagggagcgagagctgcacaagcaggggaagtgcgccacttgcgtatataacatgatgggaaagcgcgagaagaagctgggcgaattcgggaaggccaagggaagcagagccatctggtacatgtggctgggcgcccgcttcctggaattcgaggcgcttgggttcatgaacgaagaccattggtttagccgagagaattccctaagcggcgtggagggtgagggcctgcacaagctcggttacatattacgcgatatttccaagatcccgggcgggaacatgtacgccgacgacaccgccggctgggacacgagaatcaccgaggacgacctgcagaatgaggcccgcatcaccgatatcatggagccggaacatgcccttcttgcacgcagcatcttcaagctgacctatcagaacaaggtcgtccgggtgcaacgccccgccaagaatggcacggttatggacgtcatctcccgaagagatcagcggggcagcggacaggtgggcacatatgggctcaacaccttcaccaacatggaagcgcagctgatacgccagatggagtcggagggcatattcagcccgtccgagctggagactcccaacttggctgaacgggtgctggactggctcgaaaaatacggggtcgaacggcttaagcgaatggccatctccggcgatgactgcgtagtgaagcctatcgacgatcgctttgcgaccgccctgaccgccctgaatgacatggggaaggtcaggaaagacattccccagtgggagccttccaagggatggaatgactggcaacaggtccctttctgcagccaccacttccaccagctcatcatgaaagacgggagagagatagtcgtcccgtgccggaatcaagacgagctggtggggcgcgccagagtatcccaaggcgccggctggagcttgcgcgagaccgcgtgcctcggcaagagctacgcccaaatgtggcagctgatgtacttccatagacgcgacctgcggctcgccgccaacgcgatttgctccgccgtccccgtggactggatccccactagccgtactacctggtccatccacgcccaccaccagtggatgaccacagaggacatgctgagcgtgtggaacagagtgtggatcgaggagaacccctggatggaagacaagacccatatttcatcgtggggggacgtgccatacctgggtaagcgggaggatcaatggtgcggctcgcttattgggttgaccgcccgggccacctgggcgacaaacatccaggtagccatcaatcaggtccggaggttaatcggcaacgaaaattacctcgactacatgacgtcaatgaaacggttcaagaatgagtccgaccccgagggggctctgtggtga

SEQ ID NO: 24419 - RNA, 9879 nt, synthetic construct
  misc_feature 1..9879: note = derived and/or modified CDS sequence (opt11) from DENV-1__GU131697__SS-prME
  source 1..9879: mol_type = other RNA
tccgtgaccatgctcctcatgctgatgccaaccgccctagcgttccacctcaccacgcggggcggcgagccccatatgatcgtgtctaagcaggagcggggcaaaagcctgctgttcaaaacgtccgcgggggttaacatgtgcaccctgatcgctatggacctgggcgaactgtgcgaagacacgatgacctataaatgcccccgcatcactgaggccgagccagacgacgtggattgctggtgcaacgccactgacacttgggtgacctacgggacttgcagccaaaccggcgagcaccggcgggataagaggtccgttgccctcgctccccacgtgggcctgggcctggagacgcgcaccgagacctggatgagctcggagggagcctggaagcagattcagcgggtcgagacctgggccctccgccatcccggctttaccgtgatcgccctgttcctggcccacgctatcggcaccagcatcactcagaaggggatcatctttatcctcctcatgctagtaacccccagtatggccatgcggtgtgtcggcattggcagtcgtgacttcgtggaagggctctccggcgccacctgggtggatgtcgttctggagcacgggagctgcgtgaccacaatggccaaggataagcccaccctggacattgagctcttgaagacggaggtcaccaaccctgcggtcctgcgaaagctctgcattgaagccaagatctccaacactacgacggacagccgctgcccgacccagggcgaggccaccttggtggaggaacaggacgccaacttcgtctgccgacgcactttcgtggaccgggggtgggggaacggctgcgggctgttcggtaaggggtccctcataacatgcgccaaattcaagtgcgttaccaagctggagggcaagatcgtccaatatgaaaacctgaaatacagtgtgattgtgaccgtacacacgggtgaccagtaccaggtgggcaacgagtctactgagcatggcacaaccgcgaccatcacgccccaagccccaaccacggaaatccagctcacggactacggtgccctgaccctggactgcagcccccgcacgggactcgacttcaacgaaatggttctgctgaccatgaaagagaagtcctggctagtgcacaagcagtggttcctggacttacccctcccctggaccagcggggcgagcactagccaggagacctggaacaagcaggacctgctggtaaccttcaaaacggcgcacgcgaagaagcaggaagtcgttgttctcggcagtcaggagggggccatgcataccgcccttaccggagccacggaaatccagacctccggcaccacgactatcttcgccgggcacttaaagtgtagactgaaaatggacaaattgacactcaaaggcatgtcatacgtcatgtgcaccggctccttcaagctcgagaaggaggtggcagagacgcagcacggcaccgttctggtccagatcaagtacgagggcaccgacgccccctgcaagataccattcagtacccaagacgagaagggggtgacccagaacggccgcctcatcaccgccaacccgatcgtgactgataaagagaagccagtcaacatcgaggccgagccacctttcggggaatcctacatcgtcatcggcgccggagagaaggccctgaaactctcttggttcaagaaggggtcctcaatcggcaagatgttcgaggccaccgcccgcggagctcgtcggatggcgatcctaggagacacggcctgggactttgggtccatcggcggcgtgttcactagtgtcgggaagctgattcaccagatcttcggcaccgcctacggggttctgttctccggcgtgagctggaccatgaagatcgggataggcgtcctgctgacgtggttgggactaaactcccgcagcacctccctgtcgatgacctgcatagccgtgggcctcgtgaccctgtacctgggcgtcatggtgcaggccgactccgggtgcgtgatcaactggaagggtcgagagctcaagtgcgggtccggcatcttcgtcactaacgaagtgcatacctggaccgagcaatacaagttccaggctgatagtccgaagcggctgtccgccgccatcggcaaggcctgggaggagggggtctgcggaatccggagcgcgacccggttagagaacatcatgtggaagcagatctccaacgagttaaaccacatcctgctggagaacgacatgaagttgaccgtcgttgtgggagacgtcgccggcattctgggccagggcaaaaagatgatccgtccccagcccatggagtacaagtacagctggaagtcctggggcaaggcgaagatcataggcgccgacgcgcagaacacgaccttcatcatagacggccccaacactccggaatgccccgacgatcagcgggcgtggaatatctgggaggtggaggactacggctttggcattttcaccacgaacatctggctgaagctccgagattcatacacccaggtgtgcgaccaccggctgatgagtgccgccatcaaggatagcaaggccgtccacgctgacatgggttactggatagagtcggagaaaaatgaaacgtggaaactggcccgcgccagcttcatcgaggtaaaaacctgcatctggcccaagagccacacgctctggagcaacggagtgctggagtccgagatgatcatccccaagatctacgggggccctattagccagcacaactaccggcccgggtattttacccagaccgctgggccgtggcacctgggcaaattggagctggactttgacctgtgcgagggcaccacggtcgtggtggacgagcattgtgggaaccggggcccgtcattacggacaaccaccgtcacggggaaaataatccatgagtggtgctgccggagctgtactctcccgccgttgagattccgtggggaggatgggtgttggtacggcatggagatccggcccgttaaggagaaggaggagaacctcgtcaaatccatggtcagcgccggcagcggtgaggtggactccttcagcctgggcttgctctgcatctccattatgatcgaggaggtgatgcgctctcggtggtcccgtaagatgctgatgaccgggaccctggccgtattcttcctcctgatcatgggtcagttaacttggaacgacttgatccggctgtgcatcatggtgggggccaacgctttcgatcgcatgggcatggggacgacatacctagccctcatggctaccttcaagatgcgcccgatgttcgctgtggggctgctgttccggagactcacaagccgggaggtactgctgctcaccatcggcctatccctagtcgcgagcgtagagctccccaattccctggaggagctgggggacggcctcgcaatgggcatcatgatcctgaagctgctcaccgacttccagagccaccaactgtgggctactcttctatccctgacgtttatcaagacaaccttcagcttacattacgcgtggaagaccatggcgatggtgttatccatcgtgagcctgttccccttatgcctctccaccacctcacagaagaccacctggctgcccgtgctgttgggttccttagggtgcaagccactgacgatgttcctgatcgccgagaataagatctgggggaggaagagctggcccctgaacgaaggcatcatggccgtggggatcgtgtccatactgctcagcagcctgctgaaaaacgacgtcccgctagccggccccctcatagctggcgggatgctgatcgcatgctacgtgatctccggcagctctgccgacctcagcctggagaaagccgccgaggtgtcttgggaggaggaggccgagcactcgggtgcgtcccacaacatcctggtcgaggtgcaggacgacggcaccatgaagatcaaggacgaggaacgggacgataccctcaccatcttgctcaaggccaccctcctggccgtgtctggggtgtatccgctctcgattcccgccaccctctttgtgtggtacttctggcagaagaagaagcagcgcagcggtgtgctttgggatacccccagcccccccgaggtcgagcgtgccgtgctggacgacggtatctaccgcatcatgcagcgggggctgctcggccgcagccaggtcggggtaggggtgttccaggagaacgtcttccacaccatgtggcatgtcacccgcggagccgtgctgatgtaccaaggcaagagactggagccctcgtgggcatcagtgaagaaggacctcatatcgtacggcgggggctggcggctgcgcggctcctggaacactggagaggaggtccaggtgatcgccgtggaacccgggaagaaccccaagaacgtacagacagcccccggaaccttcaagacgcccgagggcgaggtaggggctatcgcgctggacttcaagcccggcacttccgggtctcccatcgtgaaccgggagggaaagattgtcggtctttacggtaatggcgtggtgaccacgtccgggacctacgtcagcgccatcgcgcaggcgaaggcgagccaggagggcccgctaccggagatagaggacgaggtgttccgcaaacggaacctgacgatcatggacctccaccccgggtccggaaagacccgccgctacctgccagccatcgtccgagaggccatcaaacggaagctgcgcactctcatccttgccccgacgcgcgttgtggccagcgagatggcggaagccctgaagggcatgcccattcggtaccagacgaccgccgtgaaatccgagcacacagggaaggagatcgtagacctcatgtgccacgccaccttcacaatgcgcctgctcagccccgtgcgagtaccgaactacaacatgatcattatggatgaggcccatttcaccgacccctcctcaatcgctgccaggggctacatctctacaagagtggggatgggcgaggctgccgctatcttcatgacagcgacgccgcctgggagcgtggaggccttcccgcagtccaacgcagtgatccaggacgaggagcgagacattccggagcgatcatggaacagcggccacgagtggatcaccgacttccccggcaagaccgtctggttcgtgcccagcatcaaatccgggaatgatatcgccaactgcttgcggaagaacggaaagagagtgatccagctgagccgcaagacttttgacaccgagtaccagaagaccaagaacaacgactgggactacgtagtaactaccgacatctccgagatgggagcaaatttccgggccgaccgcgtgatcgacccgcggcgctgcctgaagcccgtcatcttgaaggacggcccagagcgggtgatcctggccggtccaatgcctgttaccgtcgcgtctgccgcgcagcgccggggccgcatcggccggaatcacaacaaggagggggaccagtacatctacatgggacagcccctgaacaacgacgaggaccacgcgcactggaccgaggccaagatgctattggacaacatcaacacgccggaggggatcatccccgccttgttcgagccggagcgcgagaaatcggccgcggtagacggggaataccgcctccgtggggaggcccggaagaccttcgtcgagcttatgcgtcgcggagaccttcccgtgtggctcagctacaaggtggcctcagaagggttccagtactcggaccggcgctggtgcttcgacggggagcggaacaaccaggtactggaggagaatatggatgtggagatctggacgaaggaaggtgagcgcaagaagctgcggcccagatggctcgatgcccggacctatagcgaccccctggccctgagggagttcaaggaattcgcggccgggcggcgttccgttagcggagacttgatactcgaaatcggcaagctgccgcagcaccttacccagagagcccaaaacgcactggacaacctggttatgctccacaactcagagcagggagggagggcgtaccgacacgccatggaggagttgcccgacaccatcgagacgctgatgctcttagcactgatcgcggtactcaccggaggcgtgaccctgttcttcctgagcgggcgtggcctcggcaagacctccattggactgctgtgtgtcatggccagctcagtgctcctgtggatggcatccgtggagccccactggatagccgcgtctatcatactggaattcttcctcatggtcctgctgatccccgagccggaccggcaacgcacgcctcaagacaaccagctcgcctacgtggtaataggcctgctgtttatgatcctcacagttgcggctaatgaaatggggttgttagagaccaccaagaaggacttaggcatcgggcacgtggccgttgagaaccatcaccacgcggcaatgctggacgtggacctgcaccccgccagtgcgtggaccttatacgccgtggccacgaccatcattacgccgatgatgcggcacaccatcgagaatacgaccgccaatatctccctgaccgccatcgcgaaccaggccgccatcctaatgggcctcgacaagggctggcccatcagtaagatggacatcggggtgcccctgctggccctgggctgctactcccaagtcaaccctctgacgctcactgcggccgtgttaatgctggtggcccattacgccataatcgggccggggctccaggccaaggcaacccgggaggcccagaagcgcaccgccgccgggataatgaagaaccccacagtcgatggcatagtagccatcgatctagaccccgttgtctatgacgcgaaattcgagaagcaactggggcagatcatgctgctcatactatgcacgagccagatcttgctcatgcgaaccacgtgggccctctgcgagtccatcaccctcgccacggggcccttgaccacactctgggaaggcagcccggggaagttttggaacaccacgatcgccgtgtccatggccaacatctttagaggcagctacctggcgggcgccgggctcgcattctctctcatgaagtccctgggcggaggcaggcgcgggaccggagcccagggcgaaacgctcggggagaaatggaaacggcagctgaaccagctgtcgaagtccgagttcaacacctacaagcgcagcggcatcatggaagtggaccgttccgaggcgaaggaggggctcaagcgtggcgagacgaccaaacacgccgtctcccgggggacggccaagctgcgctggttcgtggagcggaacctggtgaagcccgaggggaaggtcatcgacctcggctgcgggcgcggcggttggtcctactattgcgccggcctcaagaaggtgaccgaggtgaaggggtacacgaaaggcggtccaggtcacgaggagccgatcccgatggctacctatggttggaacctggtcaaattacacagcggtaaggacgttttcttcatccctccggaaaagtgcgacaccctactgtgtgacatcggcgagtcctcccccaatccgacgatagaggagggacggacgctgcgcgtgctcaagatggtcgagccttggctgcgaggcaatcagttttgcattaagatcttaaacccctacatgccctcagtggtggaaacgctcgagcagatgcagcgcaagcatggcgggatgctggtccggaatccgctgtcccgcaactccacgcacgagatgtactgggtgagctgtggaacagggaacatcgtgtccgcggtcaacatgacgagtcggatgctcctgaaccgctttactatggcccaccgcaaacctacttatgagcgggatgtggacctgggaacgggcaccaggcacgtagcggtggagcccgaggtggccaacctagacattattgggcaacggatcgagaacatcaagcacgagcacaaaagcacgtggcactacgacgaggacaacccctataaaacgtgggcctaccacggcagctacgaggtgaagccatccgggtctgcaagtagcatggtcaacggcgtggtcaagctgttgaccaagccctgggacgtgattcccatggtcacccagatcgcaatgacggacacgacacccttcgggcagcagcgcgtcttcaaggagaaagtggacactcggacgccgaaggccaagaggggcaccgcccagatcatggaggtgaccgcccggtggttatggggcttcctgagccgcaacaagaagccccggatctgcacaagggaagagttcactcgtaaggtccgcagtaacgcggctataggggccgtgttcgtggacgagaaccagtggaacagcgccaaagaggcggtagaggacgaacggttctgggatttggtgcaccgcgagcgtgagctccataagcaaggcaagtgcgcgacttgtgtgtacaatatgatggggaagcgcgagaagaagctgggcgagttcggcaaggccaaaggttcccgggccatatggtatatgtggctaggtgcccgcttcctcgagttcgaggcgctggggttcatgaacgaggatcactggttcagccgggagaatagcttaagcggcgtggagggggagggcctccacaaactggggtacatcctgcgcgacatctccaagatccccgggggcaacatgtacgccgacgatacagccgggtgggacacccgaatcacggaggacgacctccagaacgaggccaagatcaccgacatcatggagccggaacacgccctgctggcgaaggccattttcaagcttacctaccagaacaaggtggtgcgcgttcagcgccccgcgaagaatggcaccgtgatggacgtaataagcagacgtgaccaaagggggagtggccaggtcggcacttatgggctgaataccttcaccaatatggaagcccagcttatccgccagatggaaagcgagggcatcttctcccctagcgagctcgagacacccaaccttgcggagagggcgctggactggctcgagaagtatggtgtagaacgcctgaagcggatggctatctccggcgatgattgcgtggtcaagcccatcgacgacagattcgccacggcgctgaccgcactcaacgacatggggaaggtgcggaaggacatcccccaatgggagcccagcaagggctggaacgactggcagcaggttcccttctgcagccaccacttccaccagctgatcatgaaagacgggcgcgaaattgtcgtgccgtgccggaatcaagacgagctggtggggcgcgcgcgggtcagccaaggcgccgggtggtccttgcgcgagaccgcatgcctaggcaagagctacgctcagatgtggcagttaatgtacttccaccgccgcgacttgcggctggccgcaaacgccatctgctccgcagtgcctgtggactgggttcctaccagtagaacgacctggagcatccacgcgcaccatcaatggatgacaacggaggacatgctgtccgtgtggaacagggtgtggattgaggagaacccctggatggaggataagacccatataagctcctgggaggacgttccgtacctcggtaagcgcgaagaccagtggtgcggaagcctcatcggccttaccgcgcgcgccacttgggccaccaacatccaggtagccatcaaccaagtccggcgcttaatcgggaacgagaattacctggactatatgacatccatgaagcggtttaagaatgagagcgacccagagggcgcgctgtggtaa

SEQ ID NO: 24420 - RNA, 9879 nt, synthetic construct
  misc_feature 1..9879: note = derived and/or modified CDS sequence (opt11) from DENV-1__GU131700__SS-prME
  source 1..9879: mol_type = other RNA
agcgtgaccatgcttcttatgctgatgcccaccgccctggcctttcacctaactacccgaggcggagaaccgcatatgatcgtgtccaagcaggagcggggcaagagcctgttatttaagacctcagccggggtaaacatgtgcaccctcatcgccatggatctgggcgagttctgtgaggatacgatgacctataaatgcccccgcatcacggaagccgagcctgatgacgtggactgctggtgtaacgccaccgatacgtgggtgacgtacggaacgtgcagccagacaggcgagcaccgccgggataagcggtccgtggccctggcgccccacgtgggcctcgggctggaaacgcgcaccgaaacctggatgagcagtgaaggcgcttggaagcaaatccagcgggtggagacctgggcccttcgccaccccggttttaccgtgatcgccctctttctggcgcacgccatcggcaccagcatcacccaaaaaggaatcatcttcatccttctcatgcttgtaacaccctccatggccatgcgctgcgtcggtataggctcccgcgacttcgtcgagggactgtccggtgccacttgggtagacgtcgtcttagagcacgggagctgtgtgactaccatggccaaggacaagcccaccttggacatcgagctgcttaagacggaggtcaccaaccccgcggtattgcggaagctgtgcatcgaggccaagatctctaacaccaccacggactcccgttgcccgacccaaggcgaagccacgctcgtggaagaacaggacgccaacttcgtctgcaggcgcacgttcgtggatcgtggctgggggaacggctgcggccttttcgggaaagggtccttaatcacgtgtgccaagtttaaatgcgttaccaagcttgagggcaagaccgtacagtacgagaacctgaaatactccgtgattgttaccgttcatacgggcgaccagcaccaggttggtaatgagtccaccgaacacggcaccactgcgaccatcactccccaggcccccagcacggaaatacaactgaccgattacggggccttaacgctggattgcagccccaggacaggcctggacttcaatgagatggtcctcctgactatgaaggaaaagtcctggctggtacacaaacagtggttccttgacctgcctctgccctggaccagtggcgcgtccaccagccaagaaacttggaaccggaaggacctactagtgactttcaagactgcccatgcgaagaagcaggaggtcgttgtgctggggtcccaggagggcgcgatgcacacggcccttacgggggccactgaaatccagacctctggtaccacgaccatattcgccgggcacctgaagtgccgcctgaagatggacaagctaaccctgaaaggcatgtcatacgtcatgtgcaccgggagcttcaagctggagaaggaagtggcggagacgcaacacggcacagtcctcgtccaaatcaagtacgaggggactgacgccccctgcaagatacctttcagcacacaggatgaaaagggggttacgcagaacggccggctaatcaccgccaacccgatcgtgaccgacaaggagaagcctgtaaacatcgaagccgagccgccctttggggagagctatatagttattggtgcaggcgaaaaggccctgaaattgagttggttcaagaaaggcagctccatcggcaagatgtttgaggccaccgcccgcggggctcgtaggatggctatcctcggtgatacagcctgggacttcggcagtatcggcggcgtgttcacctccgttggaaagcttgtgcatcaaatattcgggaccgcatacggggtactgttcagcggcgtctcttggaccatgaagattggtatcggcgttctcctgacgtggctgggccttaatagtcgctccaccagcctgtcgatgacctgcatcgccgtgggcctggtcaccctctacctgggcgtgatggtgcaggccgactccggatgcgtcatcaactggaagggccgagaactcaagtgcgggtctggcatcttcgttacgaacgaggtgcacacctggaccgagcagtataagttccaagctgactccccgaagcgcctcagtgccgccataggcaaggcctgggaagagggggtatgcggaattcggtccgctacccgcttagagaacataatgtggaagcagatctcaaacgagctgaaccacatcctactggagaatgacatgaagtttactgtcgtggtcggggacgtcgcgggcatcctggcccaagggaagaagatgatccgaccccaaccaatggaatacaagtacagttggaagtcctggggcaaggccaagattatcggagccgacgtgcaaaacacgaccttcataatcgacgggcccaacacccctgagtgtcccgatgaccagcgtgcctggaacatttgggaagtcgaggactatggcttcggaatattcaccaccaacatatggttgaaactccgggactcccacacccaggtgtgcgatcaccggctgatgagcgccgcgatcaaggactccaaggcagttcatgccgacatgggctactggatcgagagcgagaagaatgaaacctggaagctcgcgcgggcatctttcatcgaagtcaagacctgcatctggcccaagagccacaccctgtggtccaatggcgtgctggagagcgagatgatcatacccaagatctacgggggcccgatctcccaacataactaccgccccgggtacttcacccagaccgccggcccctggcacctcgggaagctggagctggacttcgatctttgcgagggcaccacggtggtcgtggacgaacactgcggaaaccggggtccgtcacttcgcactaccaccgtgactggcaagatcatccatgagtggtgctgccggtcctgcacgctgccgcccctgcgctttaagggggaggatggatgttggtacgggatggagatccggcccgtgaaggagaaagaggagaacctggttaagagcatggtgtcagccggttcaggcgaggtcgacagctttagtctggggctcctgtgcattagcataatgatcgaagaggtgatgcgctcccggtggtctcgcaagatgctcatgaccggaaccctggcagtgttcttccttctgatcatggggcaacttacgtggaacgacctgatccggctgtgcattatggtaggcgccaacgcgtcagacaggatggggatggggaccacctacctagcgctgatggctactttcaagatgcggccaatgttcgccgtgggcttgctgtttcggcgcttaacgtcgcgggaggtgctgctccttactataggcctgtccctcgtcgcgtctgtggagctgcccaattccctggaggagttgggcgacgggctggctatgggcatcatgattctcaagctcctgaccgacttccaaagccaccagttatgggccaccttgctatccttgacgtttataaagacaacatttagcctccactacgcctggaagaccatggcgatggtcctgtccattgtgtcactgttcccactctgcctgagcactacctcgcagaagaccacatggctgcccgtgctcctgggttccctgggttgcaagccattaacgatgttcttgatcgccgaaaacaagatatggggcaggaaatcctggcctctgaacgaggggatcatggccgtcgggatagtgtccatcctcctgtccagcctgctcaaaaacgacgtgcccttagctgggcccctgattgcgggtggcatgctcatcgcatgttatgtcatctccgggtcctccgctgacctgagcctggagaaggccgcggaagtgtcctgggaagaggaggcagaacatagcggagcgtcccacaacatcttggtggaagtgcaagacgacgggaccatgaagatcaaggatgaggagcgcgatgacaccctgaccatcctgctcaaggccactttgctgacagtaagcggcgtgtatccgctctccattcccgccaccctgtttgtgtggtacttctggcaaaagaagaagcaacgcagcggggtgctgtgggacacacccagcccgcccaaggtggaacgggctgtcctcgatgatggtatctaccgcatcatgcagcggggactgctagggcgctctcaagtgggcgtgggggtcttccaggagaacgtgttccacaccatgtggcacgtgactcggggcgccgtgctgatgtatcaggggaagcgccttgagccatcctgggcgagcgtgaagaaggaccttatctcctatgggggagggtggagactgcaaggcagctggaacaccggggaggaggtgcaagtcatcgccgtggaacccggcaagaaccctaagaacgtgcagacggcccccgggaccttcaaaacctccgagggggaggtgggcgctatcgctctcgacttcaagcccgggacgtcgggatcacccattgtaaaccgcgaggggaagattgtcggactgtacggcaacggggtagtgaccacgtcaggaacctacgttagtgcgatcgcccaggccaaagcgtcccaggagggccccctgccggagatcgaggacgaggtgttccggaagcgcaacctcaccatcatggacctgcacccaggtagcgggaagacaaggaggtacctacccgcgatcgtgcgggaggccatcaagcggaaactccgtactctgattctagcccctacccgcgtggtagcgtccgagatggccgaggcgttgaagggaatgcctatcaggtatcaaaccactgccgtcaagtctgagcacaccggcaaagagatcgtggacttgatgtgtcacgccacattcaccatgcggttgctctcccccgtccgcgtgcctaattacaatatgattattatggatgaagcccactttaccgacccgagtagcattgccgcgcggggatacattagtacccgagtgggcatgggggaggccgccgccatctttatgaccgcgacgccgcccggctccgtcgaagcgttcccccaaagtaacgccgtgatccaggacgaggagcgcgacataccagaacgctcctggaacagcgggtacgaatggatcaccgacttcccaggcaagaccgtgtggttcgtcccgtctatcaagagcggaaacgacatcgccaactgcctgcggaagaacggcaaacgcgtgatccaattatcgcgtaagactttcgacaccgagtatcaaaagacaaaaaacaacgattgggactatgtggtcaccacggacatctcagagatgggcgccaacttccgcgcggatcgggtgatcgacccccgcaggtgcctaaagccggtgatcctgaaagacggtcccgagcgcgtcatactggcaggccccatgcccgtgacagtcgcatccgccgcccagcggcgcgggcgtatcggccgcaatcacaacaaagaaggcgatcagtacatatatatggggcagccgctaaacaacgacgaagaccacgcgcactggaccgaggccaagatgcttttagacaacatcaacaccccggagggcatcatccctgccctcttcgagcccgagcgggagaagtccgccgccatcgacggggagtaccgactgcgcggcgaggcgagaaagacgttcgtggagctgatgcgcaggggggacctacctgtgtggctgagctataaagtcgcatccgagggctttcagtatagcgaccgccggtggtgctttgatggcgagcgaaataaccaagtactggaggagaatatggacgtggagatatggacaaaggaaggggagcgcaagaagcttcgaccccggtggctggacgcccgcacttacagcgacccgctggccctccgggagtttaaggagttcgccgcgggccgccggtctgtgagtggggacctgatcctggagatcgggaagctcccccagcacttgacccagcgcgcccaaaacgcattggataatctcgtgatgttacacaactcggagcaaggcggccgagcttatcgccacgctatggaggaacttccggatacgattgagaccatgatgctccttgcacttatcgccgtgcttaccggcggggtcaccctcttctttctgtccggccgggggctgggcaagaccagtatcgggctgctgtgcgtgatggcatccagtgtgttgctgtggatggcctccgtcgaaccgcactggatcgcagcgagcatcatcctagagttcttcctcatggtacttcttatcccggagcccgaccgccaacggacgccacaagataaccagctggcctatgtggtcataggcctgcttttcatgatacttacggttgccgcgaacgagatgggcctgctcgagaccaccaagaaggacctcgggatcggacacgtggccgtcgagaatcaccaccacgccgccatgctggatgttgatctgcaccccgcgtccgcctggacactctacgcggtggccacaaccataatcacgcccatgatgcgccacactatcgaaaacaccaccgccaatatatctctgacggcaatcgccaatcaagcagcaatcctgatggggttggataaggggtggccgatctccaagatggacataggcgtacccctgctggccctcggttgctactcacaggtgaacccacttacgctgaccgctgcagtcctcatgctggtcgcccattacgcaatcattggacccgggttacaggcaaaggcgacgcgggaggcgcaaaagagaaccgccgccggcattatgaagaacccgacggtggacgggatcgtggcaatcgacctcgaccccgtagtgtacgacgccaagttcgaaaagcagctgggccagataatgctgttaatcttatgcacctcccagatactgctcatgcgtactacctgggctctgtgcgagtctatcacgctggctaccggccccttaacaaccctgtgggaaggatccccaggcaagttctggaatacgaccatcgccgtgagcatggccaatatcttccggggtagctacttggccggcgcgggcctcgccttctcgctgatgaagtccctcggtggcgggcgccgggggactggggcccagggcgagaccttaggggagaagtggaagcgccagcttaatcagctctcgaagagcgagttcaacacttacaagcgctccgggataatggaggtcgatcgcagcgaggccaaggagggtctcaagcgcggggagacgacaaagcacgcggtctcccgcggcacagcaaagttgcgctggttcgtggagcgtaacctggtcaagccggagggtaaagttatcgacctcggctgtggccgcggtggttggtcgtactactgcgcagggctgaagaaagtgacggaggtcaaggggtacactaaaggcgggcccggccatgaagagcccatccccatggccacctacggctggaaccttgttaagctgcacagtggaaaggacgtgttcttcatcccgcccgaaaaatgcgacaccctcctgtgcgacataggagagagctccccgaaccctacgatcgaggagggccgcacgttacgggtccttaagatggtggagccgtggctccgcggaaatcagttctgcataaagatcctaaatccatacatgccaagtgttgtcgaaactcttgagcagatgcaacggaagcacggcggtatgctggtgcgcaacccgctgtcgcggaatagcacccacgagatgtactgggtgtcctgcggaactggcaatatcgttagcgcagtaaatatgacttcgcgcatgctcctcaaccggttcaccatggcgcaccgtaaaccaacgtacgaacgggacgtggatctgggggccggcaccaggcacgtcgccgtggagccggaggtggccaacctcgacatcatcggccagcgaattgagaacatcaaacacgagcacaagagcacgtggcactatgatgaagacaacccctacaagacctgggcctaccacgggtcctatgaggtaaagcctagcggctcagcgtccagcatggtgaacggggtagtgaagctgttgaccaaaccctgggacgtgatcccgatggtcacccaaatcgcaatgacggacacaacccccttcgggcagcagagggtgttcaaagagaaggtggatacccgtacgccaaaggccaaacgtgggacagcccagatcatggaggtcaccgcaaagtggttatggggcttcctgagccgtaacaagaagccgagaatatgtactcgggaggaattcacccggaaggtgcgcagcaacgctgcgataggagccgtgttcgttgacgagaaccaatggaactcagccaaagaggcagtggaagacgaaagattctgggacctcgtgcaccgtgagcgtgagctccacaaacaggggaagtgtgcgacctgcgtctacaacatgatggggaaacgggagaaaaagctgggagagttcggcaaagccaaggggagccgggccatctggtacatgtggctgggtgcacgcttcctcgaattcgaggcgctgggcttcatgaacgaggatcactggttttcccgtgaaaatagcctgtccggggtggagggcgaggggcttcacaagctgggctatatcctgcgagacatcagcaagatccccgggggcaatatgtacgccgacgatacggcgggttgggacacgcggatcacggaggacgatctccagaacgaagcaaagattaccgacatcatggagcccgagcacgccctgcttgcgaagtccatcttcaagctcacatatcagaacaaggtggtcagggtgcagcggccggccaagaacgggaccgtgatggacgtcatcagcagacgcgaccaacggggctcgggacaggtcggcacgtacggattgaatacgttcacgaacatggaggcccagctgatccgccagatggagagcgaggggatctttagtcccagcgagctggagaccccgaacctggcccggcgagttctagactggttggagaaacacggagtcgagagactgaagcgcatggccatatccggggacgactgtgtagtaaagccgatcgacgatcgcttcgctacagcacttactgccctcaacgacatgggcaaggtccgcaaggacataccgcagtgggagcccagcaaggggtggaacgactggcagcaagtccccttctgttcccaccatttccaccagctgatcatgaaggacggccgggaaatcgtggtcccctgcaggaatcaggacgagctggttgggcgagcgcgcgtgtcgcagggtgcaggctggagcctccgggagactgcgtgcctagggaagtcctacgcccaaatgtggcagctgatgtacttccaccgccgggacctccgcctagcagcgaacgccatttgcagcgccgtcccggtggactgggtgcccacctcccggacgacctggagcatacacgcccaccaccagtggatgaccactgaggatatgctgtcagtgtggaaccgcgtttggatcgaggaaaatccctggatggaggacaaaacacacatcagctcttggggagatgtgccctacctcggtaagcgtgaggatcaatggtgcggctcgcttatcggactgaccgcgcgcgccacctgggcgaccaacatacaggtcgccatcaaccaggtgcgccggctcatagggaacgagaattacctggattacatgacctccatgaagcgcttcaaaaatgaatctgaccctgagggcgcgttgtggtag

SEQ ID NO: 24421 - RNA, 9879 nt, synthetic construct
  misc_feature 1..9879: note = derived and/or modified CDS sequence (opt11) from DENV-1__GU131701__SS-prME
  source 1..9879: mol_type = other RNA
tccgtcaccatgctgctcatgctgatgcccaccgccttggccttccacttgactacccggggcggggaaccccatatgatcgtgagcaagcaggaacggggtaagagcctgttatttaagacttcggccggagtgaatatgtgcaccctcatcgccatggacttgggtgaactctgcgaagacaccatgacgtacaagtgcccccggatcaccgaaacagagcccgacgacgtagattgctggtgcaatgccacagacacctgggtcacctatgggacatgctcccagacgggcgagcaccgacgggataagcggtccgttgccttagcgccccatgtgggcctggggctggagacccgtaccgagacttggatgagctctgagggtgcgtggaagcagattcagcgagttgagacttgggccctacggcaccccgggttcacggttaccgccctctttctggcacacgtgatcggcaccagcatcactcagaagggcattatctttatcctcttaatgctggtcacgccgtccatggccatgagatgcgtaggtataggcagccgcgactttgtagaggggctatccggggccacatgggtagacgtagttctggagcacgggtcatgtgtcaccacgatggctaaggacaagccaaccctcgatatcgagctccttaagactgaagtaaccaaccctgcggtactccggaaactctgcattgaggccaagatttccaacacgacaaccgacagccgctgcccgacccagggcgaggcgacgcttgtggaggagcaggacgccaacttcgtctgccggcgcactttcgtagacagaggatgggggaacggctgcggtctttttggtaaggggtccctaataacgtgcgccaagttcaagtgcgttaccaagctggagggaaaaatcgtgcaatacgaaaatctgaagtacagcgttattgtcactgtccacactggcgaccagcaccaggtcgggaacgagtccacagagcatggcaccaccgctactatcactccccaggcacccaccaccgagatacagctcacggactatggggcgctcaccctggactgcagcccccgcaccggcctcgacttcaacgagatggtgctgctgactatgaaggaaaagagctggctcgtgcacaagcagtggttcctcgatctgccgttgccatggacgagcggggcaagcacctcgcaggagacatggaaccggcaggacctgctagtcacctttaaaactgcccacgctaagaaacaagaggtggtggtcttaggcagccaagagggcgcaatgcacacagcactaactggggcaaccgagatccagacttccggcaccaccaccatcttcgccgggcaccttaagtgcaggctcaagatggataaattaacgcttaaaggcatgagctacgtgatgtgcaccggctcctttaagctcgagaaggaggtcgccgaaacccagcacggaacggttctggttcagataaagtacgagggcacggacgctccctgcaagatacccttcagcactcaggacgaaaagggggtgacccagaacggccggctgatcaccgcgaatccgacggtcaccgacaaggagaagcccgtgaacatcgaagcagagccacccttcggggagtcctatatcatcatcggcgccggcgagaaagcgttgaaactttcttggttcaagaaggggtccagcattggtaaaatgttcgaggcgaccgcccgcggggcccggcgcatggccatcctgggtgacacggcctgggactttggttccatcgggggcgtattcacgtccgtagggaagttggtgcaccagatcttcggcactgcgtatggcgtgttgttttctggcgtcagctggaccatgaagatcgggatcggcgtcctactgacctggcttggcctaaactcccgcagtacgtccctgagcatgacctgcatcgccgtgggattggtcaccctgtacctgggcgttatggtgcaggccgacagtggttgcgttatcaactggaagggccgggagctcaagtgcggaagcggcatctttgtgaccaacgaagtgcacacctggaccgagcaatacaagttccaggccgatagcccgaagcgcctctccgccgcgatagggaaggcctgggaagagggagtctgcggcatacgtagcgccacccgtctggagaacatcatgtggaagcagatctcaaacgaattaaatcatatactgttagagaacgacatgaagttcaccgtggtggtaggcgacgtggccggaatcctagcacaaggcaaaaagatgatccggccccagccgatggaatacaaatatagctggaagtcctggggcaaggccaagatcatcggcgcggacgtccagaacaccacgtttatcatagacggccccaacacgccggagtgccccgacgaccagcgcgcgtggaacatctgggaggttgaggactatggattcgggatcttcaccaccaatatctggctgaaattacgggacagctatacccaggtgtgcgaccacagacttatgagtgccgcgataaaggatagcaaggccgtgcacgctgacatgggatattggatcgagtccgagaagaacgaaacttggaaacttgctcgagccagcttcatcgaagtcaaaacctgcatctggcccaagtcacacactctgtggagcaacggcgtgctcgagtccgagatgatcatccctaagatctatggaggcccgatcagccagcataaccataggcccgggtacttcacgcaaaccgcgggaccatggcaccttgggaagctggagctcgactttgacctgtgtgagggcactaccgtggtcgtggatgaacactgcggcaaccgggggccctcccttcgcactacgaccgttaccggcaagatcatccacgagtggtgctgccggtcttgcactctgccgcccctccgattccgcggggaggacggatgctggtacggcatggagatcaggccagtcaaagaaaaggaagagaacctggtcaagtccatggtctccgccggctctggagaggtagactccttcagcttagggctgttgtgcatctcgatcatgatcgaggaggtgatgcgtagccgctggtcccgaaagatgttgatgaccggcacccttgcggtgttcttcctgctcattatggggcagctgacctggaacgatctgatccgactctgcatcatggtgggtgccaacgccagcgaccgcatggggatgggcacgacctacctggcgctgatggccactttcaagatgcggcctatgttcgccgtgggcctattattccgccggctgacctctcgcgaggtcctcctgttgacgatagggctcagcctggtcgcctctgttgagctgcccaactcgctcgaggagctgggagacggattggcaatgggcatcatgatcctcaagctgttaaccgatttccaacctcaccagctatgggccaccctactctcactgactttcatcaagacgaccttctctttacattacgcctggaaaacaatggccatggtcctgtccatagtgagcctgtttcccctgtgtctatccaccacgagtcagaaaaccacctggctaccggttctgttgggatcattaggatgcaagcccctgaccatgttcctgatcgcagagaacaagatctgggggcggagaagctggcccttaaatgagggtatcatggcggtcggcatcgtgagtatcttactcagctcactcctgaagaacgacgtgcccttagccggaccgctcattgccggcggcatgttgatcgcatgctacgtcatctccgggtcgtccgccgacctgagcctggagaaagcggcagaggtgtcttgggaggaggaagccgagcattcaggcgcctcccacaacatactggtggaggtgcaagacgatggcaccatgaaaatcaaggacgaagaacgggacgacacattaaccatactcctgaaagccaccttgctcgcggtgagcggagtgtaccccctgtcaatcccagcgaccctgttcgtatggtacttctggcagaagaagaaacagcgcagcggggttctctgggacactccgagtccccctgaggtggagcgggccgtcctcgacgacggcatctatcgcatcatgcagagaggcctgctcgggcggagccaggtgggcgttggggtcttccaggagaatgtcttccacaccatgtggcacgtgacccgaggcgcagtccttatgtaccagggaaagcgcttggagccaagctgggcaagcgtgaagaaggacctgatctcctatggcggcgggtggcggctccagggcagctggaataccggggaggaagttcaagtcatcgcggtggagcccggcaaaaatccaaagaacgtgcagactgcccccgggaccttcaagacccctgagggcgaggtcggagccatcgccttggacttcaagcccgggacttccggcagcccgatcgtgaatcgtgaggggaagattgtgggactgtatggcaacggtgttgtgacgacaagcggcacctatgtgagcgccatcgcgcaggcgaaggccagccaagagggtcccctccccgagattgaggatgaggtcttccggaagcgcaacctgactatcatggacctgcacccgggctccgggaagacgagacggtacttgccagccatcgtgcgggaggcgattaagcgcaagctgcgcaccctcatcctcgctcccacccgggtggtggctagcgagatggccgaggccttaaagggaatgcccatacgctatcaaaccacagcagtgaaatccgagcacaccggcaaggagatcgtggacctgatgtgccacgctactttcaccatgcggctcttatcaccggtccgcgtgccgaactataacatgattatcatggatgaggcccacttcacggatccgtccagcatagcagcgcgggggtacatctcgactcgcgttggaatgggggaggcagccgccatatttatgaccgcaacgccgccagggagtgtagaagccttcccgcagtcaaatgcggtgatacaggatgaggagcgggacatccccgaaaggagctggaactccgggtatgagtggatcacggatttccctggaaagaccgtgtggttcgtgccctcgatcaagtccggcaacgacatcgccaactgcctgcggaagaacggaaagcgcgtaatccagctcagcagaaagacctttgacaccgagtatcagaagacgaagaacaacgattgggactacgtggtcactacagatatctccgagatgggggccaacttccgcgcggaccgggtgatcgacccccgccggtgtctgaagcccgtcatcctcaaggacggccccgagcgagtaattctcgcgggtccgatgcctgtgactgtcgccagcgccgcccagcggagggggcggatcggccgcaatcacaacaaggagggcgaccagtatatttacatggggcagcccctgaacaacgacgaggaccacgcccactggacggaggctaagatgctgctcgacaacatcaacacccccgagggaattattccggccctgttcgagccggagcgcgaaaagtccgcagcaatcgacggggagtaccggctgcggggcgaggcccgcaagaccttcgtggagcttatgcggagaggggacctgcccgtgtggctgagctacaaggtcgcgtcagagggcttccagtatagcgaccgcagatggtgcttcgacggcgagcggaacaaccaggtgctcgaggagaacatggacgtggagatatggaccaaggagggggaacggaagaagctgcggccccggtggcttgatgcccgcacgtacagcgacccgctcgcgctacgtgagttcaaggagtttgcggccggcaggcggtccgtaagcggcgacctaatactggagatcggtaagttaccacagcacctgacccaacgagctcagaacgcactcgacaatctggtgatgctgcacaactcagagcagggcgggcgcgcctacagacacgccatggaggaacttcccgataccatcgagaccctgatgctactcgcccttatcgccgtgttaaccggaggggtcaccctcttcttcctcagtggccggggattaggaaagacctccatcggtctcctgtgcgtgatggcctccagcgtgctactctggatggcttccgtcgagccccactggatagccgcgtctattatcctggagttcttcctaatggtgttactgatcccggagcccgacaggcagcggacgccccaggacaaccagctggcttacgtggtcattgggctattgttcatgatcctgactgtggcggcaaacgaaatgggattactagagacgaccaaaaaggatctggggattggccacgttgccgttgagaaccatcaccacgcggccatgttggacgtggacctgcaccctgcaagcgcctggacgctgtacgcagtggcgaccacgatcatcacgcctatgatgaggcacaccatcgagaacaccaccgccaacatatccctcaccgccatagcgaaccaagccgcgatcctaatgggactggacaagggatggcccatcagcaagatggacattggcgtcccgttattagcgctggggtgctactcccaggtgaaccctctcaccttaaccgccgccgtgctgatgctagtcgcgcactacgccatcatcggccccgggctgcaagccaaggccacgcgcgaggcgcaaaagcggacagcagccggcatcatgaagaaccccaccgtcgatgggatagtggccatagatctggaccccgtcgtatacgatgccaagttcgagaagcagctcggccagatcatgctgctaatactctgtaccagccaaatcctgctgatgagaacgacttgggccctctgtgaatccatcaccctggcgacgggcccgttgaccacgctctgggaggggagccccggcaagttttggaacaccactatcgccgtgtccatggccaacattttccgggggagctatctagccggtgccggtctggcattctccctcatgaaaagcctagggggcgggcgtcgtgggactggggcacaaggcgagaccctgggcgagaagtggaagaggcagctcaaccagctgagcaagtccgagttcaacacctacaagcggtcgggtattatggaagtcgaccgctccgaggcgaaggagggcttaaagcgcggagagaccacgaagcatgccgtgagccgcggaactgcgaagctccggtggttcgtagagagaaacctggtcaagcccgaggggaaggtgatcgacctcgggtgcggccgaggcgggtggagctactactgcgccgggctgaagaaggtgaccgaggtcaaagggtacaccaaaggcggccctggacacgaagaaccgatccccatggcgacgtacggatggaacctcgtgaagctgcacagcggcaaggacgccttcttcatccctcccgagaagtgcgacaccctgctatgcgacattggtgagtcctcgccgaatcccacgatcgaagaggggcgcaccctccgggttctgaaaatggtcgagccctggctccgcggtaatcagttttgcatcaaaatcctgaacccctatatgccgtccgtggtggagaccctggaacaaatgcaacggaaacacggcgggatgctcgtccgtaatcctttgagccgtaactccacgcacgagatgtactgggtttcgtgcgggaccggcaacatcgtgtccgccatcaacatgaccagccgcatgctgttgaaccgcttcaccatggcgcatagaaagcccacgtacgagcgcgacgtcgacttaggggccgggacccgtcacgtggctgtggagcccgaagtcgccaacctggacattatcggccaacgcatcgagaatatcaagcacgagcacaagtccacgtggcactacgacgaggacaacccgtacaaaacctgggcctaccacgggagctacgaggtgaagccatctggcagcgcttccagcatggtgaacggagtcgtaaaactcttgacgaagccctgggacgtcattccaatggtgacgcagatcgctatgaccgacaccaccccgttcggccagcagcgagtgttcaaggaaaaggtcgacacaaggacacctaaggccaagcggggaacagcccagatcatggaggtgaccgccaagtggctgtggggcttcctaagccgcaacaagaagccccgtatatgcacccgcgaggagttcacgcgcaaggtccggtccaatgcggccatcggcgccgtcttcgtggatgagaaccagtggaacagcgccaaggaggccgtagaagacgagcggttctgggacctggtgcaccgggagagggaactgcacaagcaggggaagtgtgctacctgcgtttacaacatgatgggcaaaagagagaaaaagttgggggagttcgggaaggccaaggggagtcgggccatctggtacatgtggctgggcgctcgcttcctggagttcgaagcgctagggttcatgaacgaggaccactggttctctagagaaaactccctaagcggagtggagggcgagggcctgcaccgtctcgggtacatcctgcgggacatatccaagatccccggcggcaatatgtacgcggatgacacggcggggtgggacaccaggatcaccgaggacgatctgcagaatgaggcacgtatcacagacatcatggagcccgagcatgcgctcctggcaaagagcatcttcaagctgacgtaccagaacaaggtcgtgcgggttcagcgccctggaaagaatggaacagtcatggacgtgatcagccgtagggaccagcggggtagcggccaggtgggcacgtacgggctaaataccttcacgaacatggaagcccagctaatcagacagatggagtccgaaggcatcttcagccccagcgaactggagaccccgaacctcgccgagcgggtcctggactggcttgagaagtacggggtagagcgtctcaagcgaatggccattagcggcgacgactgcgttgtcaaacccatcgacgaccgctttgcgacggcgctaaccgcccttaatgacatggggaaggtacggaaggacatcccacagtgggagccctcgaaggggtggaacgactggcaacaggtcccgttctgcagccaccattttcatcagctgatcatgaaggacggacgggagatcgtcgttccctgccggaaccaagatgagctggtgggcagggcccgggtctcccagggagccgggtggagccttcgcgagactgcatgtctcggtaagagctatgcacagatgtggcagctaatgtacttccacagacgtgacttacggctcgcggccaacgccatttgctcagcggtgcccgtggactggatacctaccagccgcaccacatggtccatccacgcgcaccaccagtggatgacgaccgaggacatgctgagcgtctggaaccgcgtgtggattgaggaaaacccttggatggaggacaaaacacacatctccagttggggcgacgtgccttatctgggtaagcgggaggaccaatggtgtggttccctcatcgggttgaccgccagagccacctgggccacgaacatacaggtcgcgatcaaccaggtgcggcgcctgatcggcaatgagaactacctcgactacatgaccagcatgaagcggtttaaaaacgagtccgaccccgagggagccttgtggtga

SEQ ID NO: 24422 - RNA, 9879 nt, synthetic construct
  misc_feature 1..9879: note = derived and/or modified CDS sequence (opt11) from DENV-1__GU131703__SS-prME
  source 1..9879: mol_type = other RNA
agcgtgaccatgctgctaatgctcatgcccaccgcactggccttccacctcaccactcggggcggggaaccccatatgatcgtgagcaagcaagaacggggcaagagccttctattcaagacgtccgccggggtgaatatgtgcaccctcatcgccatggacctgggggaactatgcgaagatacaatgacgtacaaatgcccccggatcaccgaaacagagcctgacgacgtggactgctggtgtaatgccactgacacgtgggtgacgtatgggacctgtagccaaaccggggagcaccggagggacaagcggtccgtagctctcgcgccccacgtgggcctcggacttgagactcgaaccgaaacttggatgagtagtgagggcgcgtggaagcagatacaacgggtcgagacgtgggcgttgcgccacccaggcttcactgttatcgcgctgttcctcgcccatgcgatcggcactagcatcactcagaaggggatcatattcatacttctgatgcttgtgacgccatccatggcgatgcgctgcgtcggcattggcagccgtgactttgtggaggggctttctggggcaacctgggtagatgtcgtgctggagcacgggagctgcgtgaccacaatggccaaggacaaacccacgctggacatcgagctattaaagaccgaagtcacaaatccagccattttacggaaactttgcatcgaggcaaagatcagtaacaccacgaccgactccagatgccctacccaaggcgaagcgaccctagtggaggagcaggacgccaacttcgtgtgccggcgcacgtttgttgaccgtggatgggggaacgggtgcgggttgtttggtaagggatccttgatcacgtgcgcaaagttcaagtgcgttaccaaactagagggtaagatcgtgcaatacgagaacttgaaatatagcgtgattgtgaccgtgcacactggcgaccagcaccaggttggtaacgagtctacagagcacggaaccaccgctacgatcacgccccaagctccaaccaccgaaatccaactgactgattacggggcccttacgctggactgtagtccgcgcaccggtctagacttcaatgagatggtgctccttactatgaaggaaaagtcctggctcgtccataagcaatggtttttggatctgcccctcccctggaccagcggggccagcacttcccaggagacctggaatcggcaagaccttttagtaacctttaagaccgcccatgcaaagaagcaggaggtggtcgtattaggctcacaggagggcgccatgcacacggccctgaccggggcgaccgagatacagacctccggcactaccaccatcttcgccgggcacctgaaatgtcgcttaaagatggacaagctgaccctgaaggggatgagctacgttatgtgcaccgggtcgttcaaattagagaaggaagtcgccgagacacaacacgggacagtgcttgtgcagatcaagtacgagggtaccgatgcgccctgcaaaatcccgtttagcactcaggacgaaaaaggggtgacccagaacggtcggctgatcacagccaacccgatcgtgacggacaaggaaaagcccgtgaacatcgaggccgaaccgccgtttggtgagtcctacatcgtcatcggtgccggcgaaaaggcgctaaagttgtcgtggtttaagaaagggtctagcatcgggaagatgttcgaggccacggctcgcggcgcccggcgcatggccatactgggtgacaccgcatgggacttcggctccatcggaggcgtgttcaccagcgtggggaagctggtccaccagatattcggaaccgcatacggagtcctcttctccggcgtgagctggacgatgaagatcgggatcggggtgctgcttacgtggttaggccttaattctcgcagcaccagtctgagcatgacctgcattgccgttggtttagtgaccctgtacctgggcgtcatggtgcaagccgacagcggatgcgtgatcaactggaaggggcgggagctcaagtgcggcagcggcatcttcgtcaccaacgaggttcacacctggactgaacagtacaagttccaggccgatagccccaagcgcctgtccgcagcgatcggtaaggcttgggaggaaggcgtttgtggcatccgcagcgcaacgcgtctagagaacatcatgtggaagcagatctccaacgagctcaaccacatactgcttgagaacgacatgaagttcactgtggtggtgggtgacgtagccgggatcctcgcgcaggggaagaagatgattcggccccagcccatggaatataaatacagctggaagtcctgggggaaagccaagataatcggagcagacgtgcaaaataccaccttcataatagacggccccaacaccccggagtgccccgatgaccagcgcgcctggaatatctgggaggtagaagactacggcttcggcatcttcacaaccaacatctggttgaaacttcgagacagttacacccaggtttgtgatcaccgcctcatgagtgcggccatcaaggacagcaaggccgtgcacgccgatatgggctactggatcgagtcggagaagaacgagacctggaagctggcccgggcgagcttcattgaagtaaagacgtgcatttggcccaagtcccacaccctgtggagtaacggcgtcttggagtccgagatgattatcccaaaaatctacgggggcccgatcagccagcacaactacagaccagggtatttcacccagaccgccggcccgtggcatcttgggaagttagaactcgacttcgacctgtgcgaaggcacgactgtggttgtcgatgagcactgcgggaaccgggggccgtcactgcgcaccactacggtaacgggtaagatcatacacgagtggtgctgccgaagctgcacccttccgcccctgcgtttccgtggggaggatggttgctggtacgggatggagattcgccccgttaaggagaaggaggagaacctggtcaagtccatggtcagcgccggttccggtgaggtggattctttcagtctcgggctactgtgcatctccattatgatcgaggaggtcatgcggagccgctggtcccgaaagatgttaatgacaggcaccctagccgtgttcctgctcttgatcatggggcaactgacctggaacgacctcatcaggctctgcatcatggtgggcgccaacgcgagcgaccgcatgggtatgggcaccacttatctggccctcatggccacttttaagatgcggccgatgttcgctgtaggtttgctgtttcggcggctcacctcccgcgaagttctgctgctaacaatcggactgagtctggtagcctccgtcgaactccccaactcactggaggagctgggcgatgggcttgcgatgggcatcatgatccttaaactgctcactgacttccagtctcaccaactctgggccacgctgctcagcctgactttcataaagaccaccttttccctccactacgcctggaagacgatggccatggtactcagtattgtatccctgttccccctgtgcctcagcaccacctcccagaaaaccacctggctgcccgtgctcctagggtcgttaggatgcaagccgttaaccatgttcctcattgcggagaacaagatctgggggcgtcgttcctggcccctgaatgaagggatcatggcagtaggcatcgtcagcatcctactgtccagcttactgaagaacgacgtgcctctcgccgggcccctgattgccgggggcatgctgattgcctgctacgtgattagcgggtccagcgcagacctctccctggagaaagccgcggaggtctcgtgggaggaggaggcggaacactccggcgccagccacaacattctggtggaagtgcaggacgacggaacgatgaagatcaaggacgaggagcgagacgacacgctgactatcctgctgaaagcgacgttactagccgtcagtggcgtgtacccgctcagcatccctgccaccctcttcgtgtggtacttctggcaaaagaagaagcagcgctccggtgttctgtgggacacgcccagccctcccgaagtggagcgtgctgtattagacgatgggatataccgcatcatgcagcgcggcctgcttggccgttcccaggttggggtcggtgtgtttcaggagaacgtgttccacaccatgtggcacgttaccagaggggccgtgctgatgtatcaggggaaaaggctggaacctagctgggcgtccgttaagaaagacctcatatcttacggcggcggatggcggcttcagggatcctggaacaccggggaggaggtacaggttatcgccgtggaacccgggaagaaccccaaaaacgtgcagaccaccccggggactttcaaaacaccagagggcgaggtgggcgccatcgccctggattttaagcccggcaccagcggtagtccaattgtaaaccgggaaggtaagatcgtgggcctctacggcaacggggtggtcaccacgagcggcacatacgtgagcgccatcgcgcaagccaaagcctcccaagagggaccgctgcccgagatcgaggacgaggtgttccggaaacgcaacctgaccatcatggacctccatcccggcagcggaaaaacacggcgctacctcccggctatcgtccgggaggctatcaagaggaaactgcgcacgctgatactggcccccacccgggtggtagcctccgagatggccgaggcactgaagggcatgcccatccgctaccaaaccaccgctgtcaaaagcgagcacacgggtaaggagattgttgacctcatgtgccacgccaccttcaccatgcgcttattgtccccagtccgcgtccctaactacaacatgataatcatggacgaggcccacttcaccgatcccagttctatcgcggcccggggctacatctccacacgcgttggcatgggggaggcagccgcgattttcatgactgccacgccgcctggctccgtggaggccttcccccagtcgaatgcggtgatccaagacgaagaacgggacatacccgaacgcagctggaactcgggttacgagtggatcaccgatttccccggcaagacggtgtggtttgtgccctcgatcaagagtgggaatgatatcgccaactgcctccggaagaacggaaagcgcgtgattcagctgtcgcgcaagaccttcgacacggagtaccagaagaccaagaacaacgattgggactacgtggtgacgaccgatatcagcgaaatgggtgcgaactttcgggccgaccgggtcatcgacccaaggcgctgccttaaacccgttatcctcaaggatggccccgaaagagtgattttggccggccccatgcctgtcacggtggcctccgccgcccagcggcgcgggcggatcgggagaaaccacaacaaggagggcgatcagtatatctatatggggcagccacttaacaacgacgaagaccatgcccactggacggaggccaagatgctcctggataacattaacacacccgagggtatcatcccggcgttgttcgagccggagcgcgagaaaagcgccgccatagatggcgagtaccgtctgcgcggggaggctagaaaaacattcgtcgaactgatgcgccgcggggacctgccggtttggctcagttacaaggtggcgagcgaaggcttccaatactctgaccgccggtggtgctttgacggggagcgcaacaatcaagtgctcgaagagaacatggacgtggagatctggaccaaggaaggggagcgtaagaagctgcgtccccggtggttagacgcgcgcacctactccgaccccttagccttacgggagtttaaggagttcgcggctggccgccgaagcgtctccggggacttaatcctggagatcgggaagctgccgcagcaccttacccagcgcgcccagaacgcgctggataacctggtgatgctccacaatagcgaacagggcggacgtgcctaccgccacgcaatggaggagttgccagacaccatcgagaccctgatgctcctggcacttatagccgtgctcacaggtggtgtgactttgttcttcctgtccggccgcggcttgggcaagacgagcatcggcctgttgtgtgtcatggccagctcagtgctactctggatggcttccgtggagccccattggatagcggcgtccatcattttggagtttttcttaatggttctcctgatacccgaacccgaccgacagcgtacaccccaagacaaccagctcgcctacgtggtaatcggactgctgtttatgatcctcaccgtcgccgcgaatgaaatgggcctcctggagaccacgaagaaagacctcggtattggccatgtagccgtcggcaaccaccaccacgcagccatgcttgatgtcgacctgcacccagcctccgcttggactctttacgccgtcgcgacgaccatcatcacgcctatgatgcgccataccatagagaacaccactgccaacatcagccttacagcaatcgcaaaccaggctgcgatactcatgggcctagacaagggctggcccatctccaagatggacataggagtgcccctgctcgccctcggctgctacagccaagtcaaccccctgacgctgactgccgccgtgctaatgctggtggcgcactatgcgatcatcggcccgggcctgcaggccaaggccacccgtgaagctcaaaagcgtaccgctgcagggatcatgaagaatcccactgtagacggcatcgtggcgatcgacttagaccccgtggtctacgacgccaagttcgaaaagcagctgggccaaatcatgctgctgatcctgtgcacctcccagatcctgctgatgcgcaccacctgggccctgtgcgagagcattaccctggcgacgggacctctcaccacattatgggagggatcgccggggaagttctggaacaccacaatcgctgtgagtatggccaacatattccgaggcagttacctggccggagccgggctcgcctttagccttatgaaatcactaggaggtgggcgccgggggaccggcgcgcagggcgaaacgctgggggaaaagtggaagcgccagctcaaccagctgtccaagtcggagttcaacacctacaaacgatccggcatcatggaggtggacaggagcgaggccaaagagggcctgaagcggggagagaccaccaagcacgcggtctctcgaggaacggcgaagctgcgatggttcgtggagcgcaatctggtgaaacccgaaggtaaggtcatcgacctgggctgcgggcgtggcgggtggagctattactgcgccggacttaagaaagtgaccgaggtcaagggctacaccaaaggtggccctgggcatgaggagcccataccgatggcaacctacggttggaacctggtcaagctgcattctgggaaggatgtattctttataccgcccgaaaagtgcgacacgctcctgtgcgatatcggcgagtcttcgccaaacccgaccatcgaggaggggcgcaccctgcgggttctcaagatggtcgagccgtggttacgtggtaaccagttctgcatcaagatcctgaacccctatatgccctcagtggtggaaactctcgagcaaatgcagcggaagcatggcgggatgctggtccgcaacccgcttagccggaacagcactcacgaaatgtattgggtctcctgcggcacaggcaatatagtgtccgccgtcaatatgacctctaggatgttacttaaccgcttcaccatggcacaccggaagcctacctatgaacgcgacgtggacctgggcgcgggtactcggcatgtggcagtcgagcctgaggtggccaacctcgacataattgggcaacgcattgagaacatcaaacacgagcacaaaagcacgtggcactacgacgaagataacccctacaagacgtgggcctaccacggtagctatgaggtgaagccgagtgggagtgcctctagcatggtcaacggcgtggtcaaactcctgaccaagccctgggatgtgatccccatggtcactcaaatcgcgatgacagacacaacgcccttcgggcagcagcgtgtgttcaaggaaaaggtggatacccgcaccccgaaggccaaaagaggcaccgcgcaaatcatggaagttaccgccaagtggctctggggcttcctatcccgcaacaagaagcctcgaatatgcacgcgcgaggagttcactagaaaggtgcgcagcaatgccgcgattggtgccgtgttcgttgatgagaaccaatggaactccgccaaagaggccgttgaagacgaacggttctgggatctagtgcatcgcgaacgcgagctccataagcaaggtaagtgcgctacctgcgtctataatatgatggggaaacgcgagaagaagctgggcgagttcgggaaggccaagggcagccgggccatatggtatatgtggctgggagcacgcttcctcgagttcgaagccttagggttcatgaacgaggaccattggttctcccgggagaacagcctgtcaggcgtcgagggggaggggttacataagttggggtacattctgcgcgatataagcaagattccaggagggaacatgtacgccgacgacaccgccggctgggacacgcggatcaccgaagacgatctccagaacgaggcccgaatcaccgacatcatggaaccagagcacgccctgctggcgaagtccatcttcaaactcacctaccagaacaaagtggtgcgagttcagcggcccgcgaagaacggcacggtaatggatgtaattagccgccgggaccagcgagggtctggacaggtcggcacctacggcctgaacactttcaccaacatggaggcacagctgatcaggcaaatggaaagcgaagggatcttttcccctagcgagctggagacgcctaatctggccgagcgcgtgctggattggctcgagaagtacggagtcgagcgtctcaagcgaatggctatctctggagatgactgcgtcgtgaaaccgatcgacgaccgtttcgcgaccgcgctgaccgcactaaacgacatggggaaggtgcgaaaggacattccgcagtgggagcccagtaagggatggaacgactggcagcaggttcctttttgctcccatcattttcaccagctgataatgaaagacggccgggagatcgtggtgccttgcagaaatcaagacgagctggtcggccgcgctcgcgtaagccagggcgccgggtggagccttagagagaccgcctgcttgggcaagagctatgcgcaaatgtggcaactgatgtacttccacaggagagacctccgcctcgccgccaacgccatctgcagtgcggtgcccgtcgactggattcccacttcccggacgacctggtccatccacgcgcaccaccagtggatgaccacggaggacatgctgtccgtgtggaaccgcgtttggatcgaagagaacccctggatggaggataaaacacacatatcttcctggggagatgtcccctaccttggcaagcgcgaggaccagtggtgcggcagcctgataggcctgaccgcgagagccacctgggcaacaaacatacaagtggcaatcaaccaggtccgcagactcattgggaacgagaactacttagactacatgacgtctatgaagcgcttcaaaaacgagagcgaccccgaaggggccctgtggtag

SEQ ID NO: 24423 - RNA, 9879 nt, synthetic construct
  misc_feature 1..9879: note = derived and/or modified CDS sequence (opt11) from DENV-1__GU131706__SS-prME
  source 1..9879: mol_type = other RNA
agtgtgaccatgttgctcatgctgatgcccaccgccctggccttccacctcacgacacggggaggagaaccccacatgatcgtgtcgaagcaggagagaggtaaaagcttactctttaagaccagcgccggggtgaatatgtgcaccctcattgccatggacctgggcgagctgtgcgaggatacgatgacctataagtgcccccgaatcaccgaaaccgagcccgacgacgttgactgttggtgcaacgcgaccgacacctgggtgacctacgggacctgttcgcaaacgggggagcacagacgcgataagcgttccgtggccctcgcgccccacgtaggcctggggctggagacccggaccgagacctggatgagctccgagggcgcgtggaagcagatccagcgggtcgagacgtgggccctcagacaccccgggttcaccgtcatcgccctgttcctggcccatgcgatcggcaccagcatcacacaaaagggcatcatcttcatactcctgatgctggtgacgccctctatggccatgcggtgcgtcggcatcggctcacgcgacttcgtggaagggttatccggcgccacttgggtggacgtcgtgctggagcacggttcatgcgtgacaaccatggcgaaggacaagcccaccttggacatcgaattgcttaagaccgaggtcactaaccccgccgtcctacggaagctctgcatcgaggcgaagatatccaacacaaccaccgatagccgctgcccgactcagggtgaggccacgttggtggaggagcaagacgccaactttgtctgccggcgcacgttcgtggatcggggctgggggaacggctgcggattgttcggcaagggttccctcatcacgtgcgccaaatttaagtgcgtgaccaagttagagggtaagattgtccagtacgagaaccttaagtacagcgttattgttactgtccacacaggcgaccaacaccaggtggggaacgagagtaccgagcacggtaccaccgccactatcacgccccaggcccccacgacggagatccagctcactgactacggtgccctgacactggactgcagcccccgcaccggcctcgacttcaacgagatggtgctactgaccatgaaagagaagtcctggctcgtacacaagcagtggttccttgacctaccgctgccctggaccagcggggcaagcacgtcgcaggaaacctggaatcgtcaggacctgctggttaccttcaagaccgcccacgccaagaaacaggaggtcgtggtgctcggcagccaggagggcgctatgcacacggccttaaccggggccacggaaatccagacctccggcacaaccacaatcttcgccgggcacttgaagtgccgcctcaagatggacaagctaaccctgaaaggaatgagttacgttatgtgcacggggtcttttaagctagagaaggaggtcgccgagactcagcacggcactgtgctcgtccagatcaagtacgaaggcaccgacgcgccctgcaagatccccttcagcacgcaggacgaaaagggggtgacccagaacggccggctgataaccgccaacccgattgtaactgacaaggaaaagccagtcaacatcgaagcggaaccgcctttcggggagtcctatatagtaatcggagccggcgagaaggcactcaagctcagctggttccgcaaggggtccagcatcggtaagatgttcgaggccactgcccgaggggctcgacgcatggccatcctgggcgacaccgcgtgggacttcggttcgatcggcggtgtgttcacgtctgtaggtaagctcgttcatcagatcttcggaactgcctacggggtcctgttcagcggcgtaagttggacgatgaaaatagggatcggggtcctgttgacctggctcggcctgaactcccggagcacctccttatcgatgacatgcatcgcggtcgggctcgtcacgctgtatctgggagtgatggtgcaggccgactccggctgtgtcatcaactggaagggccgcgaactcaagtgcgggagcggcatcttcgtgaccaatgaagtccacacatggaccgagcagtataagttccaggccgactcccccaagcggttgtccgcggccatcggcaaggcctgggaggagggggtttgcggcatccgctccgccacccgcctggagaacatcatgtggaagcaaatttcaaacgagttaaaccacatccttctggagaacgatatgaagtttacggtggtggtcggggacgtggccggcatcctcgctcaggggaagaagatgattcgcccgcagcccatggagtataagtacagctggaagagttggggcaaggccaagatcattggcgccgacgtccagaacaccacctttatcatcgatgggcccaacacccccgagtgcccggacgaccaaagggcctggaacatatgggaagtcgaggactatggcttcgggatattcactacgaatatttggctgaagctgcgagacagctacacccaagtctgcgaccaccggctaatgtctgcggcaatcaaagacagcaaagccgtgcatgccgacatgggctactggatcgagtccgaaaagaacgagacctggaaactggccagggcgagtttcatcgaggtaaagacatgcatttggccaaagtcgcataccttgtggtctaacggcgtgctggagtccgagatgatcatcccgaagatatacggaggccccatcagccaacacaattaccgacccgggtactttacccagacggccggcccctggcacctggggaaattggagcttgacttcgatctgtgcgaaggcacgacagtggtcgtcgacgagcattgcggaaaccgcgggccgtcactgcggacgaccacggtgaccggcaagataatccacgagtggtgctgtagaagctgcaccctgccgcctcttcggttccgcggtgaggacggctgttggtacgggatggagattcggcccgtaaaggaaaaggaggagaatcttgtgaagtccatggtgtcagccggaagcggggaggttgattccttctcgctcgggttgctgtgtatttccatcatgatcgaggaggtgatgcgcagccggtggtcccgcaagatgctcatgactggaacgctggctgtgttcttcctgctcataatggggcagctgacctggaatgatctgatccgactctgcatcatggttggggcaaacgcatctgaccggatgggcatgggcatgacctacctggccctgatggcaaccttcaagatgcgcccgatgttcgccgtcggcctactgttccggcgcctgacgtctcgggaggttttgctgctgacgatcggactctctctggtcgcgtccgtggaactgccgaactcgctcgaggagctcggcgatggtctggccatgggcatcatgatcctcaaactgctaactgacttccaatcgcaccagctctgggcaaccctgctttcgctcacgttcattaagaccaccttctccctacactatgcctggaagacaatggccatggtcctgtccattgtatccttgttccccctctgcctgagtacgacctcccagaagaccacctggctcccagtgctgctgggaagcttagggtgtaagcccctgacgatgttcctaatcgcggagaataagatatggggccgtcggtcctggcccctcaacgaaggcatcatggccgtcggtatcgtaagcatcctgctgtcctccctcctgaagaatgacgtgcccctggccgggccgctcatcgccggaggcatgctcattgcctgctacgtcatcagcggctcctccgcggacctgtcccttgagaaagccgccgaggtaagctgggaggaggaagcggagcactccggcgcaagccacaacatcctggttgaggtccaggacgacgggaccatgaagattaaggacgaggagcgcgacgacaccctgaccatccttttaaaagcaaccttactcgcggtatccggcgtgtatccgctgagcatccccgccacgctgtttgtctggtacttctggcagaaaaagaagcagcgatccggggtgctctgggacacacccagcccaccggaggtagaaagagccgtcctggacgacggcatctaccgcataatgcagcgcggcctgctggggcggtcccaggtaggcgtgggagtcttccaggagaacgtgttccacaccatgtggcacgtgactcgcggtgccgtcctcatgtaccaggggaaacggctggagcccagctgggcgtctgtgaaaaaggacctgatcagctacgggggcggatggcgcctccaggggagttggaacacgggagaggaagtccaggtcatcgccgtcgagcccggcaagaaccccaagaatgtgcagaccgcgccggggaccttcaagacccccgagggcgaagtgggcgccatcgccctggacttcaagccggggacaagcggctcccctatcgtgaaccgggaggggaagatcgttggactgtacggcaacggggtagtcaccaccagcggtacctacgtgagcgcaatcgcacaggccaaggccagccaggaggggccgctccctgagattgaggacgaggtgttccgtaaacggaacttgacgatcatggacctgcatccgggcagcgggaagacccgacggtatttgcccgcgatcgtacgcgaggccatcaagcgcaagctgcggaccctgatcttagcacccacccgtgtggtcgcctccgagatggccgaggcgctgaagggtatgcctatacgctatcagacgaccgctgtcaagagcgagcatacgggcaaggagatcgtggatctgatgtgccacgctacgtttaccatgcgcctcctgtcccccgtacgggttccgaattacaatatgatcataatggacgaggctcacttcaccgacccaagctccatcgcagccagaggatacatcagcactcgggtgggcatgggggaggccgctgccattttcatgaccgccacgccacccggctccgtcgaggcgttccctcagagcaacgcagtgatccaggacgaggagcgcgacatccccgaaaggagttggaacagcgggtacgagtggatcaccgacttccccgggaagaccgtgtggttcgtcccgtccatcaagagcgggaacgacatagccaactgcctgaggaagaacgggaagcgggtgatccagttatcccgcaagacattcgacacagaataccaaaagacgaagaacaacgattgggactacgtagtcactaccgatatcagcgagatgggcgccaacttccgtgcggaccgcgtgatcgatccgcggcgctgtctgaaacccgtgatcttaaaggacgggcccgaacgcgtcatccttgcaggccctatgccagtgacggtcgcgtccgccgcccagcgccgggggcgcatcgggcgcaaccacaataaggagggcgatcaatacatatacatgggtcagcccctgaacaatgacgaggaccacgcgcactggactgaggccaagatgctgctcgacaacatcaacacccccgagggcatcatccctgccctgttcgagccggagcgggaaaaatccgctgccatcgacggggagtaccgcctgcgcggcgaggcgcgcaagaccttcgtggagctcatgcggaggggggacctgccagtgtggctcagctataaggtcgccagcgaaggcttccagtactcagaccggcgttggtgcttcgacggagagcgtaacaaccaagtgctggaggaaaacatggacgtggagatctggacgaaggagggcgagaggaagaaactcagaccccgctggctggacgctcggacgtattccgaccctctcgcgctgcgggagttcaaagaattcgccgcgggccggcgcagcgtcagcggtgatctgatcctggaaatcggcaagctccctcaacatctgactcaacgtgcccagaatgccctcgataacctggtgatgctgcacaactccgagcagggaggtcgcgcttaccggcacgccatggaagagctccccgacacgatagagactctgatgctgttggccctgatcgccgttctcaccggcggggtcaccctcttcttcctcagtggccgcggcctcggaaagaccagtataggcctcctttgcgtgatggcctcctctgtgctgctctggatggcatcagtagagccccactggatcgcggctagcatcatcctcgaattcttcctcatggtcttgcttatcccagaacctgatcggcaacgtacgcctcaggacaaccagctggcctacgtggtcattggcctcttatttatgatcttaaccgttgccgctaacgagatgggcctcttagagactaccaagaaggacctgggtatcggccacgtggcggtcgagaaccaccaccacgcggccatgctcgatgtggacctgcaccccgcctccgcctggacgctgtacgctgtggccacgaccattatcacgccgatgatgcgccacactattgagaacacgaccgccaacatcagcctcaccgccatcgccaatcaggcggccatcctaatggggctggacaagggctggcccatctcaaagatggacataggtgtcccgctgcttgccttggggtgctactcccaggtgaaccccctcacattgacggccgcggtgctgatgctcgtagcccactacgcaatcatcggcccggggctgcaggccaaagctacccgggaagcgcagaagcgcaccgccgccggcataatgaagaacccaaccgtggatgggatcgtggccatcgacctggaccccgtggtgtacgatgccaagttcgagaagcagctcgggcagattatgctgctaatcctctgcacgtcacagatcctgttaatgcggaccacctgggcgctctgcgagagcatcaccctggccacgggtcccttaactaccctctgggagggctccccgggcaagttctggaacaccacgatcgccgtgtccatggcaaacattttccgcggctcctacctggccggcgcgggcctggccttcagcctcatgaaatcactcgggggcggccggcggggtaccggggcccagggcgagaccctgggcgagaaatggaagcgacagctcaaccagctgtccaagagcgagttcaacacctataagcgttccgggatcatggaggtcgaccgtagcgaggccaaggagggcttaaagcgcggggagacgaccaaacacgctgtctcccgaggtaccgcaaagctccggtggttcgtggagaggaacctggtcaagccggaagggaaggtaatcgacctggggtgcggccgcggaggctggagctactactgcgccgggctgaaaaaggtgaccgaggtgaagggctacactaagggtgggcccggccacgaggagcccatcccgatggctacctatgggtggaacttagttaaactgcactccggtaaagacgtgttcttcatacctccagagaagtgcgacaccctactctgcgatattggggagtcatcccccaacccaacaatcgaggaaggccgcacgctgcgcgtcctgaagatggtggagccctggctccgggggaaccagttctgtattaaaatactgaacccgtacatgcccagcgtcgtcgagacgctggaacagatgcagcgcaagcacggcggtatgctcgtacggaacccgctgtccaggaactcgacccacgagatgtactgggtgtcctgcggaaccggcaacatcgtcagcgctgtaaacatgacgtcccggatgctgctaaaccggttcacgatggcgcaccgcaagcccacctacgagcgcgacgtggacctgggcgccggcacccgccacgtcgccgtagaacccgaggtggccaacctggacatcataggacagcggatcgagaacatcaagcacgagcacaaaagcacctggcactacgatgaggacaacccctacaagacttgggcataccacggttcctatgaggtcaaaccgagcggctccgctagcagcatggtgaatggggtcgtaaagctcttgactaagccctgggacgtgatccccatggtcacacagatcgccatgaccgatactacccccttcggccagcagcgagtgttcaaagagaaggtggatacccggaccccgaaggccaagcgcgggaccgcgcagatcatggaagtcacagccaaatggctgtggggctttctctcccggaataagaagccccgaatctgcacaagggaagagtttacccgcaaggtacggagcaacgcggccatcggcgccgtgttcgtggatgagaaccagtggaactccgccaaggaagcggtggaggatgagcgcttctgggacctggtgcacagggagcgcgagctgcacaagcaggggaaatgcgccacgtgcgtctataacatgatgggcaagcgggagaagaaactcggggagtttggcaaggccaagggatcacgcgccatctggtacatgtggctgggcgctcggttcctggagttcgaggccttgggcttcatgaatgaggaccattggttctcccgtgagaacagcctgtccggggtggagggcgaggggctgcacaagttgggatacatcctgcgggacatctctaagatccccgggggtaacatgtacgctgacgataccgccggctgggacaccagaatcaccgaggacgacctgcaaaacgaagcccggatcacggacatcatggagccggagcatgcactcctcgcaaagtccatcttcaagctgacctaccagaacaaggtggtcagggtgcagcgccccgccaaaaacgggacagtgatggatgtcataagccggcgcgatcaacgggggtccggccaggtggggacctacgggctaaacacgttcaccaacatggaggcccagctgatacgccaaatggagagcgaggggatcttttcgcccagcgagctggagacccccaacctcgccgaacgggtgctggactggctcgagaagtacggcgtcgagagactcaaacggatggccatatccggggacgactgcgtggtcaagccgatcgacgaccgctttgcaaccgccctaacggccctgaacgacatggggaaggtccggaaggacattccacaatgggagccctccaaagggtggaacgactggcagcaggtgcccttctgctcccaccacttccatcagctcatcatgaaggacggccgcgagatcgtggttccgtgcagaaaccaggacgagctggtaggccgcgcccgggtgagccagggggccggctggtcactgcgagagaccgcctgcctcggtaagtcctatgctcaaatgtggcagctgatgtacttccaccggcgcgacttacggctcgccgccaacgccatctgcagcgcagttcccgtggactggatccccacctcgcgcaccacgtggagcatccacgcccaccaccaatggatgaccaccgaggatatgctgtctgtgtggaaccgcgtgtggatcgaggagaacccctggatggaggacaagacccatatctcttcctggggtgacgtgccgtacctggggaagcgggaagaccagtggtgtggctcgctcatcggcctgacggcccgcgccacgtgggctaccaatatccaggtggccataaatcaggtccggcgcctgatcgggaacgaaaactacctcgactacatgacctccatgaagcggttcaagaatgagtccgatcccgagggcgctttgtggtga

SEQ ID NO: 24424 - RNA, 9879 nt, synthetic construct
  misc_feature 1..9879: note = derived and/or modified CDS sequence (opt11) from DENV-1__GU131708__SS-prME
  source 1..9879: mol_type = other RNA
agcgtaacaatgttactaatgctaatgccaacagcactcgctttccatctaactacgagaggcggcgaaccgcacatggtagtgtcaaaacaagaaaggggcaaaagccttctattcaaaacatcagctggcgtaaatatgtgcacgctaatagcgatggacctcggcgaactctgcgaagacaccatgacctataaatgtccccggatcactgaagcagaaccagacgacgtggactgctggtgcaacgctaccgacacgtgggtgacctacgggacatgctcccaaacaggggaacacagacgcgacaagaggtctgtggcactcgcaccgcacgtcggcctcgggctagaaacccgaaccgaaacatggatgtcatctgaaggcgcatggaagcaaatacaacgagttgaaacctgggcactgcgccaccccggcttcacggtcatagcactcttcctagcacatgccataggcacctccataacacaaaaaggcataatattcattctgctgatgctggtgacgccctctatggcaatgagatgcgtggggatagggagtcgtgactttgtcgaggggctatccggagcaacatgggtcgacgtagttctcgaacacggctcatgtgtgacgacaatggcaaaggacaagccgactttagacatcgaactcctcaaaacagaggtaaccaacccagccatactccgcaagctatgcatagaagccaaaataagcaacacaacaacggacagtcgctgcccaacccaaggcgaggcgacgctggtagaagaacaggacgccaatttcgtgtgtcgacgaacattcgttgatcgaggctggggtaacggatgcggtctttttggcaaggggtccctgataacgtgtgctaaattcaaatgtgtaaccaaactagaggggaagatcgtccagtacgaaaatctaaaatacagcgttatagtcacggtgcatacgggagaccaacatcaagtaggaaacgaatccacggaacacggcacaaccgctacaatcactccacaagcacctacaacagagatacagctcacggactacggagccctcacgctggattgcagtccacggacgggtttggacttcaacgagatggtcctcctgacaatgaaggagaaaagctggctcgtgcataagcagtggttcctcgacctcccacttccctggacaagcggtgcgtcaacctcccaagaaacttggaacagacaggacctattggtaacattcaaaactgcccacgcgaagaagcaagaagtagtggttctcggaagtcaggaaggagccatgcatacagcgctaactggggctacggaaatacaaacgagcgggacaaccacgatattcgcaggacacctaaaatgcagactaaagatggataaattgacgctaaaggggatgagttatgttatgtgtacatcgtcgttcaaactcgaaaaagaagtggctgaaacgcaacatgggacagtcctagtacaaataaaatacgaggggacagacgcgccctgtaaaattccattttcaacacaagacgagaaaggagttacgcaaaacgggcgactaatcactgcgaacccgatagtaaccgataaagagaagcctgtaaatatagaagccgagccgcccttcggcgagtcttacatagtcataggcgcgggcgaaaaagccctaaagctgtcatggtttaagaaagggtcgagtatcgggaagatgttcgaagccacagcacgcggcgcaaggcggatggcgatcctcggagacacagcatgggactttgggtcaatcggaggggtcttcaccagtgtcggtaaactcgtgcatcaaatcttcggcacagcatacggagttcttttctctggagtcagttggacaatgaaaataggcctcggcgtgctcctcacctggttagggctgaactcacgctcaaccagtctatctatgacttgtatcgcggtagggctagtaaccctgtacctcggtgtcatggtccaggcagattcaggctgcgtaatcaattggaagggtagagagttaaaatgtggaagcggaatctttgtcaccaacgaggtgcacacgtggacggaacaatacaaattccaggccgattcacccaagcggctgtcggcagcaattggaaaggcctgggaggaaggtgtgtgcggaatccgctccgcaacgagactcgaaaacgtgatgtggaaacagatcagcaatgaactgaaccacatcttactggaaaacgacatgaaattcaccgtagtagtaggagacgtggctggaatcttagcccaaggcaaaaagatgattcgaccgcagcccatggagtacaaatatagttggaagagttggggaaaagcgaaaattatgggcgcagacgtacagaacacaacatttatcatagacggtcccaacaccccggaatgcccggacgaccagcgcgcttggaatatttgggaagttgaagactacggcttcggaattttcaccacaaacatatggctaaagttgagggatagctacacccaagtatgtgaccacaggcttatgtcagcggcaatcaaggactcaaaagccgtccacgcggacatgggctattggatcgagagcgagaagaacgaaacatggaaactcgcacgggccagcttcatagaagtaaaaacatgcatttggcccaagagccacacgttgtggagcaacggggtgctcgaaagcgaaatgataataccaaagatatacggcggcccgatttcacaacataactatcggccaggctacttcacacaaacggccgggccgtggcatctcggcaaactagaactggacttcgacctatgcgagggaaccaccgtggtggtcgatgaacactgcggtaaccgtggaccatccctccgtacgaccacagtcaccgggaaaatcattcacgagtggtgctgccgtagctgtaccttaccaccgctcaggttccgaggagaggatggctgctggtacggaatggagatacgcccagtaaaagaaaaagaagaaaacctcgtaaaatcgatggtatccgcgggcagtggcgaggttgacagcttttcgctgggacttctttgcatatctatcatgatagaagaagtgatgcgtagccggtggagccgcaaaatgctgatgaccggaacactcgcagtcttcctcctcttaatcatgggtcagctaacatggaacgacttgatccgcctctgtataatggtaggagccaatgctagcgacagaatgggaatggggaccacctacctagcactaatggcgacattcaagatgaggccgatgttcgcagtaggtcttctctttcgccggttgacatcgagagaagttctcctcctgacgatcggactcagcttggtggctagcgtagaacttccaaacagccttgaggaactcggcgatggcctcgcaatgggaataatgatactaaaactgctaacagacttccaaagccatcaattatgggccacactccttagtctcacatttataaaaactaccttctctcttcactacgcctggaaaaccatggccatggtgctatcaatcgtatcactcttccccttgtgcctgtccaccacaagccagaaaaccacctggcttcccgtgctattaggatcgctcggctgcaaaccgttgacgatgttcctgatcgccgagaacaaaatctgggggcgccgctcgtggccacttaatgagggtattatggcggtgggcatcgtcagtattttgctctccagcttgctcaaaaacgacgtcccgctcgcgggacccctaatagccggcggcatgctaatcgcatgctacgtaatcagcggcagcagcgctgatctatccctagagaaagcagcagaggtaagctgggaagaagaagcagagcactcgggggcgagccacaacatcctggttgaggtccaagacgatggtactatgaagataaaagacgaggagcgtgacgacacccttacaatccttctcaaggcaaccttacttgcagtctctggcgtctaccctctgtctataccggcaacgttgttcgtctggtacttctggcagaaaaagaaacaacgatccggtgtattgtgggataccccttcaccacccgaggttgaacgagctgtactagacgacgggatttacaggatcatgcaaagaggccttctaggacgaagccaggtcggagtcggcgtcttccaagagaacgtgttccacacgatgtggcacgtgactcgaggagccgtcttaatgtatcaaggaaaacgcctggagcctagctgggcctccgtaaagaaagacttaatttcatatggtggtgggtggagactgcagggcagctggaatacgggcgaagaagtgcaagtcatagcagtcgagccgggtaaaaaccccaagaacgtccagaccgcccccggaacattcaagaccccagaaggggaggtaggagcgatagccctagacttcaaacccggcacatctggatcgccaatagtgaaccgcgagggcaagatcgtgggactatacggcaacggagtcgttaccacaagcggtacatacgtcagcgcaatcgcgcaagctaaagcaagtcaagagggcccgctaccagaaatagaagacgaagtatttcggaagaggaacctcacaataatggacttgcaccctgggagcggcaagacgcgccggtaccttcctgcgatagtgagagaagccatcaagcgcaaacttcgaacactcatactagccccaaccagggtggtcgcgtcagaaatggctgaagcccttaaaggcatgccgatcagatatcagaccaccgcagtaaaaagcgagcacacaggtaaagaaatcgttgacctcatgtgccacgcaacttttaccatgcgcctactaagccccgtacgagtgccgaactacaacatgatcattatggacgaggcccacttcacggacccgagtagcatcgcggcgcgtggatacatctccacgcgggtgggaatgggagaggccgcggcaatatttatgaccgcaacccctccggggagtgtggaagcgttcccacaaagcaacgccgtaatccaagatgaggaacgggacattccggagcgcagctggaactcgggctacgaatggatcacggacttcccggggaagacggtgtggttcgtacccagcataaagtcaggaaatgacatagccaactgcctacggaaaaatgggaaacgtgtgatccagctctcccgcaaaacattcgacacggaatatcagaaaaccaaaaataacgactgggactacgtcgtcacaaccgatatctctgagatgggcgcgaactttcgagcagaccgggtgatcgatccgcgacgatgcctaaaacccgtaatactgaaagacgggccggaacgcgtgatactcgccggacctatgccagtcacggttgcttccgccgcccagcgcaggggcagaatcggaagaaaccataacaaagaaggggaccaatacatctacatgggccaaccactaaacaacgatgaagaccacgcgcactggacggaagcaaaaatgctcctggacaacataaatacgccggaggggatcataccggcacttttcgagccggaacgcgagaaatcggccgccatagacggtgaataccgattacgtggagaggcacgcaaaaccttcgtcgaattaatgcgcagaggagaccttcccgtctggctcagctataaagtagcatcagaaggcttccaatacagcgacaggcggtggtgcttcgacggcgagcgaaacaaccaggtcctggaagaaaacatggacgtcgagatatggacaaaggagggcgagaggaagaaactgcgaccaagatggctcgatgcacgcacatactctgacccactggccctaagggagttcaaggagtttgccgcgggccgacgcagcgtatctggagatctaatcttagaaataggtaagttaccacagcacctaactcaaagggcacaaaatgccctcgacaacctggtaatgctccacaactcagagcaaggagggcgcgcctatcgccacgccatggaggagctgccggataccatagagacacttatgcttctagccctcatcgcagtgctaactggaggggttactcttttcttcctcagcggtcgtgggttagggaaaacttccatcggactattatgcgtcatggcatcttccgtgttactctggatggcctccgtcgaaccacactggatagctgcaagcattatcctagagttcttcctaatggtcctcctaatccccgaaccagatcgacagagaacaccccaggacaaccagctcgcttacgtcgtcatcggtctactgttcatgatcctcacggtagctgcaaacgaaatgggcctactggaaactaccaagaaagatctcggaataggccacgctgcggttggaaaccaccatcacgcagccatgttggatgtagatttacacccagcttccgcgtggacgctatatgccgtcgcaaccacgataatcacacccatgatgcgccataccatagaaaacaccacagctaacattagcctaaccgccatcgcgaatcaagccgctatactaatggggttggacaagggctggccaataagcaagatggacataggtgtaccactactcgccctcggctgttactcgcaagtaaacccacttacgcttacggccgccgtcctgatgctcgtcgcacactacgccatcataggaccgggactccaagcaaaagcaacgcgggaggcgcagaaaagaacagcggcgggcatcatgaaaaacccaaccgtcgatgggattgtcgccattgatttagaccccgtggtctatgacgctaagttcgaaaaacaactgggccaaatcatgctgctcatactctgcacgtcacaaatactgctgatgcgaaccacatgggccctctgcgagtcgatcacccttgcaacaggccccctgacaaccttatgggaggggtcgcccggaaagttctggaatacaaccatagctgttagcatggcaaacatctttcgaggatcgtacctggcaggcgcaggtctggcattctcactcatgaaatcactcggagggggcaggaggggtaccggggcacaaggagaaactctcggagagaagtggaaaaggcaactcaaccagctaagcaaatcagagttcaacacatataagcggagtgggataatggaagtggaccggagcgaagcgaaggagggattaaaaagaggggaaactacgaagcacgcagtatcacgcggaacggctaaactaaggtggttcgtcgagcgcaaccttgtcaagccggagggcaaggttatagaccttgggtgtggacgaggcggctggtcatattattgtgccgggctgaagaaagtcaccgaagtaaaaggctatacaaaaggcggaccgggacatgaagaaccaatacccatggcaacgtacggctggaacctagtcaagctacacagtggaaaagatgtcttcttcatcccacccgagaaatgtgacaccctgctctgcgacatcggagaatcatcacctaatcccacgattgaagaaggccgaacactccgcgtactaaagatggtcgaaccctggctacggggaaaccagttttgcataaagatcctgaacccatatatgccaagcgtggtcgagaccttagaacagatgcagagaaaacacggtgggatgctggtcagaaaccccctatcacgaaacagcacccatgaaatgtactgggtatcgtgcgggactggaaacattgtcagcgcagtaaacatgaccagtcgaatgctcttaaaccgttttacaatggcccaccggaagcctacgtacgagcgcgacgtggacctcggggcaggcacacggcacgtggcagtggagccagaagtcgccaacctcgacatcatcgggcagcgcatagaaaatatcaagcacgaacataaatcaacgtggcactacgacgaggacaacccctataaaacctgggcctaccacggctcttatgaggtgaaaccctccgggtcagcttctagtatggtcaacggtgtcgtaaaactgttgacgaaaccgtgggatgtgatccctatggtaacccagatagcaatgaccgacaccactccatttggacaacaacgcgtattcaaagagaaagtggacacacgaacgccaaaggcgaagaggggcaccgcgcagatcatggaagtaacagcaaagtggctttgggggttcctatcgcggaataagaaaccgcggatatgtacaagagaggagttcactcgaaaagtgagatcaaacgccgcgataggggcagtctttgtcgacgaaaaccaatggaactccgcaaaagaggcagtggaggacgagcgattctgggacttagtacaccgggaacgagaactccacaaacaaggcaagtgcgccacctgtgtctacaacatgatgggcaaaagggagaagaaattgggtgagttcgggaaagccaagggatcccgagctatctggtacatgtggcttggtgcgagattcttagagttcgaagcattagggtttatgaacgaagaccactggttctccagagagaacagtctttccggagtcgaaggcgaaggcctacacaagctaggctacatacttcgcgacatctctaagattccaggtggcaatatgtacgcggacgacactgcgggatgggacacaagaatcacagaggatgacctccagaacgaagcccgaatcacagatatcatggaacctgaacacgcactgctcgcgaaaagcatatttaagttaacgtatcaaaacaaagtcgtacgagtccaacgcccagcgaaaaacggcaccgtaatggatgtaatttcacgcagagatcaaaggggcagcggacaggtcggtacgtatggactaaacacctttactaacatggaggcgcaactcatcagacaaatggagagcgagggcatatttagcccatcagaacttgagaccccaaacctcgcagagcgagtactagactggttggaaaaatatggggtcgaacgactgaagcggatggccatctcgggagacgactgcgtcgtgaagcccatagacgataggttcgcgactgcacttaccgcattgaacgacatgggcaaggtaagaaaggacattccacagtgggaacccagtaaaggctggaacgattggcaacaggtcccgttttgcagtcaccactttcatcaactcattatgaaagacggaagagaaattgtggtcccctgtaggaaccaagatgagctagtagggagagctcgcgtcagccaaggcgccggttggtcacttagagaaaccgcgtgtctcggaaaatcctatgcccaaatgtggcaactgatgtactttcaccggcgcgacctcaggttagccgcaaacgcaatttgttccgcagttcccgttgactggataccgaccagccgcaccacgtggagcatccacgcccaccaccaatggatgaccaccgaggacatgttatccgtatggaatagagtgtggatcgaagagaacccgtggatggaagacaaaacacacataagcagctggggcgacgtcccatacctggggaaacgcgaggaccagtggtgtggctcgttgatcggactgaccgcgcgggctacgtgggccaccaacatccaggtagctatcaaccaggtaaggcgcctcattgggaatgaaaactatctcgactacatgaccagcatgaaacgcttcaagaacgaaagcgatccagaaggcgccctatggtag

SEQ ID NO: 24425 - RNA, 9879 nt, synthetic construct
  misc_feature 1..9879: note = derived and/or modified CDS sequence (opt11) from DENV-1__GU131710__SS-prME
  source 1..9879: mol_type = other RNA
tctgtgacgatgctgctcatgttgatgcccaccgccttggccttccacctaacgacgcggggcggagagccccacatgattgcgagcaagcaggagcgcggcaagagcttgctgttcaagacgagcgccggggtcaatatgtgcaccttaatcgccatggacctgggtgagctgtgtgaggataccatgacctacaagtgccctcggatcaccgagaccgaacccgacgacgttgactgctggtgtaacgcgacggatacctgggtgacgtacgggacctgctcacagacgggcgagcaccggagagacaagaggtccgtggctcttgctccccacgtgggcctggggctggaaacccgcacagagacctggatgagcagcgagggcgcgtggaagcaaatccagcgcgtggagacgtgggccctccggcatccagggttcacggtcatcgccttattcctggctcatgccatcggcacctctattactcagaaggggatcattttcatcctcctgatgctggtgacgccatccatggccatgcggtgcgtgggcatcggcagcagggatttcgtagaggggctctccggggccacctgggtggacgtggtcctggagcatggaagctgcgtgaccaccatggccaaggacaagcccacgctggacattgagttactgaagaccgaggtgacgaaccctgccgtcctgcggaagctctgcatcgaggccaagatatcgaacaccacgaccgacagccgctgtccgacccaaggcgaagccaccctggttgaggagcaggacgccaatttcgtatgcagaaggacgttcgtagataggggttgggggaacggttgtgggcttttcggcaaggggtcgctcatcacctgtgcaaagttcaagtgtgtgaccaagctggagggcaagatcgtgcagtacgaaaaccttaagtatagcgtaattgtcaccgtgcacacgggggaccagcaccaggtcgggaacgagtccacagagcacggcacaaccgcgaccatcactccgcaagcccccaccactgagatccaattgaccgactacggggctctaacgctggactgttcaccccgtaccggtctcgacttcaacgaaatggtgctcctcacaatgaaggagaagtcctggctagtccataaacaatggttcctggatttgcccctcccctggacgtcaggggcctcaacgtcccaggagacctggaaccggcaggatttgttggttaccttcaagactgcccacgctaagaaacaggaagtggtcgtgctaggaagtcaggagggcgccatgcacaccgcccttacaggggccaccgaaatacagaccagtggcacgaccactatcttcgccgggcacctgaagtgccgcctcaagatggacaagttgacgttaaagggcatgagctacgtaatgtgcacagggtcctttaagttggagaaggaggtcgcagagacccagcacggaacggtgttagtgcagatcaagtacgaagggaccgatgccccctgcaaaatacccttctccacgcaggacgaaaaaggggtcacccagaacggacggttgatcaccgccaacccgatcgtgaccgacaaggagaaacccgtgaacatcgaggccgaaccacccttcggcgagtcctacatcgtcatcggagcgggtgaaaaagccctgaaactcagctggttcaaaaagggtagtagtatcggcaaaatgttcgaggcgactgcccgcggggcccggcgtatggctatccttggagacaccgcgtgggacttcggttcaatcggcggcgtgttcaccagcgtggggaaactggtccaccagatctttggcactgcctacggggtactgttttcaggcgttagctggacgatgaagataggcatcggcgtactgctgacctggctcggcctgaactctaggagcacctccctgagcatgacctgcatcgccgtggggctcatcaccctgtacttgggtgtcatggtgcaggccgactcggggtgcgtgatcaactggaaaggccgggagttaaagtgcgggagcggcatcttcgtgacgaacgaggtacacacgtggaccgagcagtacaagttccaggcggatagcccgaagcgcctgtccgccgcaattggaaaggcatgggaggagggggtctgcggtatccgaagcgccactcgcctggagaacataatgtggaaacagatctccaacgaactgaaccacatactgctggagaacgacatgaaattcacggtggtcgttggggacgtagctggcatcctcgcccaaggtaagaaaatgatccgtccccagcccatggagtacaagtattcgtggaaaagctggggcaaggccaagatcatcggggcagacgtccagaacacaaccttcatcatagatgggccgaatacacccgaatgcccagacgaccagcgcgcatggaatatctgggaggtggaggactacggttttgggatcttcaccaccaatatctggctaaagctgcgggactcctatacccaggtgtgtgaccaccgattgatgtcagccgcgatcaaggacagcaaagcggttcacgctgatatgggctactggatcgagagcgagaagaacgagacctggaagctggcgcgggcgagcttcatcgaggtgaaaacgtgcatctggcccaaatcccataccctgtggtccaacggcgttctcgagagcgagatgatcatccccaagatctacggcggaccgataagccagcataactaccgcccggggtacttcacccaggccgccggcccctggcacctggggaaacttgagcttgactttgacctgtgtgagggcactacggtggtagtcgatgagcactgtggcaaccgcggaccgtccctgcgcaccaccaccgttaccggtaaaatcatccacgagtggtgctgcaggagctgcaccctgccacccctacgcttccgcggggaggacggctgctggtatggtatggaaatccgccccgtgaaagagaaggaggagaatcttgtgaagtctatggtgtctgcggggagcggggaggtagactcgttcagcctcgggctgctgtgcatctccatcatgatagaggaagtgatgcggagtcgctggtcccgccggatgctcatgaccggaaccctggcggtcttcttccttctgatcatgggacagctgacgtggaatgacctgatcagactgtgcatcatggtgggagccaacgcgagcgaccggatggggatgggcacaacctacctggccctgatggccaccttcaagatgcgcccgatgttcgcggtcggactcctgttccgtcgcctaacgtccagggaggtcctcctgctgacgattgggctcagtctagtagcgtccgtggagttgcccaacagcctcgaggagctgggagacggcctggcaatgggcatcatgatcctgaaacttctgacggacttccagtcccaccagctctgggctaccttactgtcgctcacgtttatcaagaccacattctccctgcactatgcctggaaaaccatggcgatggtgctgagcatcgtgtccctcttccctctgtgtctgagcacgacctcccagaaaaccacgtggctccccgtactgcttggcagcctcggatgcaagcctctgacgatgttcctgatagcagaaaacaagatctggggtcgacggtcctggccccttaatgaggggatcatggcggtaggcatagtgagcatcctgttgtcgtccctcctcaagaatgacgtccctctggcagggcctctaatcgcgggcggcatgttaattgcctgctacgtgattagcgggtccagcgccgatctgtcattggagaaagccgccgaggtttcttgggaggaggaggcggagcactccggcgccagccacaacatcctggtcgaggtccaggatgacgggacaatgaagatcaaggacgaagaacgcgatgataccctgactatcctcttaaaggccaccttacttgccgtatcgggcgtctacccgttatcgatcccagccacgctgtttgtctggtacttctggcagcggaagaagcagcgctctggggtgctctgggacacccccagtccgcccgaggtcgagagagcggtgctggacgacggcatataccgcatcatgcagcggggcctgctcgggcgcagtcaggtgggcgtcggggtgttccaggagaacgtgtttcacacaatgtggcacgtgacccggggcgccgtgctcatgtaccagggaaagcgcctggagcccagctgggcgtccgtgaagaaagacctcatcagctacggcggagggtggcggcttcagggttcctggaacacgggggaggaagtacaggtgatcgccgttgagcccggcaagaatcccaaaaacgtccagaccgcccccgggacctttaaaacgccggagggggaggtaggggcgatcgccctggacttcaagccggggacgtctggctcccccatcgtaaaccgcgaagggaaaatcgtaggtctctacggcaacggtgtggtgaccaccagcggcacctacgtcagcgctatcgcccaggcgaaagcatcacaggaggggccgctccccgagatcgaggacgaggtattcaggaaaaggaatctgacgatcatggatctgcaccccggatcggggaagacgagacggtacctcccggccatcgttcgagaagccataaaacgcaagttacgcaccctgatcctcgcacccacccgggtagttgcgtccgagatggccgaggccctgaagggcatgccaatacgctaccagacaaccgctgtcaagagtgagcataccggtaaagagatcgtcgacctgatgtgtcacgccacctttacgatgagactcttgtcccccgtgcgggttccgaattataacatgattatcatggacgaggcgcacttcacagacccgtcatcaatcgccgcccgggggtacatcagcacccgcgttgggatgggggaggccgccgcgatcttcatgaccgcgacgccgcccggctcggtggaggccttcccgcagagcaacgctgtgatccaggacgaggaacgagacatccccgagcgctcctggaactccgggtacgagtggataaccgacttccccggcaagaccgtctggttcgtgccatccatcaagagcggcaacgacatcgcgaactgtctgcggaagaacggaaagagggtgatccaactctcgcggaagaccttcgacacagagtaccagaagactaagaacaacgattgggactatgtcgtgaccacagacatcagcgagatgggcgcgaacttccgcgccgatcgggtgattgacccgcgcagatgcctcaagcccgtcatcctgaaggacgggccagagcgcgtaatcttagcagggccaatgccggtgacagttgcctccgcggcccaacggcgagggcgcatcggcagaaaccataataaggagggcgaccagtacatctacatgggtcagccgcttaacaacgatgaggaccacgcccactggaccgaggccaaaatgctgctcgataacattaacacccccgagggcataatacccgccctattcgagccggagcgcgagaagtcggccgccatcgatggcgaatacagattgcgcggggaggcccggaagacgttcgttgaactcatgagacgcggggacctcccagtctggctgtcctacaaggtggcgagcgagggcttccagtatagcgacaggagatggtgcttcgacggcgagcgcaacaaccaggtgttggaggagaacatggacgtcgagatctggacgaaggaaggggagcggaagaagctgcgaccccggtggctggacgcccgaacctattccgaccctctcgcgttacgggagttcaaggagttcgccgccggccgccggagcgtgtccggggacctgatcctcgaaatcggcaaacttccgcaacacctgacacagagggctcaaaacgccctcgacaacctcgttatgctgcataactccgaacagggcgggcgggcgtaccgacacgccatggaggagctccctgacactatcgaaacgctgatgctgttagccctgatcgccgtcctcaccgggggagtaacccttttcttcctgtccggccgcgggctgggtaagaccagcattggtctcctgtgcgttatggcctccagcgtcctgctctggatggcctccgtggagcctcattggattgctgcctcgattattctggagttcttcctgatggtgctattgatacccgagccggaccgccaacgcacgccccaggacaatcaactggcatatgttgtcatcgggctcttattcatgatcttgactgtagctgccaacgagatgggcctgctggagaccaccaagaaggacctgggaataggccacgtcgccgtggagaaccaccaccacgccgcgatgctcgacgtcgaccttcacccggcgtccgcctggacactctacgccgtcgctacgaccatcatcacaccgatgatgcgacacaccatcgagaatacgaccgctaatatcagcctcaccgcgatcgccaatcaggccgcaatcctgatggggttagacaagggttggccaatctccaagatggacataggcgtgcccctcctggcgctcgggtgctacagccaggtgaaccccctcaccctgacagccgcagtcttaatgctcgtggcccactacgccattatcgggccaggcctgcaggccaaggcaacccgcgaggcacaaaagcggaccgccgcgggcattatgaaaaaccccactgtggacgggatcgtcgcgatcgatctcgacccagtggtgtatgacgccaaattcgagaaacagctcggccagattatgctgctgatactgtgtacgagccagatactcctgatgcggaccacctgggccctttgcgagtcaatcaccttggccaccggccccctgacgaccttatgggaagggtccccgggcaagttctggaataccacgatcgccgtatccatggcgaacatattccgggggtcctatcttgcaggcgcgggcctagccttcagtctcatgaagtccctcgggggcgggcgtaggggtaccggagcgcagggcgagaccctgggcgaaaagtggaaaagacagttaaaccaactaagcaagagcgagttcaacacatacaaacggtctggtatcatggaggtggaccgctctgaggccaaggagggcctgaaacgcggggagaccacaaagcacgcggtatcccggggcaccgccaagctcaggtggtttgtcgaaagaaacctggtgaagcccgagggcaaggtgatcgacctgggctgcggcagaggaggctggtcgtactactgcgccgggttgaagaaagtgaccgaggtgaaaggctacacgaagggagggcccggccacgaggaacccatcccgatggcgacctacgggtggaatttggtgaagttgcacagtggcaaggacgtcttcttcataccgcccgagaagtgcgacacactgctctgcgacattggggagagctcccccaacccgaccattgaggaaggcaggactctgcgggtattgaaaatggtggagccctggctgcgagggaatcagttctgcatcaaaatcttgaacccctatatgcccagcgtcgtggagactctagagcagatgcagaggaagcacggcggcatgctggtgaggaacccgctgtccagaaactccacccacgagatgtactgggtaagctgcgggaccggcaacatcgtgagtgcagtaaacatgacctccaggatgttgcttaacagattcacgatggcccatcgtaagcccacgtacgagagggacgtggacctgggtgccggcacccggcacgtggccgtggagcccgaagtggccaacctggacatcatcggccaacgtatcgagaacataaagcacgagcacaagagcacctggcactacgacgaggacaacccctataagacctgggcctaccacgggtcctacgaagtgaagccttctggctcggctagcagcatggtgaatggagttgtgaagctcctgacaaaaccctgggacgtcatcccgatggtgacccaaattgctatgacggatacgaccccgtttggccagcaacgggtgttcaaggagaaagtcgacacacgcactccgaaggccaagcggggcacggcgcaaataatggaggtgaccgccaaatggctatggggcttcctctctaggaacaagaagccacggatttgcacgcgcgaggagttcacgcggaaggtgaggagcaacgccgccataggtgcggtgttcgtggatgaaaaccagtggaactctgctaaggaggccgtggaagatgaacgcttctgggacctggtccacagagagagagagttgcacaagcaggggaagtgtgctacgtgcgtgtataacatgatgggcaagcgggagaagaagttgggcgagttcggcaaggctaaaggcagccgggctatctggtacatgtggctgggcgcccgtttcctggagttcgaagccctcggctttatgaacgaagaccattggttctcccgggagaactccttgtcaggagtggagggagaggggctccacaagttagggtacattctacgcgacatcagcaaaatccccggcggcaacatgtacgcggatgataccgccggctgggacacgcgcatcaccgaggacgaccttcaaaacgaggcaagaatcacagatatcatggagccggagcacgccctcctggccaagtccatcttcaagctgacgtatcagaacaaggtcgttcgcgtgcagcggcccgccaaaaacggtaccgtgatggacgtgatcagtcgccgggaccagcgcggctcgggccaggtggggacgtacggcctcaacacctttaccaacatggaggctcagctgatccggcagatggaaagcgaggggatattctcccccagcgaattagaaacacccaacttagccgaacgagtgctggactggctggagaagtacggcgtagaacggctaaagcgcatggccatatccggggacgactgtgtggtcaagccgatagacgaccgcttcgccactgccctgacggccttgaacgacatgggaaaggtgcgcaaggatattccccagtgggaacccagcaagggatggaacgattggcagcaggttcccttctgctcccaccacttccaccagttgatcatgaaggacggcagggagatcgtcgtgccctgccgcaatcaggacgagctagtgggccgcgcgcgcgtaagccagggggccggctggtcgttgcgggaaacagcttgcctcgggaagtcttacgcgcagatgtggcagctaatgtacttccaccgccgggatctgcgcctagcggcaaacgccatctgtagcgccgtaccagtggactggatccccacgtcccgcaccacgtggagcatccacgcccaccaccagtggatgaccaccgaggacatgttatcggtctggaacagagtatggatcgaggagaacccttggatggaggacaaaacccacataagctcctggggtgacgtcccgtatctggggaagcgcgaagaccagtggtgtggctcactcatcggcctgactgcgcgggccacctgggccactaacatccaagtcgccatcaaccaggtgcgacggcttatcgggaacgagaactatctcgactatatgacttccatgaagcggttcaagaacgagagcgaccccgagggcgccctgtggtaa

SEQ ID NO: 24426 - RNA, 9879 nt, synthetic construct
  misc_feature 1..9879: note = derived and/or modified CDS sequence (opt11) from DENV-1__GU131717__SS-prME
  source 1..9879: mol_type = other RNA
agcgtcaccatgctgctcatgctaatgcccacggccctggccttccacctcaccacacgggggggggaaccccacatgatcgtcagcaagcaggagcggggcaagagccttctgttcaagacatccgcgggggtgaacatgtgcaccttaatcgctatggacctgggcgagttctgcgaggacacaatgacctacaagtgcccccgcatcaccgaggccgagcccgacgacgtggactgctggtgcaacgccacagacacgtgggtcacctacggaacctgcagccagactggagagcaccggcgggacaaacggtccgtggccctggcgccccacgttggcctcggactggagacgcgcaccgagacctggatgagctccgagggtgcgtggaagcagattcagcgggttgagacctgggccctgcgccaccccgggttcacggtgatcgccctcttcctggcgcacgcaatcggcaccagcatcacccagaagggaatcatctttatcctgttgatgctggtgaccccctcgatggcgatgcggtgcgtcggcatcggcagccgagacttcgtggaggggctgtccggcgcaacgtgggtggacgtcgtgctcgagcacgggagctgtgtgaccaccatggccaaggacaagcccaccctggacatcgagctgctcaagacggaggtcaccgaccccgctgttctgcggaagttatgcatagaggccaaaatctccaacaccaccacagacagccgctgcccaacccagggcgaggccaccctcgtggaggaacaggacgccaatttcgtctgccggcgcaccttcgtggaccggggctggggaaacggatgcggcctgttcggaaaagggtccctgatgacgtgcgccaagttcaagtgcgtgaccaagctcgagggcaaaatcgttcagtacgagaacctgaagtactctgtgatcgtgaccgtccacacaggcgaccagcaccaggtagggaacgagtccacggagcacggcacgaccgcgaccatcaccccacaagcccccagcacggagatccagctgactgactacggggccctgaccctagactgcagcccccggaccggcctggacttcaacgagatggtcctgctgacgatgaaggagaagtcctggctagtccacaaacagtggtttctcgacctgcccctgccctggaccagcggtgcctccaccagccaggagacatggaaccggaaggatctcctggttaccttcaaaaccgcccatgctaagaagcaggaggtcgtcgtgctgggctcgcaggagggtgccatgcacaccgccctcacgggggccacggagatccagaccagtggtaccaccacgatcttcgctgggcacctgaagtgccgcctgaagatggataagctcaccctgaagggaatgtcctatgtcatgtgcaccgggagcttcaagctggagaaggaggttgccgagacccagcacggcacggtgctcgtccagatcaagtacgagggcaccgacgccccctgcaaaatcccctttagcacccaggacgagaagggggtgacccagaacggccggctgatcacggccaatcctatcgtgaccgacaaggagaagcccgtaaatatcgaggccgagccccccttcggagagagctacatcgtgatcggcgccggtgagaagaccctgaagctgtcctggttcaagaaggggagctccatcggcaagatgttcgaggccaccgcccgcggggcccggcgcatggcgatcctcggtgacacggcgtgggacttcgggagcatcggcggcgtgttcacctccgtggggaagctcgttcaccagatattcggcaccgcctacggggtgttgttcagcggggtctcctggaccatgaagatcgggatcggcgtgctgctaacgtggttgggcctcaacagccggtccaccagcctgtccatgacctgcatcgccgtcgggctggtcaccctctacctgggcgtgatggtgcaggccgacagcggttgcgtgatcaactggaagggccgggagcttaaatgcgggagcggcatcttcgtgacaaacgaagtgcacacctggacggagcagtacaagtttcaggccgacagcccgaagagactcagcgcggccataggaaaggcctgggaggagggggtctgcggcatccggtccgccacccgcctggagaacatcatgtggaagcagatcagcaacgagctgaatcacatcttgctggagaacgacatgaagttcaccgtggtggtcggggacgtggccggcatcctggcgcagggtaagaagatgatccggccccagcccatggagtacaagtactcatggaaaagttggggcaaggccaagattatcggagccgacgttcagaacaccaccttcatcatcgacgggcccaacaccccggagtgtcctgacgaccagcgcgcatggaacatatgggaggtcgaggattacggcttcgggatcttcaccactaacatctggcttaagctgcgggactcctacacccaggtttgcgaccaccgcctgatgagcgcggccatcaaggactctaaagccgtgcacgccgatatgggctactggatcgagagcgagaagaacgagacctggaagctcgcacgggcgtccttcatagaggttaagacctgcatctggcccaagtcacacacgctgtggtccaacggcgtgctagagagcgagatgatcatccccaagatctatggggggccgatctcccagcacaactaccgccccgggtacttcacccagaccgccggcccctggcacttagggaagctggagctggacttcgacctctgcgagggcaccacggtggtcgtagatgagcactgcggcaaccgggggccgagcctgcgcaccaccaccgtgaccggcaaaatcatacacgagtggtgctgcagatcctgcactctgccgcccctgcgcttcaaaggggaggatggctgttggtacgggatggaaatccggcctgtcaaggagaaggaagagaacctggtcaaaagcatggtgagcgccggctccggcgaggtagacagctttagtctggggctcctgtgtatcagcatcatgatcgaggaggtgatgcgctccagatggagccgcaagatgttgatgacaggcaccctcgccgtgttcttcctgctgatcatggggcagctcacgtggaacgacctgatccggctgtgcatcatggtcggcgccaacgcgtccgaccgcatgggaatgggcaccacctacctcgccctgatggccaccttcaagatgcgcccgatgttcgccgtggggctattattccggcgcctaacgagccgggaggtcctgctcctgaccatcgggctgtccctcgtagcctccgtggagctgcccaactccctggaggagctcggcgacgggctggctatgggcatcatgatcctgaagctactgacagacttccagtcacaccagctgtgggccaccctcctatccctgacgttcattaagaccaccttcagcctccactacgcatggaagaccatggccatggtcctgagtatcgtcagcctgttccccctctgcttatccactacctcgcagaagaccacctggctgcccgtgctcctgggctccctgggctgtaagcccctcacaatgttcctaatcgcggagaacaagatctggggccgcaagtcctggcccttaaacgaggggatcatggccgtaggcatcgtaagcattttattgtcggcgctgctcaagaacgacgtgcccctggctgggcctctgatcgccggcggcatgctcatcgcgtgctatgtcatcagcgggtccagcgcggatctgtccctggagaaggccgccgaggtgagctgggaggaggaggccgaacactccggcgcgagccacaacatcctcgtggaggtccaggatgatggcaccatgaagatcaaggatgaagagcgggacgacacgctgacaatcctgctcaaagccaccctgctcgccgtcagcggcgtgtaccccctcagcatccctgccacgctgttcgtctggtatttctggcaaaagaagaagcagcgctccggggtgctgtgggacacccccagcccgcccgaggttgagcgagccgtcctcgacgacggcatctaccgcatcatgcaacggggtctgctggggcgctcccaggtgggcgtgggggtcttccaggagaacgtgttccacaccatgtggcatgtaacccggggcgcggtcctgatgcaccagggcaagcgcctcgaacccagctgggcctccgtgaaaaaggacctgatcagctacggtggcgggtggcgactgcagggttcatggaacacgggggaagaagtacaggtaatagccgtggagcccgggaagaacccgaagaacgtgcagaccgcccccgggacgttcaagaccagcgagggcgaggtcggcgccatcgcgctcgacttcaaacccgggacgtccggcagtcctatcgtcaaccgcgaggggaagatcgtgggcctgtacgggaatggggtcgtgaccacaagcggcacttacgtgagcgcgatcgctcaggccaaggcgagccaggaggggcccctgccggagatcgaggacgaggtctttcgcaagcgcaatctcaccatcatggacctgcatcccggttcagggaagacacggcgctacctgcccgccatcgtgagagaggccatcaaacgcaagctccggaccctgatcctggccccgacgcgcgtggtagccagcgagatggcggaggccctcaaaggtatgcccatccgctaccagacgaccgccgtgaagagtgaacataccggcaaggagatcgtggacctgatgtgccacgccacctttaccatgcggctgctcagccccgttcgcgtgcccaactacaacatgattatcatggacgaagcccacttcactgacccgagcagcatcgcggcccgggggtacatctccactcgcgtgggcatgggggaagccgccgccatcttcatgaccgcgacgccgcccggcagcgttgaagccttcccccagagtaacgccgtgatccaagacgaggagagagacatcccggagcggagctggaactccgggtacgagtggatcaccgacttccctggtaagaccgtgtggttcgtgcccagtatcaagtccggcaacgacatcgccaactgcctgcggaagaacgggaagagagttatccagctgagccggaagaccttcgacacggagtaccagaaaaccaagaacaatgactgggactacgtggtcacgaccgacatctccgagatgggcgccaacttccgcgccgaccgggtcatagacccccgccgatgcctcaagccggtgatcctgaaggacgggcccgagcgcgtcatcctggctggccccatgcccgtgacggtcgccagcgctgcgcagcggcgcgggcggatcggccgcaaccacaacaaggagggcgaccagtacatttacatgggtcagccgctcaacaacgacgaggaccacgcccactggaccgaagctaaaatgctactggacaacatcaacacccccgagggcataatccccgcgctcttcgagcccgagcgggagaagagcgcggcgatcgacggggagtaccgcctacgcggagaagcgaggaagaccttcgtggagctgatgcgacgcggggacttacctgtgtggctaagctacaaggttgcgtcggagggtttccagtattccgatcgccggtggtgcttcgacggcgagcgcaacaaccaggttctggaagaaaacatggacgtggagatatggacgaaggagggggagcgcaagaagctccgcccccggtggttagatgcccgcacctatagcgaccccttggcgttgcgggagttcaaagaattcgcggcaggccgacggtctgtcagcggggacctgatcctggagatcgggaagctcccccagcacctgacccagcgcgcccagaacgccctggacaacctagtgatgctccataattccgagcagggcgggcgggcataccgccacgccatggaggagcttccggacaccatcgagaccctcatgctgctagccctcatagccgttctgaccggcggggtcaccctgttcttcctaagcggccgggggctgggcaagacctctatcggattactctgcgtgatggcctcatccgtgctactctggatggcgtccgtcgaaccccactggatagccgcctccatcatactagagttcttcctgatggtactgctcattcccgagccggaccgccagcggaccccgcaggacaatcagctggcatatgtagtcatcgggctcctctttatgatcctgacggtggccgcaaacgagatgggcctgctcgagaccaccaagaaggacctggggatcggccacgtcgccgtcgaaaatcaccaccacgccgctatgttagacgtggacctccaccccgcctcggcgtggaccctgtacgccgtggccacgaccataatcacccccatgatgcgccacaccatagagaatacgaccgccaacatctccctgaccgctatcgcgaaccaggccgccatcctcatggggctggacaagggctggccgataagcaagatggacatcggcgtacccctgctcgcgctgggctgttactcccaagtgaaccccctgaccttgacggcggccgtgctgatgcttgtcgcacactacgccatcatcggacccgggctccaggccaaggcaacccgggaggcccagaagcgcaccgcagccggcatcatgaagaacccgaccgtggacgggatcgtggccatcgatctggaccccgtcgtgtacgacgcgaagttcgagaagcagctaggccagatcatgctcctgatcctgtgcacgagccagatactcctgatgaggaccacctgggccctgtgtgagtccataaccctcgccacgggcccgctgaccaccctgtgggaggggtcacccggcaaattctggaacaccacgatcgctgtgtccatggccaacatcttccgagggagctatctcgcgggcgccgggctggccttctctctgatgaagtcccttgggggcgggcgccggggcaccggcgcgcagggcgagaccctgggcgagaagtggaaacgccagctgaatcagctaagcaaatccgagttcaacacctacaagcgatctggcatcatggaggtagatagatcagaggcgaaggagggactgaagcggggggagacaaccaagcacgccgtgtcccgcggtaccgccaaactgcggtggttcgtagaacgcaacctagtcaagccggaggggaaggtgattgatctcggctgcggccgcggcgggtggtcctactactgcgccgggctgaagaaggtgaccgaggtcaaggggtacacaaagggcgggcccggacacgaggagcccattcccatggccacctacgggtggaacctggtgaagctccacagcggcaaggatgttttcttcatcccgcccgagaagtgcgacaccctgctgtgcgacatcggggagtctagccccaaccccaccatcgaggagggccgtacgttacgggtcctgaagatggtagagccgtggctacgcgggaatcaattttgcataaagatcctcaatccctacatgccatccgtggtggagaccctggagcagatgcagcgcaagcacgggggaatgttggtgcgcaaccccctcagccggaactccacccacgagatgtactgggttagctgtgggaccggcaacatcgtctccgcggtgaacatgactagccgcatgcttcttaaccggttcaccatggcccaccgaaagccgacctacgagcgcgacgttgacctcggggccggcactcggcacgtcgccgtggagcccgaagtggcgaacctcgacatcatcggtcagcgcatcgagaacataaagcacgagcacaagtccacctggcactatgacgaggataatccctacaagacgtgggcgtaccacgggagctacgaggtcaagccatccggcagcgccagctccatggtgaacggggtcgtgaagcttctcaccaagccgtgggacgttatccctatggtcacccagatcgctatgaccgacacgaccccctttggccaacagcgggtcttcaaggaaaaggtggacacccgcacccccaaggccaagcggggtactgcccagatcatggaggtcaccgcgaagtggctctggggcttcctaagccgaaacaagaagccgcgcatctgcaccagggaggagttcacccggaaggtgcgctccaacgccgcgatcggcgccgtgttcgtcgacgagaaccagtggaacagcgcgaaggaggctgtggaggacgagaggttctgggacctcgtgcaccgcgagagggagcttcacaagcaagggaagtgcgccacgtgcgtctacaacatgatgggcaagcgcgagaagaagctgggtgagttcggcaaggccaaaggatcccgggccatctggtacatgtggctcggcgcgcgctttctggagttcgaggcgctgggctttatgaacgaggaccattggtttagtcgggaaaactccctgagcggggtggagggcgaaggcctgcacaagctgggctatatcctccgcgacatttccaagatccccggggggaacatgtatgccgacgacaccgccggctgggacacccgcatcaccgaggacgaccttcagaacgaggccaagatcacggatattatggagcccgagcacgcgctcttggctaagagcatcttcaagctgacctaccaaaacaaggtggtccgcgtgcagcggccggccaagaacgggaccgtgatggacgtcatctcccgcagggaccagcggggcagcggtcaggtcggcacctacggcctgaatacgttcaccaatatggaggcccagctcatacgccagatggagtccgagggaatctttagcccctccgagctggagacccccaacctggccggccgggtgctcgactggctggagaagcacggggtcgagcgcctgaagcggatggcgatcagcggcgacgactgcgtggtgaagcccatcgacgaccgcttcgccgccgccctcaccgccctgaatgacatgggcaaggtgaggaaggacatacctcagtgggagccgtccaagggctggaacgactggcagcaggtacccttctgcagccaccatttccaccagctgataatgaaggacggccgcgagatcgtggtcccttgccggaaccaggacgagctagtggggcgcgcgcgggtgagccagggcgccgggtggtccctgcgcgagacggcctgccttggcaagagctacgcccagatgtggcaactcatgtacttccaccggcgcgaccttaggctggcggctaacgcaatctgctccgcggtcccggtagactgggtgcccacctcgcgcaccacctggtcgatccacgcccaccatcagtggatgacgaccgaggacatgctgagcgtctggaaccgggtgtggatcgaggagaacccctggatggaggacaagacccacatcagcagctggggcgacgtgccctacctgggcaagcgcgaggaccagtggtgtggttccctgatcgggctcaccgcgcgtgccacgtgggctaccaacatccaggtagcgatcaaccaggtgcgccgcctgatcggcaacgagaactacctggactacatgaccagcatgaagcggttcaagaacgagagcgacccggagggggccctctggtag

SEQ ID NO: 24427 - RNA, 9879 nt, synthetic construct
  misc_feature 1..9879: note = derived and/or modified CDS sequence (opt11) from DENV-1__GU131718__SS-prME
  source 1..9879: mol_type = other RNA
agtgtgaccatgctgctcatgctgatgcccacagccctggcattccatctcaccacccggggcggagagccccacatgatcgtgacaaagcaggagagaggcaagtccctgctgttcaagacctctgccggggtgaacatgtgcactctcatcgccatggatttaggcgagctgtgtgaggacaccatgacctacaaatgccctcgtatcactgaagctgagcccgacgacgtagactgctggtgcaatgccacggacacttgggtaacatacgggacctgtagccagaccggggaacaccggcgcgacaagcggagcgtagccctcgcgccgcacgtcggcttagggctcgagacccgcaccgaaacctggatgtccagcgagggcgcgtggaagcagatccagcgggtcgagacctgggccttacgccaccccgggttcacggtgatcgccctttttttggcgcacgccattggcacctccatcacccaaaagggtatcatcttcatcctactgatgttagtaactcccagcatggctatgcggtgtgtcggcatcggatcccgagacttcgttgagggtctcagcggcgccacctgggtggacgtagtgctggagcatgggtcctgcgtgacaaccatggccaaggataagcctacgctagacatagaactcctgaagaccgaggttaccaaccccgcggtgctgaggaagttatgcatcgaggccaagattagtaacaccacgaccgattcccgctgccccacccagggcgaggccacactgatggaagagcaggacgccaattttgtgtgcaggcgcacgttcgtcgaccggggctgggggaatgggtgcgggcttttcggcaagggtagcctcataacgtgcgccaagttcaaatgcgtgactaagttagagggcaagatcgtgcagtacgaaaaccttaagtactccgtcatcgtgaccgtgcatacaggcgaccagcaccaagttgggaacgagagcatcgagcacgggaccaccgcaacaatcacgcctcaggcccccacgtccgaaatccagctcaccgactacggggccttaaccctggattgcagcccccgcactggattggatttcaacgagatggtgctgctgacaatgaaggagaagtcctggctcgtgcataagcagtggtttctggacttaccactcccgtggaccagcggggcgagcactagtcaggaaacctggaaccggcaggacctgctggtgacgttcaagaccgcccacgcgaagaagcaggaggtagtggtgctcgggagccaggagggtgccatgcataccgctctcaccggggccacggaaatccagacctccggcaccaccacgattttcgccgggcacctgaaatgccgcctcaagatggacaagctgaccctgaagggtatgagctacgtgatgtgtaccgggtccttcaagctcgaaaaagaggtcgcggagacccaacacggaacggtcctggtccagattaaatatgagggcaccgacgccccctgcaagatccccttcagcacccaggacgagaagggtgttacccagaacgggcggttgatcacggccaatccgatcgtgatcgacaaggagaagcccgtgaatatagaagcggagccgcctttcggggagtcctatatagtcatcggcgcgggcgagaaagccctgaagctcagctggtttaagaaggggtcgagcattggcaagatgttcgaggccaccgcgcgcggggcccggagaatggcaattctgggcgacaccgcgtgggacttcgggtccattggcggtgtgttcacgtcgatcgggaagctggtgcaccagatctttggcacggcatacggggtcctcttctctggtgtaagctggactatgaagatcgggattggcgtcctgctgacctggctcggtctgaactcccgcagcacttccctgtcgatgacgtgcatcgctgtcggcctcgtgaccctgtatctgggcgttatggtccaggccgattcaggttgcgtgatcaattggaagggtcgggagctgaagtgcggcagcggcatctttgtcaccaatgaggtccacacctggacggagcagtacaagttccaggctgactcccctaagcgcctgtccgccgcgatagggaaggcctgggaggagggggtatgcgggatccgcagcgcgacccgtctggagaatatcatgtggaagcagatctccaacgagcttaaccacatccttctggaaaacgacatgaagttcaccgtggtcgtgggagacgtggtcggcatcctcgcgcagggaaagaagatgatccggccacagcccatggagcacaagtacagctggaagtcttggggcaaggccaagatcatcggcgccgacgtgcaaaacacaacctttattatcgatgggcccaacaccccggagtgccccgacgaccagcgcgcctggaacatctgggaggtggaagactatggtttcggtatctttactaccaacatctggttaaagatgcgggacagctatacccaagtctgcgaccaccggctcatgtccgcggcgatcaaggactcaaaggccgttcacgccgacatggggtactggattgagtcggagaagaacgagacgtggaagctcgcccgggcgtcgttcatcgaggtcaaaacctgcatctggcccaagtcccacaccctgtggagcaacggtgtcctagagagcgaaatgataatcccaaagatctacgggggcccaatcagccaacacaactatcgcccgggctacttcactcaaactgccggcccgtggcacctagggaagctggagctggacttcgacctctgcgagggcaccaccgtggtcgtcgacgaacactgcggtaaccgggggccgtccctgcgcaccacaaccgtgaccgggaagataatccacgaatggtgctgccggagctgcacgttaccgcccctgcgcttcaagggggaggacggttgctggtacgggatggagatccggcccgtgaaagagaaggaggagaacttggtcaagtccatggtcagcgccggtagtggcgaggtcgattccttcagcctggggctcctgtgcatctcaattatgattgaagaggtgatgcgtagcagatggtcccggaagatgctgatgacggggaccctggctgttttcctgttactcatcatggggcaactgacctggaacgacctgatccggctctgcattatggttggcgccaatgcgagcgatcgcatggggatgggcaccacgtacctcgcactgatggctaccttcaagatgcgcccaatgtttgccgttgggctccttttccggcgcctgacctcccgcgaggtgctcttgttaaccattgggctcagcctggtagcctccgttgagctgcccaacagcctcgaggagctgggagatgggctcgcaatggggattatgatcctcaagctgctgacggacttccagtcacaccagctctgggctaccttactgagccttactttcatcaagaccaccctatctcttcactacgcatggaagaccatggccatggtgcttagcatcgtcagtctgattcccctgtgcctcagcaccacctcgcaaaagacaacgtggctccccgtgctgctaggaagccttgggtgcaagcctctgaccatgttcctcatcgcggaaaacaaaatctggggccgcaaatcctggcccctgaacgagggcatcatggctgtgggcgtcgtgagcatcctgcttagcagtctgctgaagaacgacgtgcccctcgccgggcccctgatcgccggcggcatgctgatcgcctgctacgtcatcagcgggtccagcgcggacctctcccttgagaaggccgccgaggtgagctgggaggaggaggccgagcactccggggccagccacaatatcctggtggaggtccaggatgatgggacgatgaagattaaggacgaggagcgggatgatacgttaactatcttactgaaggcgaccctcctggccgtgtccggcgtatacccgttgagcatccccgccaccctcttcgtctggtacttctggcagaagaaaaaacaacgctccggagtgctatgggacaccccctcgccgcctgaggtggagcgggcagtcttagacgacggaatttaccgcatcatgcagaggggcctcttggggcgttcacaggtgggcgtgggggtattccaggaaaacgtgttccacacgatgtggcacgtgacccggggcgccgtgctgatgtatcagggtaagcgcctagagcccagctgggcgagcgtgaagaaggacctcatcagctacggcggagggtggcggctgcagggctcatggaacaccggagaggaggtgcaagtcatcgccgtggaacccgggaagaatcctaagaacgtgcaaaccgccccgggtacgttcaagacgcccgagggtgaggttggtgccatcgccctggattttaagcccgggaccagcggcagccccatcgtgaacagggagggaaagatcgtgggcctctacggcaatggggtagtcaccacttctgggacttacgtgagcgcgatcgcccaggccaaagcatcccaggaggggccgcttcccgagatcgaggacgaggtcttccggaaacgcaacctgaccatcatggacctccacccgggcagcggcaagacacgtcgctatctgccagcgatcgtacgggaggccatcaagcgcaagctacgaacgctcatcctggcaccaacccgggtcgtcgcgtccgagatggctgaggcgctgaagggcatgccaatccgataccagaccacggccgtcaagagcgagcacacgggtaaggagatcgtggacctcatgtgccacgccaccttcacaatgcggttattatcacccgtccgcgtgccgaactacaacatgataatcatggacgaagcccattttaccgatcccagctccattgccgcgcgggggtacatctccactcgcgtaggcatgggggaagccgctgccatcttcatgaccgccacgccacccggctccgtggaagccttcccgcaatctaacgccgttatccaagacgaggaacgggacatccccgaacgctcctggaacagcgggtacgagtggatcaccgacttccccggcaagacggtgtggtttgtcccctccatcaagagcggtaacgacattgcaaactgcttgcgaaagaacgggaagcgcgtcatccagctatcccggaagaccttcgacactgagtaccaaaagaccaagaacaacgactgggactacgtggtcacgaccgatatcagcgagatgggcgccaacttccgagcagacagagtgattgatccgcgccggtgcctgaaacccgttatcctcaaagacgggcccgagcgcgtaatcctggctggcccaatgcccgtgaccgtagcctcggccgcccagcggcgtgggcggattggtcgcaaccataataaggaaggagaccagtatatctacatgggccagcccctgaacaatgacgaggaccacgctcactggaccgaggccaagatgctcctggacaatatcaacacgcccgagggcatcatccccgctctgttcgagccagagagggagaagtcggccgccattgacggggaataccgcctcaggggcgaggcgcgaaaaaccttcgtggagctgatgcgccgcggagacttacccgtctggctttcctacaaggtcgcttccgagggcttccagtactctgacaggcggtggtgctttgacggggaaaggaacaaccaggtgctagaggagaacatggacgtggagatctggaccaaggagggggagcggaagaagctgcgccccagatggttagacgctcgcacatactccgatcccctggctcttcgggagttcaaggaattcgcagcgggccggcggagcgtcagtggagacctcatcttggagatcggtaagctgcctcaacatttaacgcaacgagcgcaaaacgccttggataacctggtgatgttacacaactcggagcagggcggccgggcataccgccacgcgatggaggagctgcccgacaccatcgagaccctgatgctgctggccctgatagccgttttaaccggcggcgtcacgctgttctttctgtcgggccgggggctcggcaaaaccagcattggcctgctgtgcgtgatggcgtccagcgttctactgtggatggcctccgttgagccccattggatcgcggccagcattatcctggagttcttccttatggtgctgctgatccccgagcctgacagacagcgaacgccgcaagacaaccagctcgcctacgtcgtcatcgggttgctattcatgatcctcaccgtggccgccaatgaaatgggcctgctggagaccacgaagaaagacctcgggatcggccacgtggcagttgagaaccatcatcacgctacgatgttagacgttgacctgcatcccgcatccgcctggaccctctatgctgtggcgaccacgatcatcacccccatgatgcgccataccatcgagaacaccacggctaacatcagcctgaccgcgatcgcaaatcaagccgcgatcctgatggggctggataagggctggcccatctccaagatggacataggtgtccctctgctagccctcgggtgttatagccaggttaaccccctgaccctgaccgccgccgtgttgatgttagtcgcgcactacgccatcatcgggccggggctgcaggccaaggctactcgggaggcgcagaagcgcaccgcggccggtattatgaagaaccctaccgtggacggtatcgtcgctatcgaccttgaccctgtcgtttatgacgccaagttcgagaagcagctggggcagatcatgctcctcatactatgcaccagtcagatcctgctaatgcgcacgacgtgggccctttgtgagagcatcaccctggcgaccggccctctcacgactctgtgggaggggtccccggggaaattctggaacaccaccatcgcagtgagcatggccaacatcttccgcgggtcctacctggccggggccggcctcgccttctcgctgatgaagtccctagggggcggacgccggggtacgggggcccaaggcgagaccctcggagaaaaatggaagcgccaactgaaccagctgtccaagagcgagttcaacatctacaagcgctctggtataatggaggtcgaccgcagcgaggccaaggagggcctcaaacggggggaaaccactcgccacgccgtgtcccggggaactgccaagctgcgctggttcgtcgagcggaatttggtaaagcccgaggggaaggtgatcgacctggggtgtggccgtgggggttggagctactactgcgccgggttgaagaaggtgaccgaggtcaaaggctacaccaagggtggacccggccatgaggagccaattcctatggcaacctacgggtggaacctggtgaaacttcattcaggcaaggacgtgttcttcacgccaccagagaagtgtgacaccctcctgtgcgatatcggggaatcttcgcccaacccgaccattgaggaaggccggacactgcgcgtcctgaagatggtggagccatggctgcgagggaaccagttctgcatcaaaatcctgaacccatacatgcctagcgtcgtagagacgctcgagcagatgcagcgcaagcacggcggaatgctggtgcggaacccgttgtcacgcaactcaactcacgaaatgtactgggtgtcctgcgggactgggaacatcgtcagcgccgttaacatgacttcccggatgctcctgaacaggttcacgatggcccaccgcaagcccacgtacgagaaggacgttgacctgggagcggggaccagacatgtcgctgtagagccagaagtggcaaatctggacatcatcggccagcgcattgagaacatcaagcacgagcacaaaagcacctggcattacgacgaagacaatccctacaagacctgggcctaccatgggtcctacgaggtcaagccgagcggctccgccagcagcatggtgaacggggttgtgaaactgttgaccaagccgtgggacgtgatccccatggtcacccagatcgccatgaccgacaccacaccctttggccaacagagggtgttcaaggagaaggtggacacccgcaccccgaaggccaaacgtgggaccgtccaaatcatggaagtgacggcccgctggctctggggcttcctgtcccggaacaagaaaccacgcatctgcacccgggaggagtttacccgcaaggtgcggagcaatgccgccattggcgcggtttttgtggatgagaaccagtggaactccgccaaggaggccgtggaggatgagcgcttctgggatctggtaaagaaggaacgggaactccataagcaggggaaatgcgcgacctgcgtctacaacatgatgggcaagagagagaagaaactgggggagtttggcaaagctaaggggagccgggctatctggtacatgtggcttggggctcgcttcctcgagttcgaggccctgggcttcatgaacgaggatcactggttctcccgagagaacagcctgtccggtgtggagggtgagggcctccacaagctgggctatatcctgcgcgacatatctaaaattcccggtggcaacatgtatgccgacgacacggctggctgggatacccggattaccgaggacgacctgcagaatgaggccaagattaccgacatcatggagccggaacacgccctgctagccacgtccatcttcaagctcacctaccagaataaagtcgtgcgcgtgcaacgcccagccaagaacgggacggtcatggacgtgataagccgaagagaccagcgaggctcgggccaagtcggaacctatgggctgaatacgttcaccaacatggaggcgcagctgatcaggcagatggagagcgaagggatcttcctccccagtgaactggagacgcccaaccttgcggagcgggtcctcgactggctggagaagtacggcgtggagcgcctgaagaggatggctatcagcggggacgactgcgtggtcaaaccgatagacgaccggttcgccactgcactcacggccctgaacgacatgggcaaggtgcgcaaggacatcccccagtgggagccatctaaggggtggaacgactggcagcaagtacccttctgcagccaccacttccaccagttaataatgaaggacggcagggagatcgtcgtgccctgccggaatcaggacgagctagtgggccgcgcccgggtctcccagggggccggttggagcctaagagagactgcatgtctgggcaaaagctatgcccagatgtggcagctcatgtacttccaccgtcgcgacttacggttagcggccaacgccatctgcagcgccgtgcccgttgactgggtcccgaccagccggaccacgtggtccatccacgcgcaccaccagtggatgaccaccgaggacatgctgagcgtgtggaaccgggtgtggatagaggagaacccttggatggaggacaagacccacgtgagcagctggggcgacgtaccctacctgggaaaaagggaagaccaatggtgtggatcactgatcggcctcacggcccgggccacgtgggccagcaacatccaagtggctatcaaccaggtcagaaggctgatcggtaacgagaattacctggactacatgacgtctatgaaacggttcaagaacgagggcgacccggagggggcgctctggtag

SEQ ID NO: 24428 - RNA, 9879 nt, synthetic construct
  misc_feature 1..9879: note = derived and/or modified CDS sequence (opt11) from DENV-1__GU131720__SS-prME
  source 1..9879: mol_type = other RNA
agcgtcaccatgctgttgatgctgatgcccaccgctctagcctttcacctcaccacccggggcggggagccccacatgatcgtgacaaagcaggagcgtggcaagtcactgctgttcaagaccagcgccggtgtgaatatgtgcacgctcatcgccatggaccttggcgagctgtgcgaggacaccatgacctacaagtgcccccggatcaccgaagccgagcccgacgacgtggactgttggtgcaacgccacggacacctgggtcacctacgggacctgctcccagaccggtgagcaccgacgcgacaagcgaagcgtggccctcgcgccgcatgtgggtctgggactggaaacccgtaccgagacctggatgagtagcgaaggcgcctggaaacagatccagagggtggagacgtgggccctccgtcaccccgggttcaccgtgatcgccctgttcttggcccacgccatcggcacctcgattacgcagaaggggatcatcttcatcctcctgatgctggtgactccaagcatggccatgcggtgcgtcggcatcggatcccgcgacttcgtggaggggctgagcggagccacctgggtcgatgtcgtgctggagcacgggtcgtgcgtgaccaccatggccaaggacaagcccaccctggacatcgagcttctgaagaccgaagtcaccaaccccgcggtgctgcggaagctctgcatcgaggccaagattagcaacactactaccgattcccgctgtccaacccagggcgaggccaccctgatggaggagcaggacgccaacttcgtatgccggcgaacgttcgtcgatcggggctgggggaacggctgcggtctattcggtaagggtagcctcatcacgtgcgccaagttcaagtgcgtgaccaagctggagggcaagatcgtgcagtacgaaaacctgaagtattccgtcatcgtgaccgtgcacacgggagaccaacaccaagtcgggaacgagagcaccgagcacggaacaaccgcgaccataacgccccaggcccccaccagcgaaatccagctcaccgactacggggccttgacactggactgctcgccccgcacggggctagacttcaacgagatggtactgctgactatgaaggagaagtcctggctcgtccacaagcaatggtttctggacctcccgctcccctggactagcggggccagcacctcccaggagacgtggaaccggcaagacttgctggtcacgttcaaaaccgcccacgcgaagaagcaggaggtggtggtgctcggcagccaggagggcgccatgcacacggcactaacgggagccacggaaatccagacctccggcaccacgacgatcttcgccgggcacctgaagtgccgcctaaaaatggacaagctgacattaaagggaatgagctacgttatgtgcaccgggtccttcaagctcgagaaggaagtcgcggagactcagcacggcacagtgctggttcagatcaaatacgagggcaccgacgcgccctgtaagatccccttcagcacacaagacgagaagggggtcacgcagaacggccggctgatcactgccaacccgatcgtgaccgataaggagaagcccgtaaatatcgaggccgagccgccctttggggagtcctatatagtcatcggggcgggcgagaaagccctgaaactctcctggttcaagaagggctcctcaatcggcaagatgttcgaagccaccgcccgcggggcccgacgcatggcaatcctgggagacacggcctgggacttcgggtccgttggcggcgtgttcactagcgtcggtaagctagtgcaccagatcttcggaaccgcatacggggtgctattctccggtgtcagctggactatgaagatcgggatcggagtactgctaacgtggctcggcctaaattcccgctcaacctccctgtctatgacctgcatcgccgtggggctcgtgaccctctacctgggcgtcatggtgcaggccgactcaggttgcgtcattaattggaagggccgggagcttaagtgcggttccgggatcttcgtgacgaatgaggtgcacacctggaccgaacagtacaaattccaggcggactcaccgaaacgcctgtccgccgccatcggcaaggcatgggaggagggggtctgcggcatccggagcgctacccgcctggagaacatcatgtggaaacagatctccaacgaactcaaccacatattacttgagaacgacatgaagttcacagtggttgtcggggacgtggtgggaatcctcgcgcaagggaagaagatgatacggcctcagcccatggaacacaagtatagctggaagtcctggggcaaggcgaagattatcggcgctgacgtccagaacacaacattcattatcgatgggcccaacaccccggagtgccccgacgaccagcgcgcctggaacatctgggaagtggaggactacggcttcgggatattcgcgaccaatatctggctgaagctgcgggactcgtacacacaggtttgcgatcacaggttgatgagtgcagccataaaggacagcaaggcggtccacgccgatatgggctactggatcgagtccgagaagaacgagacctggaagctggctcgggcgagcttcatcgaggtaaagacctgcatttggcccaagagccacacgctatggagcaacggtgtgctcgagtcggagatgataatccccaagatctacgggggcccgattagccaacacaactaccgcccaggatacttcacgcaaacggctggcccttggcacctggggaagttggagctcgacttcgacctgtgcgagggtaccaccgtcgtggttgacgaacactgcggcaaccgggggccatccctgcgcacaaccaccgtcaccggcaagatcatccacgaatggtgctgccggagttgcacgctgccccccctccgattcaaaggagaggacggctgctggtacgggatggagatccggcccgtgaaggagaaggaggagaacctggtgaagtccatggtcagtgcgggctcaggcgaggtggacagcttcagcctcggcctgctgtgcatctccataatgatcgaggaggtgatgagaagccgttggtcccgcaagatgttaatgaccggcacccttgccgtcttcctgttgctgatcatgggacagctgacatggaacgacttgatccggctgtgcatcatggtgggcgcgaacgcaagcgaccgcatgggcatgggcacaacctacctggcgctcatggccacgtttaagatgcgcccgatgttcgccgtgggcttgttattcaggcgcttgacctcccgggaggtcctgctcctgacgatcgggctaagtctggtggcctccgtcgagctcccaaacagcttagaggagctgggcgacgggctcgctatgggcattatgatcctgaagctgttgaccgacttccagtcccaccagctatgggccaccctgctcagcctgaccttcatcaagacgaccctgagtctccattacgcctggaagaccatggcgatggtcctgtcgatcgtatccctgtttcccctctgcctgagtaccacctcccagaagactacctggctgcctgtcctcctaggcagcttcgggtgcaaaccgctgacaatgtttttgatcacggagaataagatctggggccgaaaatcctggccgctgaacgaggggataatggccgtgggagttgtctcaatcctgctcagcagcctgctgaagaacgacgtgcccctcgccgggcccctgatcgccggcggcatgctgatcgcctgctacgtgattagcgggtccagcgcggacctctccctggagaaagccgccgaagtcagctgggaggaggaggcggagcactccggcgccagccataacatactggtggaggtccaagatgacggaacaatgaaaatcaaggacgaggagcgcgatgacaccctcaccatcctgctgaaggcgaccctcctggcagtctccggcgtctacccgctgtcgatcccggccaccctcttcgtgtggtacttctggcaaaagaagaagcagcgctccggggtcctgtgggacaccccatcgccccctgaggtagaacgtgccgtgctggacgacggcatctacaggatcatgcagagaggcctgctcgggcgctcccaggtcggcgtgggggtcttccaggagaacgtcttccataccatgtggcacgtgacccggggcgcagtgctgatgtaccaggggaagcgcctggagccctcctgggcgtccgtcaagaaggacttaatcagctacggtggcgggtggagactgcagggctcctggaacacgggggaggaggtgcaggtgatcgccgtcgagcccggcaagaaccccaagaacgtgcaaaccgcccctgggaccttcaaaacgcccgagggcgaggtgggcgccatcgccctggactttaagcccgggacgagcggctcgcccatcgtcaaccgcgaggggaagatcgtgggcctctacggcaacggggtggtcaccacaagcggcacttacgtgagcgcgatcgcccaggccaaagcaagtcaggaggggccgctgcccgagatcgaggacgaggtgttcaggaaacgcaacctgacaatcatggacctgcatccaggcagcgggaagacacgacgatacctgccggcgatcgtccgggaggccatcaagagaaagctgaggaccctcatcctggcccccacccgcgtggtggcctccgagatggccgaggcgctgaagggtatgcccatccgttaccagacgaccgcagtgaagtcggagcacaccggcaaagagatcgtggacctcatgtgccacgccacatttacgatgcggctgctgtcccccgtgcgcgtcccaaactataacatgatcatcatggacgaagcccatttcactgatcccagttcgatagcggctcggggctacatcagcaccagggtgggcatgggcgaagccgccgccatatttatgacagccacgccgcccggctccgttgaggcgttcccgcagagcaatgccgtcatccaggacgaggagcgggacatccccgagcgtagttggaatagcgggtacgagtggatcaccgacttcccaggcaagaccgtgtggttcgttccgtccataaagagcggcaatgacatcgccaactgcctccggaagaatgggaaacgcgtcatccagctgtctcggaagactttcgacacggagtaccagaagaccaagaacaatgactgggattacgtggtgaccaccgacatcagcgagatgggcgccaacttccgcgcggaccgggtcatcgatccgcgccggtgccttaagcccgtgatcctcaaggacgggcccgagcgcgtcatactggccggccccatgccagtgacggtcgcctccgccgcccagcggcgcggtcgtatcggccgcaatcacaacaaggagggcgaccagtacatctacatggggcagccgctgaacaacgatgaggaccacgcgcactggacagaggccaagatgctcctggacaacatcaatacccccgaaggcatcattcccgccctgttcgagccggagcgggagaaatccgctgcgatcgacggggagtaccgactccgcggggaggcgagaaagaccttcgtcgagctgatgagacgcggagacctgcccgtgtggctctcctataaggtggccagcgagggattccagtacagcgacaggcggtggtgcttcgacggcgagcgaaacaaccaggttctggaggagaacatggacgtggagatctggacgaaggagggggagcgcaaaaagctgcgcccccggtggctcgacgccaggacgtactccgacccactggcactacgggagtttaaggaattcgccgcgggtcgccggagcgtgtccggggacttaatcctggagatcggcaagctgccgcagcacctcacccaaagggctcagaacgcccttgataacctggttatgctccacaacagcgagcaaggcggccgggcctacagacatgcaatggaggagcttcccgacactatcgagacgctgatgctcctggccctgatcgctgtgctcaccggcggggtgaccctgttcttcctatccggccgggggctcggcaagacgagcatcggcctgctgtgcgtcatggcctccagcgttctcctgtggatggcctccgttgaaccccactggatcgcggcaagcatcatcctggagtttttcctcatggtcctgctgatccccgagccggatcgccagcggacgccccaggacaaccagttggcctacgtggtgatcgggctgctgttcatgatactcacggtcgccgccaatgagatgggcctcttggagacaaccaagaaagacttgggaattggccacgttgcggtcgagaaccaccaccacgccaccatgctggatgtcgatctgcaccctgcatctgcctggacgctctatgccgtggcgaccaccatcataaccccgatgatgagacacacgatcgagaataccaccgccaacattagcttaaccgccatcgctaaccaggctgcaatcctgatggggctcgacaagggctggcccattagcaagatggatatcggcgtgcccctgctggcgctcgggtgctatagccaggtcaaccccctgacgctgacggccgccgtgctcatgctggtggcgcactacgccatcattggaccggggcttcaggcaaaggccacccgggaggcccagaagcgcaccgcggccggcatcatgaagaaccccacggtcgacgggattgtggccatcgacctcgacccagtggtctacgacgccaagttcgagaagcagctggggcaaatcatgctgctcattctgtgcacctcccagatcctgctcatgcgcaccacctgggccctgtgcgagagcattacgctggcgaccggtccccttacaaccctctgggaggggtccccgggcaaattctggaacacgacaatcgcggtgagcatggctaacattttccggggctcctacctggccggcgccggcctcgcgttctccctgatgaagtccttggggggcggacgccgtgggactggggcacagggagagaccttgggagagaagtggaagcgccaactcaaccagctatccaagagcgagttcaacatctacaagcggtccgggataatggaggtcgaccgcagcgaggccaaagagggcttgaagcgcggtgaaacgaccagacacgccgtttcacggggcacggcgaagctgcgctggttcgtggagcggaacctggtgaagccggaaggaaaggtcatcgacctgggatgcggccgcggcggctggtcttactactgcgccggtctcaagaaggtgacggaggtgaagggttatacgaagggagggcccggccacgaggagccgatcccgatggccacctatggttggaatctggtcaaactgcattccggcaaagacgtatttttcactccgcccgaaaagtgcgataccctcctgtgcgacatcggggagagctctcctaacccgacgatcgaggagggaagaaccctccgcgtgctcaagatggtcgagccctggctgagagggaatcagttctgcatcaagatcctgaacccctacatgcccagcgtggtggaaaccctagagcaaatgcagcgcaaacacggcggcatgctggtccggaaccctctgtctcgcaacagcacccacgagatgtactgggtttcctgtgggaccggcaatattgtgtcggctgtcaacatgacgtcccgaatgcttctgaaccgcttcaccatggcacatcgcaaacccacctatgaaagggacgtggacctgggggcgggcactcgccatgtcgccgtcgaacccgaggtggccaacctcgatattataggccagcggatcgagaacatcaagcatgagcataagagcacgtggcactacgatgaggacaacccttacaagacctgggcttaccacgggtcctacgaggtcaagccgagcggcagtgccagctcaatggtgaacggggtggtcaagctgctgaccaagccctgggacgtgatccccatggtgacccagatcgcgatgactgacactacccccttcggccagcagcgcgtctttaaagagaaggtagacacccggacgccgaaggcgaagcgcgggaccgcgcagatcatggaagtgaccgcccggtggctctgggggtttctgtcccgcaacaagaaaccccggatctgcacccgcgaggagttcactcggaaggtccgcagcaacgccgcgatcggcgccgtgttcgtggacgagaaccaatggaattccgccaaggaggccgtggaggacgaacggttctgggatctggtgcagaaggagcgcgagctccacaagcaggggaagtgtgctacctgcgtatacaatatgatggggaaacgggagaagaagctgggggaattcggcaaggcgaaggggagccgggccatttggtacatgtggctgggcgcgcggtttctcgagttcgaggcactgggattcatgaatgaggaccactggttctctcgagagaacagcctgtccggggtcgagggagagggcctccacaagctgggctacatcttacgggatatcagcaagatccccgggggcaacatgtacgcggacgacaccgccggctgggacactcgcatcacggaagacgacctccagaatgaggccaagatcaccgacatcatgaagccggaacacgccctgctcgccacctctatcttcaagctcacctaccagaataaggtggtgcgggtccagcgccccgcgaagaacggtacggtgatggacgtgatctcacgccgggaccagagggggtcggggcaggtcggcacctatggcttaaataccttcaccaacatggaggctcaactaatccggcagatggagagcgaggggatcttcctcccctccgaactggagacgcctaacctagccgagcgcgtactcgactggctggagaagtacggcgtggagcggctgaagcgcatggcgatcagcggggacgactgcgtcgtcaagccgatcgacgaccgtttcgcgacagcgcttaccgccctgaacgacatgggcaaggtcagaaaggacatcccacagtgggagcccagtaaggggtggaacgactggcagcaggtccccttctgcagccaccacttccatcaactgattatgaaggacgggcgagagattgttgtgccttgccgcaaccaggatgagttagtaggccgggcccgcgtgtcccagggcgcaggctggagcttacgggagaccgcctgcttaggcaagtcgtacgcgcagatgtggcaattaatgtacttccaccgccgggacctgagactggccgccaatgccatctgcagcgcggtgcccattgactgggtccccactagccgcaccacctggtcgatccacgcccaccatcagtggatgaccacggaagacatgctaagcgtgtggaaccgcgtgtggatcgaggagaacccctggatggaagacaagacccatgtctccagctggggcgacgtgccgtacctggggaagagggaggaccagtggtgcggctccctgatcggcctcaccgctcgcgccacatgggctagtaacatccaggtggcgatcaaccaggtccgtcggctgattgggaatgagaactacctcgattacatgacctccatgaagagattcaagaacgagggggaccccgagggtgccctgtggtga

SEQ ID NO: 24429 - RNA, 9879 nt, synthetic construct
  misc_feature 1..9879: note = derived and/or modified CDS sequence (opt11) from DENV-1__HM181960__SS-prME
  source 1..9879: mol_type = other RNA
tccgtgaccatgttgttaatgctgatgccgacggcactggcatttcacctcaccacccggggcggggaaccccacatgatcgtgagcaagcaggagaggggcaagagcctgctgttcaagaccagcgccggggtcaacatgtgcaccctaattgccatggacctgggggagctgtgcgaggatacgatgacctacaagtgtccccggatcaccgagaccgagcccgacgatgtggactgctggtgcaacgccacggatacctgggtgacctacgggacctgcagccagacgggcgagcaccggcgggacaagcggtccgttgcgctcgcgccccacgtgggcctggggctcgaaacccggaccgagacctggatgagctccgagggcgcctggaagcaaatccagcgcgttgaaacgtgggccctcaggcatcccgggttcaccgtgattgccctgttcctggcccacgcgatcggcaccagcatcacccagaagggaatcatattcatcctccttatgctggtgacgccctccatggcaatgcgatgcgtgggcatcggcagcagggatttcgtagaggggctcagtggcgccacctgggtggacgtcgtgctggagcacgggtcctgtgtaaccaccatggccaaggacaagcccacgctggatattgagctccttaaaaccgaagtcactaatcccgccgtgctgcggaagctatgcatcgaggccaagatctccaacaccacgacagattcccgctgcccgacccagggcgaggccaccctggtagaggaacaggacgcaaacttcgtctgccggcgcacgttcgtggaccggggctgggggaacggctgcggtttgtttgggaaggggtccctcatcacgtgcgccaagtttaaatgcgtgactaagctggaaggcaaaatcgtccagtacgaaaacctgaagtacagcgtaatcgtgaccgtccacacgggcgatcagcaccaggtgggaaacgaatccaccgagcatggcacgaccgcaacgatcacaccccaggcgcccacaaccgagatccaacttacggattacggggccttaacgctagattgcagcccaaggaccgggctcgatttcaacgagatggtcttgctgaccatgaaagagaagagttggctcgtgcacaagcagtggttcctggacctgccattaccctggactagcggggccagcacatcccaggagacctggaaccggcaggacctgctggtgacctttaagaccgcccacgccaagaagcaggaggtcgtggtgctcggcagccaagagggcgcgatgcacacggctctgaccggggctaccgaaatccagaccagtggcacgaccaccatcttcgccggccacctgaagtgtcgcctcaaaatggacaagctgaccctaaagggaatgtcgtacgtcatgtgtacggggtcctttaagctcgagaaggaggtggccgaaacgcagcacggcaccgtcctggtccaaatcaagtacgagggcacagacgcaccctgtaaaatcccctttagcacgcaggacgagaagggggtaacccagaacggccggctgatcacagccaacccgatcgtaaccgataaggagaagcccgtgaacatcgaggccgaaccaccatttggcgagtcgtacatcgtaatcggcgccggcgagaaggccttaaagctcagctggtttaaaaaggggagtagcattggcaagatgttcgaggccacggcccgtggggcccggcgcatggccatcctgggtgacaccgcgtgggacttcgggtccatcggaggcgtgttcaccagcgtcgggaaacttgtgcaccagatctttggcaccgcttacggggtcctcttctccggcgtctcatggacgatgaagatcgggattggggtactgctgacgtggttaggccttaactccaggagtacgtccctctcgatgacctgtatcgccgttgggctcgtcacgctgtacctgggtgtaatggtacaggccgactcggggtgcgtcatcaactggaaggggcgggaactcaagtgtgggagcggcatcttcgtgacaaacgaggtgcacacctggacagagcagtacaagttccaggccgactctccgaagcgcctgtcagctgccatcggcaaggcatgggaggagggggtctgcggcatccggtccgccacaagattggaaaacatcatgtggaaacagatctccaacgagctcaaccacatcctgctggaaaatgacatgaagttcacggtggtagtcggggacgtggccggcatactcgcgcaggggaagaagatgattcggccccagcccatggagtacaagtatagctggaagtcctggggcaaggcgaagataatcggggccgacgtccagaataccactttcataatcgacgggccgaacacaccggagtgccccgacgaccagcgcgcctggaacatctgggaagtcgaggactacgggttcgggattttcacgaccaacatatggctgaagctgcgggacagctacactcaggtgtgcgaccaccgtctcatgtccgcggccatcaaggacagcaaggccgtacacgccgacatgggctactggatcgaaagcgaaaagaacgaaacctggaagctggcgcgggcatctttcattgaggtcaagacgtgcatttggcccaagtcacacaccttatggagcaacggcgtgctcgagtccgagatgatcatccccaagatctacgggggcccgatcagccaacacaactaccgccccgggtacttcacccaaaccgccggcccctggcacctgggcaagctggagttagacttcgatctatgtgaagggactaccgtggtcgtggacgagcattgcggcaaccggggaccgtcgctgcgcaccaccacggtgacagggaaaatcatccacgagtggtgctgccggagctgtaccctgcctcccctacgcttccgcggggaggacggctgctggtacgggatggaaatccgccccgtcaaggaaaaggaggagaacctggtgaagagtatggtaagcgccggcagcggcgaggtcgactcgttcagcctggggctgctgtgtatctccatcatgatcgaggaggtgatgcggtcacgatggtccaggaaaatgttgatgaccggcacgttagccgtcttctttctgctcatcatgggccaattgacctggaacgacctgattcgcctctgtatcatggtcggcgccaatgcgtccgaccgcatgggtatgggcaccacctaccttgctctgatggccaccttcaagatgagaccgatgtttgccgtggggttgctgtttcgtaggctgacctcccgcgaggtgctccttttgaccatagggctcagcctggtagccagtgtggagctgccaaacagcctcgaggaactgggtgacgggttagcgatgggtatcatgatcctcaagctgttgaccgacttccaatcgcaccagctctgggccacgctactgagcctcacctttatcaagaccaccttctcccttcactacgcctggaagacgatggccatggtcctttcgatcgttagtctcttccccctgtgcttaagcaccacctcccagaagaccacgtggctgcccgtgctgctgggcagccttggatgcaagccgctgaccatgttcttgatagccgagaacaagatttggggccggcgctcctggcccctcaacgaagggattatggccgtaggcatcgtgtccatcctactgagctccctcctgaagaacgacgtgcccctggccggccccctcatcgccggcggcatgctgatcgcctgctacgtcatctccgggtccagcgccgacctgtccctcgaaaaggccgccgaggtgagctgggaggaggaggcagagcattcaggcgccagccacaacatcctggtggaagtccaggacgacgggaccatgaagatcaaagatgaggaacgggacgacaccctgaccatcctcttgaaggcgacgttactcgcggtgtccggcgtgtacccgctgtccatacccgccaccctgttcgtctggtatttctggcagaagaaaaagcagcgctccggggtgctctgggacacccccagcccacccgaggtgggccgggccgtcctggacgacggtatttaccgcatcatgcagcggggacttcttggccgctcccaggtgggggtgggcgtcttccaggagaacgtgttccacaccatgtggcacgtgacgagaggggccgtcctcatgtaccagggcaagcgcctggagcccagctgggcgtccgtgaagaaggacctgattagctacggcggagggtggcggctgcagggctcctggaacaccggggaggaggtgcaggtcatcgccgtggagcccgggaagaacccgaagaacgtgcagaccgctcccggcacctttaagacgcccgaaggcgaggtcggcgccatcgccctggacttcaagcccggcaccagcgggtcccccatcgtcaaccgcgagggcaaaatagtgggcctatacgggaacggggttgtgactacgagcgggacatatgtctcggcgatcgcccaagcgaaggcttcccaggagggcccgctccccgagatcgaggacgaggtcttccggaagcgcaacctcacgatcatggacttgcacccaggaagcggcaagactcggcgctacctcccagcgatagttcgtgaggccatcaagcgcaaactccgcaccctgatcctcgcacccacgcgggtggttgcctccgaaatggccgaagcgcttaagggaatgcccatccgctaccagacaacagccgtcaagagcgagcatacgggaaaggagatcgtagacctgatgtgccacgccacgttcaccatgagactcctgtcacccgttcgcgtgccgaactacaacatgatcatcatggacgaggcacacttcaccgaccccagctccatagccgcgcggggctacatatccacacgcgtggggatgggagaggcggccgccatcttcatgacggccacgccgcccgggtccgtcgaggcgttcccgcagagcaacgccgtgatccaggacgaggaacgcgacatccccgagcgctcctggaactccggctacgagtggattaccgacttccccggcaagaccgtgtggtttgtcccatccatcaagtcagggaacgacatcgcgaactgccttcggaagaatggcaagcgcgtgatccagctctcccgcaagacgtttgacaccgagtaccagaagacgaagaacaacgattgggactacgtggtcaccacggacatcagcgagatgggggccaacttccgcgcggaccgggtgatcgacccgcgccgatgccttaagcctgtgattctgaaggacgggcccgagagggtcatcctcgcagggccgatgccggtgacggtcgcctccgcggcccagcggcgcggccggatcggccgcaaccacaacaaagagggggaccagtacatctatatgggccaaccgctgaacaacgacgaggaccatgcgcactggacagaagccaagatgctgctcgacaacattaacacccctgaggggataatccccgccctgttcgagccagagcgcgagaagtccgctgccatcgacggtgagtaccggctgcgcggggaagcgcggaagaccttcgtggagctgatgcggcggggtgacctgcctgtgtggctgtcctacaaggtagcaagcgaaggcttccagtacagcgaccgccgatggtgtttcgacggtgagcgcaacaaccaagtgctcgaggagaacatggacgtagagatctggaccaaggagggcgagcggaagaaactgcgtccccggtggctcgacgctcgcacctacagtgaccccctcgccctgcgggagtttaaggagttcgccgcagggcgcagatcggtctccggcgacctgatcctcgagattggcaagctgccgcagcacctgacccagcgcgcacagaacgccctcgacaacctggtgatgctgcacaactccgagcagggcggtcgggcctaccgccacgcgatggaggagttgcccgacacgatcgagactctgatgctgcttgcgctgatcgcggtgcttaccgggggcgtgaccctcttctttctctcagggcggggcctgggcaaaacctcaatcggtctcctgtgcgtgatggcttccagcgtgctcctctggatggcctccgtggagccccattggatagcggcctcaatcatcctggagttcttccttatggtgctcttgatccccgagccggaccgccagcggacaccccaggacaaccaactggcctacgtggtaatcggcttgctgttcatgatcctgacggtggccgctaacgaaatggggctccttgagaccaccaagaaagacctaggcatcgggcacgtggcagtcgagaaccatcaccacgccgccatgctcgacgtggacctgcaccccgcatccgcctggacgctgtacgcggtggccaccaccatcatcaccccgatgatgcgccacacgatcgagaacaccacagccaacatctctctcaccgcaatcgccaaccaggcggccatccttatgggccttgacaaaggctggcccatctccaagatggacatcggggtccccttactggccctcggctgctacagccaggtgaaccccctcacgctgactgccgctgtattaatgctcgtcgctcactacgccatcatcgggcctggactacaggctaaggccactcgcgaggcacagaagcggaccgccgccgggatcatgaagaatcccacggtggacggtatcgtggccatcgacttagaccccgtcgtttacgacgccaagttcgagaagcagctcggacagatcatgctgctgatactctgcacctcccaaatcctgctgatgaggaccacctgggctctctgcgagagcatcacacttgcaaccggacctctgaccaccctctgggagggatcccccgggaagttctggaacacgaccatcgccgtgagcatggccaatatctttcgtggcagctacctggcaggcgcggggctggcattcagcctcatgaaaagcctgggcggagggaggcgggggacgggcgcccagggcgagacactaggggagaagtggaagcgccagctcaaccagctctccaaaagcgagttcaacacgtataagagatcgggcatcatggaggtcgaccgcagcgaggccaaggaggggctcaagcggggcgagaccaccaagcacgcggtctcccgcgggacagccaagctccggtggttcgtggagcgcaacctcgtaaagcccgagggccgggtgatcgacttaggctgcgggcgcggcgggtggagctactattgcgccggattgaagaaggtcacggaagttaaggggtacaccaaaggcggcccggggcatgaggagcctatcccaatggctacctacggctggaacctcgtgaaactgcactccgggaaggacgtgttcttcatcccgcccgagaagtgcgacacattgctctgcgacataggcgagagctcccccaacccgaccatcgaggaggggcgcactctgagggtcctgaagatggtggagccctggctccggggcaaccagttttgcatcaaaatcctgaacccctacatgcccagcgtggtcgagaccctggagcaaatgcaacgcaagcacggcgggatgctcgtgcggaatccgctgtcccgcaacagtacccacgagatgtattgggtgtcctgtgggacgggaaacatcgtcagcgcagtgaacatgacgtcccgcatgctgctcaaccggttcaccatggcccaccgcaagcccacctatgagcgggacgtggacctgggagccggcacccgacacgtagccgtggagcccgaggtcgcgaaccttgacattatcgggcagcggatcgagaatatcaagcacgagcacaagtccacgtggcactacgacgaagataacccctacaaaacttgggcctaccacgggtcctacgaagtcaagcctagcggttccgctagcagcatggttaacggcgtcgtgaaactgctgaccaagccatgggacgtgatacctatggtcacccagatcgcaatgactgacaccacccccttcgggcagcagcgcgtgttcaaggaaaaagtggacacccggaccccgaaggccaagcgcggcaccgcacagatcatggaggtcaccgctaagtggctgtggggcttcctctcgcggaacaagaaaccaaggatctgcacccgggaggagtttacgcgcaaggtgcggagcaacgcggccatcggtgccgtcttcgttgatgagaaccaatggaactccgcaaaggaggcggtggaggacgagcgcttctgggatcttgtccaccgggagcgcgagctacacaaacaaggcaagtgcgcgacgtgcgtctacaacatgatggggaaaagagagaagaagctcggagagttcgggaaggccaagggcagccgcgccatatggtacatgtggctgggcgccagattccttgagtttgaagcgctcgggttcatgaacgaagaccactggttctccagagagaactctttatcgggcgtggaaggagagggactccacaagctcgggtacatcctgcgggacatcagcaaaatccccggcggcaacatgtacgccgacgacaccgccggatgggacacccgcatcacggaggacgacctgcaaaacgaggcccgcattacggatataatggagccggagcatgccctcctggcgaaatccatcttcaagttaacctaccagaacaaagtcgtacgagtgcagcgcccagccaagaacggcaccgtgatggacgtcatcagccggcgcgaccagcggggatccggccaagttggcacgtacgggctcaacaccttcaccaatatggaggcccagctgatccggcagatggagagcgagggaattttcagtccaagcgaactggaaacccctaacctcgctgagcgggtactggactggctggagaagtatggggtcgagcgcttgaagcggatggccatttctggcgatgactgtgtggtgaagccaatcgacgaccgctttgcgacggcgctgaccgcgctgaacgatatgggtaaggttcggaaggatatcccccaatgggagccctcgaagggctggaatgactggcagcaggtccctttctgctcacaccacttccaccagctcatcatgaaggacggccgggagattgtcgtcccgtgccggaaccaggacgagctggtgggaagggcccgggtgtctcaaggcgccgggtggagcctgagggagaccgcgtgcctggggaagtcctacgctcagatgtggcagctgatgtacttccacagacgcgacctgcggctcgccgccaacgcgatttgcagcgcggtgcccgtggactggatcccaacatcccgcacgacctggagcatccatgcccaccaccagtggatgaccactgaggacatgctttccgtgtggaaccgagtctggatagaggagaacccctggatggaggacaagactcacatcagctcctggggagacgtgccgtacctgggcaagcgggaggaccagtggtgcggcagcttaattggtctgacagcccgcgccacctgggcgaccaacatccaggtggccatcaaccaggtccgtcgcttgattggcaacgaaaattacctcgactacatgacctctatgaagcgtttcaagaacgaatcagaccctgagggagccctgtggtaa

SEQ ID NO: 24430 - RNA, 9879 nt, synthetic construct
  misc_feature 1..9879: note = derived and/or modified CDS sequence (opt11) from DENV-1__HM181963__SS-prME
  source 1..9879: mol_type = other RNA
tcggtaacaatgctactgatgctaatgcccaccgcactggccttccacctaacaacacgcggcggcgaaccacacatgatagtaagcaaacaagaacggggcaaatcacttctattcaaaacctcagcaggagtaaacatgtgtaccctaattgctatggacctaggagaattttgcgaagatacaatgacctataaatgcccacggataacggaagccgaaccagatgatgtggattgctggtgcaatgcaacagacacctgggtaacgtacggaacctgctctcaaataggggagcatcgccgtgataaacgatcggtcgctctggcccctcacgtgggcctcgggctcgagactagaacagagacctggatgagtagtgagggcgcatggaaacaaatccaaagggtggaaacatgggcactgcgacacccaggcttcactgtcatagcccttttcctcgcacatgcaatcggaacatcgataacacaaaagggcataattttcatcctcttgatgctcgttacacccagcatggcaatgcgctgtgttgggatcggcagcagggacttcgtggagggcctgtccggggcaacgtgggtcgacgtcgtcctggagcacgggagttgtgtgacaacgatggcgaaagataaacccaccttagacatagagctactaaaaactgaagtaaccaaccctgccgtcctcaggaaattatgtatcgaggcgaaaataagcaataccaccacagatagtcgctgcccgacgcaaggggaagcgactttggtcgaagaacaagatgcaaacttcgtatgccggagaaccttcgtagaccggggttggggaaacggctgcggcttattcggcaaaggatctcttatcacgtgcgcgaaattcaaatgcgttacgaaattggaagggaaaatcgtacaatacgaaaatcttaagtactcagtcatcgtaacagtacacacgggcgaccaacatcaagtagggaacgaatccacagagcacggtacaaccgccaccataacaccgcaggcaccaagcaccgagatccaactaacggactacggggccctaaccctcgactgtagtccgcgaacgggactcgacttcaacgagatggtcctcctcaccatgaaggagaaatcatggctcgtccataaacaatggttcctcgacctacccctcccctggaccagcggggcgtccacaagccaagaaacatggaatcgacaagacctcctcgtcaccttcaaaacagcacacgcgaagaaacaagaggtggtagtactaggatcccaagagggtgcgatgcatacagcgctgacaggcgcaaccgaaatacaaacgagcggtacaaccacgatattcgccggccacctaaagtgccgcctgaaaatggacaaactcaccctgaaaggcatgtcctacgtgatgtgcacggggtcattcaaattagaaaaagaggtcgcggaaacccaacacgggaccgtactcgtacagatcaaatatgagggcacggacgcaccatgtaaaatcccattcagcacacaggacgaaaagggcgtaacacaaaacggacggctcatcacagccaaccccattgtaaccgataaagaaaagcccgtgaacatagaagcagagccacctttcggagaatcatacatagtcataggtgtcggggaaaaggcgctcaaattgagttggttcaaaaaggggagtagcataggtaaaatgtttgaggcaacggccagaggggccaggcgtatggccatactaggcgacacagcgtgggacttcgggagtataggaggcgtcttcacctcggtaggaaaactcgtccaccaaatattcggaaccgcgtacggggtgctattctccggagtgagctggacaatgaaaataggaattggagtcttattaacatggttaggactaaacagcaggtcaaccagcctatcaatgacatgcatcgctgttggattagttaccttatatctgggggttatggtacaagcagactccgggtgcgtcatcaattggaaagggcgcgaactcaagtgcggcagcggtatctttgtgacgaacgaggtacatacgtggacggagcagtacaagtttcaggcagatagcccgaaacgtctcagtgcagcaatcggaaaggcgtgggaggagggtgtctgcggcattaggagcgctacacgactagaaaacataatgtggaagcagatcagcaatgaacttaaccacatactcctagaaaacgacatgaagctcacagtggtagtcggggacgtggcaggaatcctggcacagggcaagaaaatgataagaccccagccaatggaatacaagtacagctggaaatcgtggggcaaagccaagatcattggcgcagatgtacaaaacactacctttatcatcgacggccctaacaccccggagtgtccggacgatcaaagagcgtggaacatatgggaggtagaagactacgggttcggcatcttcacgaccaatatctggctcaaactacgtgacagctatacgcaagtctgcgaccaccgcctaatgagcgctgcgatcaaagactccaaagcagtacatgcagacatgggatattggatcgaatcggagaaaaacgagacctggaaacttgcgcgcgcgagcttcatcgaagtgaaaacttgcatatggcccaaaagccacacactgtggagcaacggagtcttagaatctgaaatgatcatcccaaagatctacggtggcccaatctctcagcacaactaccgccctggctactttacgcaaacagctggcccctggcatctcgggaagctcgagctagattttgacctgtgtgagggaactacagtagtcgtagatgaacactgcggaaaccggggcccatcacttaggacgactaccgtaaccggcaaaatcatacatgaatggtgctgccgcagctgcacccttccgccacttaggtttaagggcgaggacggctgctggtatggaatggaaatacggccagtgaaagagaaggaagagaacctcgtgaagtcgatggttagcgccggatccggcgaggtagactccttttctcttggcttgctgtgcataagcatcatgatcgaagaggtaatgaggtcacgttggtcacgaaaaatgctaatgacgggtactctggctgtgttcttcttactgatcatggggcagctaacatggaacgacctgatccgcttgtgcataatggttggggcgaacgcgtcagaccgaatgggaatgggcaccacatatctggcgttaatggcaaccttcaagatgcgaccgatgttcgcagtagggctgctattccgtcgattgacctcccgcgaggttctgctacttacaattggcttgtcattggtagcaagcgtggaattgcctaactcgttggaagagttaggagacggtctggctatgggaatcatgatcctcaaattactcacagacttccaatcacatcaactctgggcgacattactctctatgaccttcataagaacaaccttttcgctacattacgcctggaaaactatggcaatggttctaagtatagtgagcctattccctctttgcctaagcacaacatcccaaaagaccacgtggctccccgtgttattagggagcctgggatgcaaaccactaacaatgttcctaattgcggaaaataagatatgggggagaaagtcatggccattaaacgaaggaataatggccgtgggaatcgtgtccattctgctatcgtccttactcaaaaatgacgtaccactagcaggaccgttaatcgcaggaggaatgcttatcgcatgttacgtgattagcggatcctcggcggacctttcacttgagaaggcagcggtcgtaagctgggaggaagaggcggaacacagtggagcgtcacacaacatcctagtggaggtgcaagacgatggaacgatgaaaataaaagacgaagaacgcgacgacaccctgacgatccttctcaaagcaacacttctagccgtctccggagtatatcccctgtccattccagcgacactcttcgtctggtatttttggcagaagaagaaacaaagatccggcgtcctgtgggacacaccgtcccctccggaggtggagagggcagtcttagacgacgggatatacaggataatgcaaaggggacttctaggaaggtcccaagtaggtgttggggtatttcaagaaaatgtatttcacacgatgtggcacgtcacacgaggcgccgtccttatgtaccagggaaaacgcctggagccctcgtgggcctccgtcaagaaagatcttataagctacggaggcgggtggaggctccagggatcctggaacacaggggaagaagtccaggtaatcgccgtagagccggggaaaaaccccaaaaatgtacagacggcacccggaacgttcaagacatcagaaggcgaagtcggagcgatagccctagatttcaaacccggtacctcaggttccccaatcgtgaaccgggagggcaaagtcgtgggcctctatggaaacggagtagtaactacaagcggaacctatgtatcggccatagcgcaagcgaaggcatcccaagaaggccccctccccgagatcgaagatgaggtctttcgcaagaggaacctgaccatcatggatttacacccagggagcggcaaaactcgacgatacctaccagccatagtacgcgaggcaataaaacgtaaacttaggactctgatactggcacctaccagagtggtggcatcagaaatggccgaggctctgaaagggatgcccataagatatcagacgactgcagtcaagagtgaacacaccggaaaagaaatcgtcgacctaatgtgtcacgctacattcactatgcgtctgctgtcgcccgttcgagtaccgaactacaacatgataattatggacgaagcccacttcacagacccatcatcgatagccgcgcgaggttacataagtacacgagttggcatgggagaagccgcagcaatatttatgacggcgacgcctcccgggtctgtggaggcctttccacaaagcaacgcagttatacaggacgaagagagagacatcccggagagaagctggaactctgggtacgagtggataaccgatttcccgggcaagacagtctggtttgtaccgagcataaagtcgggcaatgacatagccaactgcctaagaaagaatgggaagcgcgtaatccaactatcacgaaaaaccttcgacacggagtaccagaagaccaaaaacaacgactgggattacgtcgtgaccactgacatcagcgaaatgggcgcgaatttcagagccgatagggtcattgatccacggcggtgcttaaaaccggtaatacttaaggacgggccagaacgagtgattttagcaggacccatgcccgtcactgtggcttcggccgcgcagcgaagaggacgaataggacgaaaccataataaggaaggcgaccaatatatctacatgggccaaccgctaaataacgacgaagatcacgcacattggacggaggcaaagatgctcctagataacataaatacaccagaaggaatcattcccgcactgttcgaaccggaacgagaaaagagtgcggcaatagatggcgagtacaggctacggggcgaggctcggaaaaccttcgtagaactcatgagacggggcgaccttcctgtatggctcagctacaaggtggcaagcgaaggatttcagtactcagacagacgctggtgcttcgacggagagcgcaataatcaggtactggaagaaaacatggacgtggaaatatggaccaaagaaggggaaagaaagaaattacgtcctcgctggttagacgcaagaacatatagcgacccactagcactgcgagagttcaaggagttcgccgctggaagaagaagcgtctccggggatttaatccttgagatcggcaagctacctcaacacctcacccagagagcacaaaatgcgctcgacaatctagtgatgctgcacaactcggagcaaggaggacgcgcctatagacacgccatggaggaattgcccgacacgatagaaacgctgatgctgctcgccctcatcgcagtgctgacaggcggcgtcacactgttcttcctcagcggacggggactggggaagaccagcatcggcctactgtgcgtcatggcctcaagcgtattgctgtggatggccagcgtagaaccgcactggatagcggcttctatcatactcgagttctttctgatggtactgttaatacccgaacccgaccgtcagcgaacgccccaagacaaccaactggcatacgtagtaatcggtctactcttcatgatcctcacagtggcggccaatgagatgggacttctcgagacaactaagaaagacctaggaataggccacgtagcagtggaaaatcaccaccacgcggcaatgctggacgtagacctacacccagcatccgcctggaccttgtacgcagtggccacaacgataatcacacccatgatgcgacacacaattgagaacaccaccgcaaatatttcgctaacggccattgccaaccaagcagctatactcatgggcctagataagggctggcccatctccaagatggacataggcgtccctttgctggccctaggatgctactcgcaagttaaccccttgacactaacggcggcagtcctgatgctggtggcacactatgcaataataggcccaggcctgcaagccaaagcaacgcgagaagcacagaaaagaacagccgcaggaatcatgaaaaaccccacagttgatgggatcgtcgcaattgacctcgaccccgtagtgtacgacgcaaaattcgagaagcaactaggccaaataatgttgctcattctctgcacatcacaaatcctgctgatgagaacaacttgggcactctgcgaatccatcaccctcgcgaccggtccattgacgacattatgggaaggcagtcccggcaagttttggaacacaacaatcgcggtctctatggccaacatattcagggggagctacctagctggggcaggcctcgccttttcccttatgaaaagcctgggaggaggcaggcgaggaaccggagcgcagggcgagaccttgggagagaaatggaagcgtcagctcaaccagctatccaaatccgagtttaacacgtataagcgatcaggcatcatggaggtggacagaagcgaggccaaggagggtcttaaaagaggagaaacgacgaagcatgcggtgtcccgggggaccgccaagctacggtggtttgtggaacgcaatctcgtgaaacctgaagggaaagtcatagatctaggatgtggccgaggtggctggagttactattgtgctggcctcaagaaagtcaccgaagtaaagggctatacaaaaggcgggcctggccacgaagaaccaatacccatggcgacctatgggtggaatctagtgaagttgcacagcggcaaagatgtgtttttcatcccgcccgagaaatgtgacaccctactatgcgacatcggggaatcgtcccccaacccaacgatagaagaaggaagaacgctgcgcgtgcttaagatggtggagccgtggctacgtggcaaccaattctgcattaaaatattgaacccatacatgccaagcgtggtggagacactagagcagatgcagaggaagcatggaggaatgctggtccgcaatcccctaagcaggaactcgacacacgagatgtattgggtgtcctgcggaacaggaaacatcgtcagcgcagtcaacatgacatctcgaatgctactgaacagattcaccatggcccaccgcaagcccacctacgaacgggacgtcgacctgggtgccgggactcgccacgtggctgtagagcctgaagtagcgaacctcgacattatagggcaacgaatagagaacatcaaacatgagcacaaatcgacctggcactatgatgaagacaatccttacaaaacgtgggcataccacggatcatatgaggtaaagccatccggaagtgccagctccatggtaaatggtgtcgtgaaactactcacgaagccctgggacgtgattcccatggtaacgcaaatagcgatgacagacacaacgcctttcggccaacagcgcgtatttaaggaaaaggtggacacgcgcacaccaaaagcgaaaagggggacagcacaaataatggaggtaaccgccaaatggctctggggcttcctatcgcggaacaagaagccgagaatctgtacgagggaggagttcactaggaaagtgagatccaatgccgcaataggtgctgtgttcgtggacgagaatcagtggaacagcgcaaaagaagcagtcgaagatgagagattctgggacctagtccacagagaacgagaactgcacaagcagggaaaatgcgcaacatgcgtatataatatgatgggcaagagggagaagaaactaggcgagtttggcaaagcgaagggatcccgcgcaatctggtacatgtggttgggcgcgagattcctcgaatttgaagccttgggcttcatgaacgaagaccactggttcagcagggagaatagcttgtcaggtgtcgagggggaaggcttacacaaacttgggtacatattacgtgacatatcaaaaatacccggaggaaacatgtacgcggatgatacggccggatgggatactcggattaccgaagacgacctacaaaacgaagctaaaatcacagacatcatggaacccgaacatgctctccttgcaaaatccatattcaaactcacctaccagaacaaagtcgtaagagtccaacgacccgcgaagaatggaaccgtaatggacgtgataagtagacgggaccaacgtggaagcggccaagtggggacgtacgggctaaacacgttcaccaacatggaagcgcaactaattcgacagatggaatcagagggaatattctcaccttctgaattggaaacaccgaacctagcaggacgggcattagactggctagagaaacacggagtggagcggctcaagagaatggccatctccggcgacgattgtgtcgtcaaaccaattgacgaccgctttgcaaccgcactaactgcgttaaacgacatgggaaaggtaaggaaagatattccacaatgggaaccgagcaaaggctggaatgattggcaacaggtaccattttgctcgcatcacttccaccagttgatcatgaaagacggccgagagattgtagtaccgtgcagaaaccaagacgaattagttgggagagcccgtgtgtcccaaggagcgggatggtccctccgagaaacagcgtgcctaggaaagagttatgcacagatgtggcaactcatgtatttccaccggcgtgacctgcggctggcggcgaacgcgatatgcagtgcggtccccgtggattgggtcccgacatcgcgcacaacgtggagcatacacgcacaccaccagtggatgactaccgaggacatgctaagcgtatggaaccgggtgtggatagaggagaacccctggatggaggacaaaacccacataagcagctggggagacgtcccgtacctcggaaaacgtgaggaccaatggtgcgggtcattaatcggactaaccgccagggccacctgggcgactaatatccaggtcgccataaatcaggtacgccggctgctcggtaacgaaaattatttagactacatgacctccatgaagcgattcaagaatgaaagcgacccggaaggggcactgtggtag

SEQ ID NO: 24431 - RNA, 9879 nt, synthetic construct
  misc_feature 1..9879: note = derived and/or modified CDS sequence (opt11) from DENV-1__HM181964__SS-prME
  source 1..9879: mol_type = other RNA
agcgtaaccatgctgctaatgctcatgcctaccgcactcgctttccacctaacgacacgtgggggcgaaccgcacatgatagtgtcgaaacaagaacggggcaaaagcctactatttaaaacgtctgccggggtgaacatgtgtaccctcattgcaatggatctaggtgaactctgtgaagacaccatgacatacaaatgcccccgaatcactgaaaccgaaccagacgacgttgactgttggtgtaatgcgactgatacatgggtcacatatggaacttgttcccaaaccggggaacaccgccgagacaaaaggagcgtggcattggcgccccacgtcggccttggtctcgaaaccaggacagaaacttggatgagctcggaaggagcatggaaacaaatacaacgagtcgaaacctgggcattacgccacccagggtttactgtaatcgcccttttcttagcacacgcaatcggcacgagtataacacaaaaaggtataatcttcattctcttaatgctcgtaacaccatcaatggccatgagatgcgtaggcatagggtcacgtgacttcgtagaaggactatccggagccacatgggtagacgtagtcctggaacacggatcgtgtgtaaccacaatggctaaagacaaacccaccctcgatatcgaattactgaagacggaggttacgaatccagcggtgctccggaaactctgtatagaagcaaagatttcaaatacaacaactgacagccgatgcccaacccaaggggaagcaacgctcgtggaggagcaagatgcaaactttgtttgccggcgaactttcgtcgacagaggatggggcaacggctgcggcctatttggaaagggaagcctcataacgtgtgcaaagttcaaatgtgtgacgaaattggaaggaaaaatagtccaatacgaaaacctaaaatacagcgtcattgttactgtacataccggggaccaacaccaagtcgggaacgaatccacagagcatggcacaaccgccaccatcactccccaagctcccaccacagaaattcaattaacggactatggagcactaaccctggactgctccccacggaccggtctggacttcaacgagatggtattgctcaccatgaaggagaaatcgtggttggtgcacaagcaatggttccttgacctgccactaccttggacttctggagcctcgacatcgcaggagacatggaaccgacaagacctcttagtgaccttcaaaacagcccatgcgaagaaacaagaagtcgtagtactcgggtcacaggaaggagcaatgcacaccgccctcactggggcaacggaaatccaaacctccggcaccacaacgatcttcgccggacacctgaagtgtcggctgaaaatggataagctcacactgcgaggcatgtcttacgtcatgtgcaccggctcattcaagctagaaaaggaagtcgccgagacgcaacatggtacagtcctcgtacaaataaaatacgagggcaccgacgccccctgcaaaatcccatttagcacccaggatgagaaaggcgtcacgcaaaacgggcgactgatcaccgccaaccccatcgtcacagacaaagagaaaccagtcaacatagaagctgaaccaccgttcggagagtcatacatcgtcatcggcgctggagaaaaggccttaaaactgtcctggttcaagaaaggatcgagcataggcaaaatgtttgaggccacggcacggggagccagaaggatggccatactaggggacacagcctgggactttggcagcattggaggagtgttcactagcgtgggcaaactggtccaccagatattcggcacagcgtatggggtcctttttagtggcgtaagctggacgatgaaaatcggaataggggtactgctaacttggctaggcctgaatagccgttctacatccctaagtatgacctgcatcgcagtcggcctagtcaccctctacctaggtgtgatggttcaggcagactcaggctgtgtaatcaactggaaaggaagggaattgaagtgcggaagcggaatcttcgttaccaatgaagtccacacatggacggagcaatacaaatttcaggcggattcgcccaaacgactaagcgccgcaatcggtaaagcgtgggaggaaggcgtctgcggcatccgttcagcgaccaggctcgagaacataatgtggaaacaaataagcaatgaactaaaccatatactcctggaaaatgacatgaagttcacggtagtagttggagatgtggcaggcatcctggcgcaagggaagaaaatgatacgaccgcaaccgatggaatacaaatacagttggaaaagctggggcaaagcaaaaatcatcggcgcggacgtacagaataccaccttcataatcgacgggccaaatactccggaatgtccggatgaccagcgagcatggaacatatgggaagttgaggactacggattcggaatattcacgaccaatatatggctaaaactccgagacagctacacccaggtatgcgaccaccggctaatgagtgcggcaataaaagacagtaaggcggtacatgcagacatgggatactggattgagagcgagaagaacgagacctggaaactagccagggcgtcctttatagaagtgaaaacctgcatctggccaaaaagccacaccctatggtctaacggggtgctagagagcgaaatgataatacccaagatatatggaggcccaatcagccaacacaactaccggccgggctactttacccaaacagcaggcccatggcacctggggaaattagaactcgattttgacttgtgcgaaggaaccactgtcgttgtagacgagcattgtggcaaccgaggccccagcctacgcacaaccacagtgaccgggaagataatccacgagtggtgctgtcgaagctgtaccttaccaccgctaagattccgaggcgaagatgggtgctggtacggtatggagattcgtcccgtcaaggaaaaagaagagaacctggtaaaaagcatggtctcggcaggtagcggcgaggtagacagtttcagcctcgggctactgtgtatatcgataatgatcgaagaggtaatgcgctcgcgatggtcccgtaagatgcttatgacaggaacgctagcagtattcttcctcttgatcatgggccaactaacttggaacgacctaatacgattatgcataatggtaggagcaaacgcaagcgacagaatgggcatgggcaccacgtacctagctcttatggcaaccttcaaaatgcgccccatgttcgcggtcggcttactgtttcggagactgaccagtcgggaagttctattattaaccatcggtctgtcgctagtcgcatcagttgaactcccgaacagcctagaagaactgggcgatggccttgctatggggatcatgatactaaagttgctcacagacttccagtcacaccaactctgggccaccctactcagtctaacgtttataaagacgacattttctctgcactgcgcatggaagactatggcaatggtcttgagcatagtcagtctcttccccttgtgtttgtccaccacgagccagaaaacgacatggttaccagtgcttctcggatcgctgggatgcaaaccattaaccatgttcctgatagcagaaaacaaaatatgggggcgcagatcctggccgctgaatgaaggcatcatggcagttggcatagtcagtatactcctatcgtcattactcaaaaacgacgtccctctcgcgggaccgctgatagcaggaggaatgctcatagcctgctatgtgatcagcggaagctcggcagacctaagcctcgagaaagccgccgaagtatcatgggaagaagaagcggagcacagcggcgcaagtcacaacatcctggtagaagtgcaagacgacgggaccatgaagatcaaggatgaagaacgtgacgatacactcaccatactactgaaagcaactttattggcagtgtccggcgtctacccgttgagtatcccagcgacgctattcgtctggtacttctggcagaagaagaaacaacgctccggggtgttatgggatacgccaagcccgcccgaagtagaacgagctgtacttgacgacggtatctatcgcataatgcaacgtggcctactcgggagatcgcaagtgggagtaggtgtattccaggaaaacgtttttcacaccatgtggcacgttacgcgtggggcagttctaatgtaccaagggaaaagactggaaccgtcttgggcaagcgtaaagaaagacctgatctcatatggagggggctggaggctacaaggttcgtggaacacaggtgaagaggtacaagttatagccgtcgaacctgggaaaaaccctaaaaatgtacaaacggcacctggaacgttcaagacgccagaaggagaagtaggagcgatagctctggatttcaaaccgggaaccagcggatcaccgatagtgaaccgcgagggcaagatagtagggctatatggcaacggagtagtaacaacgtcggggacctacgtctcagctatagcacaagcaaaagcaagccaagaaggaccacttcccgaaatagaagatgaagtcttccgtaagcgaaacctcacgatcatggacctacacccaggatccgggaagacacgaaggtacctacctgccatcgtgcgggaggcaatcaaacgaaaactacgaaccctaattttagcaccgacacgagtggtagcatccgagatggccgaggccctcaaaggaatgccaataaggtaccagacgaccgcagtaaagtccgaacacacgggcaaagaaatagtggacctgatgtgccacgctacatttactatgcggctactgagcccagtgcgggtaccgaattacaacatgattataatggatgaagcgcacttcacggatccaagcagcatcgccgcacgggggtacatcagtacacgcgtaggcatgggagaagcggccgccatatttatgaccgccacacccccagggagcgtggaagcgttccctctatcaaacgcagtaatacaggatgaagaaagggatataccagaacgaagctggaactccggatacgaatggataacagacttccccgggaaaactgtctggttcgtgccatcgatcaaatcaggtaacgacatagctaactgcttaagaaagaacgggaagcgcgtaattcaactatcacgaaagacattcgacactgaataccagaaaaccaagaacaacgactgggactacgttgtcaccacagatatctcagaaatgggagcgaacttccgagcggaccgggtaatcgatccgcgtcgatgtcttaaaccagtaatattgaaagacggcccagagagggtgatactggccgggcctatgcccgtcaccgtagcttcggcagcacagcgcaggggtaggataggcagaaaccacaacaaggaaggcgaccagtatatctacatggggcaaccgttgaacaacgatgaggatcatgcccactggacggaagccaaaatgctcctagacaacatcaacacgccagaggggatcatccccgctctattcgagcctgaacgcgaaaagagcgcggcaatagacggcgagtaccggcttcggggagaggcacgtaaaacgttcgtagagcttatgagacggggcgacctgccggtgtggctaagctacaaagttgctagcgaaggcttccaatactcggaccggagatggtgcttcgacggtgagagaaataatcaagtgctagaggaaaacatggatgtggagatttggaccaaagaaggcgagcgcaagaaactgcgtccaagatggctagacgcgaggacttactcggatcctctcgcgctgagggaatttaaggagttcgcagcagggagacgatcagtgtcaggcgacttgatattagagatcgggaagctgccccaacacttaacgcagagagcacagaatgcgctcgacaacctggtgatgctacataacagcgagcaaggaggtagagcataccgacacgcaatggaagaactaccagacaccatcgaaacattgatgctattagcgctgatcgctgtccttacgggtggagtaacactattctttttatcaggccggggactcggcaaaaccagcatcggcctgttgtgcgtcatggcctcgtccgtcctcctatggatggcttcagtggagccacactggatcgcggcgagtattatcttagagttcttcttaatggttctattgatcccagagccggacaaacagagaacgcctcaggacaaccaactggcatacgtcgtcataggactcctcttcatgatcctcacagtggccgcgaacgaaatgggcctacttgagaccacgaagaaggacctaggcatcgggcacgtagcggtcgaaaaccaccaccacgctgccatgctagatgttgacttacacccagcgtccgcatggacgttatacgccgtcgcgacaacgataataacaccaatgatgagacatacaatagagaacaccacagcaaacatcagcctaacggcgatcgcaaaccaggccgcaatcctcatgggactagacaagggctggccgatctccaaaatggacatcggggtaccgttgctcgcactagggtgctactcccaagtaaacccactcaccttgacagcagctgtccttatgctagtagcccactacgcgatcataggaccgggcttacaggccaaagctacccgagaggcacaaaaacggacggcggcgggaatcatgaaaaaccccacagtagacggcatagtagcaatagacttggacccggtagtctacgacgcgaaattcgagaaacagttgggacagatcatgctcctaatcctatgcaccagccaaatcctgttaatgagaacgacttgggcactgtgcgaatccatcacccttgcgacaggccctctaacaaccctctgggaaggctccccaggcaaattctggaatacgacaattgccgtatcaatggcaaacatatttaggggatcatatctggccggagcgggcttagcgttctctctcatgaagagtctcggcggaggccgacgagggacaggggcacaaggggagacgttaggagaaaaatggaaaagacaacttaatcaactcagcaagagtgagttcaacacctacaaacgtagcggcataatggaggtcgacaggtcggaagccaaagaggggttaaaacggggagaaaccaccaaacacgcagtcagccgtggaaccgccaagctcaggtggtttgtggaacgcaacctagtaaagccagaagggaaagttatagacctcgggtgcggtagaggagggtggagctattactgtgctggactaaagaaagtaacagaagtaaaggggtataccaaaggcggaccaggccatgaagaacccatccccatggcaacctacggatggaatttagtcaaactccactcaggaaaagatgtatttttcattccacccgaaaagtgcgacacgttgctttgtgatatcggggaaagctcccccaatccaacaattgaagaaggtcggaccctccgagtgctgaaaatggtagaaccatggttacgcgggaaccaattctgcatcaaaatactaaacccatacatgccctcagtagtagaaacattagaacaaatgcaacgaaaacacggaggcatgctggttagaaatccacttagccgcaattccacacacgagatgtactgggtcagctgcggcaccgggaacatagtatcagcggtaaacatgacgagcaggatgttactaaaccggtttacgatggcccatagaaagccaacctacgagcgcgacgtggacctaggagctggaacgaggcacgtagcagtcgaacccgaggttgctaacctcgacataatcggtcaaaggatcgaaaatataaaacacgagcataaatcgacatggcattacgacgaagacaacccgtacaaaacatgggcttaccacggctcatacgaggtaaaaccaagcggcagcgcaagctcgatggtcaacggagtcgtgaaactgctaacaaaaccatgggatgtgatcccaatggtcacacaaatagccatgaccgacacgacgcccttcggacagcaaagagtctttaaggagaaggtagatacccgaaccccaaaggccaaaagaggtactgcccaaattatggaggtaaccgctaagtggctatggggattccttagtagaaacaaaaagccgaggatatgcacccgcgaagagttcacgcggaaagtcagaagcaacgctgcaataggagcagtatttgtcgacgaaaaccaatggaacagcgcaaaagaagccgtcgaagacgaacgcttctgggacctggtacacagggaacgggaactacacaaacaaggaaaatgcgcaacctgcgtgtacaacatgatgggcaaaagggagaagaaactaggagagttcggtaaagcaaaaggctcaagggcgatctggtatatgtggctaggggctcgcttcttggagttcgaagcacttggtttcatgaatgaagaccactggttcagtagagaaaatagtctgagcggcgtggagggcgagggcttacacaaacttggttatatcctccgcgacataagcaagatccccggagggaacatgtacgccgacgacacagccggctgggacactaggataacagaagacgacctacaaaacgaagcgcgaattacggacatcatggaaccagagcacgcactgttggccaaatcgatctttaaactcacctatcagaataaagtagtacgtgtccaacgacccgcgaagaacggaacggtaatggacgtcatttctcgccgtgaccagcgaggcagcggccaagtgggtacatacgggctcaatacgtttaccaacatggaagcccagctaatccgccagatggaaagcgaaggcattttctcgccatcggaactagaaacgccaaacctagcagagcgagtacttgattggcttgagaaatacggagtggagcgactaaagcgaatggcaatatcgggagacgactgtgtggtaaaacctatcgatgaccgctttgcgacggccttgacggccttgaatgacatggggaaagtacgcaaagacatcccccaatgggaaccctcaaaagggtggaacgactggcaacaagtccctttttgcagtcaccactttcaccaacttattatgaaggacgggcgagagatcgtagtcccctgtcgcaatcaagatgaattggtcggcagggctcgagtatcccagggcgctggctggtcgcttagagaaactgcatgtttagggaaatcctatgcacagatgtggcagctcatgtactttcaccgcagagacctaaggctagcagcaaacgccatatgttcggccgtacccgtagattggatccccacgtcccgcacgacctggagcatacacgcgcaccaccaatggatgactaccgaggacatgttaagcgtgtggaaccgtgtctggatagaagaaaatccctggatggaggacaaaacgcacatctcttcttggggcgacgttccctacttggggaagagggaggaccaatggtgcgggtcactcattggactgaccgcgagagcaacatgggcgaccaacatccaggtagcgatcaatcaagtaaggcgactcatcggcaatgaaaactacctggactacatgaccagtatgaagaggttcaaaaacgagagcgatccagaaggagccctatggtga

SEQ ID NO: 24432 - RNA, 9879 nt, synthetic construct
  misc_feature 1..9879: note = derived and/or modified CDS sequence (opt11) from DENV-1__HM181966__SS-prME
  source 1..9879: mol_type = other RNA
agcgtgaccatgctgctcatgctgatgcccaccgccctagcattccacctaacaacgcggggcggggagccccacatgatcgtaaccaagcaggagcgggggaagagtctgctgttcaagacgagcgtgggggtgaacatgtgtactctcatcgccatggatctcggcgaactatgcgaggacaccatgacctacaagtgcccccgcatcaccgaggccgagcccgacgacgtggattgctggtgcaacgccacagacacgtgggtgacgtacgggacctgctcccagaccggggagcatcggagagacaagcggagcgtggcgctcgcgccccacgttggcctggggttagagacccgcaccgaaacctggatgtcctctgagggcgcgtggaagcagatccaacgggtggagacgtgggccttgaggcaccccgggttcaccgtgatcgccttattcctggcccacgccatcggcaccagtatcacgcagaaagggatcatcttcatcttattaatgctggtcacgcccagcatggccatgcggtgcgtgggcatcggctctcgcgactttgtggaggggctcagcggtgccacctgggtcgacgtcgtgctggaacacggctcgtgcgtaaccaccatggccaaggacaagcccacgttggacatcgaactcctgaagaccgaagtgaccaaccccgccgtgctgcgaaaactttgcatcgaagccaagataagcaataccactaccgattccagatgcccgacccaaggtgaggccaccctgatggaagaacaggacgccaacttcgtctgccggcgcacgttcgtcgatagaggctggggaaacggctgtgggctgttcggcaaggggagcctcatcacgtgcgccaagtttaagtgcgtcaccaagctggaggggaagatcgtccagtacgaaaacctcaagtactccgtaatcgtgacggtccacacgggtgaccagcaccaggtggggaacgagagcaccgagcacggcaccaccgccaccatcacgccgcaagcgcccacctccgagatccagctcactgactacggggccctgaccctggactgcagccctcgcacgggcctcgacttcaatgagatggttctgcttaccatgaaggagaaatcctggttggtgcacaagcagtggttcttagacttgccgctcccgtggacctcaggggccagcacgtcccaggagacgtggaaccgacaggacctgctcgtgaccttcaagactgcgcacgccaagaagcaggaggtcgtcgtgctcggcagccaggaaggggcgatgcatactgccctgacaggggccaccgagatccagacctccggcacaacgaccatcttcgccgggcacctgaagtgccgcctcaagatggacaagctaacgctgaagggcatgtcctacgtcatgtgcacagggtccttcaagctcgagaaggaggtggccgagacgcagcacgggaccgtgctggtccagattaagtacgagggcaccgacgcgccctgcaagatcccctttagcaccctggacgagaagggcgtcacgcaaaatggccggctgataaccgcaaacccgatcgtaaccgacaaggagaaacctgtcaacatcgaggcggagccacccttcggcgaatcctatattgtgatcggggccggggagaaggcgcttaagctgagctggttcaaaaagggctcctcaatcggcaagatgttcgaggcaacagcccgcggagcacggcgcatggccatactgggcgacacggcgtgggactttgggtccatcggcggcgttttcacaagcgtcggcaagctcgtccatcagatctttggcaccgcctacggcgtgctgttctccggcgtcagttggaccatgaagatcgggattggggtcctgctcacgtggctgggcctgaacagccgcagcacttccctcagcatgacctgcatagcagtggggctggtcactctgtacctcggcgtaatggtgcaggccgactccgggtgcgtcatcaactggaagggccgagagctgaaatgtggtagcggcatcttcgtgacgaatgaggtgcatacctggacagagcagtataagtttcaggccgacagcccgaagcgcctgtccgcggccatcggcaaggcgtgggaagagggggtatgcgggattcggagcgctacccgcttggaaaacattatgtggaagcagatctccaacgagctgaaccacatcctgctcgagaacgacatgaagttcaccgtggtggtcggagacgttgtggggatcttggcccaaggcaagaagatgatccgacctcaacccatggagcacaaatacagctggaaatcctggggtaaggcgaaaatcattggcgccgacgtccaaaacacgaccttcatcatcgatggacccaacactccggaatgccccgacgaccaacgcgcctggaacatctgggaggtggaggactacggctttgggatcttcaccacgaacatctggctgaaactccgggacagctacacccaggtgtgcgaccaccgcctgatgtccgccgcgatcaaggactccaaggcggtgcacgccgacatgggctactggatcgaatccgagaaaaacgagacgtggaagttggctcgggcctcgttcatcgaggtaaagacttgtatttggcccaagagccacaccctctggagcaacggcgtcctagagagtgaaatgatcatccccaaaatctacgggggccccatcagccagcacaactaccgccccgggtacttcacccagaccgcgggcccctggcacctagggaagctcgagttggacttcgacctgtgtgagggcaccaccgtcgtggtggacgagcactgcgggaatagagggccgtccctccgcacgaccaccgtcacgggcaagataatccacgagtggtgttgccggagctgcacattaccgccgctgcgcttcaagggggaggacggatgctggtacgggatggaaatacggccggtgaaagagaaagaggaaaacctcgtaaagtctatggtcagcgccggctctggcgaggtcgactccttctctctaggcttactttgtatttctatcatgatcgaggaggtgatgcgtagccgctggtcccgcaagatgctgatgaccggcacactggccgtcttcttgctgctgatcatgggtcagctcacgtggaacgatctgatccggctgtgcatcatggtgggcgcaaatgccagcgacaggatggggatgggcaccacctacctcgcgctgatcgccaccttcaagatgcgccccatgttcgccgtgggcctcctgttccggcgcctgacgtcccgggaggtactgcttctcactatagggctctccctcgtggcctccgtcgagctgcccaacagcctggaggagttgggcgacgggctggccatgggcatcatgatcctgaagctcctaaccgacttccagtcccaccagctgtgggcgacactgctgtcgttcacgttcatcaaaacgaccttatcccttcactatgcttggaagaccatggccatggtgttaagcatcgtgtcactgttccccctctgcttaagcacgacatcccaaaagaccacctggctgcccgtcctcctgggctctctcgggtgcaagccgctaacaatgttcctcatcgcggagaacaagatctggggccgcaaatcctggccgctgaatgaggggatcatggcggtcggcgtggtcagcatactcctgagctcactgctcaagaacgacgttcccctagccgggcccctgatcgccggcgggatgctgattgcctgctacgtgatctcagggtccagcgccgacctgtccctggagaaggccgccgaggtatcatgggaggaggaggccgagcactccggcgccagccacaacatcctcgtggaggtgcaggatgacgggaccatgaagattaaagacgaggaacgggacgacaccctgaccatcctgctcaaggccaccctgctggcggtttccggcgtgtacccgctaagcatcccggctacgttgtttgtgtggtacttctggcagaagaagaagcagcgctccggggtcctgtgggacacccccagcccgcccaaagtggagcgggccgtgctggacgacggaatttaccgtatcatgcagcggggtctcctggggcgatcacaagttggcgtgggcgtgttccaggagaacgtctttcacacgatgtggcacgtgacgcgaggcgccgtgctcatgtaccaggggaagcgcctggaacccagctgggcctcagtcaagaaggatctgattagctacggaggcggatggaggctgcagggctcctggaacacgggggaggaggtccaggtgatcgctgtagagcccggcaagaaccccaagaacgtgcagaccgcccccgggaccttcaagaccagcgagggcgaggtgggcgccatcgccctcgacttcaagcccgggacgtccggcagccccatcgtcaaccgcgaagggaagatcgtcggcctgtacggcaacggggttgtaaccactagcggcacctacgtgagtgctatagcgcaggccaaggcctctcaggaggggcccctgccggagatcgaggacgaggtcttccggaagcgcaatctcacgatcatggacctgcaccccggctctgggaagacccggcgctatctgcccgccatcgtccgggaggcgatcaagcgcaagctccggacactgatcctggccccgaccagggtggtggctagcgaaatggccgaggctctcaagggcatgccaatccgctaccagacgactgcggtcaagtccgagcataccggcaaggagatcgtggacttgatgtgccatgctacgttcacgatgcggctgctcagccccgtgcgcgttcccaactacaacatgataatcatggacgaggctcactttaccgatccgtccagcatcgccgcccgggggtacatttccacgcgcgtgggaatgggggaggcggctgctatcttcatgaccgcgacgccgcccggcagtgtggaggccttcccccagtccaacgcggtgatccaggacgaggagcgggacatcccggaacgaagctggaactccgggtacgagtggataaccgacttcccgggcaaaaccgtgtggtttgtgcccagcatcaagtccggcaacgacatcgccaactgcctgcggaagaacgggaagcgcgtcatccagctgagccggaagaccttcgacacagagtaccagaagaccaaaaacaacgactgggactacgtggtgaccaccgacatctccgagatgggagccaacttcagagccgaccgggtcatcgacccgcgccggtgcctcaagccggtcatactgaaggacgggcccgaacgcgtcatcttagcaggcccaatgcccgtgacggtggcgagcgccgcccagcggcgcgggcggatcggccgcaaccacaacaaggagggagaccagtacatctacatgggtcagccgctcaacaacgacgaggaccacgcccactggaccgaggcgaagatgctactggacaatatcaacaccccggagggcatcatccccgccctcttcgaacccgagcgggagaagtccgccgccattgacggggagtaccgtttacgcggagaggcgcggaaaaccttcgtggagctgatgcgtcgcggagacctcccggtgtggctgagctacaaggtggcgagcgagggctttcagtactctgatcgccggtggtgtttcgacggcgagcgcaataaccaggtcctggaggagaacatggacgtagagatctggactaaggagggggaacgtaagaagctccgtccccggtggctagacgcccgcacgtacagcgaccccctggcactccgtgagttcaaggagtttgcggccggccgacggagtgtgtccggggatctgatcctggaaatcggcaagctcccacagcacctgacacagcgcgcgcaaaacgccctggacaacctcgtcatgctgcataattcggagcagggcgggcgggcctaccgccatgcaatggaggagctgcccgacacgattgagacgctcatgctgctggcactcatagccgtcctgaccggaggggtgaccctgttcttcctctctggccgggggctgggcaagacctccatcggcctgctatgcgtcatggccagctcagcactgctctggatggccagcgtggagccccactggatcgcggcctccatcatcctcgagttcttcctgatggtgctgctcatccccgagcccgatcgtcagcggaccccgcaggacaaccagctggcctatgtcgtcatagggctcttgttcatgattctaacggtggccgccaacgaaatgggactgctcgagaccaccaaaaaggacctggggatagggcacgtcgcggtggagaaccaccatcacgccaccatgctggacgtagacctccacccagccagcgcctggacgttgtacgctgtcgcgaccaccatcatcaccccgatgatgcgccacacgatcgagaacaccactgccaacatctcactaaccgccatcgccaaccaggccgcgatcctcatggggctggataagggctggccgatatcaaaaatggacatcggcgtgccattactagccctggggtgttattcccaagtgaatcccctgactctcaccgccgcagtcctcatgctggtggcgcactacgctatcatcggccctggcttacaggccaaggccacacgggaggcccagaagagaaccgcggccggcatcatgaagaacccgacagtcgatgggatcgtcgccatcgacctggaccccgtggtgtacgacgccaagttcgagaagcaactgggtcagatcatgctcctgatactgtgcaccagccagatcctcctgatgcgaaccacctgggccctgtgcgagtccatcaccctcgcgaccggccccctgacgaccctgtgggaggggtccccagggaagttctggaacactaccatcgccgtgtccatggccaatatcttccgggggagctacctcgccggcgccggcctagcgtttagcctgatgaagtccctcgggggcggtagacggggtaccggagcccagggtgagaccctgggcgagaagtggaagcgccagctgaaccagctcagcaagtccgagttcaatatctataagcggagcgggatcatggaggtggaccgatccgaggccaaagagggcctgaagcgcggggagacgacaaggcacgccgtgagccgtggcacggcaaagctgcgctggtttgtcgagaggaacttggtgaagccggaggggaaggtgatagacctgggctgcgggcggggtggctggtcatactactgtgccgggctgaagaaggtcaccgaagtgaagggatacacgaagggcgggcccggccacgaggagcccatcccaatggccacctacgggtggaacctcgtaaagttgcacagcggcaaagacgtcttcttcaccccgcctgagaagtgcgacaccctgctgtgcgacatcggggagtccagtcccaaccccacgatcgaagagggccggacactccgagtcctgaagatggtggagccgtggctccgggggaaccagttctgcataaaaatcctcaacccctacatgccatccgtcgtggagaccctggagcagatgcagcgcaaacacggaggcatgctggtgcggaaccccctcagccggaactcgacccacgaaatgtactgggtcagctgtgggaccggcaacatcgtgtccgccgtcaacatgacgagccggatgctgttaaaccgattcactatggcccaccgcaagccgacctacgagcgagacgtcgacctcggcgcgggcacgcgccacgtggccgttgaacccgaagtcgcaaaccttgacattatcggccagcggatcgagaacatcaagcacgaacacaagagcacgtggcactatgacgaagacaacccctacaagacctgggcctatcacgggagctacgaagtgaagccctccggcagcgccagctccatggtcaacggggtagtgaagctgctaaccaagccgtgggacgtcatccccatggtgacccagatcgccatgacggacaccacccccttcggacagcagcgcgtgttcaaggaaaaggtggacacccggacccccaaggcaaagcgagggaccgcacagatcatggaggtgaccgcccggtggttgtggggcttcctgagccgcaacaaaaagccgcggatctgcacccgcgaggagttcacgcggaaggtacgctccaacgccgcgataggcgcggtcttcgtggacgagaaccagtggaatagcgccaaggaggccgtggaggacgagcgtttctgggacctcgtccaaaaggagcgcgagttacacaaacaggggaagtgcgcaacctgcgtgtacaacatgatggggaagcgggagaagaagctgggcgagttcggaaaggccaaggggtcccgcgcaatctggtacatgtggctcggtgcccgattcctggagttcgaagccctgggcttcatgaacgaagaccactggttcagccgagagaactccctcagcggggtggagggcgaggggctgcataagctaggctacatcctcagggacatttccaagatccctgggggaaacatgtacgcggatgataccgccgggtgggacacccgcatcacggaagacgatttacagaacgaggctaagattaccgacatcatggagcccgagcacgcgctgctggctaccagcatctttaagttgacctaccagaacaaggtcgttagggtgcagcgcccggcgaagaacgggacagtcatggacgtcatctcccgccgggaccagcgcgggagcggacaggtgggaacgtacggactgaacactttcaccaacatggaggcccagctcattaggcagatggagtccgaggggattttcctgccaagcgagctggagacgcccaatctcgctgagcgcgtcttggactggctggagaagtacggcgtggagcggttgaagcggatggccatatccggggacgactgtgtggtcaagcccatcgacgaccggttcgccaccgcgctcaccgccctgaacgatatgggcaaggtgcgcaaggatatcccacagtgggagccctcaaaggggtggaacgattggcagcaggtccccttttgcagtcaccatttccaccagctcgtcatgaaggacggccgggagatcgtggttccctgccgcaaccaagacgagctggttggccgcgctcgcgtgtcacagggggcaggctggagcctgcgggagacagcctgcctcgggaagtcctacgctcagatgtggcagctgatgtacttccaccgccgggacctgcgtctcgccgccaacgccatctgcagcgctgtgccagtcgactgggtgcccacgtcccggaccacctggtctatccacgctcaccaccagtggatgacaaccgaggacatgctctccgtgtggaaccgcgtgtggatcgaggagaacccctggatggaggacaagacccatgtgagctcctggggcgatgtgccctacctggggaagcgggaggaccagtggtgcggcagcctcatcggcctgaccgcacgagccacctgggcctccaacatccaggtcgcgatcaaccaggtccgccggctgatcgggaacgagaattaccttgactacatgacctccatgaagcgcttcaagaacgagggcgacccggagggggccctgtggtga

SEQ ID NO: 24433 - RNA, 9879 nt, synthetic construct
  misc_feature 1..9879: note = derived and/or modified CDS sequence (opt11) from DENV-1__GU131721__SS-prME
  source 1..9879: mol_type = other RNA
agcgtgaccatgttactgatgctgatgcccaccgcccttgccttccacctcaccacccggggtggggagcctcacatgattgtgtctaaacaagaacgaggcaaaagccttctgttcaagacgtccgctggggtgaatatgtgcaccctcatagccatggacctgggggagctgtgcgaggacaccatgacctacaagtgtccccggatcacggagaccgagccggacgatgtggactgttggtgtaatgctacggacacctgggttacctacgggacgtgctcccagacgggcgagcaccgccgcgataagcggtccgtagccctcgcgccccacgtgggcctggggctggagacgaggaccgagacctggatgagcagtgagggggcctggaaacagatccagcgggtggaaacgtgggccctccgccaccccgggttcaccgtgatagccctcttcctggcccatgcgatcgggaccagcatcacccagaaggggatcattttcatcttattaatgctggtgaccccctccatggcaatgcgctgtgtcggcatcggcagccgcgactttgtggaggggctatctggcgccacctgggtagacgttgtgctggagcacgggtcgtgcgtgaccacaatggcgaaagacaagcccacgcttgacatcgaactcctgaagaccgaagtgaccaaccctgcagtgctgcggaaactctgtatcgaagcgaagatatccaacaccacgaccgacagtcgctgcccgacacagggcgaagcgacgctggtggaggagcaggacgccaacttcgtgtgccgtcgaacgttcgtagaccggggctgggggaacggctgcgggctgttcggcaagggttccctcataacttgtgccaagttcaaatgcgtgacaaagctggagggcaagatcgtccagtacgagaacctgaagtacagcgtgattgtcactgtccatacaggagaccaacatcaagtggggaacgagtccaccgagcacggaactaccgccaccatcacgccccaggcacccacaacagaaatacagcttacggactatggggccctgacgctagactgcagccccagaacagggctcgacttcaacgagatggtgctgctgaccatgaaggagaaatcctggctcgttcacaaacagtggttcctcgacctccccctcccctggaccagtggggccagcacatcccaggagacctggaaccggcaggacctgctagtgactttcaagaccgcccacgccaagaagcaggaggtcgtggtgctcggcagccaggagggcgcgatgcacacggccctgaccggtgcgaccgagattcagacatccggcacgacgaccatcttcgccggacatctgaaatgccgcctcaagatggacaagctgaccctcaagggcatgtcctatgtcatgtgcactgggtcattcaagctcgagaaggaggtcgccgagacccagcatggcaccgtgctggtccaaatcaaatacgaaggcactgatgcaccatgcaagatcccctttctgacgcaagacgagaagggggtgacacagaacggccggcttattaccgcaaatccgatcgttaccgacaaagagaagcccgtcaacatcgaggccgagccgcccttcggggagagctacattatcatcggcgccggggaaaaggcgctcaagctgtcctggttcaagaagggaagcagtatcggcaaaatgttcgaagccacagccaggggcgcgcgtagaatggcaatcctgggcgacacagcttgggacttcggatcaatcgggggtgtgtttacctcggccgggaagttagtgcatcagatcttcggcaccgcctacggggtcttgtttagtggcgtgtcctggacaatgaagatcggtataggcgtactgctcacctggctgggtctgaatagccgctcaacctccctctcaatgacgtgcatagctgtcgggctggtaacgctctacctcggagtaatggtccaggccgacagcggttgcgtgatcaactggaaaggcagggagctgaagtgcgggtctggcatcttcgtaaccaatgaggtccatacatggaccgaacaatacaagttccaggcggactcgccgaagcgtttaagcgccgccattggcaaggcctgggaagagggggtgtgcggcatccggtcagccactcgcctcgaaaacatcatgtggaagcagataagtaatgagcttaaccacattttactcgaaaacgacatgaagttcacagtggtcgtgggggacgtggcggggatcctggcccaggggaagaaaatgatacggccgcagccgatggaatataagtacagctggaagtcctggggcaaggctaagatcatcggcgccgacgtccaaaataccacctttatcattgacgggcccaatactccggagtgccccgacgaccagcgggcgtggaacatctgggaggtcgaggactacggcttcgggatcttcactactaacatttggctgaaactgagagactcatacacgcaagtgtgcgaccaccgcctgatgagcgcagcaattaaagactccaaggcggtgcacgcagacatgggctattggatagagtcggagaagaacgaaacgtggaaacttgcgcgggcatccttcattgaagtgaagacgtgtatctggcccaagtctcacaccctctggtccaacggagtgctggagagcgagatgatcgtgcccaagatctacgggggcccgatttcccagcataactatcgcccggggtacttcacccagacggccggaccttggcacctcgggaagctcgagttggacttcgacctgtgtgagggtacaaccgtggtggtcgatgagcattgtggcaaccgcgggccgagcctcagaacgaccaccgtaaccggcaagattatacacgagtggtgctgtagaagctgcaccctgcctcccctgaggttccgcggggaggacggatgctggtacgggatggagatccgtcccgtgaaggagaaggaggagaatctagtcaagagcatggtatccgccggtagcggcgaagtcgacagcttcagtcttgggctgttgtgcatctcaatcatcatcgaggaagtgatgcggtcccgctggtctcggaagatgctgatgaccgggacgctggccgtgtttttcctcctaatcatggggcagctgacttggaacgaccttattcgcctgtgtattatggttggcgcaaacgcctctgaccgcatggggatgggcaccacctacctggccctaatggccacgttcaagatgcggcccatgttcgcagtcggccttctgttccgccgtctgacctctcgcgaggtgcttctgctcacgatcgggctgtccctggtggcgagcgtagaactccccaattccctggaggagctgggcgatggcctcgccatggggatcatgatcctgaagctgctcaccgacttccagtcgcaccagctgtgggccactctgctcagcctgaccttcattaagacaacgttcagcctgcactacgcctggaagacgatggctatggtattgtccatcgtatccctgttccctttatgcctaagtaccaccagccaaaagacaacgtggctgcccgtgcttctcggcagcctggggtgcaagccgctgaccatgtttctcatcgcagagaataagatctggggtagaagaagctggcccctgaacgaagggatcatggccgtgggaatcgtatccatcttgctcagctcgctgctgaagaatgacgtcccactcgctggtcctctgatagctggcggcatgctaatcgcgtgctatgtgatctccgggagctccgctgacttatcgcttgagaaggctgccgaggtctcatgggaggaggaggccgaacatagcggcgcgtcgcacaatatcctggttgaggtgcaagacgacgggaccatgaaaatcaaggacgaggaacgggatgacacactcaccatcctgctgaaggccacgcttctggccgtcagcggcgtttacccgctgtcgataccggccacgcttttcgtgtggtacttttggcagaagaagaaacagcgcagcggggtcttatgggatacgccctcaccgcctgaggtggagcgcgccgtgctagacgatggtatctaccgtatcatgcaacggggtctgttagggcgcagccaggtcggcgtgggagtgttccaggaaaacgtatttcataccatgtggcatgtgacgcggggtgcagtgctaatgtaccaagggaagcgcttagagccatcatgggctagcgtcaaaaaggacttaatctcctacggcgggggttggcgtctgcagggcagctggaacaccggggaggaggttcaggtgatcgcagtcgagcccggcaaaaatcccaagaacgtgcagaccgctcccggtaccttcaagacgcccgagggcgaggtgggcgcgattgcgctggacttcaagccagggacctccggctcccctattgtcaacagggagggtaagatcgtgggcctctatggcaacggggttgtcaccacctccggaacgtatgtcagtgcaatagcacaggccaaggcgagccaggagggacccctgcccgagatcgaagacgaggtgttccggaagcggaacctgactataatggatctccatccaggctcagggaagaccaggaggtacctgccggccatcgtccgcgaggcaataaagaggaagctgcgcactctcatcctggcccccacacgggtagtggcctctgaaatggcggaggcactgaagggcatgcccatccgctaccagaccaccgccgtcaagagtgagcacactggcaaggagatcgtagatctcatgtgccacgccactttcaccatgcggctgctatcgcccgtgagagtgccgaactacaacatgattatcatggacgaggcccactttactgacccaagttcaatcgcggctcgaggatatatcagcactcgggtggggatgggggaggctgccgcgatattcatgaccgcgactccacccggcagcgtggaggccttcccgcaatccaacgccgtgatccaagacgaggagcgggatattcccgagcgcagctggaactccgggtacgaatggatcaccgacttccccgggaagaccgtgtggttcgtgccgtccatcaagtccggcaacgacatcgctaactgcctcagaaagaacgggaaacgagtcattcagctgagtcgcaagacgttcgacaccgaataccaaaagaccaagaacaacgactgggactacgtcgtgaccacggacatctccgagatgggcgcgaactttcgagccgatcgggtgattgacccgcgccggtgcctcaagccagtgatcctcaaggacggaccagagcgcgtaatcttggccgggccaatgccggtcaccgtggctagcgctgcgcaacggcgcgggcggatcggccgcaatcacaacaaagagggggaccagtacatctatatggggcaacctctgaacaacgacgaggaccacgcgcattggacagaggccaagatgcttcttgacaacatcaacacccctgagggcataatcccagccctgtttgagcctgagagagagaagtccgctgcgatagacggcgagtaccggctccgcggcgaggcccggaagacgttcgtcgagctaatgcgccgcggtgatctgcccgtttggctcagctacaaggttgcctctgagggatttcagtactcagatcgccggtggtgcttcgacggcgagagaaacaaccaggtcctagaggagaacatggacgtggaaatctggacaaaggagggggaacgtaaaaagctgcgcccccgctggctcgacgcccgcacttacagcgaccccttagccctgagggagtttaaggagttcgcggcggggcgccgctctgtgtccggcgacttaatcctagagatcggcaaacttccgcaacacctcacccagagggctcagaatgcactggacaacttagtcatgctccacaacagcgagcaaggtgggagagcgtatcgtcatgcaatggaggagctgcccgatacgatagagacgctgatgctcctggccctgatagccgtgctaaccggcggggtgaccttattcttccttagcggccgggggttggggaagacatccattggcctgttgtgcgttatggcaagctccgtgctcctgtggatggcgtctgtagagccccattggatagctgcctccatcatcttggagttcttccttatggtcctcctaattcctgagccggaccggcagcggacgcctcaggacaaccagctcgcctacgtagtgatcgggctactcttcatgatcctcaccgtcgccgcaaacgagatgggccttctggagaccactaagaaggacctagggatcgggcacgtggccgttgaaaaccaccaccacgcggccatgctcgacgttgacttgcgccccgccagcgcgtggaccttatacgccgtagccaccaccatcatcaccccgatgatgcgccacacgatagagaacactacggccaacatctccttgaccgccatagcgaaccaagcggccatccttatgggcctagacaagggctggccgatcagcaaaatggatattggcgtgccgctgctggccctcggatgttacagtcaagtgaaccccctgacgctaacggcggccgtgctcatgctggtggcacactacgcaattatcggccccgggttacaggcaaaggctacccgggaggcacagaagcgaaccgcagccggcatcatgaagaatcccacggtagacgggattgtggctattgatctcgaccctgtagtttacgatgccaagttcgagaagcagctgggccaaatcatgctgctgatactgtgtaccagccagatcctgctcatgcggacgacctgggccctgtgtgagtccataacgctggccaccggccccctcaccacgctgtgggaggggagcccgggtaagttctggaatactacgatcgctgtgtccatggccaacatcttccgcgggtcttacctggcaggagcaggcttagccttttcgctcatgaaatcgctcgggggcgggcgcagagggaccggggcacagggcgagaccttaggtgagaaatggaagcggcagttaaatcagctaagcaagtccgagttcaacacctacaagagatccgggatcatggaggtggaccgatccgaagcgaaggaaggtctcaagcgcggggagaccactaagcacgccgtctcgcggggcaccgccaagctgcgctggtttgtagagcgcaacctggtgaaacccgagggaaaggtcatcgacctgggctgcgggcgtgggggctggtcctactattgcgccgggctcaaaaaggtcaccgaggtgaagggctacaccaagggcggaccgggacacgaggagcccatccctatggctacatacgggtggaacttggtcaagctacacagcggcaaggatgtgttctttataccacccgagaagtgcgacaccctcctgtgcgacattggggaatcctcccccaacccgacgatcgaggaaggccgcaccctgcgtgtactcaagatggtcgagccttggcttcgggggaaccagttctgcatcaagatcctgaacccatacatgccatcggtagttgaaactctcgaacagatgcagcgcaagcacggcggcatgctggtccggaacccgttaagccgcaacagtacgcacgagatgtattgggtgtcgtgtgggaccggaaacatcgtatccgcagtcaacatgacgagccggatgttactgaaccggttcaccatggcccatcgcaagccaacctacgaaagggacgttgatcttggggccggcactcgtcacgtggccgtcgagcctgaagtggcgaacctcgacataataggtcagcggatagagaatatcaagcacgaacacaagtccacatggcactacgacgaggacaacccctacaaaacatgggcgtaccacggatcgtacgaggttaaaccgtctggctccgctagttctatggtaaacggggtggtcaagctgctgaccaagccatgggacgtgatccccatggtgactcagatcgccatgaccgacacaacgccgttcggccaacaacgagtattcaaggagaaggtggacactcgtactccaaaggcaaagcgcgggacggcccaaatcatggaggtgaccgcgaaatggctctggggcttcctgagccggaataagaagccccgcatctgcacgcgggaggagttcacgcgcaaggtccggtccaacgcggccatcggagctgtgttcgtggacgagaaccagtggaatagcgcaaaggaggccgtcgaagacgagcgcttctgggacttagtacaccgggagagggagctccacaaacaggggaagtgcgcgacctgcgtttacaatatgatgggcaagcgggagaagaaactgggggagtttggcaaggcaaagggctcccgcgccatctggtatatgtggctgggcgcgcggttcctcgagttcgaggccttgggcttcatgaacgaggaccactggttctcgcgcgaaaattcccttagcggcgtagagggagagggtctgcataagctgggttatatcctccgggacatctcaaagatacccggtggtaacatgtatgcggacgataccgccggctgggacacgcgcataacagaggacgatctgcaaaacgaggcccgcatcaccgacatcatggaacccgagcacgcattgctggctaagtctatcttcaagctcacctaccagaacaaagtggtgcgggttcaaaggcccgcgaagaacggaacggttatggacgtgatatcccgcagagatcaacgtggaagcggtcaggtcggaacgtacggcctgaacacgttcaccaacatggaggcccaactcattcgccagatggaatccgaaggcattttcagcccgtcggagctcgagacccccaacctggcggagcgcgttctggactggctagagaaatacggagtggagcgtctgaagcggatggcgatcagcggcgacgattgcgtcgtcaagccgatcgatgaccgcttcgccactgccctgaccgctctgaacgacatgggcaaggtgcgcaaggacatcccccaatgggagccctccaaggggtggaacgactggcagcaggtccccttctgtagccaccattttcatcagctgatcatgaaggacggccgcgagatagtggtgccctgtcgtaaccaagacgagctggtcggtcgtgcaagagtgtcccaaggggcgggttggtctctgagagaaaccgcctgtctgggcaagagctacgcccagatgtggcagctgatgtacttccaccggcgcgacctcagacttgccgcgaatgccatctgctcagccgtgcccgtcgactggatccccaccagccgcacgacctggtccatccacgcacaccaccaatggatgaccaccgaagacatgttgagcgtgtggaacagagtgtggatcgaagagaacccttggatggaggacaaaacgcacatctcttcgtggggagacgtcccgtacctcgggaagcgggaggatcagtggtgcggatccctgattggcctgaccgcccgcgcgacatgggctaccaacatccaagtggctatcaaccaggtgcggcgcctcatcgggaacgaaaactacctggattacatgaccagcatgaagcggtttaaaaatgagggcgagccggagggtgccctttggtga

SEQ ID NO: 24434 - RNA, 9879 nt, synthetic construct
  misc_feature 1..9879: note = derived and/or modified CDS sequence (opt11) from DENV-1__GU131723__SS-prME
  source 1..9879: mol_type = other RNA
tccgtgaccatgctgttaatgctgatgcctaccgcgctggcattccaccttactactcggggaggggagccccacatgatagtgagcaagcaggagcggggcaaaagcctgctattcaagaccagcgcaggcgtcaacatgtgcacgctcatcgccatggacctgggcgaactgtgcgaggacaccatgacctataaatgcccgcggatcaccgagaccgagcccgacgacgtggactgctggtgcaacgccacggatacatgggtcacctacgggacttgcagccagactggcgaacatcggcgcgacaagagatccgttgctctcgcgccccatgtcggcctgggattagaaacccggaccgaaacctggatgagctccgagggagcctggaagcagatccagcgggttgaaacgtgggcactccggcacccggggttcaccgtgatcgccctgtttttagcccatgcgatcggaacctctattacccagaaggggattatcttcattctgctgatgctggttacaccttccatggcaatgcggtgcgttggcatcggcagtcgcgacttcgtggaggggttgtctggggctacatgggtggatgttgtgctggagcatgggtcgtgcgtgaccacaatggccaaggacaagccgacgctcgacattgagctcttaaagaccgaggttaccaatcctgccgtgctacgtaagctctgcatcgaggcgaaaatcagcaacaccacgacggactcccgctgcccgacccagggcgaggccacactggtggaggaacaggacgccaatttcgtctgtcgtagaacgttcgtggaccgtggctgggggaacggctgcggactgttcggcaagggctccctcatcacgtgcgctaaatttaagtgcgtgaccaagctggagggaaagatcgtccaatacgagaacctaaagtacagcgtaatagtcacagtacatacgggagaccagcaccaggtggggaacgagtccaccgaacacggcaccaccgccacaatcacaccccaggccccgaccaccgagatacagctcacagactacggggccctgaccttagactgctcaccccgcactggtcttgattttaacgagatggtactgctaaccatgaaggaaaaatcctggctcgttcacaagcagtggttcctggacctgcctctgccgtggactagcggggcctctacgtcccaggagacctggaatcggcaggatctcctagtgacattcaagaccgcacacgccaagaagcaggaggtcgtggtgctcggctcacaggagggtgccatgcacaccgccctgacaggggccaccgagatccagacctccggaacaaccaccatctttgctgggcatctgaagtgccgcctcaaaatggacaagctgaccttgaaaggaatgagctacgtcatgtgcacaggttcgtttaaactagagaaggagctggccgagactcagcatggcacggtcctggtgcagattaagtacgagggcaccgacgcgccctgcaagataccattttcgacgcaagatgagaagggggtcacccagaacggtcggctgatcaccgctaacccgatcgtgaccgacaaagagaagcctgtgaacattgaggctgagcctccatttggggagtcgtatattgtcataggtgcaggcgaaaaggcgctcaagctgagctggttcaagaagggatcctcaattggaaaaatgttcgaggctacggccaggggggcccgacgtatggcaatcctaggcgacaccgcctgggatttcggttcgattgggggcgttttcactagcgtaggcaagctcgtacaccagatctttggtactgcctacggtgtactgttctcgggcgtgtcttggacaatgaagatagggattggcgtcctgctcacatggctgggcttgaactcccgatcgaccagtctctctatgacttgtatagcagtggggctagttacgctttacctcggggtcatggtgcaggcagactccgggtgtgtaatcaactggaaaggacgggaattgaagtgtgggtctggcatatttgtcacaaacgaagtgcacacctggacagaacagtacaagttccaagctgacagcccgaaacgcctgtccgcggcgatcggcaaggcctgggaagagggggtgtgtggcatccggtcagctacacgcctagagaacatcatgtggaagcagatctctaacgagttgaaccacatcttactcgagaacgatatgaagttcacggttgtagtaggggacgttgccggcatcctggcgcaggggaagaaaatgatccggcctcagcccatggagcacaagtatagctggaagtcctggggaaaggcgaagataatcggcgccgatgtgcagaacaccaccttcattatcgacgggcccaacacgccggagtgtcccgacgaccagcgtgcctggaacatctgggaagtcgaagactatggattcggcatattcacgaccaatatttggttaaaactcagggactcatacacccaggtgtgtgatcaccgcctgatgtccgcggccatcaaggatagcaaagccgtgcacgccgatatgggatattggatcgagtccgagaagaacgagacctggaagctggcccgcgcgagcttcatcgaggtgaaaacgtgcatatggcctaagtcccataccctctggagcaacggcgtcctggagtccgagatgatcatacccaagatctacggcggcccaatcagccagcacaactaccgcccagggtacttcacccagaccgccggcccgtggcacttgggaaagctcgaactggacttcgatctgtgcgagggcacgaccgtggtggtggacgagcactgcggcaaccggggtccgtccctccgcaccacaacggtgaccggcaaaatcatacacgagtggtgctgccggagttgcacccttccgccgttgcgcttccgcggggaggacgggtgctggtacggaatggagatcaggcccgtgaaggaaaaggaagaaaacctcgtaaagtccatggtatctgctggcagcggcgaggtagactcctttagcctgggcctgctctgcatttctataatgatcgaagaggtcatgcggagccgctggtcccgtaagatgctgatgaccggcacactagccgtgtttttcctcctgatcgtggggcagctgacctggaacgatctcatcagactgtgcatcatggtgggcgccaatgcctccgaccgtatggggatgggcactacgtacctagcgctcatggccacattcaagatgcggccgatgtttgccgtgggcctgctgttccgccggctcacttcgagagaggtgctgttactgaccattgggctgagcctggtggcatccgtggaattacccaactcactggaggaactgggagacgggctcgcaatgggtatcatgatcctcaagctgctcactgacttccaatcccatcagttgtgggccacgctgctcagtctgacgttcatcaagacgactttctcgctgcattacgcgtggaagacgatggcgatggtccttagcgtggtatccctattccctctatgtctctcaaccaccagccagaagaccacgtggctacccgtcctgctcggcagcctgggatgcaagccgctgacaatgtttctcatagcagagaataagatctgggggcggcgctcctggcccctgaacgaagggataatggcggtgggaatcgtgagcatcctgctcagctccctgttgaagaacgacgtccctcttgccgggcccttgatcgccggcggcatgctgatcgcgtgttacgtcatatcagggtctagcgccgacctctcattggagaaggcagccgaagttagctgggaggaagaggccgagcattctggcgccagccacaacatcctcgtcgaggtgcaggacgacggtaccatgaagataaaggacgaggaaagagacgataccctcaccatactgctgaaggcgactctccttgcagttagcggcgtctacccgctgagcatacctgccacactcttcgtttggtacttctggcagaagaaaaagcaaaggtccggtgtgttgtgggacaccccaagcccgccagaggtcgaacgggccgtgctggacgatggcatataccgcatcatgcagcggggcctgctcggccgctcccaggtaggcgtcggcgttttccaagagaacgtgttccacaccatgtggcacgtcacgcggggcgcggtgcttatgtaccagggtaagcgcctggagcctagctgggcgtcggttaaaaaggatcttatcagttacggcggtggatggcggctccagggctcttggaataccggggaagaggtccaggtgattgctgtggaacccggcaagaaccccaagaacgtccaaaccgccccggggaccttcaagacgcccgaaggggaggtgggcgccatcgctctggactttaagcccggaaccagcggatcccccatcgtgaaccgcgaggggaagatagtcggactctacggcaacggggtggtgacaaccagcggcacgtatgtcagcgccatagcgcaggctaaggcttcgcaagaggggcctctgcctgagatcgaggacgaggtgttccgcaagcgcaatctgaccattatggacctccaccccggatccggaaaaacccggcgctacctgccggcgatcgtccgcgaggccataaagcgcaaactgcgtaccctcatcctagctcccacacgggtcgtggcctccgagatggccgaggcgctgaagggcatgcctatacgctatcagacaaccgccgtcaaaagcgaacacaccggcaaggaaatcgtcgacctgatgtgccacgccacgttcaccatgcggctgctgagccccgtgcgagtgccgaactataacatgatcataatggacgaagcccacttcaccgatcccagctctatcgccgctcgggggtacataagcacccgcgtcggcatgggggaggccgccgccatcttcatgacggctacgccgcccggatccgtagaggcgtttccgcagagcaacgccgtgatccaggacgaggaacgggacattcccgagcgctcctggaatagcggatacgagtggatcactgacttccccggtaagaccgtctggtttgttccctccatcaaatccggcaacgacatcgccaactgcttacggaaaaatgggaagagagtgatccagctgtcccggaagactttcgacactgagtaccaaaagaccaaaaacaacgattgggactacgtcgtgaccacggacattagcgagatgggagccaacttccgcgccgatcgagtcatcgaccctcgcagatgtctgaaacccgtgatcctcaaggacgggcccgagagggtgattctcgccggccctatgcctgtcaccgtcgcatccgccgcccagcgaaggggtcgtgttggacgcaaccacaacaaagaaggggatcagtatatctacatggggcagccactgaacaacgacgaggaccacgcgcattggaccgaggctaagatgctcctcgacaacatcaacacgcccgagggcatcattcccgctctgttcgaacctgaacgtgagaaatccgccgccatcgacggggagtaccggctccgcggcgaggcgcggaagacgtttgtcgagttgatgcgcaggggggacctgccggtgtggcttagctataaggtggccagtgaaggatttcaatacagcgaccgccgatggtgcttcgatggcgagcgcaacaatcaggtactggaggagaatatggatgtggagatctggaccaaggaaggggaacggaagaagttacgcccccggtggctggacgcacgaacgtacagcgacccactcgccctgcgcgagtttaaggaattcgcggcgggccgaaggagcgtgtccggggacctcatcctggagatcgggaagctcccgcagcacctcacccagagagcccagaatgccctggacaaccttgtcatgctccacaatagcgagcagggtgggcgggcctaccgtcatgcgatggaggagctccccgacacgatcgagaccctgatgctcctggcattgatcgctgtcctgactggaggggtgaccctgttttttctttccggtcggggcctcgggaagacctcaattggcctgctatgcgttatggcctcgtctgtactcctctggatggcgtccgtggagccccattggatcgcggcaagcataattttggagttctttctaatggtcttgctgatccccgagccggaccggcagcggacgccacaggacaaccagcttgcttacgtggtgatcgggttacttttcatgatcctcacagtagcagccaatgagatgggcctactagagaccaccaagaaggacctcggaatcggccacgtggcggtggagaaccaccaccacgccgccatgctggacgtagacttacaccccgctagtgcctggacgctctacgcggtagctactaccataataaccccaatgatgaggcatacaattgagaacacgaccgccaacatcagcctgactgccatcgcgaatcaagcggcaattctgatgggcctcgacaagggctggcccatctccaagatggacataggcgtgccacttctggctttggggtgctacagccaagtcaaccccttgactctgaccgctgccgtgctcatgctggtggctcactacgccataataggcccggggcttcaggccaaggccacccgcgaggcacaaaaacggaccgcggccggcatcatgaaaaatcccacggtcgacgggatcgtggctatcgacttggatcccgtggtatacgatgcgaagttcgaaaagcagctaggccagataatgctgctcatactttgcacatcccagatcttgcttatgagaaccacctgggctttgtgcgagagcatcacgttggccactggacctttaaccactttgtgggaaggctcccccgggaagttctggaatacgaccatagccgtgtcaatggccaacatcttccgggggtcctatctggccggcgcggggctcgccttcagtctgatgaagtccctcgggggcgggcgtcggggaaccggggcccagggcgagaccctgggagagaagtggaagcgccaactcaaccagctgtctaaaagcgagtttaacacgtataagcgatccgggatcatggaggtggaccgcagcgaggcgaaggagggcttgaagcgcggcgaaacgaccaagcacgccgtttcccgcggaacggccaaactgcgctggttcgtggagagaaacctagtaaagccagaggggaaggtcatcgacctgggctgcggccgaggtggatggtcatactactgcgccgggctaaagaaggtgactgaggttaagggctacaccaagggcggccccggtcatgaggagcccatcccgatggccacctacggttggaacctggtcaagttgcactcgggaaaggacgtgttctttattccgcccgagaagtgtgacaccctcttatgcgacatcggggagagctcccccaacccgacgatcgaggaggggcgcaccctgcgagtgctcaaaatggtcgaaccctggctccgaggaaatcagttctgcatcaagatcctcaacccttatatgcccagcgtggtggagaccctcgagcaaatgcagcggaagcacggaggcatgctggtccgcaacccgctgtccagaaactcaacccatgagatgtattgggtgtcctgcggcaccgggaatatagtgtcggctgtaaacatgacaagtcgcatgctcctgaacaggttcacgatggcgcaccgcaagcccacttacgagcgtgacgtggatctgggggcgggcacccggcatgtggccgtcgagcccgaggtagccaacttagacatcatcggacagcgcattgagaacattaagcacgagcataagagcacgtggcactatgatgaagacaatccctacaagacctgggcctaccacggttcctacgaggtcaagccgagcgggtccgctagcagcatggtaaacggggtggtcaagctgctgaccaagccctgggacgtgatccccatggtgacacagatcgccatgacggacacgaccccctttggccagcagcgggtcttcaaagagaaggtggacacccgcaccccaaaggcgaaacgcgggaccgcccagatcatggaggtgacggccaaatggctatggggcttcctctcccgcaacaagaagccacgcatctgcacccgagaggagttcacgcggaaagttcggagcaacgcggccatcggagccgtgttcgtggacgagaaccagtggaacagcgcgaaagaggctgtcgaggatgagcggttctgggacctcgtgcacagggaacgtgagctacacaagcaggggaaatgcgcgacatgcgtctataacatgatgggcaagcgtgagaagaagctgggtgagttcggcaaggccaaaggtagccgagccatctggtacatgtggctgggtgcacgcttcctcgagttcgaggcgctgggcttcatgaatgaggatcactggttctcacgggaaaattcgctgtctggtgtcgagggtgaggggctccataagcttggctacattcttcgcgatattagcaagatacccggtggcaacatgtacgccgacgacaccgccgggtgggacacccgcatcacggaagacgacctgcaaaatgaagcccgcataacagacattatggaacctgaacacgccctattggcgaagtcaattttcaagcttacctaccagaacaaggtggtgcgggtacaacgacccgcgaagaatggaaccgtgatggatgtgatcagccgccgggatcagcgcgggtccgggcaggtaggcacgtacggcctgaacaccttcaccaacatggaggcccagctgatacggcagatggaatctgaggggatcttctccccaagcgagctggagaccccaaatctggccgaacgcgtcttagattggctcgaaaaatacggtgtggagcgcctgaaacgaatggcgatttccggggacgattgtgtcgtgaagccgattgatgacagattcgccacggccctgaccgccctgaacgatatggggaaggtgcgcaaagacatcccccagtgggagccaagcaaaggctggaacgactggcagcaggtacccttctgttcccaccacttccaccagctgataatgaaggacggacgggagatcgttgtgccgtgtaggaaccaagacgagcttgtcggtcgcgcccgcgtgagtcagggagccggctggtcgctccgggaaaccgcatgtctggggaagagttacgcccagatgtggcagctgatgtactttcaccgccgggacctgaggctggccgcaaacgccatctgctctgccgtgcccgtcgattggatccccacttcccggacgacttggtccatccacgcgcaccaccagtggatgacgaccgaagacatgctgtcggtgtggaaccgcgtgtggatcgaggagaacccttggatggaagacaagacgcacatcagctcttggggcgacgtcccttatcttgggaagagggaggaccagtggtgtggaagcttgatcggtctgaccgctcgggccacctgggcaacgaatatccaggtggccatcaaccaggttcgccggctcatcggtaacgaaaactacctggattacatgacttctatgaagcgctttaagaacgagtcggaccccgaaggcgccctgtggtga

SEQ ID NO: 24435 - RNA, 9879 nt, synthetic construct
  misc_feature 1..9879: note = derived and/or modified CDS sequence (opt11) from DENV-1__GU131725__SS-prME
  source 1..9879: mol_type = other RNA
agcgttaccatgctgctaatgctgatgcctacggccctggccttccatctcaccacacggggcggggagccacacatgatcgtgtcgaagcaggaacggggaaagagcctactgttcaaaacaagcgcgggggtaaacatgtgcaccctcatcgccatggacctgggcgagctttgtgaagacaccatgacctacaagtgccccagaatcaccgaggccgaacccgacgacgttgactgctggtgtaatgccacagacacgtgggtcacatacggaacctgttcccaaaccggcgaacaccggcgggacaagcggtccgtggcgttggcgccccacgtgggcctgggactagagactcgaaccgagacatggatgagcagcgaaggcgcctggaaacaaatccaacgggtcgagacctgggcccttagacaccccgggttcacggtaatcgcccttttcctggcgcacgccatcggaacaagcataacgcagaaggggatcatatttatcctgttgatgctggttaccccctccatggccatgaggtgcgttggtattggttcacgcgacttcgtggaggggctaagtggcgccacctgggtggacgttgttctcgaacacggttcgtgcgtaaccaccatggcgaaggacaagcccaccctggatattgaactgctgaagactgaggtcaccaaccccgcggtgctgcggaagctctgcatagaggccaaaatatctaacaccaccactgacagcaggtgtcctacccagggcgaagccaccctagtcgaggagcaggatgccaacttcgtctgtcggcgcaccttcgtcgaccggggctgggggaacggctgcggtttattcggcaagggttccctcataacatgcgccaagttcaagtgcgtcaccaagctcgagggcaaaatcgttcagtatgaaaatctgaagtacagcgttatcgtgacagtccacaccggcgaccagcaccaggttgggaacgagtccacggagcacggaactaccgctaccatcacgcctcaggccccaactaccgagatccagctcaccgactacggggccctgaccctggactgcagcccccgcacgggactcgacttcagcgagatggtcctgctgaccatgaaggaaaagtcctggttggtgcacaagcagtggtttctggacctcccattaccgtggacctctggtgcctccacctcgcaggagacgtggaaccgccaggatctgctggtgacattcaaaaccgcccacgcaaagaagcaggaagttgtggtactcggatcccaagagggcgccatgcacaccgcgctgacgggagcaactgagatccagaccagcggcaccacgactatcttcgcggggcatctgaagtgccgcctcaaaatggataagctgacactgaagggaatgtcctatgtcatgtgcacgggctcttttaagctcgagaaggaggtcgcggagacgcagcacggcaccgtgctggtccagataaagtacgagggcaccgacgcgccatgcaagatcccgtttagtacccaagatgagaagggggtgacgcagaatggccgattaatcaccgccaacccgatcgtaactgacaaagagaaacctgtcaacatcgaggcagagccgccctttggggagagctacatagtgatcggcgcgggcgagaaggcccttaagctatcctggttcaagaagggttcctccataggcaaaatgtttgaggccacagcccgcggggcacggcgcatggcaatcctgggcgacacagcatgggacttcggctctattggcggagtgttcacctccgtcgggaagctggtgcatcaaatcttcgggaccgcttacggggttctgttctccggcgtttcctggaccatgaagatcgggatcggtgtgctgctaacgtggctcggcctaaacagccgctccaccagcttatccatgacctgcattgccgtcgggctcgtgaccctttaccttggggttatggttcaggcggacagcgggtgcgtaatcaactggaagggccgggagctgaaatgcgggtctgggatcttcgtgacgaacgaggtccacacctggaccgaacagtacaaattccaggcggattccccgaaacgcctgtcagccgcgatcggcaaggcgtgggaggaaggtgtctgcggaatccggtctgccacgcgtttggagaatattatgtggaagcagataagcaacgagctcaaccatatattactggagaacgacatgaagctaaccgtcgtggtcggtgacgtcgcaggcatattagggcaggggaagaagatgatacgtccccagcctatggagtacaagtactcctggaagtcctggggcaaggccaaaatcataggggccgacgcccagaacacgaccttcatcatagacggccctaacaccccagaatgtcctgacgaccaacgcgcgtggaacatctgggaggtcgaagattacggcttcggcatattcacaacgaacatctggctaaagctccgggactcctacacccaggtctgcgaccaccgcctcatgagcgccgccatcaaggactcgaaagcagtccatgccgacatgggctactggattgagagcgagaagaatgagacctggaaactggcccgggcttccttcatcgaggtgaagacttgcatctggcccaagtcgcacaccttgtggtccaatggggtattagagagcgagatgattatccccaagatatacggcgggccgatctctcagcacaactaccgacctgggtatttcacgcaaaccgccggcccctggcacctaggcaaactcgagctagacttcgatctgtgcgagggaaccacggtggtggtcgacgagcactgcgggaaccggggcccgagcctccgcaccaccactgtgacggggaagatcatacacgagtggtgctgccggtcctgcaccttaccgcctcttcgctttaggggcgaggacggatgctggtacggtatggagatacgccccgtgaaggagaaggaggagaacctagtcaagtcaatggttagcgcagggtccggggaggtagactcattctccctggggctgctgtgcataagcatcatgatcgaggaggttatgcgatcccgctggtcgcggaagatgctgatgaccgggacgctggcggtgttcttcctgctcatcatgggccagctgacgtggaacgacctcatccgcctgtgcatcatggtgggagcgaacgcatccgaccgcatgggcatgggtaccacttatctggccctcatggccacctttaagatgcggcctatgtttgccgtcgggttactgtttcgccggctcacgagccgcgaagtgctgctgctcactataggcctgtccctggtggcaagcgtcgaactccccaactccctggaggagctgggagacggcctcgctatgggcatcatgatcctgaaactccttactgattttcagagctaccagctatgggcaacccttctctccctgacgtttattaagaccactttcagcctgcattacgcctggaaaaccatggcgatggtacttagcatcgtctctcttttccccctgtgcctgtccaccacaagccagaagaccacctggctgcctgtactgttaggttccttaggctgcaaaccgctgacgatgttcctcatcgccgagaacaagatctgggggcggaagagctggccgctgaacgagggcatcatggcagtgggaatcgtcagcattctgttaagtagcctcctgaaaaacgacgtgcccctcgccggccccctcatagccggcgggatgcttatcgcatgctacgtaatctccgggagctccgccgacctcagcctggaaaaagcggcagaagtgagctgggaagaggaagccgagcacagcggggcgtcacacaacatcctggtcgaggtccaggacgacggcactatgaaaataaaggacgaggagcgcgacgacacccttaccatcctgctgaaggcgaccctactggctgtctctggggtgtatccgctctcaatcccggccaccctattcgtctggtacttttggcagaagaagaagcaacggagcggtgtgctgtgggacaccccttcaccgcctgaggtcgagcgcgccgtgctggacgacggaatctacagaatcatgcagcgcggactgctgggtaggagccaagtaggtgtgggcgtattccaagagaacgtcttccatacgatgtggcatgtgacgaggggggcagtgctgatgtatcagggcaaacgtctggagccgtcttgggcctctgtcaagaaagacctcatctcctacggcggcggctggcgcctgcgtggtagctggaacaccggtgaagaagtccaggtaatcgccgtcgagcccgggaagaaccccaagaacgtgcaaaccgcccccgggaccttcaagactcccgagggcgaggttggggccatcgctctggatttcaagcccgggacgtccgggagccccatcgtcaacagggagggaaaaatcgtcggcctctacggcaatggcgtggtcaccaccagcgggacctacgtgtccgccatcgcccaagctaaggcgtctcaagagggcccgctgcccgagatcgaggacgaggtgttccgcaagcgcaatctgaccatcatggacttgcaccccggatccggcaagactagacgatatctgcccgccattgtccgtgaggctataaagaggaagctgcgcacgctcatactggcccccacccgcgtggtcgccagcgaaatggcggaggcgctgaagggaatgcccatccgctaccagacgaccgcggtcaaaggtgaacacaccggcaaggagatcgtggacctcatgtgtcacgccacctttaccatgcgtctcctgtctcccgtgcgcgttcccaactacaatatgatcataatggatgaggcacacttcactgacccaagctccatcgcggcccggggttatatcagcacccgcgtggggatgggtgaagccgccgccatcttcatgacagcgacgcctcccggctccgttgaggcatttccgcagagcaacgccgtcatccaggacgaggaacgagacattcccgagaggtcctggaatagcggatacgaatggatcaccgactttcccgggaagaccgtgtggttcgtgccctccattaagtctggtaacgacattgcgaactgccttcggaagaacggaaagcgcgtcatccagctgtcccggaagactttcgacactgaataccaaaaaaccaagaacaacgattgggactacgtggttaccaccgacatttcggagatgggcgctaacttccgcgccgaccgggtcatcgaccctcgccgatgcttgaagcccgtgattctgaaggatgggcccgagcgcgtgatcctggcaggccctatgccggtgacagtggcctccgcagcgcaacggcgcggccggatcggtcgcaaccacaacaaggagggcgaccagtatatctacatggggcagcccctgaacaacgacgaggaccacgcccactggaccgaggcaaagatgctgttggacaacatcaacacccccgagggcatcatccccgctttattcgagccggagcgcgaaaagagtgcggccgtggacggggagtaccggctccggggagaggcccgaaagacgtttgttgagctgatgcgccgaggcgacctgcccgtttggctttcctataaggttgccagcgaggggttccagtactctgacaggcgttggtgtttcgatggcgagagaaataaccaagtcctggaggagaacatggacgtcgaaatatggaccaaggagggtgagaggaagaagctccgcccgcggtggctcgacgctagaacctactccgatcccttagctctgcgggagttcaaggaattcgcggccgggcgccgcagcgtctccggtgatctcatcctggagatcggcaagctgccgcagcacctcacccagagggcccagaacgccctggacaacttggtaatgctgcataacagtgaacagggagggagagcgtaccgccacgccatggaagagctaccagacaccatcgagacactgatgctgctggccctcatcgccgtcctcaccggcggggtcaccctgttcttcctgtcgggacgggggctggggaaaaccagcatcggcttactgtgcgtgatggcctcgagcgtgctcctttggatggcgtccgtcgagccccactggatcgccgccagcatcatcttagagttcttcctcatggtcctgctgatccctgaaccggacagacagagaacacctcaggacaatcagctcgcctatgtggtcatcggactgctgttcatgatactcacggttgccgcgaatgagatgggacttctggagaccacaaaaaaggacttagggatcggccacgtggcagtcgaaaaccatcaccacgcagccatgctcgacgtggatctgcaccccgcctccgcgtggaccctctacgccgtggcgacgaccatcatcaccccgatgatgcgacatactatcgagaacacgaccgccaacatctcattaaccgccatcgccaatcaggccgcgatcctgatggggttggacaagggctggcccatctccaagatggacataggtgtcccccttctggccctcggctgctacagccaagtgaaccccctgaccctgacggcggccgtgctcatgctcgtagcccactatgcaatcataggcccgggcctgcaggctaaagcgacccgcgaagcgcagaaacggacggccgccggtatcatgaaaaaccccaccgtagatggcatcgtggcaatcgacctcgatcccgtggtgtacgatgcgaaattcgaaaagcaactggggcaaataatgctgttaatcctgtgcacgtctcaaattttgctcatgaggaccacgtgggccctttgcgagagcatcacgctggccacgggcccactaaccaccctgtgggaaggctcccccggcaaattctggaataccactatcgccgtgtccatggccaacatctttcgggggtcctaccttgcgggtgctggcctcgcattcagtctgatgaaatccctcgggggagggcgccgagggaccggcgctcagggggaaaccctcggtgagaaatggaagagacagctcaaccagctgtcgaagagcgagttcaacacatacaagcggtccgggataatggaggtcgatcgcagcgaggcgaaggaaggactcaagcgtggggagaccaccaagcacgccgtgagtcgcggcaccgccaagctccggtggttcgttgagcgcaacttggtcaagcccgagggcaaggtgatcgatttagggtgcggccgcgggggctggagctactactgcgctgggctcaagaaggtgacggaggttaaaggctacaccaaaggcggcccgggccacgaggagcccatccccatggccacctacgggtggaacctcgtcaagctgcactccggtaaggacgtgttcttcatcccgcccgagaagtgcgacactttactgtgcgacatcggagaaagctccccgaatccgaccatcgaggaggggcgcacgctgcgggtccttaagatggtggagccctggcttcggggaaaccagttttgcatcaagatattgaacccttacatgcccagcgttgtggagacgcttgagcagatgcagcggaagcacgggggcatgttggttcgtaacccgctgtcccgaaactcgacacacgagatgtattgggtctcttgcgggaccggcaacatcgtcagcgcggtgaacatgacctcgcgcatgttgcttaaccgctttacgatggcccaccggaagcccacatacgaaagggacgtggacttaggaaccgggacccggcacgtcgcggtagagcccgaggtggccaacctggacattatcggccagcgcatcgagaacatcaaacacgagcataagagcacgtggcactacgacgaggacaacccctataaaacttgggcttaccatgggtcctacgaggtcaagccgagcggatcggcgtcatcaatggtcaacggcgtcgtaaagctgctgaccaagccctgggacgttatccccatggtcacacaaatcgccatgacggacaccacccccttcggtcaacagcgggtgtttaaggaaaaagttgacaccaggaccccgaaggccaagcggggtaccgcccagatcatggaggtcactgcccgctggctctggggattcctgtcccgaaacaagaaaccccgcatctgtacccgggaggagttcacacgaaaggtgagaagcaacgctgcaatcggcgctgtgttcgtggatgagaaccagtggaactctgccaaggaggcggtggaggacgagagattctgggacctggtgcacagagagagagagctccacaaacaggggaagtgcgccacctgcgtctacaacatgatgggcaagcgggagaagaagctgggggagtttgggaaggccaagggcagccgcgccatttggtacatgtggttgggggcacgcttcttggagttcgaggccctgggcttcatgaacgaggaccactggttctcccgcgagaatagcctctccggggttgagggcgagggtcttcacaaactgggatacatactgagagatattagcaagatccccggcgggaacatgtacgcggacgacaccgccggctgggacacccgcatcacggaggacgacctccagaatgaagccaaaatcacggatatcatggagccggagcacgccttgctggcgaaagccatcttcaagctcacttaccagaacaaggtcgtaagggtgcagcgaccggccaagaacgggaccgtgatggacgtcatctcccgccgggaccagcggggcagtgggcaggttgggacctacggcttaaataccttcacgaacatggaggcgcagctgatccggcagatggagtcagagggcatcttcagcccctccgagctagagactccgaacctcgcggagcgcgcgctggattggctcgagaagtacggggtggagaggctcaagcgcatggccatttccggggacgactgcgttgtaaagccgatcgacgacagatttgccacggctctgaccgcccttaacgacatgggcaaggtccgaaaggacatcccccagtgggaaccctccaggggctggaatgactggcaacaggtccccttctgctcgcaccacttccaccagctgatcatgaaggacgggcgcgagatcgtggtcccatgccggaaccaggacgaacttgttggccgcgcgcgggtgtcccagggtgccggttggtccttgcgtgagaccgcctgcttgggaaaaagctacgctcagatgtggcagctaatgtatttccaccgtcgcgacctccggctcgcggcgaacgccatctgttccgccgtgcccgtcgactgggtgcccaccagccgcacgacctggtccatccatgcccaccaccagtggatgaccaccgaggatatgttgagcgtgtggaaccgtgtctggatcgaggaaaacccatggatggaggacaagacgcacatctccagctgggaggacgtgccgtatctcggaaagcgggaggaccaatggtgtggtagccttatcgggttgactgcccgcgccacctgggccaccaatatccaggttgccatcaaccaggtccggaggttgatcggcaatgagaattaccttgattacatgacaagcatgaagagatttaaaaacgagtccgacccagagggggccctatggtag

SEQ ID NO: 24436 - RNA, 9879 nt, synthetic construct
  misc_feature 1..9879: note = derived and/or modified CDS sequence (opt11) from DENV-1__GU131726__SS-prME
  source 1..9879: mol_type = other RNA
agtgttaccatgttactcatgctgatgcccaccgccctagccttccacctcaccaccagagggggtgaaccacacatgatagtgacgaagcaggaacggggcaagtctctactgtttaagaccagcgcgggggttaatatgtgcacactcatcgcgatggaccttggcgagctgtgtgaggacaccatgacctataagtgtccaagaatcactgaggccgagcccgatgacgtggactgctggtgcaacgcgacagatacatgggtgacatatgggacctgtagccagacgggggagcaccggcgagacaagaggagcgtggcgctcgcgccgcacgtcggccttgggttggagacccgcaccgagacctggatgtcttctgaaggcgcctggaaacaaatccagagggtggagacttgggctttgcgtcacccagggttcaccgtgattgccttgtttctggctcacgcaatcgggacctcaatcacgcagaaaggaattatcttcattcttctgatgctggttacgccgagcatggctatgcgttgtgtagggatcggcagtcgagacttcgtcgaagggctcagcggtgctacctgggtcgatgtcgttttggaacacgggtcatgcgtgacgaccatggccaaggacaaacccactctggacatcgagctcttgaaaactgaggtcaccaatcccgccgtcctgcggaagctctgtattgaggccaaaatcagcaacaccactaccgattcccgctgcccgacccaaggcgaggccacacttatggaggaacaggacgccaacttcgtttgtagacgaactttcgtagatcgtggctgggggaatggctgcgggctgtttggtaaggggagcctcatcacatgtgccaagttcaaatgcgtaaccaaattggagggcaagatcgtgcaatatgagaacttgaagtacagtgtcatcgttaccgtgcacactggagatcaacaccaggtcgggaatgaaagcaccgagcacggtaccaccgcgacaatcacgccccaggcccctacctccgagatccaactgacggactatggcgccctgaccctcgattgcagccctcgcaccggcctcgattttaatgagatggtactgctgaccatgaaagagaagtcctggctagtacacaagcagtggttccttgacctgccgcttccgtggacaagcggggcctccacttcccaagagacgtggaaccggcaggacctgctggtgacctttaagaccgcacacgcgaagaagcaagaggtggtcgttctgggcagccaagagggtgccatgcacactgccctcacgggggcgaccgagatacaaacctcaggtacgaccacaatctttgcagggcacctgaaatgccgcctcaagatggataaactgaccctgaaggggatgtcatacgtgatgtgtaccgggtccttcaaacttgagaaagaagtcgcggagacgcagcatggcacggtgctggtccagatcaagtatgaggggacggatgccccctgcaagatcccgttcagcacccaggacgagaagggcgccacccagaacggccggctgattacagccaacccaattgtcaccgataaggaaaaacctgttaacatagaggcagaacctccgttcggggaatcctacatcgtcatcggcgccggcgagaaggccctgaagttgagctggttcaagaaagggtccagtattggaaagatgttcgaggccaccgcccgcggagcgcgaagaatggcaatcctaggcgacacggcctgggacttcggttctgtcgggggagtgttcacctccgtgggcaagctggtccaccagatcttcggtacagcctacggggtattattctccggggtcagctggacaatgaagattggcattggagtcctcttaacctggctcggccttaactcccgctctacctcgctgtcgatgacctgtatagcggttgggctcgtgactctgtacctgggcgtcatggttcaggcggactccggttgcgtcatcaactggaaaggccgcgagctcaagtgcgggagtggcatcttcgtcacgaacgaagtgcacacctggactgaacagtacaaattccaggccgacagccccaagagactatccgcggcaatcggcaaagcctgggaggaaggggtgtgcggcatccgaagcgcgacccgcctggagaatatcatgtggaagcagatctccaatgagctaaatcatatcctgctggagaacgatatgaagttcacggtcgtcgtgggagatgttgtgggcattctagcccaagggaagaaaatgatccgcccccagcccatggaacacaagtattcttggaaaagttggggcaaagctaagatcattggagcggatgttcaaaacacgaccttcatcatagacggccccaacacaccggagtgccccgatgatcagcgcgcgtggaacatctgggaggtggaggactacggcttcgggattttcgccaccaacatttggctgaaactgcgggacagctacacccaagtgtgcgatcatagactcatgagtgccgctattaaagactccaaggctgttcacgcagatatgggctactggatcgaatccgagaaaaatgagacatggaagctggcacgggccagcttcatcgaggtcaagacttgcatctggcccaagtcccatacgctgtggagcaatggcgttctagaatccgagatgatcatccccaagatctacgggggcccgatcagtcagcataactaccgccccgggtactttacgcaaacggccggtccttggcacttagggaagctggagctcgacttcgacctatgcgagggaaccaccgtagtcgtggacgagcactgcggcaatcgagggccgtcactgcggaccaccaccgtcacagggaaaatcatccacgagtggtgctgcaggagctgtacgctgccgcccctccgttttaagggcgaggacggctgctggtacggtatggagatcagaccagtcaaggaaaaggaggaaaacctggtgaagtctatggtcagcgccggcagcggcgaggtggactccttctcgctcgggttattatgcatatctatcatgatcgaggaagttatgaggtcaaggtggtccaggaagatgctcatgaccggcaccctggcggtatttttattactgatcatggggcagctcacctggaacgacctcatccggctatgcatcatggtcggcgcgaacgcctctgaccgcatgggaatgggaacgacgtacctggccttaatggccactttcaagatgcgtcccatgtttgccgtggggctactgctcaggaggttaacctcacgggaggttctactcctgacgatcggtctaagcctcgttgccagtgtggagctgcccaacagcctggaggagctcggcgatggccttgccatgggcatcatgatcctgaagctcctgaccgatttccaaagccaccaactttgggctactctactgtctcttacgttcatcaagacgaccctctccctgcactatgcttggaagaccatggcgatggtcctgagcatcgtgtccctcttccccctgtgcctgagcacgacgtcccagaagaccacctggctccccgtgctactcgggtcgttcgggtgcaagcctttgaccatgttcctgatcacggagaacaaaatatggggccgtaagtcctggcccctgaatgaggggataatggccgtaggggtggtgagcatattgctgagctctctgctaaagaatgacgtgccccttgcaggaccactgattgccggagggatgttaattgcctgctatgtaatcagcggctccagtccggatctctccctggagaaggcagccgaggtgagctgggaggaggaggcagagcattccggcgcctcgcacaatatcctagttgaggtccaggacgatggcaccatgaagatcaaggacgaggaacgcgacgatactcttaccatcctgttgaaggcaaccttgctggccgtgtcgggcgtctatccactcagcatccccgccacgctgtttgtgtggtacttttggcaaaagaaaaagcagcggtcgggggtgctctgggacacgcccagccctcccgaggtagagcgggcggtgctggacgacggcatctaccgcatcatgcagcggggactccttggccgctcccaggttggggtcggggtcttccaagagaacgtgttccacaccatgtggcatgtcaccaggggcgcggtgctgatgtaccaaggaaagcgcttggagcccagctgggcgtccgtcaagaaggatttaattagttatggtggagggtggcggctgcaagggtcctggaacacgggtgaggaggtgcaggtcatcgctgtggagcccggcaaaaaccctaagaatgtccagaccgcaccagggacctttaagaccccggagggcgaggtgggcgcaatcgccctcgacttcaagcccgggacgagcggctcccctatcgtcaaccgcgaggggaagatcgtcggcttatacggcaacggggtggttaccaccagtgggacctacgttagcgcgattgcccaggctaaggcctcccaggaggggccgctgcccgaaatcgaagacgaggtatttcggaagcgcaatctcacgattatggacctgcacccgggcagcggtaagacacggcgatacctccccgcgattgtgcgggaagccatcaaacgcaagctccggacgctgatcctcgcgcccacccgtgtcgtcgcctccgagatggccgaggcgctcaagggcatgcccatccgctaccagaccacagctgtcaaatcagagcacactggcaaagagatagtcgacctgatgtgtcatgccaccttcactatgcggttactctcacccgtgcgcgtgccaaattacaatatgatcatcatggacgaggcccatttcaccgacccgagcagtatcgccgcgcgtggttacatctcaacccgcgtcggaatgggagaagccgcagccatattcatgaccgccacgcccccgggcagtgtggaggccttccctcagtcgaacgccgtaatccaggacgaggaaagggatatacccgagagatcctggaatagcggttacgagtggataaccgactttccaggtaagacagtctggttcgtgccgtccatcaagtcgggcaacgacatcgccaattgcttacggaaaaatgggaagcgcgtgatccagctgtcccggaagaccttcgacacggagtatcagaaaaccaaaaacaatgattgggattacgtcgtcacaactgatatctcggagatgggtgcaaacttcagagcggaccgtgtcatcgatccccggcgatgcttaaagcctgtgatcttaaaggatgggccagagcgcgtgatcctagccggccccatgcccgtcacagtggcctctgcggcccagcggcgcgggcggataggacgcaaccacaacaaggagggtgaccagtacatctacatggggcagcccctcaacaacgacgaggaccacgcgcattggacggaggccaagatgctgctggacaatataaacacccctgagggcatcattcctgcactcttcgagcccgagagagagaagtccgccgcaatcgacggggagtatcggctacgcggcgaggcgcggaaaaccttcgtggaactgatgcgccgcggggatcttcccgtatggctgtcctacaaagttgcctcagagggcttccagtacagcgaccgccgatggtgttttgacggcgagcgcaataaccaggtactcgaagagaatatggatgtagagatttggaccaaagagggtgagaggaagaagctccgccccaggtggctggatgcccgcacctattcagatccgttagccctccgggagttcaaagagttcgccgcgggcagaagaagcgtgtccggggatctgatcctggagatcggaaagttaccccagcacctgacccagcgcgcacaaaacgccctggacaacctggtgatgctgcacaacagcgagcaaggtgggcgagcgtaccgacacgcgatggaggagctgccagacacaattgaaacgctcatgctgctggccctcatagccgtcctgacagggggtgtgaccctgttcttcctctccggcaggggcctgggcaagacctccattggcctgctttgcgtgatggcctcctcagttctgctgtggatggcctccgtggagccgcattggatcgcagccagcattatcctcgagttcttcctgatggtgctgctcataccggagccggatcgccaacggacgccccaagacaaccagctggcctacgtcgtgattgggttactcttcatgatcctaaccgtggccgcaaacgagatgggactgctcgagaccaccaagaaagacctggggatcggtcatgtcgcggtggagaaccaccaccatgcaaccatgttggatgtagacctccacccggcgtccgcctggacgctgtacgccgtcgcgaccaccatcatcacccctatgatgcgccatacgatcgagaacacgacagccaatatcagcctgactgctattgcgaaccaggcagcgattctcatggggctggacaagggatggccgatttccaagatggacatcggagtgccgctgctcgccttgggatgctacagccaggtgaaccctctgacgctcaccgcagcagtattgatgctggtagctcactatgccatcatcggacctggcctccaggctaaagcaacccgcgaggcccagaagcggacagcggcgggcatcatgaaaaaccccaccgttgatgggattgtagcaatcgacctcgatccagtggtctacgacgccaagttcgaaaagcaactggggcagattatgttgctgatcttgtgcacaagccaaatcctactcatgcgcaccacctgggcgttatgcgagagtatcacgttggcgactggccccttaaccaccctgtgggaaggtagtcccgggaagttctggaacacgactatcgccgttagcatggccaacatcttcaggggtagttatttggccggcgccggcttagcgttttcattaatgaagtccctcgggggcgggaggcggggaaccggagcccagggcgagaccctgggtgagaagtggaaacgccagttaaaccaactttcgaaaagcgagttcaacatctacaagcggtccgggatcatggaggtggacagaagcgaggccaaggagggcctaaagcgcggtgagactacccggcacgcagtgtccagaggcacagcgaagctgcgatggttcgtagagcggaacctggtaaagcccgaggggaaagtgatagaccttggttgcggtcgcggagggtggagctactactgtgcagggctgaagaaagtcaccgaggtgaaaggctacacgaaaggagggcccgggcacgaggagccgatccccatggccacctacggatggaatctagtgaagctccattcgggcaaggacgtcttcttcacgccgcccgagaagtgcgataccctgctgtgtgacatcggggagtccagcccaaaccccactatcgaggagggccggaccctgcgcgtgctaaagatggtggagccatggctgcgtgggaaccagttctgcatcaaaatattgaacccctacatgccgagcgttgtggagaccctggagcaaatgcagcgcaaacatggcggcatgctggttcgcaacccactctcccgcaacagcacccacgagatgtactgggtcagttgcgggacgggcaacatagtgtccgccgtgaacatgacgtcgcggatgctgctcaaccgcttcaccatggcccacagaaaaccgacctacgagcgagacgtcgacctgggggctgggacccgccacgtggcggttgagccagaggtcgccaaccttgatattatcgggcagcggatcgaaaacattaagcatgaacacaagagcacgtggcactacgacgaggacaacccctacaaaacctgggcataccacgggtcctacgaagtgaagccaagcggatccgcgtcttccatggtgaacggagtggtgaagctgctcactaaaccctgggacgtaatccccatggttacgcaaatcgcaatgacggacaccaccccattcggccaacaacgcgttttcaaggagaaggtagacacccggacgcccaaggctaagcgcgggaccgcccagataatggaggtgactgcccggtggttatggggcttcttgtcccggaacaagaaaccgagaatctgcacgcgcgaggagttcacccgtaaggtgcgctcaaacgctgcgataggggccgtctttgtagacgaaaatcagtggaactctgctaaggaggccgtggaagacgagaggttttgggacctcgtccaaaaggagagagagctgcacaagcagggaaagtgcgcaacctgcgtgtataacatgatgggcaagcgtgagaagaaactgggagagttcggcaaggccaaagggtctcgcgcaatatggtatatgtggctcggcgcccggtttttagagttcgaggccctgggctttatgaatgaggatcactggttcagtcgcgagaatagtctcagcggcgtggaaggagagggtctgcataaattggggtacatactccgggacataagcaagatccccgggggcaatatgtatgcggatgacaccgcaggctgggatacccgcatcacggaggacgatttacagaacgaggcaaaaatcaccgacatcatggagcctgagcatgccctactcgcgacctcaatcttcaagttaacataccagaataaggtggtgcgtgtgcaacgcccagccaagaatgggacggtaatggacgtgatttctcgccgggaccagcggggctccggccaggtgggcacctacggcctgaacaccttcactaacatggaggcccagctcatccggcagatggagagcgagggcatcttcctgccctccgagctggagacaccaaatttggctgagcgcgtgctcgattggctggagaaatacggcgtcgagcggctcaagaggatggcaatctctggggatgactgcgtagtcaagcccatcgacgatcggttcgctaccgccctgaccgccctgaacgacatgggtaaggttcgcaaggacatcccgcagtgggagccctctaaagggtggaacgactggcagcaagtcccattctgcagccaccatttccatcagctcatcatgaaggacggccgggagatcgtcgtgccctgcagaaaccaagacgagctagttggccgggcccgcgtctcccagggggccggctggtcactgcgggagaccgcgtgtctcggcaaaagctacgcacagatgtggcagctgatgtacttccaccgccgggaccttcgcttggccgccaatgctatctgttcagcagtaccaatcgactgggtgcccacgagccggaccacgtggtccatccacgcccaccatcaatggatgaccacagaggacatgctgagcgtctggaaccgcgtgtggatcgaggaaaatccgtggatggaggacaagacccacgtgtccagctggggcgacgtaccctaccttggcaagcgggaagatcaatggtgtggttccctcatcggcttaaccgctcgcgcaacttgggccagcaatatccaggtggccatcaatcaagtgcggcggctgattgggaacgagaactatctggactacatgacttccatgaagcgcttcaaaaacgagggcgatcctgagggggctctgtggtga

SEQ ID NO: 24437 - RNA, 9879 nt, synthetic construct
  misc_feature 1..9879: note = derived and/or modified CDS sequence (opt11) from DENV-1__GU131727__SS-prME
  source 1..9879: mol_type = other RNA
agcgttacaatgcttctcatgttaatgcccaccgcactcgccttccacctcacgacccggggaggggaacctcacatgatcgtgaccaaacaggaacggggcaagagcctgctgttcaagaccagcgccggagtaaatatgtgcaccctcatcgccatggacctcggcgagctgtgcgaggacaccatgacttacaaatgtccccggatcaccgaggccgagcccgacgacgtagattgctggtgcaacgccaccgacacgtgggtgacctacgggacctgcagccagacgggcgagcaccggcgcgacaagagaagcgttgcgctggcgccccacgttggcttagggctggagacccgaaccgagacctggatgtccagcgagggcgcatggaagcagatccagcgggtcgagacgtgggcgttacgccacccaggcttcaccgtgatcgccttgttcctggcgcacgccatcggcacatccattacccagaaggggattatctttatcctactaatgttggtgacacccagcatggccatgcggtgcgtcggcatcggatcgcgcgacttcgtggaggggctcagcggcgccacctgggtcgacgtcgtgctggagcacgggtcctgcgtgaccaccatggcaaaggacaaaccaacgctggacatcgagttactaaagacagaggtcaccaaccctgcggtcctccggaaactctgcatcgaggccaagatcagtaacaccacgaccgactcgcgctgccctacccagggcgaggccaccctgatggaggagcaggatgccaacttcgtgtgccggcgtaccttcgtcgaccggggatgggggaacggatgcgggctgttcggaaagggatcgctcataacctgcgccaagttcaaatgcgtgaccaagctggaaggaaagatcgtgcaatacgagaacctgaaatactctgtcattgtgaccgtgcacactggcgaccagcaccaggtcgggaacgagagcacggaacacggtaccaccgcgaccataacgccccaggcgcccacctccgagatacagctcaccgattatggggccctgaccctcgactgtagcccccggacgggcttagatttcaatgagatggtgctgctgactatgaaggaaaagtcttggctcgtccacaagcagtggttcttggacctgccgcttccctggaccagcggtgctagcacgtcccaggagacctggaaccggcaagacctgctggtgaccttcaagacagcccacgcgaagaagcaggaagttgtggtactcggcagccaagaaggcgcaatgcataccgcactcacgggggcaaccgagatccagacctcgggcaccacgaccatctttgccgggcacctgaagtgtcgcctcaaaatggacaagctgaccttgaagggcatgagctacgtgatgtgcaccgggtccttcaagctcgagaaggaggttgcggagacgcagcacggcaccgtattagtacaaatcaagtacgaaggcaccgacgccccctgcaagatccccttcagcacccaggacgagaagggggtcacgcaaaacggccgactgatcacggccaacccgattgtaaccgacaaggagaagcctgtcaacatcgaggcagagccgccatttggtgaatcctacatcgtcatcggagctggcgagaaggcgttaaaactttcatggttcaaaaagggttccagcatcgggaagatgttcgaggctacagcccgcggggcacggcgaatggcgatcctgggagacacggcgtgggacttcggctccgtgggcggcgtattcacatctgtcgggaagctggtgcaccaaatcttcggtaccgcctatggcgtgctgttttccggggtttcgtggaccatgaagatcggtataggcgtgctgctgacgtggctcggcctgaactcacgcagcacctccctgagcatgacctgcatcgcggtcggcctggttaccctgtacctgggcgtgatggtgcaagccgattccgggtgtgtcatcaactggaagggccgggaactcaagtgcgggagcggcatcttcgtgacgaacgaggttcacacatggaccgagcaatacaagttccaggcggactcaccgaaacgcttgtccgctgccatcggcaaggcttgggaggagggcgtgtgcggtatccggagcgctacccggctggaaaacatcatgtggaaacagatctccaatgagctcaaccacatcctgctggaaaatgacatgaaatttaccgtggtggtcggggacgtggtgggtatcctcgcgcagggtaaaaagatgatacggccccaacccatggagcacaagtatagctggaaatcctgggggaaagccaagataatcggtgctgacgtccaaaacacgactttcatcatcgacggacccaacacaccggagtgtcccgacgaccagcgcgcctggaatatctgggaagttgaggactacggcttcgggatcttcaccactaatatctggttgaagctgcgagacagctacacccaggtgtgtgatcacagactcatgagcgcggccatcaaggacagtaaggctgttcacgccgacatgggctattggattgagtccgagaagaatgagacatggaagttagcccgggccagcttcatcgaggtgaagacctgcatctggcccaaatcccacacactgtggtctaacggtgtgttagaatccgagatgatcatccccaagatctacggtggccccatatcgcagcacaattacagacccgggtactttacccagaccgcaggcccttggcacctggggaaactggagctcgacttcgatctgtgcgaggggactacggtcgtggttgacgagcactgtggcaaccgggggccgtccctccgcaccaccaccgttactggcaagatcatccatgaatggtgctgtcggagctgcacgctaccgcccttgcgcttcaaaggagaggatggatgctggtacgggatggagatccggccagtcaaagagaaagaggagaacctggtgaagtccatggtctcggccggaagcggcgaggtggacagtttcagcctcgggctgctgtgcatatccattatgatcgaggaggtgatgcgaagccgttggtcccgcaagatgctcatgaccggaaccctggccgtctttttactcctgatcatgggtcagctgacatggaacgatctaatccggctgtgtattatggtgggcgccaacgcgtcggaccgcatggggatgggaaccacgtacctggccctcatggccactttcaagatgcgcccgatgttcgccgtggggctgctgtttcgccgtctgacgtcccgggaggtcctgctgttgactatcgggctcagcttagtggcctctgtcgagcttcccaattcattggaggagttgggggacggactcgcgatgggcatcatgatcctaaagctgctcacagatttccagtcccatcaactgtgggccactttgctcagcctgacgttcatcaagacgaccctgtcgctacactatgcctggaagaccatggccatggttctgagtatcgtgtccctgttccccttatgcctgagcacgacttcccagaagacaacctggctgcccgtcctcttaggcagccttgggtgcaagccgctcacgatgtacttaatcaccgaaaacaagatctggggccgcaagtcatggcccctgaacgaggggatcatggcggtgggcgtggtcagcatccttctcagctccctactcaagaatgatgtgccactggccggaccgctgatagcaggcggcatgttaatcgcctgttacgtgattagcgggtccagcgccgacctgagtctcgagaaagcggctgaggtcagctgggaggaggaggccgagcattcaggcgccagccacaacatcctggtcgaggtgcaggacgacgggaccatgaagatcaaggacgaggagcgggatgacaccctcacgatcctgctcaaggccaccctgctggctgtctccggcgtttacccgctctccatccccgccaccctattcgtgtggtacttctggcagaagaagaagcagcgcagtggggttctgtgggacacacccagcccgcccgaggtggagcgggccgtactggacgatggcatctatcgcatcatgcagcggggcttactcggacggtcccaggtaggcgtaggggtgttccaagagaacgtcttccataccatgtggcacgtgacgcggggcgccgtgctgatgtatcaggggaagcgcctcgagcccagctgggcctccgtcaaaaaggatctgatctcgtacggtggcggatggcggcttcagggctcctggaacaccggggaggaggtccaggtgattgcggtcgagcccggcaaaaacccgaagaacgtgcaaaccgcccccgggacctttaagacgcccgagggcgaggtgggcgcaatcgccctcgacttcaagcccgggacctcaggctcccctatcgttaaccgcgagggaaagatcgttggcctgtacggcaatggggttgtcaccaccagcggcacatacgtcagcgcaatcgcccaagcaaaggcgtcacaggaggggccactccctgagatcgaggacgaggtattccggaaaagaaacttgacgatcatggacctgcatccaggctcgggtaagacccggcgctacctgccagccatagtccgggaggctatcaaacgcaaacttcggaccctgatattagcccctacgcgtgtggtggcctccgagatggccgaggccctcaagggcatgccaatccggtaccagacaaccgcggtcaagagcgagcacaccggaaaggagatcgtagacctgatgtgccacgctacattcaccatgcggctgctctcccccgtgcgcgtgcctaactacaacatgatcatcatggacgaggcccacttcaccgacccaagctcaatcgcggcccgggggtacataagcacccgcgtgggaatgggggaggcagccgccattttcatgaccgccacgccgcccggcagcgtagaggcctttcctcagagcaacgcagtaatccaagacgaagaacgggacatccccgagaggtcctggaactccgggtacgagtggatcactgactttcctggcaaaactgtgtggttcgtgccatccatcaagagcggcaacgatatcgccaactgtttacggaagaacggaaagcgcgtcatccagctgtcccggaagacgttcgacaccgaatatcagaaaacgaaaaacaacgactgggactacgtggtgaccaccgatatcagcgaaatgggcgccaactttcgggccgacagagtcatcgatccgcgccggtgtctcaagcccgtcatcctgaaggatgggcccgaacgcgtcatcctcgcgggccccatgccggtcaccgtggcttctgccgcgcagagacgcgggcggatcggtagaaaccacaataaggagggcgaccagtatatctacatgggtcaaccactcaacaacgacgaggaccacgctcattggaccgaggcgaagatgctgcttgacaacatcaacacccctgagggcatcatccccgccctcttcgagccggagcgggagaagtccgcagccatcgatggggagtaccgcctgcgaggcgaggcccgaaagacgttcgtcgagctgatgcgccgcggggacctccccgtgtggctttcttacaaggtggcgagcgagggcttccagtacagcgaccgccggtggtgcttcgatggcgagcgcaacaaccaggttttagaggaaaacatggacgtggagatctggaccaaggaaggggagaggaagaagctgcgcccccggtggttagacgcacgtacctactccgaccccctggccctccgggagtttaaggagttcgccgccggacgccggagcgtatccggggacctgattctcgagatcggcaagctccctcagcacctgacccaacgcgcgcaaaatgccctggacaacctcgtcatgctccacaacagcgagcagggcgggcgggcctaccgtcatgctatggaggagctgcccgacacgatcgagaccttgatgctgctggcacttatagccgtgctaaccggcggcgtgaccctgttcttcctttccggtcgggggctgggcaagaccagcatcggcctgctctgcgtcatggcctccagcgtgcttctatggatggcctccgtagagccccactggatcgccgcgagcatcatcctcgagttctttctgatggtcctgctcatccccgaaccggaccgccagcggacgccccaggacaaccagctggcatatgtggtgatcgggctcttatttatgatcctgactgtcgcggcgaacgagatgggcctgctcgagaccaccaagaaggacctgggaatcggccacgtggccgtggagaaccaccaccatgcgacaatgcttgacgtagacctgcaccccgccagtgcgtggacactgtacgccgtggccacgacaatcatcacgccaatgatgcgccataccatagagaacaccaccgcgaacatcagcctgacggccattgccaatcaggcggctatcctgatgggtctggacaaaggatggcccatctcgaagatggatatcggcgtgcccctgctcgctctggggtgctacagccaggtcaacccgctgaccctcactgcagccgtgctgatgttagtggcccattacgcgatcatcggtccgggtctccaagccaaggccacccgggaggcccagaaacgcacggccgcaggcatcatgaagaaccccaccgtcgacgggatcgtcgccattgacctggacccagtggtctacgacgccaagtttgagaagcaactgggtcaaatcatgctacttattctgtgcacctcccagattctgctaatgcgcaccacttgggccctttgcgagagcattaccttggccaccggtcctctgacgacgctgtgggaagggtcgccgggcaagttttggaacaccaccatcgcggtaagcatggcgaacatcttcaggggctcttatctcgccggagccgggctggctttcagcctcatgaagagtctcgggggtgggcgcaggggcacaggtgcgcagggggagactctgggtgagaagtggaagagacaactgaaccagctctcgaagtccgagttcaacatttacaagcgatctgggatcatggaggtggaccgctcagaggccaaggaaggcctgaagcgcggggagaccaccaggcacgccgtctcccggggcaccgccaagctgcgatggtttgtagaacggaaccttgtgaagcccgaagggaaagtaatcgacctcggctgtggtagagggggctggagctactattgtgcggggttgaagaaggtcacggaggtgaagggctacacaaagggcggcccgggtcacgaggagcctatcccgatggccacctacggctggaacctggtcaagctacactccggaaaagacgttttcttcacgccgccggagaagtgcgacacacttctgtgtgacatcggggagagcagccccaaccctactattgaggagggtcgtaccctccgcgtgttaaagatggtcgagccctggctgcggggaaaccagttctgcattaaaatactcaacccttacatgccaagtgtggtggaaactctggagcaaatgcaacgcaagcatggcggtatgctggttcggaaccccctctcccgcaacagcacccacgagatgtactgggtgtcgtgcgggacgggcaatattgtgtcagccgtgaacatgacttcccggatgcttctgaaccgcttcactatggcccaccgaaaacccacctacgagcgtgacgtggacctcggggccggcacgcgccacgtggcggtggagcccgaagtggccaacctggacatcatcggccagcgcattgaaaatatcaaacacgagcataaaagcacctggcactacgacgaggacaacccctacaagacctgggcctaccatgggtcttacgaggtcaagccgtcaggctccgcaagcagcatggtcaacggggtggtcaaactgctcactaagccctgggatgtgatcccaatggtgacgcagattgccatgacagacaccaccccattcggccagcagcgcgtattcaaggagaaagtagacacgcggactccgaaggcgaagcgcgggaccgcccagataatggaggtgaccgcccggtggctgtggggcttcctgtcccgcaataagaagccacgtatctgcacacgcgaggagttcacccggaaggtccgtagcaacgccgcaatcggcgcggtgtttgtcgacgagaaccaatggaactcggccaaagaagctgtcgaggacgagaggttttgggacctcgtacagaaggaacgtgagctgcacaagcaggggaaatgcgcaacctgtgtatacaatatgatgggcaaaagagagaagaagctgggggagttcggcaaggctaaggggtcacgggccatctggtacatgtggctcggcgcacgatttctggagttcgaggccctaggcttcatgaacgaggaccactggttctcccgcgagaactccttatccggggtcgagggcgaggggttacacaagctgggctacattttgcgggacattagcaagatccccgggggcaacatgtacgccgacgacaccgcgggatgggacacgagaatcaccgaagacgatctgcagaacgaggctaagataaccgacatcatggaaccggagcacgccctgctcgccaccagtatcttcaagctgacgtaccaaaacaaggtggtccgggtccagcgccctgccaagaacgggaccgtaatggacgtgatcagccgcagggaccagcggggctcaggacaggtgggcacctatggcctgaacaccttcacgaacatggaggcgcagctcatacggcagatggagagcgaggggatcttccttccctccgaactagagacccccaacctcgcagaaagagtgttagactggctggagaagtacggagttgagcggctcaagcgcatggcaattagcggggatgactgcgtcgtgaagccaatcgacgaccgttttgccaccgctctgacagcgctgaacgacatgggcaaggtgcgcaaggacatcccccagtgggagcccagtaaagggtggaacgattggcagcaggtccctttctgcagccaccacttccaccagctcatcatgaaggacggccgggagattgtggtgccgtgccgcaatcaggacgagctggttggccgggctcgcgtgtctcaaggagccggctggagcctgcgggagacagcttgcctcggcaagagctacgcccagatgtggcagctgatgtacttccaccggcgggacctgcgcctcgccgccaatgcgatatgctccgccgtacccgtcgactgggtgcctaccagccggaccacgtggtcgattcacgcgcaccaccagtggatgacgaccgaggacatgctgagcgtgtggaaccgcgtatggatcgaggagaacccctggatggaggacaaaacgcacgtgagcagctggggcgacgtgccgtatctggggaagagagaggaccagtggtgcggctccttgatcggcttaaccgcccgggccacctgggccagcaatatccaggtcgccatcaaccaggtgcgccggctaatcgggaacgagaactacctcgactacatgacgtccatgaaacgctttaagaacgaaggcgacccggagggggctctgtggtga

SEQ ID NO: 24438 - RNA, 9879 nt, synthetic construct
  misc_feature 1..9879: note = derived and/or modified CDS sequence (opt11) from DENV-1__HM631850__SS-prME
  source 1..9879: mol_type = other RNA
agcgtgaccatgctgctcatgctcatgccaaccgcactggcctttcacctcacaacccgcggcggggagccccatatgatcgtgtcaaagcaggagaggggcaagagcttgctgttcaaaaccagcgcgggcgtgaacatgtgcaccctcatcgccatggacctgggggagttctgcgaggacacgatgacgtacaagtgcccccggattaccgaggccgagcccgacgatgtagactgttggtgcaacgccaccgatacctgggtaacctacgggacttgcagccagaccggggagcaccggagagataaacggagcgtggccctggcgccccacgtgggtctcgggctggagacccgcaccgagacctggatgagctcagaaggtgcctggaagcagatccaaagagtggagacctgggccctgcggcaccccggctttactgtgatcgccttgttcttggcgcatgccataggaacgagcatcacccagaagggcatcatcttcatactgctaatgctggtgaccccctccatggccatgcgttgcgtcgggattggcagccgcgactttgtggaggggctgtccggcgcgacgtgggtggatgtcgtgcttgagcacgggagctgcgtgaccacgatggccaaggacaaacccacccttgacatcgagctgctcaagactgaggtcaccaaccccgcggtgctgcggaagctctgcatcgaggccaagatctccaacacaaccacggacagccgttgccccacccagggcgaggccaccctcgtggaggagcaggacgccaacttcgtctgcaggaggacctttgtggaccggggctgggggaacggctgcgggctgtttggcaaggggtctctcatcacgtgcgccaagttcaagtgcgtgactaagctggaaggcaagaccgtccagtacgaaaacctgaaatacagcgtgatcgtcacggtccacacgggcgaccagcaccaggtgggcaacgagtccaccgagcatggcaccacggcgaccattacgccccaggccccctcaaccgaaatccagctgacggactacggcgccctcaccctggattgctcgcctcggacgggcctagacttcaacgagatggtcttactgaccatgaaggagaagtcctggctcgtgcacaagcagtggtttctagacttgccgctaccctggaccagcggggcctcaaccagccaggaaacgtggaaccggaaggacctcctagtgaccttcaagactgcccacgcgaagaagcaggaggtagtggtgctgggctcacaggaaggcgccatgcacaccgccctcacaggggccaccgagatccaaaccagcggaactacgacaatctttgccgggcatctgaagtgtcgcctgaagatggataagctcacactaaaaggcatgtcctacgtcatgtgcaccgggtctttcaagttagagaaggaggtggctgaaacgcagcatgggaccgtgctcgtccagatcaagtacgagggaacagacgccccatgcaagatccccttttctacccaggacgagaaaggcgtgacgcagaatggccgtctgatcacggccaaccccatcgttaccgataaagaaaagcccgtcaacatcgaggccgagccccccttcggagagagctacatagtgatcggcgcgggcgagaaagccctgaagctgtcctggttcaagaaggggagctccatcggtaagatgttcgaagcgaccgcgcgcggcgcccggagaatggcgattctcggcgacacggcctgggacttcgggtcgatcgggggggtgttcacctcagtcgggaagctcgtgcaccaaatctttggtaccgcctacggggttcttttctctggcgtctcctggaccatgaagatcgggattggcgtgctcctgacgtggctgggactcaactcgcgctccaccagcctgtccatgacctgcatcgccgtcggtttggtcaccctctacctgggcgtaatggtgcaggccgattcggggtgtgtcataaactggaagggtcgtgagcttaaatgcgggagcggtatcttcgtgacgaacgaggtgcacacctggaccgagcagtacaaattccaggcggactccccaaagcgcctcagcgccgccatcggcaaggcctgggaggagggggtctgtggcattcgctccgccacccgactagagaacattatgtggaagcagatcagcaacgagctgaaccatatattgctggagaacgacatgaaattcaccgtggtggtcggggatgttgccggcatcctggcccaagggaagaagatgatccggccccagcctatggaatacaagtactcctggaagtcgtggggcaaggccaagatcatcggcgccgacgtacagaacacgaccttcatcatcgacgggcccaacactccggagtgcccagacgaccaacgcgcctggaatatctgggaggtcgaggactacggcttcgggatcttcaccacgaacatctggcttaaactccgggactcctacacccaggtatgcgaccaccgacttatgagcgccgccatcaaagattccaaggccgtccacgcggacatgggttactggattgaaagcgagaagaacgagacctggaagctcgcgcgggcgtctttcatcgaggtgaagacctgcatctggccgaaatctcacactctgtggtccaacggcgttcttgagagcgagatgatcatcccgaaaatctacggaggcccgatctcccaacacaactaccgccccggatacttcacccagaccgccggcccttggcacctcgggaagctggagctggacttcgatctctgcgagggcaccacggtagtggtcgacgagcactgtggcaaccgcgggccgtccctgcgcaccaccaccgttacgggcaagatcatccacgagtggtgctgcagaagttgtacccttcctcccctgagatttaagggggaagatggctgctggtacgggatggagatccgccctgtcaaggagaaggaggagaacctggtgaagagcatggtgtctgccggctcgggcgaggtcgacagcttctccctaggtctcttgtgcatcagcatcatgatcgaggaggtgatgcgctcccgttggtctcgcaaaatgctgatgacgggcaccctcgccgtctttttcctactgatcatggggcagcttacgtggaacgacctgatcaggctgtgcatcatggtcggcgcgaatgcctcagacagaatggggatgggtaccacgtatctcgccctgatggccacattcaaaatgagaccgatgttcgcagtgggcctcttattccggcgcctgacaagccgggaggtgctgttgctgaccatcgggttgtccctcgtcgcttccgtggagctccccaactccctggaggaattaggcgacgggctggccatgggcatcatgatcttgaagctcctgaccgattttcaaagccaccagctctgggccaccctgctgtccctaacgttcattaaaaccaccttcagtctccactacgcctggaagactatggcaatggtgctgtccatagtgtcgttattcccgctttgcctgtccacgaccagccagaaaaccacttggctgccagtgctcctgggctcgcttgggtgtaagcctctcacgatgttcctgatagcagagaacaagatttggggccgcaagagctggccactgaacgaagggatcatggcggtcggcatcgtgtcgatccttctgtcctccctgctcaagaatgacgttcctctggccgggccccttatcgccggcgggatgctcatcgcctgctacgtcatctccgggagctcccccgacctgtccctggagaaggccgccgaggtgtcctgggaggaggaggccgagcacagcggcgcatctcacaacatcctcgtggaggtacaggatgacgggaccatgaagattaaggacgaggagcgggatgataccctgacaatcctgctcaaagctaccctgctggccgtatctggggtttaccccctgtctatacccgccacgttattcgtctggtacttctggcagaagaagaagcagcgcagcggggttttatgggacacgccgagcccacccgaggtggaacgggccgtcctcgacgacggcatctaccgaatcatgcagcggggcctgctggggcgcagccaggtgggcgtgggagtcttccaggagaacgtgttccacactatgtggcacgtgacgcggggcgccgtcctgatgtaccagggaaagcgcctcgagccctcctgggcaagcgtgaagaaagacctgatctcctacggcggggggtggcgtctccagggcagctggaataccggggaggaggtgcaagtcatcgccgtggagcccggcaagaacccgaagaacgtgcagacagcacccgggacattcaagacctccgagggcgaggtcggcgccatcgccctcgacttcaaacccggtacgagcggaagtcccatcgtgaaccgcgaggggaagatagtggggttatacggcaacggagtcgtgaccaccagtggcacatacgtgagcgcgatcgcgcaggccaaggcctcccaggaggggcctctgcccgagatcgaggacgaggtgtttcggaagcgcaacctcacgatcatggatctgcacccaggcagcggaaaaacacggcgctatttaccggcgatcgtgcgggaggccattaagaggaaactgcggaccttgatcctggcccccactcgcgtggtcgcttccgagatggccgaagcgcttaaaggcatgcccatccgctatcagacgaccgccgtgaaaagcgagcacaccggtaaggaaatcgtggacctaatgtgtcacgccaccttcacgatgagactgctctctcccgtccgcgtacctaactacaacatgatcataatggacgaggcccacttcaccgaccctagttccatcgccgcgcgggggtacatcagcacccgggtgggaatgggggaggccgccgccatcttcatgaccgccacgccgcccggctccgtggaggcgttcccgcagagcaacgccgtgatccaggatgaggaacgggacatccccgaacgctcctggaattccggatacgagtggataactgacttccccgggaagaccgtgtggttcgtcccctccatcaagtcaggcaacgacatcgccaactgcctgcggaagaacggaaagcgcgtgatacagttatcccggaagacatttgacacggaatatcaaaagaccaagaacaacgattgggactacgtagtcaccaccgacatcagcgagatgggcgccaacttccgggcggaccgggtgattgacccgcgccggtgcttgaagcccgttatccttaaggacgggcctgagagggtcatcctggccgggcccatgccggtgacggtcgcgtccgccgcacaacggcgcggccggatcggccgcaaccacaacaaggagggggaccagtacatctacatggggcagcctctcaacaacgacgaggaccacgcgcactggacagaggcaaaaatgctgctagacaacatcaacacgcccgagggcatcatcccagccttgttcgagcctgaacgggagaagagcgccgccatcgacggcgagtaccgcctacgcggggaggcgcggaagaccttcgttgagctgatgcgccggggggacctccctgtgtggcttagctacaaggtggctagcgagggcttccaatactccgaccgacggtggtgcttcgacggcgagcggaacaatcaggtgctggaggagaacatggatgtcgagatctggacaaaggaaggtgagcggaagaagctccgaccccgatggttagacgcccgcacatactctgatccccttgccctccgggagttcaaagagttcgccgcgggccgtcgttccgtgtccggggacctaatcctggaaatcggcaagctcccgcagcacctgacccaaaaggctcagaacgccctagacaacctcgtgatgctgcacaatagcgagcagggggggcgcgcctaccggcacgcgatggaagagctccccgacaccatcgagacgctcatgctattagccctcattgctgtgctgaccggaggtgtcacacttttcttcctctccggacgcgggctgggcaagacctccataggcttactctgtgtcatggcctcgagcgtgcttctgtggatggcctccgtcgagccgcactggatagcggccagcatcatcctcgagttcttcctgatggtgctgctcatacccgagccggaccggcaacgcacgccccaggacaaccagctagcatacgtggtcatcggcctcttgttcatgatcctgacggtggccgccaacgagatggggctgctcgagaccaccaaaaaggacttaggtataggccacgtggcagtcgagaatcaccaccacgccgcaatgttagatgtggacctccatcccgcctctgcttggaccctgtatgcggtggccaccacaataataaccccgatgatgcgccacaccatcgagaacacgaccgccaacataagcttaacagccatagctaaccaagccgccatactcatgggactggacaaaggctggcccatctccaagatggacatcggcgtccccctgcttgctctagggtgttacagccaagtgaatcccctgaccctgacggccgcagtgctaatgctggtagcacactatgcaattatcgggccgggtttacaggccaaagccactcgcgaggcgcagaaacggaccgccgccggtatcatgaagaacccgaccgtagacgggatcgtagccatcgacctagaccccgtcgtgtacgacgctaagttcgagaagcagctgggccagatcatgctcctgatcctgtgcacatcccagatactcctgatgcgtacaacctgggcgctgtgcgagagcataacgctcgccacgggaccgcttaccactctgtgggaggggtcaccggggaagttctggaacaccacgatcgccgtgagcatggcgaacatcttcagggggagctacctcgccggcgcgggactggcgttctccttaatgaaatctttggggggcgggcggcgcggcaccggagcccagggcgagacccttggggagaagtggaagcggcagctgaaccagctctcaaagtccgagttcaatacctacaagcgctccgggataatggaagtcgaccgtagtgaggccaaggaaggcttaaagcgcggggaaactaccaaacacgctgtgtcccggggtacagcgaagttacgctggttcgtcgagcggaatctcgtcaagcccgaggggaaggtgatcgatctgggctgtggacgggggggctggagttactattgtgcggggttaaagaaggtgaccgaggtcaagggatacactaagggcgggcccggccacgaggagcccatcccgatggccacctacggatggaacctggtgaaactacactccggaaaagacgtcttcttcatcccacccgaaaaatgcgacaccctactctgcgacatcggggagagctcgccgaacccgaccatcgaggagggccggacgctacgcgtcctgaagatggtagagccctggctacgtggtaaccagttctgcataaagattctcaacccctatatgcccagcgtcgtcgaaaccctcgaacagatgcagcgcaagcacggcggcatgctggtgcgaaatccgctttcgaggaacagcacccacgaaatgtactgggtgagttgtgggaccggtaatatcgtaagcgccgtgaacatgaccagccggatgctgctgaaccgttttacgatggcccacagaaaacctacctatgagcgcgatgtggatctcggggccgggactcggcacgtcgcagtagaaccggaggtggcaaacctggacatcatcggccaacggatcgagaacatcaagcacgagcacaaaagtacttggcactacgacgaggacaatccctacaagacgtgggcctaccatgggtcctacgaggtcaagccgtctggcagcgcgtccagcatggttaatggggttgtgaagttactcaccaagccctgggacgtgatccccatggtcacacagatcgccatgactgacacgaccccgttcggccaacaacgcgtgttcaaggagaaggtggatacgcggacaccaaaggccaagaggggtacggctcaaatcatggaagtcaccgccaagtggctttggggctttctgtcccgtaacaagaagccccgcatctgcacccgggaagagtttacccgcaaggtgagaagcaacgcggccatcggagccgtgttcgtcgacgagaaccaatggaactccgccaaggaggcggttgaggacgagcgcttctgggacctagttcaccgagagagagaactacacaaacaggggaagtgcgccacgtgcgtatataacatgatgggcaaacgggagaagaagctgggggagttcggcaaggccaagggtagtcgcgcaatctggtacatgtggctgggcgcccgtttcctcgagttcgaggcgctcgggttcatgaacgaagaccattggttttcccgggaaaactctctttccggggtagagggcgaggggctccacaagctgggatacatcctccgcgacatcagcaaaatcccagggggcaacatgtacgccgacgacaccgcaggatgggacactcgcatcaccgaggacgacctgcagaatgaggccaagatcacggacattatggagccggagcatgccctgctcgctaagtccatattcaagctgacgtaccaaaataaagtggtccgggtccagcgccctgccaagaacgggaccgtgatggacgtaatcagccggcgcgaccagcgcggcagcggccaagtgggcacctacggtctgaacacgttcaccaatatggaggcccagctcatccggcagatggagagcgaggggatcttctcccccagcgagctggagacccccaacctggccgggcgcgtgctcgactggctagagaagcacggggtcgagaggttaaagcgcatggccatctccggcgatgactgcgtggtgaagccgatcgatgatagattcgctaccgcgctcacggccctgaatgacatgggtaaggtccgcaaggacatcccccagtgggagccgtcgaagggctggaatgactggcagcaggttcccttctgcagccaccacttccatcaattgatcatgaaggacggcagagagatcgtcgtcccgtgccgcaaccaagacgagctcgtggggcgggcccgagtgtcacagggcgccggatggagcctgagagagaccgcctgcctggggaagagctacgcccagatgtggcagctcatgtacttccaccggcgtgacctgcgcctggctgccaatgcgatctgcagcgccgtccccgtggactgggtgcccacatcccgcaccacgtggtctatccacgcccaccaccagtggatgaccacagaggacatgctgagcgtatggaatcgcgtgtggatcgaagagaacccctggatggaggacaagacccacatcagcaactggggcgacgtgccgtacctgggaaagcgggaggaccagtggtgcggcagcctgatcgggctcactgcccgggccacctgggctaccaacatacaagtcgcgattaaccaagtgcggcgcctgatcggcaacgaaaactacctggactacatgacaagcatgaagcgcttcaagaatgagtccgaccccgagggcgccttgtggtga

SEQ ID NO: 24439 - RNA, 9879 nt, synthetic construct
  misc_feature 1..9879: note = derived and/or modified CDS sequence (opt11) from DENV-1__KF955446__SS-prME
  source 1..9879: mol_type = other RNA
agcgtaacgatgttcttaatgctaatgccaactgccctagccttccacctaactacccgtggaggtgaacctcatatgatcgtatcaaaacaagaaaggggaaaatccttgttatttaaaacaagcgctggcgtgaacatgtgcactctcatcgccatggacctcggtgaactttgcgaagataccatgacatataaatgccctagaataacggaaacagaaccggacgacgtagattgctggtgcaatgccacggatacttgggttacctatggcacctgttctcaaaccggcgaacacaggagagacaaaaggtccgtcgcactagcaccacatgtaggactcggactagaaacgagaacagaaacgtggatgtcaagcgaaggagcctggaaacagattcaacgagtagaaacctgggccttacgccaccccgggttcaccgtcatagcgttgtttctcgcacatgcgatcggcacttccataacacaaaaagggatcatcttcatactactcatgctagtaactccatctatggcaatgcgctgcgtagggataggaagtcgcgatttcgtggaagggttgtccggagccacctgggttgacgtggtcctcgagcacgggtcatgcgttacgaccatggccaaagacaaaccgacgctggacatcgaactgctgaaaaccgaggttactaaccccgctgtactaagaaaactctgcatagaagccaaaataagcaacactaccacagattcgcgttgtccaacccaaggggaggcgacattagtggaagaacaagacgcaaacttcgtatgccgccgaacgttcgtagaccgcgggtggggaaacggctgtggtctctttggcaaaggaagcctaataacttgcgccaaattcaagtgtgtcactaaacttgagggtaagatcgtccaatacgaaaacctaaagtacagtgtaatagtgacagtccacacaggagaccaacatcaggttgggaatgaaagtacagaacatgggacgacggccactattactccgcaggcaccgacgacggaaatacaattgaccgactacggagcgctaactttggactgcagcccgcggaccggactcgattttaacgagatggtcctgctgaccatgaaagaaaagtcgtggctcgtacacaaacaatggtttctggaccttcccctaccctggacaagcggcgcatccacgtctcaagaaacctggaacagacaagatctcctagtcactttcaagactgcccacgccaagaagcaagaagttgtagtgctcggatcccaggagggggcaatgcacacagcgctaacgggcgctacagagatccagacgtcagggacaacaacaatattcgccggccatctgaaatgccgcctgaagatggacaagttaaccctaaaaggaatgagctatgtcatgtgcacgggcagtttcaaactggaaaaggaacttgccgagacccaacacgggacggtgctcgtgcagattaaatatgagggaaccgacgccccatgcaaaataccattcagcacgcaggacgaaaaaggtgtcacacaaaacggacggctcattacagcaaacccaatcgtgaccgataaagagaagcccgtcaacatagaagcggaacctcctttcggtgagtcctacatagtcatcggcgcgggggaaaaagcgctcaaactaagctggttcaagaaaggcagcagcatcggcaaaatgttcgaagcgacagcccgaggtgcccggaggatggctatattaggagataccgcttgggactttgggtcgatcggaggagtcttcacatcagtcgggaaactcgtccaccaaatattcggcacagcctacggcgtcttgttctcgggcgtctcctggacaatgaaaattggcatcggagtactcttaacctggctcggcttaaactcgagaagcacaagtttgagcatgacatgcatagcagtcggactcgtcactctctatcttggagtaatggtccaggccgacagtggttgcgtaataaactggaaaggacgcgaactcaaatgcggatcgggaatcttcgtcacaaacgaagttcatacctggacagaacaatataagttccaggcagacagcccaaagaggctatcagccgcgatcggaaaagcatgggaagaaggcgtatgcggcattcgctccgccacacgacttgaaaacataatgtggaaacaaatctcaaatgagctaaaccacatcttgctggaaaacgatatgaagtttacagtagtagtgggcgacgtcgccgggatactcgcccaagggaagaaaatgatacgcccgcaaccaatggaatacaaatacagttggaagtcatgggggaaagcaaaaatcatcggcgcggatgttcaaaacaccaccttcattatcgacggacctaatacccccgagtgtcccgacgatcagagagcatggaacatctgggaggtagaggactacgggtttggcatttttacaacaaacatatggctaaagctcagggattcgtacacccaagtctgtgaccatcgcctcatgtcggcggccatcaaagactcaaaagcagtacacgcagacatgggatactggatcgaatccgagaaaaacgagacatggaagctggcacgcgcttcctttatcgaggtaaaaacctgcatttggccgaaaagccatacgctatggagtaatggggtccttgaaagtgagatgatcatacccaaaatctacggaggcccaattagccagcacaattaccgacccggttacttcactcaaacagcaggaccatggcatctcgggaaactcgaattggatttcgatctgtgcgaaggtaccactgtagtagtcgacgaacactgtggcaacagagggccgtccctcagaacaacgacggtgacggggaaaatcatccacgaatggtgctgcagatcgtgcacgctacccccgttgcgattccgaggggaagacggctgctggtatggaatggaaatccgtcccgtcaaggaaaaagaagaaaacctggtgaaatcaatggttagcgcaggatcaggagaggtagacagtttctcactcggactactgtgcataagcataatgatcgaggaggttatgcgcagccgatggagccgcaaaatgctcatgacgggcacactcgcagttttcttcctactcattatgggtcaactgacctggaacgacctcattcgcttgtgcataatggtaggagcgaacgcctcggatcgaatgggcatgggcacgacctacctcgcgctgatggccacattcaagatgagaccgatgtttgccgtagggctactgtttagacgtctaacttcgcgagaggtcctattgctaacaataggcctttctcttgtagctagcgtggaactgccaaattcactagaagaactaggagacggtctagccatgggaattatgatcttgaaactgctaaccgactttcagagccatcagctatgggcgaccctcttgagtctgacgttcataaagaccaccttttcactccactatgcttggaaaacgatggcaatggttctctcgatcgtgagcttatttcccctttgtctgagtacaacatcgcagaaaacgacttggctccctgttctgctcggcagcctaggatgcaagcccctcaccatgttcttaatagccgagaataagatctggggaagacggagttggccgctgaacgaagggattatggcggtcggaatcgtaagtattctactgtcgtccctgctgaaaaacgacgtccctctagcaggaccgttgatcgcaggaggaatgctaatagcgtgctacgtgatcagtggcagcagtgcggatctaagcctcgagaaggcagcagaggtctcatgggaagaagaagcggaacactcaggtgcaagccataatatcctagtcgaggtccaagatgacgggacgatgaaaataaaggacgaggaacgagatgacacactaaccatacttctcaaggcgaccctcttagcagtaagcggggtgtacccgctctcaataccagcgacactattcgtgtggtacttctggcaaaagaagaaacagcggtctggggtgctctgggacaccccgagcccaccggaggtagaacgagcggtactggatgacggcatataccgaattatgcagagggggctcttgggaaggagtcaagtaggagtcggggtattccaagagaatgttttccacacaatgtggcacgtgacacgaggagcagtactaatgtaccaggggaaacgcctagagccatcgtgggcaagcgtcaagaaagacctcatatcgtatgggggcggctggcgactccagggatcttggaacacaggcgaagaagttcaggtcatcgcagtggaaccaggcaaaaatcccaagaatgtacaaacggcgccaggcacattcaaaacgccagagggcgaagtcggggccatagccctcgacttcaaaccgggtacctccggcagcccaatagtgaaccgtgagggaaaaattgtcgggctctacggtaacggggtagttaccacctctggcacatacgtctcagctatcgcgcaggccagggccagccaagaaggtcctctacccgaaattgaagcggaggtttttcgaaaacgcaaccttaccattatggacctacaccctggctcgggaaaaacacgccggtatctaccagccatagtcagggaagcgatcaaaagaaagctacgaaccctaatcctggcccccacccgcgtcggggccagtgagatggcagaggccctcaaaggaatgcctatccgatatcagacaactgctgtaaagtcggaacacaccggcaaagaaatagttgacctgatgggacacgcaacattcacaatgggtctattagctcctgggagggtgccaaattacaacatggtgattatggatgaggcacacttcacagatccatctcgaatagcagctcgagggtacatttccacccgagtgggcatgggagaagctgccgccatctttatgacagctacgcctccagggtcggtcgaagcattcccacaatccaacgccgtgattcaggatgaagaaagggacatcccagaaagatcgtggaactcaggctacgagtggattaccgacttcccggggaaaacggtttggttcgtgccaagcataaaatcaggaaacgacattgcgaactgcctccgcaaaaatggtaagagagtaatccagctatcccgaaaaacgttcgacaccgagtaccagaaaaccaaaaataacgactgggactacgtagtcacaaccgacatatcagagatgggcgctaactttcgggcggaccgggtcatagatccaagaaggtgcctaaacccagtaatcctcaaggacggtccggaaagagttatccttgccggccctatgcccgtaacagtggccagcgctgcacaacgccgcggcagaatcgggagaaaccacaacaaggaaggcgatcagtacatctacatgggacaacccctgaataacgacgaggaccatgccccatggacggaagcaaagatgctgcttgacaacataaacacacccgaaggtatcattcctgccctctttgaaccagagcgcgagaagtcagcggctatcgacggtgagtcacggctacgaggggaagcccgaaaaaccttcgtcgagctaatgcgaaggggagacttgccggtatggctgagctacaaagtggcctccgagggcttccaatactccgaccgacgatggtgtttcgacggggaacgtacgaatcaggtactagaagaaaacatggcggtagaaatctggccaaaagaaggagagaggaagaaattgcgaccgcgatgccttgatgcaaggacctatagtgaccctttagcgctgagggaatttaaggagttcccaccaggccgaaggagtgtctcaggagacctcatacttgagataggcaagctaccgcacccacttacgcagcgaccgcaaaacgccttagccaccctcgtcatgagccacaccagcgaacagggtggacgagcgtacagacatgcaatggaggagctcccggccacaatagaaaccctaatgctactagcgcttatcgccgtcctcacaggaggagtcacgctatttttcctctccgggagaggactaggcaagacaagtataggcttgctgtgcgtaatggcctctagtgtgctactgtggatggccagcgtcgaaccccactggatcgcggcgtccatcatcctggagttcttcttgatggtactattgattcccgaaccagactccaacgctacacggcaagacaaccagctggcctacgtagttatcgggctacttttcatgatcctcaccgtcgccgccaacgaaatgggcctactagagacgaccaagaaagaccttgggatcggccacgtggctgtcgagaaccaccatcacgccgctatgctggacgtagaccttcaccccgccagcgcctggaccctctatgcagtagccacgacaatcattacaccgatgatgcgacataccatcgaaaacacaacggccaacataagcctcaccgcaatcgcgaaccaggcagccatattaatggggctcgccaagggatggccaatcagcaagatggacataggcgtcccactcctcgcattgggatgctatagccaggtaaaccccctcacgttaacggctcccgtcttgatgctagtcccacattatccaataataggaccgggcctccaagccaaggccaccagagaggctcagaaaagaaccgctgcaggaatcatgaagaacccaacagtcgacggcattgtagcaatcgacctcgaccctgtagtctacgatgccaagtttgaaaagcaattaggccaaataatgcttcttatcctatgcaccagccaaatactacttatgagaacaacgtgggcactctgcgagtccataacgcttgccaccggcccattaacgactctttgggaggggagtcctgggaaattctggaacacgaccatagcagtatccatggcgaacatattccgtggaagctacctagctggtgccggattagcattctcactaatgaaatcgttaggcggaggacgccgcggtacaggggcacaaggcgaaacactcggggaaaagtggaagcgccagctcaaccagctaactaagtccgagttcaacacgtacaaacgttccgggatcatggaagtagatcggagcgaagctaaagaagggctgaagcgtggcgaaacgacaaagcatcccgtgagccgtggcacggcgaaactccgctggttcgtagagagaacactcgtaaagcccgaggggaaggtaatagatcttggctgcgggcggggtgggtggtcgtattattgcgcaggtttgaagaaagtcaccgaggtgaagggctacaccaaaggaggacccggtcatgaagacccaataccaatgggaacctacggctggaaccttgtaaaactgaggtcaggcaaagacgtattctttatcccgcccgaaaaatgcgacacgctcctttgtgacatcggcgaaagctcgcctaacccgactatagaggagggccgaaccctgcgcgtacttaaaatggtcgaaccatggttacgtggcaatcaattctgcattaaaatactaaacccgtacatggcatcagttgtcgaaacattagaacagatgcaacgaaagcacgggggaatgctggtccgcaaccctctatctcggaactccacccatgaaatgtactgggtatcatggggtaccggaaacatagtaagcgccgtcaacatgacaagccgaatgctgctgaaccggttcaccatggcccacagaaaaccaacttatgaacgcgacgtcgaccttggcgcgggaacacgtcatgtagctgtcgaaccagaggttgcgaatctggatatcatagggcaacggatagaaaacataaaacatgaacacaaatctacatggcattacgacgaagacaatccttacaaaacctgggcctaccatggcagctacgagggcaaacccagcggaagcgcgagttcgatggtaaacggaggcgtcaaactgctaacgaaaccatgggacgggataccaatggtaacgcaaatcgccatgacagacacgactcctttcggtcaacaacgggttttcaaggaaaaagtcgacactcggaccccaaaggcaaagcgaggcactgcacagatcatggaggtaaccgctaagtggctgtgggggttcctaagtcgcaacaagaaaccacgaatatgcacacgggaggagtttacaaggaaggtccgcagcaacgccgcaataggggctgttttcgtggacgagaaccaatggaacagcgcgaaagaagcggtcgaggacgagcgattctgggaccttgtacaccgcgagagagaactgcataaacaggggaagtgcgctacatgcgtatacaatatgatgggcaaaagggagaagaaactcggcgagtttgggaaggcaaaagggagcagggcaatctggtacatgtggctaggcgccagattcctcgagttcgaagccctagggtttatgaatgaagaccactggttctctcgggaaaactcattgtcgggggtcgagggcgagggcctccacaaactcggttacatactgagggacatcagcaaaataccagggggcaatatgtacgcagacgacacagcgggctgggacacgaggatcacagaggacgatctacagaatgaagcaaggataacggacataatggaacctgaacatgcactgcttgccaaatcgattttcaaactaacataccagaacaaagtagtcagagtgcaacggcccgcgaaaaacggcacagtcatggatgtgatatccagacgcgatcaaagaggctccggtcaagtggggacatacggactaaacaccttcacgaacatggaagctcagcttatccgtcaaatggaaagcgggggtatcttcagtccgcgggaactagaaacccctaacctagcagaaagagtccttgattgggtggaaaaatatggcgttgaacgcttagagaggatggccattagtggggacgattgtcttggagagccaatttacgacagattcgcaaccgccctcacggctcttaacgacatgggtaaagtgcgcaaggacataccacagtgggaaccgtcgaaagggtggaatgactggcagcagggaccgttttgctcacaccatttccaccaacttataatgaaagacgggagagagatcgtcgtgccttgcagaaaccaagatgagctagttggacgcgcacgagtctcccaaggagccggatggagcctccgagaaacggcatgcctaggaaagtcatatgcacaaatgtggcaactgatggacttccaccggagggacttacgacttgccgcgaatgccatatggtcggcaggaccgggcgactggattccaactcggcggacaacctggagcatacacgcgcaccaccagtggatgaccacggaggacatgctgtcagtatggaacagagtatggatagaagaaaacccatggatggaagacaagacgcacatatcctcatggggcgatgtgccgtatctggggaagcgagaagatcaatggtgcggctccctgatcggacttacagcccgggcaacttgggcgacgaacatccaggtagcgatcaaccaagtaagacgcctgatcgggaacgagaactacctcgattacatggctagcatgaaacgcttcaagaatgagtccgatcccgagggcgccctctggtaa

SEQ ID NO: 24440 - RNA, 9879 nt, synthetic construct
  misc_feature 1..9879: note = derived and/or modified CDS sequence (opt11) from DENV-1__KF921942__SS-prME
  source 1..9879: mol_type = other RNA
tccgtgaccatgctcctcatgctaatgcccacggcgctggcgtttcacttaaccacacgcggcggggaaccccacatgatcgtttcaaagcaagagcgtgggaagtccctactgttcaagacatcagcaggtgtgaatatgtgcaccctgatcgctatggacctaggcgagttgtgcgaggacacaatgacctacaagtgccctcggatcaccgagaccgagcctgacgacgtggactgttggtgcaacgccacagatacctgggtaacctacgggacctgctcacagacgggcgaacatcggcgggacaagcggtccgtcgcgctcgcgccccatgtgggcctggggttagagactcggaccgagacctggatgagcagcgagggcgcttggaagcagatacagcgggtcgagacctgggccctccggcatcccgggttcaccgtgatcgccctgttcttggcacacgcaattggcaccagcatcacccagaagggaatcatcttcatcctcctgatgttggtaactccctccatggccatgcggtgtgtagggatcggctctcgcgatttcgtagaggggctatccggcgccacctgggtagacgttgtgctcgagcacgggtcttgcgtgactaccatggccaaggataagcccacattagacatcgagctcttaaagaccgaggtcgccaaccccgcggtccttcgaaagctctgtatagaagcgaagatctccaataccacgacagatagccgatgcccgacccagggcgaggccacactggtcgaggagcaggacgccaatttcgtctgccggcgcaccttcgtggaccggggctggggtaatgggtgcgggttgtttggcaagggttcactcatcacgtgcgccaagttcaaatgcgttaccaaactggaggggaaaattgtccagtacgagaacttaaagtatagcgtgatcgtgactgtccacacgggagatcagcaccaggtggggaacgagtctacggagcacggtaccaccgcgaccatcaccccccaggcaccgactacggagatacagctgaccgactacggggccttgacgctggattgcagcccccgcactggcctcgacttcaacgagatggtacttcttaccatgaaggaaaagtcctggctcgtacataaacagtggttcctggacctgcccctgccctggaccagcggagcgagcacgagccaagagacctggaaccggcaagacctactggttacctttaagactgcgcatgcgaagaaacaggaagtcgtagtgctaggctcgcaggagggcgccatgcatacagccctgacgggggccaccgagatccagacctccggcaccaccacgatattcgccggacacctgaaatgccgccttaagatggataagctcaccctaaagggcatgtcgtacgtgatgtgcaccggatcctttaagctggagaaggagctggcagaaacacagcacggcaccgtgctggtgcaaataaagtacgagggtaccgacgccccctgcaagattcctttctctacccaggatgagaagggagtcacgcagaatggccggttgatcaccgccaaccccatcgtgaccgataaggagaaaccagtgaatattgaggccgagccgcctttcggggagagctacatcgttatcggcgcaggcgaaaaggccctaaaattaagttggtttaaaaaggggtccagcatcggcaagatgttcgaggccaccgctagaggggcccggagaatggccatcctaggcgacacggcctgggacttcgggagtataggtggtgttttcacgtcggccgggaaactcgttcaccaaatcttcggcaccgcatacggtgtactgttctctggcgtgagctggactatgaaaatcggtatcggagtacttctcacgtggctcggcctaaacagtcgcagcacctccctcagcatgacatgcatagccgtcgggctggtgaccctgtacttaggcgtgatggtccaggcggacagtggatgtgtgatcaattggaagggccgggagctgaagtgtgggagtggaatcttcgttacgaacgaggtccacacatggacggagcagtataagttccaagctgacagcccgaagcgcctgtccgccgccataggcaaggcctgggaggaaggagtgtgcggcattcgcagcgcgacccgtctcgagaacatcatgtggaagcagatctccaacgagctgaaccacatcctgctcgagaatgacatgaagttcaccgtggtcgtgggggacgtagccggcatcctggcccagggaaagaagatgattagaccccaacccatggagtacaaatattcatggaagtcctggggcaaggccaagatcatcggagcggatgtgcaaaacacaacgttcatcatcgacggtcccaacaccccggaatgccccgacgatcagcgcgcctggaacatttgggaagttgaagactacggctttgggatcttcacaaccaacatttggctgaagttgcgggattcttacacccaggtgtgcgatcacaggctgatgtccgccgcgatcaaggatagcaaggccgtccacgccgatatgggctactggatcgagagcgaaaaaaacgaaacctggaagctcgctagggccagcttcatcgaagtgaagacctgcatctggcctaagtcccacactctctggtcgaacggggtcttagagtccgaaatgatcatccccaagatatacgggggcccgatctcacaacacaactaccggcctggttacttcacccaaacggcaggaccctggcacctggggaagcttgagttggatttcgatctttgcgaggggaccactgtcgtggtggacgagcactgtggtaaccggggaccgagcctccgcaccaccaccgttacgggcaagatcatccacgagtggtgttgcaggtcctgcaccttaccgcccctgcgcttccgaggtgaggacgggtgctggtacggaatggagatccgccccgtgaaggagaaggaggagaacctcgtgaaatccatggtgagcgctggcagcggcgaggtggattccttcagcctggggttattgtgcatctccatcatgatcgaggaagtgatgcggagccgctggtcccggaagatgcttatgaccgggaccctggcggtcttcttcctcctcatcatgggacagctaacttggaacgatcttatccgactgtgcatcatggtgggagccaacgccagcgacagaatggggatggggacaacatacctcgccctcatggcgaccttcaagatgcggcccatgttcgcggttggcctgctatttcgccggctcacctccagggaggtcctgctgctaactattggactaagcctggtggcctccgtggagctcccaaacagcttagaagagctaggcgacgggctcgccatgggcatcatgatcctcaaactgctcaccgattttcagtcccaccagctgtgggctacactgctcagtctgacattcatcaaaacaacgttctccctacattacgcgtggaagaccatggccatggtcctcagcattgtgtccctgttccccctgtgcctcagcacaacctcccaaaagaccacctggcttccagtactactcggctccctagggtgcaaacctctgaccatgttcctcatagctgagaacaagatctggggtcgacgctcctggccactaaacgagggcatcatggccgtgggcatcgtgtcgatcctgctctcttccttgctgaagaacgatgtccccctagccggtcccctgatcgccggcggcatgctgatcgcgtgttacgtgattagcgggagcagcgcagacctctccctcgagaaggccgcggaagtttcgtgggaggaggaagcagaacattccggcgccagccacaatatcctggtcgaggtgcaagacgacggaacgatgaagatcaaagatgaggagcgggacgacacactcaccatcctgctgaaggccaccctcctcgccgtttccggcgtataccctctgagcatccccgccaccctcttcgtgtggtacttttggcagaagaaaaagcaacgctcaggtgtgttatgggacacccctagcccgcccgaggtcgagagggctgttttagacgacggcatatataggattatgcaacggggcctgctcggccggtctcaggtgggtgtaggagtgttccaggagaacgtgttccataccatgtggcatgtcacccggggcgccgtgcttatgtaccaagggaagcgattagagcccagctgggccagcgtgaaaaaggacctcatcagctacggaggcgggtggcggctacagggcagttggaataccggagaggaggtccaggtgatagccgtggagccaggcaaaaatcccaaaaacgtccagaccgcacctgggacctttaagacccccgagggcgaagtgggtgcgatcgcattagacttcaaacccggaacgtcgggttcccctatcgtgaaccgcgaggggaagatagttggcctctatgggaatggagtggtaaccaccagcggcacctacgtcagtgccatcgcccaggcgaaagcctcccaggaggggccgctaccggagattgaggacgaggtgttccgaaagcgcaacctgaccataatggatctgcaccccggctcggggaagactcggcgctacctgccggccattgtacgagaggccatcaagaggaaactgcgcacgctaattctggccccaacgcgagtcgtcgcctccgaaatggccgaagcactaaagggaatgccaatacgctaccaaacgaccgccgtaaagagcgagcacaccggaaaagaaatcgtcgacctcatgtgccacgctaccttcaccatgcggctgttgtctcctgtgcgtgtgccgaattacaatatgatcatcatggacgaggcccattttacagatcccagctcgatcgctgcgcggggatacattagcacccgcgtaggcatgggggaggccgccgcgattttcatgactgctacgccccccggttcggtggaagccttcccccagagcaacgcggtgatccaagacgaggagcgggatatacccgaacgctcctggaacagcggttacgaatggatcaccgacttcccgggcaagaccgtttggtttgtgccctccataaagagcgggaacgatatcgctaactgcttacggaagaacgggaaacgtgtgatccagctctcccggaagaccttcgacacggagtaccagaagacaaagaacaatgactgggattatgtagtgaccacggacatatcagagatgggcgccaattttcgcgcagaccgggtgattgacccccggcggtgtctgaagcccgtcatccttaaggacgggcccgaacgcgtcatactagcggggcctatgccagtgactgttgcctccgccgcgcaacggcgcgggcggatcggccgcaaccataataaggagggcgatcagtacatctacatgggacagcctctgaacaacgacgaggatcacgcccactggaccgaggccaaaatgctcctagacaatataaacacgcccgaaggcatcatccccgccctcttcgaaccggaacgcgagaaatccgcagccatcgacggcgagtacaggctacgcggcgaggcccggaagacgttcgtcgaactgatgcgccgcggtgatctgccggtctggctctcctacaaggtggcatcggagggctttcagtatagcgaccgccggtggtgcttcgatggcgagcgtaataaccaggtgctggaagaaaacatggatgtcgagatttggacgaaggaaggtgaacggaagaaacttcgcccccgatggctggatgcccgcacctactccgatcccttggcgctgcgggagttcaaagagttcgccgccggtcgccggagcgtgtctggggacttgatactagaaattggtaaattaccgcagcacctcacccagcgcgcccagaacgcactggacaacctggttatgctccacaacagcgaacagggaggccgggcctacaggcacgccatggaggagctgcccgacactattgagacgctgatgctcctggctttgattgctgtcctcactgggggggttaccctgttcttcctatccggccgcggattgggcaagaccagcatcggtctgctgtgcgtgatggcatccagcgtcctcctgtggatggcttccgtggagccccactggatcgccgcctcgataatcttggagttcttcctcatggtactcttgatccccgagccggatcgccaacggacaccgcaggacaaccagttagcatacgtcgtaatcggcctcctgttcatgatcctaacggtggcagcaaatgagatgggactgctagagaccaccaaaaaagacctcgggataggtcacgtcgcggtcgagaaccaccatcacgccgccatgttagacgtggacctgcacccagcctccgcctggaccctctacgcagtagctacgactatcattacgccaatgatgcgccacaccatcgagaatactaccgcgaacatatcactgactgcgatcgccaaccaggccgcaatcttgatggggttggacaagggctggcccatttctaagatggacattggggtgccgctgctagcgttaggatgctactcacaggtgaatcccctgaccctcacggccgcagtacttatgctggtcgcgcattacgccatcattggcccggggttgcaagccaaggcgaccagagaggcccagaaacgaactgcagcgggtatcatgaagaacccaacggtggacggcattgtagcgatcgacctcgaccccgtcgtgtacgacgccaagttcgagaagcagctaggtcagatcatgttactcatcctgtgcacgtcgcagattttactaatgcggactacctgggctctgtgcgagagcataaccttggccactgggcccctcactaccttatgggaggggtccccgggtaagttttggaataccacgatagctgtctccatggcgaacatcttccgggggtcatacctggcgggcgccggcttagcattctctctgatgaagtcactcgggggcgggcgccgaggtaccggcgcgcagggagaaaccctcggtgagaagtggaagcgccagctaaaccagctgtctaagagcgaattcaacacctataagaggtccgggatcatggaggttgaccgcagcgaggccaaggagggcttgaaacgaggggagacgaccaagcatgccgtgtcccgcggcaccgccaagctccggtggttcgtcgagcgcaacctggtaaagccggaaggaaaggtgatagacctggggtgcggccggggtgggtggagctactactgcgccggtctcaagaaagtgaccgaagttaagggttatacgaaagggggccccggccacgaggagcctatcccgatggcgacctacgggtggaacctggtgaagctgcactccggcaaggatgtcttcttcatcccgcccgagaaatgcgacactcttttatgcgacatcggcgagagctctcccaacccgaccatagaggagggtcgcacgctgcgggtactcaaaatggttgagccctggctgcgcgggaaccagttctgcatcaagatactgaacccctacatgcccagcgtggtggaaaccctcgaacagatgcagagaaagcatggtggcatgctagtaagaaacccgctgagccggaactccacccacgagatgtactgggtgtcctgtgggacaggcaacatagtgagcgccgtgaacatgacgtccagaatgctcctcaacagattcacgatggcccaccgaaagcccacttatgagcgtgacgttgatctcggggccggcaccagacacgtggccgttgaaccggaggtcgctaacctcgatatcattgggcaacgcatcgaaaacattaagcacgagcataagtccacctggcactatgatgaggacaacccatataaaacgtgggcctatcacggttcctacgaggtgaagccgagcggctccgccagctcgatggtaaacggagtcgtgaagttactgacaaagccctgggacgtcatcccaatggtgacccaaatcgccatgacggacacgacccccttcggccagcaacgggttttcaaggagaaagtcgacacccgcaccccgaaggccaagcgggggactgcgcagattatggaggtaacggccaagtggctctggggcttcctgtcgcgcaataagaagcctcgtatctgcacccgggaggagttcactcggaaggttcgatccaacgccgctatcggagcggtcttcgtcgacgagaaccagtggaactccgccaaagaggccgtagaggacgaacgtttctgggacctcgtgcacagggagagagagttacacaagcaagggaaatgcgccacgtgtgtctataatatgatgggaaaacgcgagaagaagttgggggagtttgggaaggccaagggctcacgcgcaatatggtacatgtggctgggcgcccgctttctcgaattcgaggcgctgggattcatgaacgaagaccactggttctcccgggaaaactccctttccggcgttgagggtgaggggctccacaagttgggttacatcttacgcgacatcagcaagatcccagggggcaatatgtacgctgatgataccgccggctgggacacccggatcaccgaggacgacctccagaatgaggcgcgcatcacagatatcatggaacccgaacacgccctgctggccaaatccatcttcaagctgacctatcagaacaaggtcgtacgggtccagcggcccgctaagaacgggaccgtgatggacgtgatcagccgccgggaccaacgtggatccggtcaggtgggcacgtacgggctgaacacgttcaccaacatggaggcccaactgatccggcagatggagagcgagggtatcttctctcccagcgagttggagacacccaatctggcggagcgtgtactggactggctcgagaagtatggtgtggagaggctgaagaggatggccatcagtggggacgactgtgtggtcaagcctatcgacgaccggtttgccaccgccctgacggcactgaacgacatgggcaaggtgcgcaaggacatcccccagtgggagccctcgaaggggtggaacgactggcagcaagtaccattctgttcccaccactttcaccagctgatcatgaaggacggccgggagatcgtagtgccgtgcagaaaccaggacgagctggtgggccgggcgagagtcagccaaggtgcaggctggagcttgcgggagaccgcctgcctgggtaagtcgtacgcccaaatgtggcagctaatgtacttccaccgccgagacctccgcctggcagccaacgccatctgcagcgccgttcccgtggactggatccccacttcacggaccacatggtccatccacgcccaccatcaatggatgacgaccgaggacatgctctccgtctggaatcgggtgtggatcgaggagaatccctggatggaggacaagacccacatcagtagttggggcgatgtgccctacctcgggaagcgcgaggaccaatggtgcggaagtctgatcggattaaccgcgcgtgccacctgggctaccaacatccaggtggccataaatcaggttaggaggctaattgggaacgaaaactaccttgactatatgacatccatgaagcgctttaagaacgagagcgatccagagggcgccctgtggtga

SEQ ID NO: 24441 - RNA, 9879 nt, synthetic construct
  misc_feature 1..9879: note = derived and/or modified CDS sequence (opt11) from DENV-1__JF937602__SS-prME
  source 1..9879: mol_type = other RNA
agcgtcacaatgctgctcatgctgatgcccacggccttggccttccacctcacgactcgcggcggggagccccacatgatcgtgtccaagcaggagcggggcaagtctctgctgttcaaaacttcagctggcgtgaacatgtgtaccctcattgctatggacctgggcgagttctgcgaagataccatgacctacaaatgccctcgcataaccgaggccgagcccgacgacgtggattgctggtgcaacgctactgacacgtgggtcacctacgggacgtgttctcagaccggcgaacaccggcgcgacaaaaggtccgtggcgttagccccacacgtgggcctcgggcttgaaactcgaaccgagacttggatgagctccgagggtgcttggaagcaaatccagcgggtggagacctgggcactgagacaccccgggttcacggttatcgccttattcctggctcacgccatcgggacgtctatcacccaaaaggggatcatcttcatactgctcatgctggtgaccccctcgatggcgatgcggtgcgtcgggattggtagccgcgacttcgttgaggggctgtccggagccacttgggtggatgtcgttttagagcacgggagctgtgtgaccacgatggcaaaggataaacccaccctggacatcgagctgctcaagaccgaagtcaccaacccggctgtgctgagaaaactgtgcatcgaagccaaaatcagcaacacaacgacggacagccgctgcccgacccaaggcgaagccacactcgtggaagaacaggatgcgaatttcgtgtgccgacgcactttcgtggacaggggctggggcaacggctgcgggctgttcggcaagggttccttgattacttgcgctaaattcaagtgcgtgacaaaattagaaggcaagatcgtccagtacgagaacctgaagtatagcgttatcgtgacggtccacaccggcgatcagcaccaggtggggaacgagtccactgaacacggaaccacagctaccatcacgccccaggcccccagtacggagatccaactgaccgactacggggccctcaccttagactgctctccccgcaccggcctggacttcaacgagatggtcttgctgacgatgaaggagaaaagttggctggtgcataagcagtggtttctcgacctgccgctgccttggaccagcggagccagtactagccaggagacctggaaccgtcaggacctgctggtgacgttcaagaccgcccatgcaaagaaacaggaggtcgtagtgctgggcagtcaggaaggcgctatgcacaccgctttgaccggcgccacggaaatccagacctcaggcacgacaacgatcttcgcagggcacttgaagtgcagactgaagatggacaagctcaccctgaagggcatgtcatatgtcatgtgcaccgggtccttcaagttggagaaggaggtggcggagacgcagcacggcacggtcctcgtccaaattaagtacgagggcaccgacgccccatgtaagatccccttcctgacgcaagacgagaagggtgtgacacaaaacggccggctgatcacggcaaacccgatcgtaaccgataaggaaaagcccgtaaacattgaggctgaaccgcctttcggggagtcctatatcgttatcggcgcgggcgaaaaggccctgaaactcagctggttcaagaaagggagtagcatcggcaagatgttcgaggccaccgcccgcggggcccggcgcatggcgatcctgggcgataccgcctgggacttcgggtccatcggcggcgtgttcacgtccgtcggtaagctggtgcaccagatcttcggaaccgcctacggggtgcttttcagtggagtcagctggaccatgaagatcggaatcggtgtcctgttaacatggctgggcctgaactcccgcagcacttcccttagcatgacctgtatcgcagtggggctcgtcaccctttacctgggcgtgatggtccaagccgactctggctgcgtcatcaactggaagggccgcgagctcaagtgtggaagcggcatctttgtaaccaacgaggtacacacttggaccgagcagtataagttccaagcggacagcccgaagcgcctgtccgccgccatcggtaaggcctgggaggagggggtttgtgggatccggtcggccacccgcctggagaatataatgtggaagcagatatccaatgaacttaactacatcctgctagaaaacgacatgaagttgaccgtggtagtcggggatgtggccggcattctggcccagggcaagaagatgatccgaccgcagcccatggaatataagtacagctggaagtcatggggtaaggccaagattataggcgccgacgtgcagaataccacgttcataatcgacgggcccaacaccccggagtgccccgacgaccaaagagcttggaacatctgggaggtcgaagactacggtttcggtatcttcaccacaaacatctggctgaagttgcgggacagctacacccaagtgtgcgaccatcgcctgatgtcggccgcaataaaggacagcaaagccgtgcacgccgacatggggtattggatcgagtccgagaagaacgagacctggaagctggcccgggccagcttcatcgaggtaaagacgtgtatatggcccaaatcccacaccctatggtcaaacggtgtgctagagtccgagatgatcatacccaaaatctacgggggcccgatcagccagcataattacagacccgggtatttcactcagacggccggcccctggcacctggggaaactcgagctggacttcgacctgtgcgagggcaccaccgttgtcgtggacgaacactgcggcaaccgcggtccctccctccgcacaacgaccgttaccggcaagatcatacatgaatggtgctgcaggtcttgtacgctgccgccgctacgcttcaagggggaggacggctgctggtacggaatggagattagacccgtaaaagagaaggaggagaacctcgttaagtcaatggtgtcggccggctcaggcgaggtggacagctttagtctggggctgctctgcatcagtatcatgatcgaggaggttatgaggtcgcggtggtcacgaaaaatgcttatgactggtaccttagctgtgttcttcctcctgatcatgggccagctgacttggaacgacctcatccggctgtgtatcatggtcggagcaaacgcaagcgaccgcatggggatgggcacgacgtacctggcgctcatggccaccttcaagatgagaccgatgttcgccgtaggcctactatttcgcaggctcacatcccgcgaggtactgctgctcactattggacttagtttagtcgcgtccgtcgagctgcccaacagcctggaggaactgggcgacgggctcgccatgggcataatgatattgaagctgctcacagacttccaatcacaccagctgtgggccacgctgctcagcctgaccttcgttcgcacaactttttccctgcactatgcctggaagaccatggcgatggtgctcagcatcgtgagcctgttccccctctgcctcagcaccacgtctcagaagaccacctggctgcccgtcctgctcggcagcctcgggtgcaagcctctgaccatgttcctcatcgccgagaacaaaatatggggccggaagtcttggcccctgaacgaggggatcatggccgtgggcatcgtcagcattctcctgagttccctgctgaagaacgacgtgccccttgcagggccccttattgctggaggaatgttgatcgcgtgctacgtgatttctggctcctctgcggacctctccctggagaaagccgcggtggtcagctgggaggaagaggccgagcacagcggtgcgagccataacattctggtggaggtgcaggatgacgggacgatgaagataaaggatgaggagagagacgacacactcaccatcctgctgaaagccaccctcttggccgtctccggcgtttatccgctgagcatcccggctaccctcttcgtttggtacttctggcagaagaagaagcagcggtccggtgtcctgtgggacacgcccagcccgccggaggtggagagagcggtgctggatgacgggatctatcggatcatgcagcgcgggctgctagggcgctcccaggtcggtgtgggggttttccaggagaacgtcttccacaccatgtggcatgtgacccgcggggcggttttgatgtaccagggaaagcggctggagccctcctgggcctccgtcaagaaggacctgattagctacggtggcgggtggcgcctgcaaggctcgtggaacaccggcgaggaagtacaggtgatcgccgtggagcccgggaagaatcccaaaaacgtgcagacagcccccgggacctttaagaccagcgagggcgaggtgggtgctatcgcgctggacttcaaaccaggcacgtccggaagtccgatcgtcaaccgagaggggaaaatcgttggcctctacggcaatggcgtggtcacgacgtccggcacctacgtgtccgccatagcacaagccaaggcgagccaggaaggacccctgccagagatcgaggacgaggtgttccgaaaacggaacttgactatcatggacctgcatcccggctcggggaagacgcgccggtatctgccggccatcgtccgcgaggccatcaaacggaagctgcgcacacttatactcgcacctacccgcgttgtggctagcgagatggcagaggcgctaaagggcatgcccattcggtaccagaccacagccgtcaagtccgagcacactggtaaggaaatcgtggacctcatgtgccatgctaccttcacgatgcgcttgctgagccctgtgcgagtccctaactacaacatgatcatcatggacgaggcccacttcaccgacccttcgagcattgcggcccgcgggtacatctcaacccgagtcgggatgggggaagctgccgcgatcttcatgaccgcgaccccgcccggcagcgtagaggcattcccccagtcgaacgccgtcatccaggacgaggagcgcgacataccggagcggtcgtggaactccgggtatgaatggatcacggatttccctggcaagaccgtgtggttcgtgcccagcattaagtccggtaacgacatcgccaactgcttacgcaagaatgggaagcgtgtgattcaactgagtcgtaagactttcgacaccgaataccagaagactaaaaacaacgattgggactatgtggtgaccacggacatctcggaaatgggcgcgaactttcgggcagaccgagttatcgacccgcggcgctgcctaaagccagtgatcctcaaggacggtcccgagcgggtgatcctggccggtcccatgcccgttaccgtggctagcgcagcgcagcggcgggggcgcatcggtcggaatcacaacaaggagggcgatcagtacatctacatggggcagccgctcaataacgacgaggaccacgcccactggacggaggcgaagatgctcctggacaacatcaacaccccggagggcatcattccggctctgttcgagcccgagcgcgagaagtccgcggcgatcgacggggaataccgactccggggagaggcgcgcaaaacattcgtcgagcttatgcggcgcggggaccttccggtttggttgagctataaggtggccagcgaaggcttccagtacagtgacaggcgatggtgcttcgacggcgagagaaacaaccaggtcctagaggaaaacatggacgtagaaatatggaccaaagaaggggaacgcaagaagctgcgtcccagatggctagacgcccggacgtacagcgaccccctggcactgcgcgagttcaaagagtttgcggccggccggcgcagtgtgtccggagacctcatactggagattggcaagctgccgcagcacctcacccagcgagcccagaacgctctggacaacctggtaatgctccacaactccgagcaaggagggcgcgcctatcggcacgccatggaagaactgccggataccatcgagaccctgatgctcttggccttaatagcagtgctcaccggcggcgtgaccttatttttcctgtcaggccgcgggctcggaaagacctccataggactgctgtgtgttatggcgagctcggttctcctgtggatggcatcggtagagcctcactggatcgcggcctccatcatcctggagttcttcctcatggtactgttaatccccgagcccgatcggcagcgaaccccgcaggacaaccagctcgcctacgtggtgatcggcctactcttcatgatcttgactgtcgccgcgaacgagatggggctcctggagacgacaaagaaagatctcgggatcggccacgttgccgtggagaaccaccaccacgctgctatgcttgacgtagacctgcaccccgcgagcgcgtggaccctttacgcagtggccaccacgatcatcaccccgatgatgcgacataccatcgagaataccacagctaacatctccctgaccgctatcgcgaaccaagctgccattctgatggggctagacaaaggatggcctatctctaaaatggatatcggggtcccgttactggcattggggtgttattcccaagtcaacccactgaccttaaccgcggccgtgctcatgcttgtagcccactacgccatcatcgggcccgggcttcaggctaaggcgacgagggaggcccagaagcgtacagcggcaggcatcatgaaaaacccgacagtggacgggatcgtggccatcgacctcgatccagtggtctacgacgcgaagtttgagaaacagctgggccagattatgctactcatcctctgtactagccagatcctgctcatgcgcactacatgggccctgtgtgaatccataaccctagccaccggcccactcacgaccctgtgggaggggtcgcccggcaagttctggaacaccacaatcgcagtgtccatggccaacatcttccgcggctcgtaccttgcgggcgccggattagccttcagccttatgaagtccctagggggcggtcggagaggaacgggggcccagggcgagacccttggcgagaagtggaaacggcagctgaaccagctgagcaagagtgagtttaacacctacaagaggagcgggattatggaagtggaccggtccgaggcgaaggagggtctcaagagaggggaaaccacgaagcacgccgtaagccgcggcaccgccaagctgcgctggtttgtggaacggaacctggtgaagccggagggaaaggtaatcgacctgggttgcggtcgcggagggtggtcctattactgcgccgggctcaaaaaggtgaccgaggtgaagggctacacgaaaggagggcccggccacgaggagcccatcccaatggccacgtacgggtggaacctggtcaaactgcatagcggcaaggacgtgttcttcatcccgcccgaaaaatgtgacacgctcttgtgcgacatcggggagtccagccccaaccccaccatcgaggaaggccgaaccctgagagtcctcaagatggtcgagccgtggctgagagggaatcagttttgcatcaagattttgaacccctacatgccgtcagtggtggagacgctcgagcaaatgcaaaggaagcacggaggcatgctggtccggaacccactgagcaggaacagcacccacgagatgtactgggtatcttgcgggaccggcaatattgtatcggctgtaaacatgacctcgcggatgctcctgaaccgcttcaccatggctcaccgcaagccgacgtatgaacgggatgtggaccttggggccggcacacgccacgttgccgtcgagccggaggtggccaacttggacattatcggccaacggatcgagaacatcaaacacgagcataagtccacctggcactacgacgaggacaacccctacaagacgtgggcataccatgggtcttacgaagtaaagcccagtggcagcgcgagctccatggtgaacggggtcgtaaaattactgacgaagccgtgggacgtgatccctatggtgacccaaattgccatgactgacaccactcctttcggccagcagagagtgttcaaggagaaggtggacacccggacccccaaggcgaagcgtgggacggcccaaatcatggaggtgaccgcgaaatggctctggggcttcttgagcagaaacaaaaagccgaggatatgtacgcgtgaggagttcacccgcaaggtcaggtccaacgccgccatcggcgccgtattcgtagacgagaaccagtggaactccgcgaaggaagcagtcgaggacgaacgcttctgggatctagtgcaccgggaacgcgaactacacaagcagggtaagtgtgcaacctgcgtgtacaacatgatgggaaagagggagaaaaagttaggggagtttggcaaagcaaagggttcccgcgccatatggtacatgtggctcggagcgcggttcctcgaatttgaggcgctgggctttatgaacgaggaccactggtttagccgcgaaaattcccttagcggggtcgagggcgaggggctccacaagttagggtacatcctccgggacatatctaagataccagggggtaacatgtacgccgacgacacggccggctgggacactcgcattaccgaggatgacctccagaacgaggctaagattaccgatatcatggagcccgagcacgcgctgctggccaagagtatcttcaagctaacgtaccagaacaaagtggtacgggtccagagaccggccaagaatgggaccgtgatggacgtgatatcccggcgggaccagcgaggcagcgggcaggtcgggacctacggcctaaacacgttcacgaacatggaggcccagctgatccgtcagatggagtccgaggggatcttctcgccctcggagctcgagacccccaacctggccgggcgcgtactagactggctcgaaaagcatggtgttgagcggcttaagcgcatggcaataagcggtgacgattgtgtcgtgaagcccatcgatgatcggttcgcaactgcactgaccgcccttaacgacatggggaaggtgcgcaaggatatcccgcagtgggagcccagtaagggctggaacgattggcagcaggtccccttctgcagccatcatttccaccaactgataatgaaggatggccgggagatcgtggtgccctgtcgcaaccaggacgagctagtgggccgggcccgcgtcagccagggcgcaggctggtctttacgggagacggcgtgtctcggcaagtcatacgcccagatgtggcaacttatgtacttccaccgccgggacctccgcctggcagcgaacgccatctgctccgccgtgcccgttgactgggtgcccacctcacggaccacctggtccatccacgctcaccaccaatggatgacgaccgaagacatgttgagcgtttggaaccgggtctggatcgaggagaacccctggatggaggacaagacccacatctccagctggggcgacgtgccatacttaggcaagcgagaggaccagtggtgtggctccctgatcgggctgaccgcccgcgcgacgtgggctaccaacattcaggtggccatcaaccaggtccgccggctcctgggaaacgagaattacctagactatatgaccagcatgaagcgcttcaagaacgagtcagatccggagggcgcgttatggtaa

SEQ ID NO: 24442 - RNA, 9879 nt, synthetic construct
  misc_feature 1..9879: note = derived and/or modified CDS sequence (opt11) from DENV-1__GU131729__SS-prME
  source 1..9879: mol_type = other RNA
tccgtcactatgctcctaatgctcatgccaacagcgctagcgttccatctaactactcgtgggggtgaaccacacatgatagtatccaaacaagaaagaggaaagagcttactgtttaaaacgagcgctggcgtgaatatgtgcaccctaatagcgatggacttgggcgaactctgcgaagatacgatgacctacaagtgtcccagaataacggaaaccgagccggacgacgtcgattgttggtgcaatgcaaccgatacctgggtcacgtacggcacttgcagccaaacgggggaacacagacgcgataagagatccgtagctctcgcgccacacgtcggtctgggactcgaaacccggacagaaacatggatgagctccgaaggagcctggaaacaaatccaacgcgtcgagacgtgggccttgcgccacccgggtttcaccgttattgcgttatttctcgcacacgcgataggaacaagcatcacccaaaagggaataatctttatactgctcatgctagttactccgagcatggcaatgagatgcgttggaataggctcgagagacttcgttgaaggcctcagcggagcgacatgggtcgacgtggtgctcgaacacgggagctgcgtgaccaccatggctaaggacaaaccgacactcgatatagaattactaaaaaccgaagttacgaatcccgcggtgttaggtaaattgtgcatcgaagcaaaaattagcaatacgacgacagacagccgatgccccacacaaggcgaagcgaccctagtggaggagcaagatgccaacttcgtctgccggagaacgttcgttgatcgcggctggggaaacgggtgtggcctttttgggaaaggcagtttaatcacatgcgccaaattcaaatgcgtgacgaaactcgagggaaaaatagttcaatacgagaacctgaaatatagcgtgatcgtgacggtacacactggagaccaacaccaagtcggtaacgagagcacggagcacgggactaccgccactatcacgccccaagcacccacgacagaaatacaactcactgattacggggcgctgacactagattgttcccccaggacaggcttggacttcaacgaaatggtactgctcacgatgaaagagaaatcctggctggtccacaaacaatggttcctcgacctgcccctaccttggactagcggagccagcacatctcaagaaacctggaaccgacaagatcttttggtgaccttcaaaacggcgcacgccaagaaacaagaagtcgtcgtactgggtagccaagaaggggccatgcacactgccctgacaggagccaccgaaatacagacatccggaacaacgactattttcgccggccacctaaaatgcagactgaaaatggacaaactgacactcaagggaatgtcatacgtaatgtgtacgggctccttcaaactggagaaagaactagcggaaacccagcatggcacagtcctcgtacagatcaaatatgaagggacagacgccccttgtaaaataccattcagtacacaggacgaaaaaggagtgacgcaaaacggtaggctgatcacagccaacccgatagtcaccgacaaggaaaagccggtgaatattgaagcagaacccccattcggcgagagttacattgttataggcgcaggagagaaggcgcttaaactcagctggttcaagaagggctcctctatcggcaaaatgttcgaagccaccgcccgaggggccagacgtatggcgatactcggagacaccgcatgggacttcggcagcatagggggcgtattcacgtccgtaggtaaactcgtccaccaaatatttggaacggcctacggcgtcctcttctccggggtcagctggaccatgaaaatcggtataggagtcctcttaacctggctagggctaaattcgcgctccacgagcctcagtatgacgtgcatcgccgtagggctagtcactctctacctgggcgtcatggttcaagccgattcaggatgtgtgataaactggaaagggagagagctcaaatgcgggagtggaatcttcgtgacgaacgaagttcacacttggacagaacaatataaatttcaggctgactcacctaaacgactaagtgcagccatcggaaaggcgtgggaagaaggggtatgcggcattcgatcggcgacgaggctagagaacatcatgtggaaacaaatatccaatgaactaaaccacatattattggagaatgacatgaagttcacggtcgtagtaggcgacgtagctggtattctagcgcaaggcaaaaagatgatacgcccgcaacctatggaatacaaatattcatggaaaagctggggaaaagccaaaatcattggcgcagacgtccaaaacacaacattcatcatagacggacccaacacacccgagtgccccgacgatcaacgcgcatggaacatctgggaagtagaagactatggattcggaatatttacaactaacatttggttaaaactgcgcgactcatacacgcaggtatgcgaccaccgcctcatgagtgccgccattaaagactccaaggccgtgcacgcggacatggggtactggatagagtcagagaaaaacgagacgtggaagctcgcacgagcatcattcatagaagtaaaaacatgcatatggcccaagtcgcatactctgtggtctaacggggtcctcgagtccgagatgataatccccaaaatctatggtggaccaatctcacaacacaactaccgcccaggctatttcacgcagacagcggggccttggcacctcggcaagctggaactagactttgacctatgcgaaggtacaacagtggtagtagacgaacattgtggcaacagagggccaagtctccgaactaccactgtaaccgggaaaattatccacgaatggtgctgcagatcatgtaccctgcccccgttacggttccggggcgaagatgggtgctggtacgggatggaaatacgacccgtaaaagaaaaagaggagaacctagtaaaatccatggtgagcgccgggtccggcgaagtcgactcgttctctctaggactgctttgcatcagcataatgatagaggaagtaatgcgaagtaggtggtcaagaaagatgctgatgaccggtactctggctgtcttcttcctgctcatcatgggccaactaacctggaacgatctgattcgactctgcataatggttggcgctaacgcaagcgaccggatgggcatgggaacaacatacttggccctcatggcgacgtttaaaatgagaccaatgttcgccgtaggtttactgtttaggaggctaacctcgcgagaggtcctgctactaacgataggactcagcctagtagcgagtgtcgagttgcctaatagccttgaagaactcggagacggactcgcaatgggcataatgatactgaaactattaaccgactttcagtcgcatcaactgtgggcaacactactgagcctcacgttcatcaaaacaacattcagcctgcactacgcctggaaaacaatggcaatgatactcagcattgtgtccctatttccgctatgtctgagtaccacatcacagaagactacatggcttccggtgctactcggaagtctaggatgtaaaccgttaaccatgttcctaatcgcagaaaacaaaatttggggtcggaggtcctggcctctgaacgaaggtataatggccgtgggaatagtaagcatactactgtcaagcctcctgaagaacgatgtgcccttagctggtccacttatagcaggcgggatgctaatcgcatgctacgttatatctgggtcttccgccgacctcagcctggagaaggccgccgaggtaagctgggaagaagaagcggagcactcaggggccagccacaatatactggtagaagtccaagacgacggaccaatgaaaatcaaagacgaggagcgagacgacacactaactatattgctcaaagccaccctactcgccgtctcaggggtatatcccttgagcataccggcaacactcttcgtgtggtacttctggcagaagaagaaacaacggagcggagttttgtgggacacaccgagtccaccggaggtcgagcgagcagtcctcgacgatggtatctaccgaatcatgcaaagaggcctgcttggcaggagccaagtgggcgtaggagtgtttcaagagaacgtgttccacacgatgtggcatgtaacccggggcgccgtgcttatgtaccaaggaaaacgtcttgagccgtcgtgggcgagcgtaaagaaagacctaatcagctacggaggagggtggaggctccaagggagctggaataccggagaggaggtacaggtaatagcagtcgaacctggcaaaaacccgaagaacgtccaaaccgcacctggcacatttaagaccccggaaggggaggtaggcgctatagcgctagatttcaaacccggaacaagcgggtccccgatcgtgaaccgagaagggaaaatcgtaggcctatacggaaacggtgtcgtgacgacaagtggcacctacgtcagtgccatagcacaagcgaaagcgagccaggagggtcccctacccgaaatcgaggacgaagtcttccgcaagcggaaccttacaataatggacctccacccaggatcaggcaagaccagacggtatctgcccgcgatcgtgcgcgaagcgatcaagcggaaactccgtaccttaatactggcgccgacacgcgtcgttgccagcgaaatggccgaagcgcttaaaggaatgccgatacggtaccaaacaacagccgtcaagagcgagcacacagggaaggagatagtcgacctaatgtgtcacgcgacatttaccatgcgcctcctatcccctgttagggttccaaattacaacatgataataatggacgaggcccacttcacagacccatcctccatcgcggccagaggctacatctcaacgagggttggaatgggagaggccgccgccatctttatgacagcaacccctccgggaagtgtcgaagccttccctcagtccaatgccgtgatacaggacgaggaacgcgatatcccggagagatcatggaactcaggctacgagtggataacggacttccccggcaagaccgtatggttcgtccccagcatcaaatcaggaaacgatattgcaaactgcctacgaaagaatgggaaaagagtcatccagctgagccgtaaaacattcgacacggagtatcagaagaccaagaacaacgattgggactacgtggtaaccacggacatcagcgagatgggtgcaaacttccgagctgcaagagtcatagacccaagacgatgtctgaaaccggtcatcttaaaggatgggccggaacgagtaatactcgccggtccaatgcccgtgactgtagcgtcggccgcacagcgcaggggccgaatcggacgaaatcacaataaggagggcgaccagtacatctatatggggcaaccattgaacaacgacgaggatcacgcccactggaccgaggcgaaaatgctattagataacatcaacacaccagaggggatcatccccgcactcttcgaaccagaaagagaaaagagcgcagccatagatggggaatatagactaagaggggaagctagaaaaacgttcgtagaactgatgaggcgaggggacttaccggtctggctctcttacaaagtggcctctgagggatttcagtatagcgaccggcgctggtgtttcgacggggaacggaataaccaggtcctcgaagaaaatatggacgtagaaatctggacaaaagagggcgagcgaaagaaactccgcccaaggtggttagacgcgcgaacatacagcgacccactcgcgctaagggagttcaaagagttcgccgcaggaagacggagcgtatctggagatcttatactagagatcgggaagctaccgcaacacctaactcagagggcccaaaacgcactagacaatctggtaatgcttcacaactcagagcaaggcgggagggcgtatcggcatgcaatggaggaacttccagataccatagaaacacttatgcttctcgccctaatagccgtgttaacgggaggggtcaccttgttcttcttgtcgggccggggacttggcaagaccagcatcgggctcctctgcgtgatggcctcgagcgtgttgctctggatggccagtgtcgaaccgcattggatcgctgctagcataatactagagttcttccttatggtactcctcataccagagcccgaccgccaaaggacaccccaggataaccaactggcatacgtagtgataggattgttgtttatgatactgacagttgcggctaatgaaatgggattgctagaaacgacgaagaaggacttaggaataggccacgtggccgtagaaaaccaccaccacgcggccatgcttgacgtcgacctccaccctgcctccgcctggaccctctacgcagtagcgaccaccataattacgcccatgatgaggcatactatagagaacaccacagccaacataagccttacggcaatcgccaaccaagcagctatattaatggggctcgacaaaggctggcccatatcaaagatggatattggagtaccactactcgctctcggttgctactcccaagttaacccgctgacgctaactgcagcagtactcatgcttgttgcccactacgccataatcggaccgggactccaagcaaaagctacgcgggaagctcagaaaagaactgcggctgggataatgaaaaacccaacagtggacggtatcgtagctatcgatttagacccggttgtatacgacgcaaaattcgagaaacaattgggccagattatgctactaatcctgtgcacatcgcaaatactcctgatgaggaccacctgggcgttgtgcgaatccatcacgctagccaccggaccactgacaacactgtgggaaggttcgccaggaaagttctggaataccaccatcgcggttagcatggcaaatatctttagaggatcttaccttgccggggcaggactcgccttctcgctcatgaaaagcctcgggggcggaagacggggaaccggggcacaaggggaaacgttgggggagaagtggaaaaggcaactcaatcaactaagcaagtcagagttcaacacctacaagaggagcgggattatggaggtcgaccggagcgaggccaaagaggggctaaaacgaggtgaaacgaccaagcacgcagtctcgcgaggcacagccaaactacgctggttcgttgaaaggacgcttgttaaacccgagggaaaagtcattgacttagggtgtggcagaggtgggtggtcctactattgcgctggactaaagaaggttaccgaagtaaagggatacactaagggaggcccaggccacgaggagcccatccccatggcaacatacggatggaaccttgtgaagctacattccggcaaggacgtcttcttcatcccgccagagaaatgcgacacgctactctgcgacattggggagtcctcgcccaatccaaccatagaggaaggcaggacgctccgggtgctaaagatggtggagccgtggctccgaggcaaccaattctgtatcaagatattgaacccttacatgccgtccgtagtagaaacactggaacaaatgcagaggaagcacggcggaatgctcgtcaggaatccactctcgcggaactcaactcacgaaatgtattgggtctcatgtggaacggggaatatcgtgagcgcagtaaacatgacatctcgaatgctgctgaataggttcacaatggcgcaccggaagcctacatacgaaagagacgtcgacctcggggcaggcactcgccatgtggcggtagaacccgaggtggcaaacttagacatcatcggccagcgcatagaaaatatcaaacacgaacacaaaagcacctggcactacgacgaagacaacccatacaagacctgggcctaccacggctcatacgagggcaaaccatcgggatccgcctcatcaatgggtaacggtgtagtaaaactactaacaaaaccgtgggatgtaataccaatggtgacacagatagcgatgacggacacgacaccatttggccaacaacgagttttcaaggagaaagtagacacgaggacacccaaggctaaacgaggaaccgcccaaatcatggaagtaacagctaagtggctatggggtttcctctcccggaataagaaaccccggatctgtacacgagaagaatttaccaggaaggtccggagcaacgcagccataggagcagtcttcgtagacgagaaccaatggaactccgcaaaagaagcagtcgaggacgaacgattctgggacctggtacaccgagaacgagaacttcacaagcaaggcaaatgcgcgacatgcgtatataatatgatgggtaagcgcgagaagaaacttggagagttcgggaaagccaaagggtcgcgagcaatctggtacatgtggctgggtgcgcgcttcctagagttcgaggccctaggctttatgaacgaagaccattggttctcgagggaaaatagcctgtcgggcgtagagggcgagggattgcacaaactaggctatattcttcgcgatatatcgaaaatccccggcgggaatatgtacgccgacgacaccgccggttgggataccaggattactgaggacgacctccaaaacgaggcacgaataacagacataatggaaccagaacacgccctgctggcaaaatcgattttcaaattgacctaccagaacaaagtagtccgggtacaacggcccgccaaaaatgggacggttatggatgtgatctcccggcgagaccagaggggcagcggtcaggtgggaacatacggcctgaataccttcacaaacatggaggctcagttaataagacaaatggaatcggagggtatcttttcccccagcgaactagaaacacctaacctggcggaacgagtacttgactggctggaaaaatatggcgtagaacggctcaagcgcatggcgatttcaggtgacgactgcgtcgtaaagccgatagacgaccgattcgcaactgccctcacggcactcaacgacatgggtaaagtccgcaaagacatacctcagtgggagcccagcaaaggctggaacgactggcaacaagtgccgttctgcagtcaccacttccaccaacttataatgaaagacggccgcgaaattgtcgtgccatgtcggaaccaagatgaactcgtagggagagctagggtctcgcaaggagcaggctggtcgcttcgcgaaacggcttgcctaggaaaatcctacgcccaaatgtggcaactcatgtactttcacagacgcgacttacgtctagccgcgaacgcaatttgttccgcagtgccagttgactggatcccgacttcaagaaccacgtggtcaatacatgcacatcaccaatggatgacaaccgaagacatgctcagcgtctggaaccgcgtttggattgaggaaaacccatggatggaagacaagacgcatatctccagctggggagacgtaccctatttaggaaaacgggaagatcagtggtgcggatctctgataggtctgactgctcgagccacatgggctacaaacatccaagtggcgatcaaccaagtccgcaggctcatcggaaacgaaaactatcttgactatatgacatcaatgaagcgatttaagaatgagtcagatccagaaggcgccctctggtaa

SEQ ID NO: 24443 - RNA, 9879 nt, synthetic construct
  misc_feature 1..9879: note = derived and/or modified CDS sequence (opt11) from DENV-1__GU131730__SS-prME
  source 1..9879: mol_type = other RNA
agcgtgacgatgctgctcatgttaatgcccactgccctcgccttccatctcaccacccggggaggggaaccccacatgatagtgtcgaagcaggagcgcggcaagagcctgctgttcaaaaccagcgcgggagtgaacatgtgtaccctcatcgccatggaccttggtgagttctgcgaggacacgatgacctacaagtgtccccgaatcaccgaggccgaaccggatgacgtggactgttggtgcaacgctaccgacacgtgggtgacttacggcacgtgcagtcaaacgggcgagcaccggcgggacaaacggtcagttgccctggcgccccacgtgggcctcgggctggagacgcgcaccgagacctggatgagctcggagggggcctggaagcagatccagcgggtggagacctgggccctgcgtcacccgggatttacggtcatcgccctcttcctggctcacgccatcggcacctcgatcacacagaagggaatcatcttcatcctgctcatgctggtgacgccctccatggccatgcggtgcgtcggaataggcagccgcgacttcgtggagggcttgtctggcgcgacgtgggtcgacgttgtgctcgagcacgggtcttgcgtgaccaccatggccaaggacaagcctactctggacatcgaactgttgaagacggaggttaccaaccccgcggtgctacggaagctgtgcatcgaagccaagatctccaacaccaccactgacagccgctgccccacacagggcgaggccactctcgtggaggagcaggacgccaacttcgtctgccggcgcaccttcgtggaccggggctgggggaatggctgcgggctgttcgggaaggggtccctaattacgtgtgccaagttcaagtgcgtgacgaaactcgagggcaagattgtccaatacgagaatctgaagtacagcgtgatcgtgaccgtccacaccggcgatcagcatcaggtggggaacgagtcgactgagcatggcacgaccgctaccatcactccccaagcccccagcaccgagatacagctgaccgactacggcgccctcaccctggactgttcgccccggaccggcctggactttaacgagatggtcctcctgacgatgaaagagaagagttggctcgtgcacaagcagtggttcctcgacctgccgctgccctggaccagcggggccagtacctcgcaagaaacctggaaccggcaggacctcctggtaacgtttaaaaccgctcacgcgaagaagcaggaggtggtcgtgctgggcagccaggagggcgcgatgcacaccgccctcaccggggccacggaaatccagacgtcaggcaccaccacgatctttgccgggcacctgaagtgccgcctgaagatggacaagctaacgctgaagggcatgtcctatgtgatgtgcacagggtcattcaaacttgagaaggaggtggcagagacccagcacggcacggtcttagtccaaatcaagtacgagggcaccgacgccccttgtaagatacccttcagcacacaggacgagaaaggggtgacccagaacggccggctgatcacggcgaacccgatagtgaccgacaaggagaagcccgtaaacatagaagcggaaccgcccttcggagagagctacatcgtgataggcgcgggcgagaaggccctgaagttgtcctggtttaagaaggggagttccatcggtaaaatgttcgaagccaccgccagaggggccaggcgcatggcgatcctcggcgacacggcctgggacttcgggagcatcggcggggtgttcacgagtgtcgggaagctggtgcaccagatcttcggcacggcatacggggtgctgttcagcggcgtctcgtggaccatgaagatcgggatcggcgtgttgctgacctggctgggcttgaacagccgctccacgagcctttccatgacctgcattgccgtggggctggtcaccttgtatctgggcgtgatggtccgggccgacagcgggtgcgtcatcaactggaagggccgcgaactgaagtgtgggagcggcatcttcgtgacaaacgaagtgcacacgtggaccgaacagtacaagttccaggccgactccccgaagcggctctctgccgcgatcggcaaagcctgggaggagggggtctgcggtatccgctccgccactcggctagagaacatcatgtggaagcagattagcaacgagctgaaccacatcctcctggagaacgacatgaagctgaccgtggtggttggtgacgtggctggcattctcgcccaggggaagaagatgatccgaccccagcccatggagtacaagtactcctggaagtcatggggcaaggccaagatcatcggcgcagacgtgcaaaacaccacgttcataatcgacgggcccaacaccccggaatgcccggacgaccagcgggcgtggaacatttgggaagtagaggactacggcttcgggatcttcaccaccaacatctggcttaagctgagggactcctacacccaggtctgcgaccaccggctcatgtccgccgccatcaaggactccaaggccgtgcacgccgacatgggctactggatagaaagcgagaagaacgaaacatggaagctggcgcgcgcctcctttatcgaagttaagacctgcatctggcccaagagccacaccctgtggtccaacggcgtgctcgagagcgaaatgatcatccccaaaatctacgggggccctatctctcagcacaactaccggcctgggtattttacgcagacagccggcccctggcacttagggaagctggaactggacttcgacctgtgcgagggcacaaccgtggtggtagacgagcactgcggtaaccgcgggcctagcctacggacgaccaccgttaccggcaagatcatccacgaatggtgctgccgctcctgcacgctgccacccctccggttcaagggggaggacggctgctggtacgggatggagatcaggcccgtgaaagagaaggaggaaaacctggtcaagagcatggtgagcgccggctccggcgaggtagactcgttcagtctcgggctgctgtgcatctctatcatgatcgaggaggtgatgcggagccgttggagtcggaagatgctaatgacgggcaccctggccgtgtttttcctgctcatcatggggcagctgacctggaacgaccttatccgcttatgcatcatggttggtgcgaacgccagtgaccgcatggggatgggtacgacctacctagctctaatggccacattcaagatgcggccgatgttcgccgtgggcctactgttccgacggctgaccagccgcgaagtcctcctgctcacgatcgggctctccctggtcgctagcgtggaactgcccaactccctcgaggagctgggcgacgggctggcaatgggcatcatgatcttaaagctgctgacagacttccagtcacaccagttgtgggcgaccctgctatccctcaccttcatccggactacctttagcttgcactacgcctggaagaccatggctatggtcctgtccatagtgtccctcttccccctctgcctgtccaccacgagccaaaagaccacatggctccccgtgctgctaggctccttggggtgcaagccgctgaccatgttcctgatcgccgagaacaagatctgggggcgcaaaagctggccccttaatgaaggcatcatggccgtcggcatcgtgagtatcctgctgagtagcctcctgaagaacgacgttccattagccggtcccctcatcgccggcggcatgctgatagcgtgctacgtgatctccgggtcctctgccgacctgtctctcgagaaggcagccgtggtgtcctgggaagaagaggccgagcactcaggcgcgagccacaacatcctagtggaggtgcaggacgacggcacgatgaagataaaggacgaggaacgtgacgacactctgaccatcttgctgaaggccaccctactcgccgtgagcggcgtctaccccctgtccatccccgcaacactattcgtgtggtacttctggcaaaagaagaaacagcgcagcggggtgctttgggacacgccctccccgcccgaggtcgagcgggccgtgctggacgacggcatataccgaatcatgcagcggggcctgctgggacgctctcaggtaggcgtcggggtgttccaggagaatgtgttccacaccatgtggcacgtcacccggggcgcagtgctcatgtaccaggggaagcgcctggagccttcctgggccagcgtaaagaaggacctgatatcctacggcggtgggtggcgactccaagggagctggaacaccggggaggaggtccaggtaatcgccgtggagcccggcaaaaatccgaagaatgtccagaccgccccggggaccttcaagacctcggagggggaggttggcgccatcgcgctggacttcaagcccgggacaagcggttcccccatcgtgaaccgcgaggggaagatcgttggcctgtacgggaacggggtggtgacgacctccggcacctacgtcagcgccatcgcccaggcgaaagcgtcccaggaggggcccctcccggagatcgaggacgaggttttcaggaagcgcaacctgaccacgatggacctgcaccccggctcaggaaagacccggcgctacctccccgccatcgtgcgtgaggccatcaagcgcaaactgcgcaccctgatcctcgccccgaccagggttgtggcctccgagatggcggaagcactgaagggcatgcccatccgctatcagacgaccgccgtcaagagcgagcataccggcaaggagatcgtcgacctgatgtgccacgccaccttcacgatgcggcttctgagcccagtgcgcgtccccaactacaacatgatcataatggacgaggcacatttcacggatccaagctccatcgcagcccgggggtatatctccacccgcgtcggcatgggtgaggccgccgccatcttcatgaccgcgactccgcccggttccgtggaagccttcccccagagcaacgccgtgattcaggacgaagagagggacataccggaacgctcctggaacagcggctacgagtggatcaccgacttcccaggcaaaacagtttggttcgtgccctccatcaagagcggcaacgatatcgccaactgcctgaggaaaaacgggaagcgcgtgattcagctctctcgtaaaaccttcgacacagagtaccagaagaccaaaaacaacgactgggactatgtcgtgaccaccgacatctccgagatgggcgcgaacttccgcgccgaccgggtgatcgatccccgccggtgcttaaagcctgtcatcttaaaggatggccccgagcgcgtcatactcgccggccccatgcccgtcacggtggcctccgccgcacaacggcgcgggcggataggcaggaacccgaacaaggagggcgaccaatacatctacatggggcaaccactgaacaacgatgaggaccacgccccgtggaccgaggccaaaatgctgctcgacaatatcaatactcccgagggaatcatcccggctttattcgaacccgagcgcgagaagtcagccgcgatcgacggagaataccggctacgcggcgaggcccggaagaccttcgtggagctcatgcgcagaggggatctgcccgtctggctgagctataaggttgcctccgagggcttccagtacagcgaccgacggtggtgcttcgacggcgagcggaacaaccaggtactcgaggagaacatggatgttgagatctggacgaaggagggggagcggaagaagctgcgcccccggtggctggacgcccgaacctactcagacccgctcgccctgcgggagttcaaagagttcgcggctggcaggcggagcgtgtctggggacctaatcttggagatcggcaagctgccccagcacctgacccaacgcgcccagaacgccctcgacaacctagtgatgcttcataacagcgagcagggcggacgggcgtaccgccacgccatggaggagctcccagacaccatcgagacgctgatgttgctcgccctcatcgctgttctgaccggcggggtgaccctcttcttcctgtccggtcgggggctgggcaagactagcatcggtcttttgtgcgtaatggcctcctctgtcctactctggatggcaagcgtggagccgcactggatcgccgccagcatcatcctggagttcttcttaatggtgctccttatcccagagcccgaccgccaacggacgccccaggacaaccagctagcctacgtcgtgatcggcctcctgttcatgatcctgacggttgctgcaaacgagatgggcctcctggagaccactaagaaggacctcgggataggccacgtcgccgtggagaaccatcaccacgccgccatgcttgatgtggatctgcacccggcctcagcgtggacactgtatgccgtggccacgactatcattacccccatgatgagacacaccatagaaaacactaccgccaacattagcctcaccgccatcgccaatcaagccgccatcctgatggggctggacaagggctggcccatctctaagatggacatcggcgtgcccctgctggcgttagggtgttacagccaggtaaacccgttgaccttgacggcggccgtcctgatgctcgttgcccactacgccatcatcggtcccgggctgcaggctaaggcaacccgcgaagcccagaagcgcaccgccgccggtataatgaagaaccccacggtggacgggatcgtcgcaatcgacctggaccccgtggtgtacgacgcgaaattcgagaagcagctcggccagatcatgctgctaatcctatgcacgtctcagatcctgcttatgcgcaccacttgggccctctgcgaaagcatcaccctggccacgggcccgttgacgaccctctgggagggctcccccggcaagttctggaataccacgatcgccgtcagcatggctaacatattccgagggagctacctggcgggagccggcctggccttctccctcatgaagtccctagggggtgggcgccggggtaccggggctcagggcgaaaccctaggcgagaagtggaagcgccagctcaaccagctgtctaagagcgagttcaacacctacaagcggtccgggatcatggaggtggatcggagcgaggcgaaggagggcctaaagcgcggggagactacgaagcacgccgtgtcccgcggcaccgccaagctccggtggttcgttgagcgcaacctagtgaagcccgaggggaaggtgatagatctgggctgtggccgcggcggttggagctactactgcgccgggctgaagaaggtcaccgaggtgaaagggtacacgaagggcggccccggccacgaagaaccaatcccaatggccacgtacgggtggaacttggtgaagctgcactccggcaaagacgtcttcttcatcccgcccgaaaagtgcgacacccttctatgcgacatcggggagagctccccaaaccccaccatcgaggagggccgcacgctgcgggtgctgaaaatggttgagccctggctccgcgggaaccagttctgtatcaagatcctgaacccctacatgccgagcgtcgtggaaaccttggagcagatgcagcggaagcacggcgggatgctagttcgcaaccccctctccagaaattccacccacgaaatgtactgggtctcctgcgggaccggcaacatcgtgagcgcggtgaacatgacgtcccgcatgcttctcaaccgcttcacaatggcccaccggaagcccacctatgagcgcgacgtcgacctgggagccggcacccggcacgttgccgtggagccggaggtcgccaatctggatatcatcggccaacgcatcgagaacattaagcatgagcataagagcacctggcattacgacgaagacaacccgtacaagacgtgggcgtaccacgggtcttacgaggtgaaacccagcggcagcgcctccagcatggtcaacggcgtagttaagctcctgaccaagccctgggacgttatccccatggtgactcagatagccatgaccgacacgaccccgttcggccaacagcgggtgttcaaagagaaggtcgacacccggacccccaaggccaagcgggggacggcccaaatcatggaggtgaccgcgaagtggctgtggggtttcctctcccgcaacaagaagccccggatttgtacccgcgaggagttcacccggaaggtgcgcagcaatgccgccatcggcgccgtattcgtcgacgagaaccagtggaacagtgcgaaggaggccgtggaggacgaacggttttgggatctcgtccaccgcgagcgggagctgcacaaacagggaaagtgcgccacgtgcgtgtacaacatgatgggcaaacgtgagaagaagttaggggaatttggcaaagccaaggggagccgggccatctggtacatgtggctgggcgcgcggttcctggagttcgaggcactcggcttcatgaacgaggaccattggttttccagggagaactcactgtccggggtggagggcgaggggcttcacaagctcggctacatcctacgcgacatcagcaaaatccccgggggcaacatgtatgccgacgacaccgccggctgggacacccgcatcaccgaagacgacctgcagaacgaggccaagatcacggacatcatggagcccgaacatgcgctgctggcaaagtccattttcaagctgacctaccagaacaaggtggtgcgcgtgcagaggccggcaaagaacgggaccgtcatggacgtgatcagccgtcgcgaccagcgcgggagcgggcaggttggcacctacggcctcaacacgtttaccaatatggaggcccagctgatccgccagatggagagcgaggggatattctcccccagcgagctggagaccccgaatctcgccggacgggtcctggactggttagagaagcacggtgtggagcggctgaagcggatggcgatctccggcgacgattgcgtggtcaagccaatcgacgaccgcttcgccacggccctgacggccttaaacgacatgggaaaagtgcggaaggacatcccacaatgggagcccagcaagggctggaatgactggcagcaagtcccgttttgctcccaccacttccatcagctcatcatgaaggacggccgcgagatcgtcgtgccctgccggaatcaggacgagttggtggggcgcgctcgggtctcccagggtgcagggtggagcctgcgggagaccgcctgccttgggaaatcctacgcccagatgtggcaactgatgtacttccaccggcgcgatctgcggctcgccgcgaacgccatttgcagcgccgtgcccgtggactgggtacccacctcccgcaccacgtggagcatccacgcccaccaccagtggatgaccacggaggacatgctgtcggtgtggaaccgtgtgtggatcgaggagaatccgtggatggaggacaagacacacatcagctcctggggcgacgtcccctacctgggcaagcgcgaggatcagtggtgtggcagccttattgggctgacggcccgcgcgacctgggctaccaacatacaggtcgccatcaaccaggtacgccggctgctcggcaacgagaactacctcgactacatgacctccatgaaacgattcaagaacgaaagcgatcccgagggggccctgtggtga

SEQ ID NO: 24444 - RNA, 9879 nt, synthetic construct
  misc_feature 1..9879: note = derived and/or modified CDS sequence (opt11) from DENV-1__GU131731__SS-prME
  source 1..9879: mol_type = other RNA
agcgtaacgatgctcctcatgctgatgcccactgctttggcctttcatttaaccacccgcggcggggaaccacatatgatcgtgacaaaacaggagcgggggaagagtctactgttcaagaccagcgcgggggtgaacatgtgtaccctgatcgccatggacctgggtgagttgtgcgaggatacgatgacctataagtgtccccggatcacggaggccgagcccgacgatgtggactgctggtgcaatgccacggacacctgggtcacctacgggacctgcagtcagacaggtgagcatagacgagataagaggagcgtggccctcgcaccccacgtgggactggggttggagacaagaacagagacctggatgtccagcgagggcgcctggaagcagatccagagagtcgagacgtgggccctccgccaccccgggttcaccgtgattgccctgttcctggcccatgccatcggcacctctataacccagaagggtatcatctttatcttgctgatgttagtcacgcccagcatggccatgcgctgcgtcggtatcggctctcgggactttgtagaggggctctccggggctacttgggtggacgtcgtgcttgagcacgggtcctgcgtgaccaccatggccaaggacaaacccacgctggatatcgaactcttaaagaccgaggtcaccaaccccgcggtgctacggaaactctgcatcgaggccaagatcagcaacacaactacagactcccgttgccctacccagggcgaggccacattaatggaggagcaagacgcgaacttcgtgtgtcggcgcaccttcgtcgaccggggctgggggaacggctgcggattgtttggcaaagggtcgcttatcacgtgcgctaagtttaagtgtgtcactaagctggagggcaagatagtgcaatacgaaaacctgaagtattccgttatcgtgaccgtgcacacgggcgaccagcaccaggttgggaacgagtccaccgagcacggtaccaccgccacaatcactcctcaggcaccaacgtccgagatccagctcaccgactacggggccctgaccttggactgttcacccagaacgggccttgacttcaatgaaatggtgctcctgacaatgaaggagaagtcctggttggtccacaagcagtggtttctggacctgccgctgccctggacaagcggggccagcacgtcccaggagacgtggaatcggcaggacctgctggtgaccttcaagacagctcacgcgaagaagcaggaagtggtcgtgcttggctcacaggagggcgccatgcacaccgctctcacgggggccacagagatccaaacttccggcacaacgaccatcttcgccggccatctgaagtgccgcttaaagatggacaaactgaccctcaagggcatgagctatgtcatgtgcaccggttcatttaaacttgagaaggaggtcgcagagacgcagcacggcaccgtgcttgtgcaaatcaagtacgagggcaccgatgcgccctgcaaaatccccttcagcacccaggacgaaaaaggagtcacgcagaacggccggctgatcaccgccaacccgattgtgaccgacaaggagaagcccgtgaacatagaggccgagccgcccttcggggagtcctatatagtcattggcgcaggcgagaaagcactaaaactttcttggtttaagaaggggtccagcatcggcaaaatgtttgaggccactgcccgtggagcccggcggatggcgatcctgggtgatacggcctgggacttcgggtctgtgggcggtgtgttcacctcggtcgggaagctggtacaccagatcttcggcaccgcatatggggtcttgttctccggcgtcagctggaccatgaagatcgggataggggtgctgctgacgtggctcggcctgaactccagaagcacttccctgagcatgacctgcatcgccgtggggctagtgaccctgtacctgggcgttatggtgcaggcggactccggatgcgtgatcaactggaagggccgggaactcaaatgtgggtcgggcatattcgtgaccaatgaggtgcatacctggacggagcagtacaagtttcaggcagatagcccgaaacgcttatccgctgccataggcaaggcctgggaggaaggggtctgtggtatccggtctgccaccagactggaaaacatcatgtggaagcagatttccaatgagctgaaccatatccttcttgagaacgacatgaagtttaccgtagtcgtcggggatgttgtaggcatcttggcccaggggaagaaaatgatccggccgcagcccatggagcacaagtacagctggaagtcctggggtaaggcaaagatcattggagccgacgtacagaataccacgtttataatcgacgggccaaatacccctgagtgccccgacgaccaaagagcgtggaacatctgggaagtggaggactacggcttcggaattttcaccacgaacatctggctgaagcttagagacagctacacccaggtgtgcgaccaccgcctcatgtccgctgccatcaaggatagcaaggccgtgcacgccgatatgggttactggatcgagtccgagaagaacgagacatggaagttggcgcgggcgtcattcatcgaggtgaagacctgcatctggccgaagtcccacaccctatggagcaacggtgtgctcgagtcagagatgataatccccaagatctacggcgggccgatctcccagcacaattatcgccccgggtacttcacccagaccgcgggcccctggcatcttgggaagctcgagctcgactttgacctgtgcgagggtaccacggtggtggtggacgagcattgtggtaaccgcgggccgtccctgcgcaccaccaccgtcacgggtaagataattcacgaatggtgctgccggagctgcaccctgccgccccttcgcttcaagggggaggacggctgttggtacggaatggaaatcaggcccgtcaaggagaaggaggagaacctggtgaagtccatggtcagcgcgggctcaggggaggtggacagcttcagcctcgggctgctgtgcatctcaatcatgatcgaggaagtgatgcgcagccggtggtcccgtaaaatgctcatgaccggcactctggctgtctttctgctcctcatcatggggcaactgacgtggaacgacctcatccggctgtgcataatggtcggtgctaacgcgagcgaccgcatgggtatgggcaccacatacctggcgctaatggccactttcaaaatgcgtccgatgttcgctgtgggcctgctgtttcgccgcctcacgtcccgggaggtattgctgctgaccatcgggctgagtttagtggcctccgtcgagttacccaacagcctggaggagctaggggacggactcgcgatgggcataatgatcctgaagctactcaccgacttccagtcccaccagctgtgggccacgttactcagcctaaccttcatcaaaactaccttgtccctccattacgcctggaagaccatggccatggtgctgagtatagtttcccttttccccctctgcctgagcacgacctcccagaagaccacatggctgcccgtcttactgggcagcctggggtgcaaaccgttaaccatgtttctgatcaccgagaataagatctggggccgaaagagttggcccctgaacgaggggattatggctgtgggtgtggtcagcatcttactctcctccctgttaaaaaacgacgtgccactggccggtcccctgatcgcaggtgggatgctcattgcctgctatgtgatcagcgggtcctcagccgacctgtccctggagaaggcggccgaagtcagttgggaggaggaggccgagcattccggcgcctctcacaacatacttgtagaggtccaggacgacgggaccatgaagatcaaggacgaagaacgggatgataccctgaccatactgctaaaagccacgctgctggcggtctccggcgtgtacccgttgagcattcccgccacgctgttcgtatggtatttttggcaaaagaaaaagcagcgtagcggggtcctgtgggacacacctagtccacccgaggttgaacgggccgtcctggacgacgggatttaccgcatcatgcaacggggcctcctggggagatcgcaggtcggcgtcggggtgttccaggagaacgtcttccacaccatgtggcacgtgacgcggggcgctgtattaatgtaccaggggaagcggctcgagcccagctgggcctccgtcaagaaggacctgatctcctatggcggcgggtggcggttgcaaggctcctggaacactggggaggaagtccaggtgatcgccgtcgagcccggcaagaatccgaagaacgtccagaccgccccgggaaccttcaagacccccgagggcgaggtgggcgcaatcgccctagacttcaaacccggtacaagcggctcccccatcgtaaatcgcgaaggcaagatcgtgggcctgtatggcaacggggtggtcaccacgagtggcacgtacgtgtcggccatcgcgcaagccaaggcttcccaagaagggccgctccccgagattgaagacgaggtattccggaagcgaaacctaactatcatggacctgcaccccggatcagggaagacccggaggtacctgccggccatcgtccgtgaagcgataaagcgcaagctccggacacttatcctggcacctacgagagtggtcgcatccgagatggccgaagcgctgaagggcatgccaatccgatatcagaccactgctgtcaagtcggaacacaccggaaaagagatcgtcgacctcatgtgccacgcgacattcacaatgaggctactctccccggtgcgcgtccccaactacaacatgatcatcatggacgaggcccacttcaccgacccctcctccatcgccgcgcggggctatattagcactcgcgtgggtatgggggaggcggccgcaatcttcatgacagccacgcctcccggatctgttgaggcctttccgcagagcaacgctgtcatccaggacgaggaacgggatataccagaacgcagttggaacagcgggtatgaatggatcacagattttcccggcaagaccgtgtggttcgtgccctccatcaagagcggaaatgacatcgccaattgcctgcggaagaacggaaagcgggtcatacagctgtcccgcaagacgttcgacaccgagtatcagaagacgaagaacaacgactgggactacgtggtaacgaccgacatcagcgagatgggcgccaacttccgcgccgaccgggtcatcgacccacgccggtgtctaaagcccgtgatcctgaaggacgggcccgagcgcgtcatcttggcgggcccgatgccagtgaccgtggcttccgcggcccagcggcgcggtcgtattggccgcactcacaacaaggagggcgaccagtacataagcatggggcagcccttgaacaccgccgaggaccacgcaccctggacggaggctaagatgctcctggataacatcaacaccccagagggaatcataccggccctcttcgagcccgagcgggagaagtccgccgccatcgacggcgagtacaggctgaggggcgaggcgcgaaagaccttcgtggagctgatgcgccgcggggacctccctgtttggctgagctacaaggttgccagcgaaggctttcaatactcggaccgtcggtggtgcttcgacggcgagcgtaacaaccaggtcctggaggagaacatggatgtggagatttggaccaaagagggggagcggaagaagctccgcccgcggtggctagacgcccggacttacagcgacccgctggcattacgggagttcaaggaatttgcggcgggccgccgatccgtgtctggtgacctgattctggagatcggcaagctccctcagcacctgactcagagagcgcaaaacgccctggataacctcgttatgttacacaactcagaacagggcgggcgcgcctaccggcacgcgatggaggagttgcccgataccattgagaccctcatgctactggccttgatcgccgtcctgaccgggggggtgacgctgttcttcctctctggccggggcctgggcaagacctccatcggcctgctttgcgtcatggcctcgtccgtgctgctgtggatggccagcgtggagccacactggatagcagcctcgatcatccttgaattcttcctgatggttctgctaatcccggagcccgaccgccagaggacaccacaggacaaccaactggcctatgtagttatcggtttactcttcatgatattaacagttgccgccaacgaaatgggtctgctcgagacgactaagaaagacctggggatcggacacgttgcggtggagaaccaccaccacgccacaatgctggatgtcgacttgcacccggcctcagcatggaccttgtacgccgtggccacgacgatcatcacgcccatgatgcgtcacaccatcgagaacacgaccgccaacatctccctgactgccatcgcgaaccaggccgcgatcctcatggggttggacaaggggtggcccatcagcaagatggacatcggagtgcctctgttagccctgggatgttactcccaggtcaacccactcaccctaacggccgccgtgctgatgttagtggcgcactatgccattatcggcccagggctccaggcgaaggcgacacgggaggcccaaaagcggactgcagcaggcataatgaagaaccccaccgtcgacgggatcgtagcaatcgacctggaccctgtggtttacgacgcgaaatttgagaagcaattaggccaaatcatgctcctgatcctgtgcactagccagatcctcctgatgcgtacgacctgggctctgtgcgagtccatcaccctcgccacgggcccattgaccaccttgtgggaggggagcccaggcaagttttggaacaccactatcgccgtgtccatggccaacatcttccgagggtcgtacctagctggcgcgggcctggcgttcagcctaatgaagtccctagggggcggccgccgcggcaccggcgcgcagggcgaaacccttggggaaaaatggaagcgccagctgaaccagctaagtaagtccgagtttaatatctacaagcggtctgggataatggaggtggatcgctccgaggcgaaggaaggacttaagcgcggggagaccacgcgtcacgccgtcagcagaggtaccgcgaagctgaggtggtttgttgagcggaaccttgttaaaccggaagggaaggtcatagacctcggctgcgggcgcggaggctggagctactactgcgccgggctgaagaaggtgacagaggtgaaaggctacactaagggcggtcccggccacgaggaccccatccccatggccacgtatggatggaacctggtcaagctgcacagtggcaaagacgtgttcttcacgccgcccgagaagtgcgataccttgctgtgcgacattggtgagtcctcgccaaaccccactatcgaggaggggcgaaccttacgcgtactgaagatggtcgaaccctggttacgtgggaaccagttctgcatcaagatcctcaacccatacatgccgtccgtagtggaaactctcgagcagatgcagcgcaaacacggcggtatgctggtccggaacccactcagccggaactctacccacgaaatgtattgggtgagctgcggtaccggcaacatcgtgtccgcagttaacatgacctcgcggatgctgctcaaccgcttcacgatggctcatcgcaagcccacctatgagcgggacgtggatctcggggcgggcacccgacacgtggccgtcgagccagaggtggcgaacctggacatcatcggccagcggattgagaacattaagcacgagcacaagtctacatggcactacgacgaggataacccatacaagacgtgggcctaccacgggagctacgaggtaaagccctccggcagcgcaagctccatggtgaacggggtcgtcaagctgctgaccaagccctgggacgtgatccccatggtgactcagatagcgatgactgacacgaccccgttcggccagcagcgggtcttcaaggagaaggtagacacccggacccccaaagctaagcgcggcactgcccagatcatggaggtgacggcacggtggctctggggcttcttgagccgcaacaagaagccccggatatgcacccgagaggaattcacccggaaggtacgctccaacgccgcgatcggcgccgtgttcgtggacgagaatcaatggaacagcgccaaagaggccgtcgaggacgagcggttctgggacctcgtacagaaggagagggagcttcataagcaggggaagtgtgcgacatgcgtgtacaacatgatgggcaagcgggagaagaagctgggggagttcggcaaagccaaagggtcccgcgcgatctggtacatgtggctgggagcccggttcttggaattcgaggcccttggcttcatgaacgaagaccactggtttagccgtgagaactcactgagcggggtcgagggcgagggtctgcataagctgggctatatcctccgggacatctccaagattcccggcggtaacatgtacgcggacgacaccgccggctgggacacccgcatcaccgaagatgacctgcagaacgaggccaagatcacggacatcatggagccggagcacgccctgctcgccacctcgatcttcaagcttacctatcagaacaaagtagtgcgtgtccagcgccccgcgaagaacggtacagtgatggacgtcatctcccgccgggatcagcggggctcgggccaggtaggcacgtacggattgaacaccttcactaacatggaagcccagctcatccggcagatggagtccgagggcatcttcctgcccagcgagctcgaaacccccaacctcgcggagcgcgtgttggattggttggagaaatacggcgttgagcggctcaagcgcatggccatctccggtgacgactgcgttgtgaaacccatcgacgaccgtttcgctacggcgctgaccgccctgaatgacatgggaaaggtgcgaaaggacatcccccaatgggaacccagcaaagggtggaatgactggcagcaggtcccgttctgctcccaccacttccaccagctcatcatgaaggacggccgggagatcgtggtaccctgcagaaaccaggacgagttagtaggccgggcccgtgtgtcgcagggggccggctggtcgctgcgggagaccgcctgcctcgggaagtcatacgcgcagatgtggcaactaatgtacttccaccgccgggacctgcgcctcgccgccaacgccatctgcagcgcggtgcctgtcgactgggtgccgaccagccgtacgacctggtctatccacgcccatcatcagtggatgaccaccgaggacatgctgtccgtgtggaaccgcgtttggatcgaggagaacccatggatggaggacaagacccacgtcagctcgtggggcgatgtcccatacctgggtaagcgggaggaccaatggtgcggcagcctaattggactcactgcgcgcgctacctgggcatccaacattcaggtagcgattaaccaggtgagacggctcattgggaacgagaactatctcgactacatgaccagcatgaagcgcttcaaaaatgaaggcgatccagagggcgcactgtggtga

SEQ ID NO: 24445 - RNA, 9879 nt, synthetic construct
  misc_feature 1..9879: note = derived and/or modified CDS sequence (opt11) from DENV-1__GU131733__SS-prME
  source 1..9879: mol_type = other RNA
agcgtcaccatgttcttgatgttaatgcctaccgccctggcctttcatttaacgaccaggggcggggagccgcacatgatcgtgagcaagcaggaacggggcaagagcctgctgttcaagacgtccgccggcgtgaacatgtgcaccctgatcgcgatggacctcggggagctgtgcgaagacaccatgacctacaagtgcccgcgcatcacggagaccgagcccgacgacgtggactgctggtgcaacgcgacggacacctgggtcacctacgggacctgtagccagacaggcgagcaccgccgcgacaagcggtccgtcgccctggcgccccacgtaggcctcgggctggagacgcgcacggagacatggatgagctcggagggcgcctggaagcagatccagcgggtcgagacttgggccctgaggcaccccgggttcacagtgatcgccctcttcctggcgcacgcgatcggcaccagcatcacccagaaggggatcatcttcatcctgctaatgctggtgacaccatccatggccatgcggtgcgtcggcattggctctagggacttcgtggaggggctgagcggagcgacctgggtggatgtagtgctcgagcacgggagctgcgtgaccaccatggctaaagacaaacccacactggacatcgagctgctcaaaaccgaggttacaaacccagccgttctgcggaaattgtgcatcgaggcgaagatctccaacaccactaccgacagccggtgcccgacgcagggcgaggccactttggtggaggagcaggatgctaacttcgtctgcaggaggaccttcgtggatcggggctggggcaacggctgcgggttatttggcaaggggtccctgatcacgtgtgccaagttcaagtgcgtcacaaagctcgaggggaaaatcgtacagtacgaaaacctgaagtacagcgtgatagtgaccgtacacactggagaccagcaccaggtggggaatgaatccaccgaacacggcactacggccactatcactccccaagcacccactaccgagatacagctgactgactacggggcgctcacgctcgactgctcgccccgcaccggcctcgacttcaatgaaatggtcctcttgacgatgaaggagaagtcctggctggtccacaagcagtggttcctcgacctgccgctgccctggaccagcggcgccagcacgtcgcaggagacctggaacaggcaagacttactggtgaccttcaaaaccgcccacgccaagaagcaggaggtggtggtcctcggctcacaggagggcgcaatgcacacggctctcacaggggccaccgagattcagacctcaggcacgaccacaatcttcgcagggcatctgaagtgccgcctgaagatggacaagctcaccctgaaaggcatgagctacgtcatgtgcacgggttccttcaagctggagaaggagctcgccgagacgcagcatggcaccgtgctggtgcagatcaagtacgaaggcaccgacgcgccctgcaagatccccttcagcacacaggatgagaagggagtcacccagaacggccggctgatcaccgccaacccgatcgtgactgacaaggagaagcccgttaacatcgaggcagagccaccctttggggagtcctacatcgtcatcggcgccggcgagaaggcgctaaaactcagctggtttaagaagggatcctcgataggtaagatgttcgaggcaacagccagaggggccaggcggatggcaatcctgggcgacaccgcatgggatttcgggtccatcggcggtgtgttcaccagcgtagggaagctggtccatcagatctttggcaccgcgtacggcgtgctattctccggcgtgagctggacgatgaaaatcgggatcggagtcctgttgacctggttaggtctaaattcccgcagcacctccctgtcaatgacctgcatcgcggtgggcctcgtgacgctgtacctgggcgttatggtacaggccgactccgggtgcgtgatcaactggaagggccgggagctcaagtgcgggagcggcatatttgtaaccaacgaggtacacacctggaccgaacagtacaagttccaagccgactcacctaaacgcctgtccgcggccatcggcaaagcctgggaggagggtgtgtgtggcatccggagcgccacccgcctggagaacatcatgtggaagcagatctctaacgagctaaaccacattttactggaaaacgacatgaagttcacggtcgttgtgggtgacgtcgccggcatcctcgcacaggggaaaaagatgatacgcccccagccgatggagtacaagtacagctggaagtcctggggcaaggccaagatcatcggcgcggacgtgcagaacacaacattcatcattgacgggcccaacacccctgagtgccccgacgaccagcgcgcttggaacatatgggaagtggaggactacggcttcgggatcttcacaaccaacatctggctgaagctgcgggacagctacacacaggtctgcgaccaccgcctcatgtccgcggctatcaaggacagcaaggctgtccacgccgacatgggatactggatcgagtccgagaaaaacgagacatggaagctggcccgggctagcttcatcgaggtgaagacgtgcatatggcccaaatcccacactctgtggagcaacggcgtcctcgagtccgagatgatcatcccaaagatttacgggggcccgatcagccagcacaattaccgccccggttacttcacccaaaccgccggcccctggcacttagggaaactggaactagacttcgacctgtgcgagggcactaccgtggtggtcgacgagcattgcggcaaccgcgggccgtctctgagaaccaccacagtgacggggaagatcatccacgagtggtgctgccggagctgcaccttacctcccctacgcttccgcggtgaggacggctgctggtacgggatggagatccgccccgtgaaggaaaaagaggagaacctggtcaagtccatggtgagcgccggctcaggggaggttgactctttcagcctcgggttgctgtgcatttccatcatgatcgaggaggtcatgcgcagtaggtggtctcggaagatgctcatgaccggcacgctggccgtgttctttctgctaatcatggggcaactaacctggaatgacctgattcgcctctgcatcatggtgggcgccaacgcgagtgaccgcatggggatgggcaccacctacttagctctcatggcgacgttcaagatgcgtccgatgtttgccgttggcctcttgtttcgccgcctgacctcacgcgaggtgctcctgttaaccataggcctcagcctggtggcctccgttgagctgcccaatagccttgaggagctgggcgatgggctggcgatggggatcatgatcctaaagctgcttaccgacttccagtcccaccagttgtgggcaacgctgttaagcctgaccttcatcaagactactttctccctgcactacgcctggaagacgatggccatggtgctgagcatcgtctccctcttccccttgtgcttgagcaccacctcccagaaaaccacgtggttgccagtcctgttgggcagcctcggatgcaaaccgctgacgatgtttctgatagctgagaacaagatctggggccggcgctcctggcccctcaacgaggggatcatggccgtgggcatcgtatctatcctgctaagctccttactgaagaacgacgtgcccctcgccggcccgctcatcgccggcggcatgttaatcgcgtgttacgtaatcagcgggtccagcgcggatctttcgctcgagaaagcagccgaggtcagctgggaggaggaggccgagcactccggggccagccataacatcctggtcgaggtgcaggacgacgggaccatgaaaatcaaggacgaggagcgggacgacaccctgaccatcctcctgaaggcgacgctgctagctgtttccggcgtttacccgctgagcatcccggccacgctgttcgtatggtacttctggcagaagaagaaacagcgctccggggtcctctgggacaccccgagcccacccgaagtggagcgggccgtactagacgacggcatctatcgaatcatgcagcggggcctgctgggccgctcacaggtgggcgtgggggtgttccaggagaacgtattccataccatgtggcacgtgacacggggcgccgtcctcatgtaccaggggaaacgcttagagcctagctgggcgtccgtcaagaaggacctgatcagctacggcgggggatggcggctccaagggtcctggaacacaggggaggaggtccaggtgatcgcagtcgagcccggcaagaacccgaagaacgtgcagaccgcccccgggacctttaaaactcccgagggcgaagtgggcgcgatcgcgctggacttcaagcccgggacctctggctcccccatcgttaaccgcgaggggaagattgtcggcttgtacggcaatggggtagttaccacgtcgggcacgtacgtgagcgctatcgctcaggcccgggcctcccaagaggggcccctccccgagatcgaagacgaggtgttccgcaagcggaacctgaccataatggacctgcatcctggctctgggaaaacccgccgttacttaccagcgattgtccgagaagccatcaagcgcaagctgcggaccctgatcctcgccccgacgcgagtggtagcgtccgaaatggccgaggcgctgaagggcatgcccatccggtaccagactaccgccgtcaagtccgagcacaccggcaaagagatcgtggacctgatgtgccacgccacgttcaccatgcgcctcctgtcccccgtgcgggtcccgaattacaacatgatcatcatggacgaagcccactttaccgacccctcctcaattgccgcgcgcggctacatcagtacgcgtgtgggcatgggggaggctgccgccatcttcatgacggccaccccgcccggctcggtggaggcgttcccccagtctaatgccgtcatccaggacgaggagagagacatccccgagcggtcctggaacagcgggtacgagtggatcaccgacttccccggtaagaccgtgtggttcgtgccctccatcaagagcggcaatgacatcgccaactgcctgcgcaagaacgggaagcgggtaatccagctctcccgtaagacgttcgacaccgagtaccagaagaccaagaacaatgattgggattacgtggtgaccacggatatttcagagatgggcgccaacttccgtgcggatagagttatcgacccgcggcgatgcctgaagcccgtaatcctgaaggacgggcctgagcgggttattctcgccggccccatgcccgtcaccgtggcttccgctgcccagcgccgggggcgcattggccgcaaccacaataaggagggcgaccagtacatctatatgggccagcctctcaacaatgacgaggatcacgctcactggaccgaggcaaagatgctgttggacaacatcaacacccccgagggcatcatccccgcgctgtttgagccggagcgggagaagtccgccgcgatcgacggggagtaccgcttacggggcgaggcgcgcaagacgttcgtggaactcatgcgacgcggggacctgcccgtgtggttgtcctacaaagtggccagcgaaggcttccagtacagcgaccggaggtggtgtttcgatggcgagcggaacaaccaggtcctcgaggaaaacatggatgtggagatttggaccaaggagggggagcgcaagaagttacgaccccgctggctggacgcccgaacgtactcagaccccttggccctgcgcgagttcaaggaatttgccgccggacggcgctctgtgtccggggatctgatcttggagattggcaaactgccgcagcatctgacccagcgggcgcagaacgccctcgataacctggtcatgctgcacaacagcgagcagggcggtcgcgcctacaggcacgcgatggaggagctgcccgacacgatcgagaccctgatgttgttggccctgatagccgtgctgaccggcggagtgacactcttcttcttgtccggccgcggtcttggcaagaccagcatcggcctcctgtgcgtgatggcctcgtctgtgctgctctggatggcctctgtcgagccccattggatcgcggcctccatcatattagagttctttctgatggtgcttctgatacccgagccggatcgccagcgcacgccccaagacaaccagctggcctacgtggtgatcggcctcctgtttatgatcctaactgtggccgcgaacgaaatggggctacttgagaccaccaagaaagatcttgggattggacacgtggcggttgagaaccaccatcacgccgctatgctcgacgtcgacctccatcccgcctccgcctggacgctgtatgcggttgccacgacgatcattaccccgatgatgcgccacacgatcgagaacaccaccgcaaacatcagccttaccgcaatcgccaatcaagcggccatcctaatggggctggacaaaggctggcccatctccaagatggacataggcgtgcccctcctggctctggggtgttacagccaggtcaaccctctcacgctgaccgccgcggtcctgatgctagtcgcccactacgccatcatcggccccggtctgcaagcgaaagccacccgagaggcgcagaagcgcaccgcggcaggcatcatgaagaatcccacggtggacgggatagttgccatagaccttgaccccgtagtttacgacgccaagttcgaaaaacaattgggccagataatgctgctgatattatgtacctcccaaatcttactgatgcggaccacctgggcgctctgcgagagtattacgctggccacaggacccctgaccacactctgggaggggtccccgggcaaattctggaacacgaccatcgccgtgtccatggctaacattttccgggggagttacctggcaggcgcgggcctggccttcagcctcatgaagtcgctcgggggcgggcggcgcggaaccggggcacagggcgagaccttgggcgagaagtggaagcggcaactcaaccagctgagtaaaagcgagttcaacacgtacaagcgctccgggatcatggaggtggaccggagcgaggccaaggaggggctgaagcgaggggagaccaccaagcatgcggtctcgcggggcaccgcgaaactccgctggttcgtggagaggaacctcgtgaagcctgaggggaaagtcatagacctgggctgcggcagaggaggatggtcctactactgcgccggtctgaagaaggtcactgaggtgaaaggctacacgaagggcggacccggccacgaggagcctatcccaatggcgacctacggatggaacctcgtcaagctgcactccggcaaggatgtcttcttcataccacccgagaagtgcgacactctgctctgcgacatcggggaaagctcccccaacccgacgatcgaggagggccggaccttgcgcgttctgaaaatggtcgaaccctggctccgggggaaccagttttgcataaagatcctgaacccctacatgcccagtgttgttgaaacactggaacagatgcagcgcaaacacggtggcatgctcgtacggaatccgctgtcacgcaactctacccacgagatgtactgggtgtcctgcgggaccggcaacattgtcagcgccgtcaacatgacttcccgaatgctgctcaaccggttcactatggcacacagaaagcccacctacgaaagagacgtggaccttggggccggcacgcgccacgtcgccgtcgagccagaggtagctaacatcgacattatcggccagcggatagagaacatcaagcacgagcacaagagcacgtggcactacgacgaggacaacccatacaagacctgggcctaccacgggagttacgaggtgaagccctcaggttccgcgagcagtatggtaaatggggtggtcaagttactgacgaagccatgggacgtgatccccatggttacccagattgcaatgacagataccacccccttcggacagcagagggtcttcaaggagaaggtggacacccgaactccgaaggccaagcgggggaccgcccagatcatggaagtgacagctaagtggctttggggcttcctatccaggaacaagaaaccccgcatctgcaccagggaagagttcacgcgcaaagttcggagcaatgcggccattggcgccgtctttgttgacgagaaccagtggaactccgccaaggaggcggtcgaagacgagagattctgggacctcgtccaccgggagcgtgagctccacaagcaggggaagtgcgcgacctgcgtgtataacatgatgggcaaacgggagaagaagctgggagagttcggaaaggccaaggggagccgcgctatctggtatatgtggctcggagcccggttcctggagttcgaggcgcttggcttcatgaacgaggaccattggttctcccgcgagaactctctctccggggtggagggtgaggggctgcacaagttaggctacatcctccgtgatatcagcaagatccccgggggcaatatgtacgccgacgacaccgccggatgggacacgcgcatcaccgaagacgatttgcagaacgaggcccgcatcaccgacatcatggagccggagcacgccctgctagcgaagtccatcttcaagctgacataccaaaacaaagtggttcgggtccaacgccccgccaagaatggtaccgtgatggacgtaatctctcggcgcgaccagcgggggagcggacaggtgggtacttacggcttaaacaccttcacgaacatggaagcccagctcatacgccagatggaaagcgaggggatcttctccccgagcgagctcgagacccccaacctggccgagcgtgtgctagattggctggagaaatacggcgtagagcgcctgaagcggatggccatctccggggacgactgcgtcgtgaagccgatagacgaccggttcgcgacagccctcaccgccctgaacgatatgggcaaggtgcgaaaagacatcccccagtgggagcccagtaaggggtggaacgactggcagcaggtccccttctgttcccatcacttccaccagctaatcatgaaggacggccgcgagatcgtggtgccgtgccggaaccaggacgagctcgtcggccgcgcccgggtcagtcagggcgccggctggagcctgcgcgagaccgcgtgtctgggaaagtcttatgcccagatgtggcagctcatgtattttcaccggcgcgacctgcggctggctgcgaacgctatctgctctgccgtgcccgtcgattggatccctacctcccgcacaacctggtctatccatgcccaccatcagtggatgaccaccgaggacatgctctccgtttggaatcgagtgtggatcgaggagaacccctggatggaagacaaaacacatattagctcctggggcgacgtcccgtacttaggcaagcgggaggaccagtggtgtggcagcctgatcggcctgaccgcgcgcgcgacctgggcaaccaacatccaggtggccatcaaccaggtccggaggctgatcgggaacgagaattacctagattacatgacctccatgaagcggtttaagaatgagagcgaccccgaaggggccttgtggtag

SEQ ID NO: 24446 - RNA, 9879 nt, synthetic construct
  misc_feature 1..9879: note = derived and/or modified CDS sequence (opt11) from DENV-1__GU131734__SS-prME
  source 1..9879: mol_type = other RNA
agcgtcacaatgctcctaatgttaatgcctacagcgttggcattccaccttacaacgcgcggtggcgaaccccatatgatcgtctccaaacaagaaaggggaaagagcttgctgttcaaaacatcagcaggcgttaacatgtgcacactaatcgcaatggatttaggggagttctgcgaagacacaatgacgtacaaatgcccgcgaatcaccgaagcggaacccgacgacgtggactgctggtgtaacgccaccgacacctgggtcacctacggcacgtgctcacaaacaggcgaacaccgccgagacaaacggagcgttgcattggcaccgcacgtcggcctaggcctagaaacacgcacggaaacctggatgtcaagtgaaggagcgtggaaacaaatccagcgggtagagacatgggctctgagacaccccggattcacagtgatcgcgctgttcctagcgcatgcaatcggcacaagtataacacaaaaagggatcattttcatcttgctcatgttagtaacaccgagcatggccatgagatgcgtggggatcgggagcagggatttcgtggaagggctgagcggtgcaacatgggtagacgtcgttctggagcacggaagctgtgtaacaactatggccaaagacaagccaaccttggatatcgaacttctcaaaacagaagtgacggaccctgctgtgttgcgcaaactctgcatagaggcgaaaatcagcaatacaacaacggactcaagatgccccacgcagggagaagcgaccctagtggaagaacaagacgcaaactttgtatgccgacgaaccttcgtagaccggggatggggtaacggatgcggactattcggaaaaggatccttgatgacgtgcgccaaattcaaatgcgtcactaaactagaagggaaaatagtccagtacgaaaacctgaaatactcagtcatagtaacagtacataccggcgaccaacatcaagtaggaaacgaaagcacagagcacggaacgacggctacaatcacgccacaagcaccgagtacagagatacaactaacagactatggggcattgacgcttgactgctcaccgcgaacaggcttagatttcaacgaaatggtactactgaccatgaaagagaaaagctggttagtccataagcaatggttcctagacctgcccctaccatggacatccggcgccagcacgagccaagaaacgtggaatagaaaggacctcctcgtgacgttcaagacagcgcacgcgaaaaagcaggaggtggtggttctaggcagtcaggaaggcgctatgcacaccgccttaacaggggcaacggaaatacaaacttctggcacaacgaccatattcgctggccatcttaagtgccgactcaagatggacaaactcaccctcaaaggtatgtcatacgtaatgtgtacggattcattcaagctcgaaaaagaagtagcggaaacgcagcacggaacggtgctggtgcaaatcaaatatgaaggcaccgacgcgccgtgcaaaattccattcagcacccaggacgagaaaggggtcacgcaaaacggaagactcattacggccaacccaatagtcactgacaaagagaaaccagtgaacattgaagcggaaccgccatttggcgaaagttacatagtcatcggagcaggcgagaaagccttgaaactctcatggttcaagaaaggatcaagtataggaaaaatgttcgaagcgacagcacgcggagcgcgacggatggcaatactaggagacaccgcgtgggactttggcagcatcggaggagtcttcaccagcgtaggcaagctagtccaccagatattcggaacagcgtacggagtgctcttttccggagtttcctggaccatgaagatcggaatcggcgtgctactaacctggctgggcctcaactcccggagcacctcactgagcatgacatgcatcgcagtcggtctcgtgaccctttacctgggcgtcatggtccaagctgattcaggatgcgtcatcaattggaagggcagggagctgaaatgcgggagcgggatattcgtaacaaacgaagtgcatacctggaccgaacagtacaaatttcaagcagacagcccaaagcgactcagcgccgcaatcgggaaagcatgggaagaaggcgtctgcggcatccgatcagccacaaggcttgaaaacatcatgtggaaacagatctcaaacgaacttaaccacatcttgctggaaaacgacatgaaattcaccgtggttgtcggtgacgttgcagggatactcgcacagggcaagaagatgatacgcccgcagcccatggaatataaatacagctggaaatcttggggtaaagcaaaaattatcggagctgacgtacaaaacaccactttcataatcgatgggccaaacacaccagaatgtcccgatgaccaacgcgcgtggaacatatgggaggtggaggattacggattcgggatatttacaaccaacatatggctaaaactgagagactcgtacacacaagtatgcgaccatagactcatgtctgcggctatcaaggactcaaaggcagtacatgcagacatgggatactggatagaatccgagaagaatgagacgtggaaactcgcgcgcgctagtttcatcgaagtaaagacatgcatatggccaaagagccatacactctggagcaacggggtcctggagtcggagatgataatcccgaagatctacggcggccccataagccaacataattacaggcccggctatttcacccagactgcgggtccatggcaccttggcaagctggaattagacttcgacctctgcgaaggcaccacagtcgtcgtcgacgagcattgcggaaaccgcgggccctctctacggactaccacggtgacaggtaaaatcattcacgagtggtgttgccgttcctgcactctgccaccgctacgcttcaaaggggaagacgggtgttggtacggcatggagatcaggccagtgaaggagaaggaagagaacctagtgaagagtatggtgtccgcagggagcggtgaagtagacagcttctccctgggactactatgtatctcgattatgatcgaagaggtcatgcgaagccgatggtcacgcaaaatgttaatgacaggaaccctggccgttttcttcctactcatcatgggacagctcacatggaacgacctcatcagactatgcatcatggtcggagccaacgcttcagatcgtatgggcatgggcaccacctacctcgcactaatggcaacattcaagatgcggcccatgtttgcggtcggactgctgttcagaagactaacatctagggaggtactgctacttacaataggactgtcactcgtagcaagcgtcgaactccctaactcgctagaagaactaggggatgggctcgccatgggcataatgatcctaaaattgctgatagacttccagagtcaccaattatgggcgacactcctctctctgacgtttatcaaaaccaccttctccctgcactacgcatggaagacaatggccatggtgcttagcatcgtaagtttgtttccattatgcctgtcgacaaccagccagaagacaacatggctgccagtcctcctcgggagcttgggctgcaagcccctgaccatgtttctcatagcagaaaataagatttgggggcgaaaatcgtggcccctcaatgagggcataatggcagttggcattgttagcatattgttatctgcactactcaagaacgacgtccccctagccggcccccttattgccggagggatgctcatagcctgctacgtaatatccggatcaagcgcagacctgagcctagaaaaggcagcggaagtatcctgggaagaagaggcggaacatagcggggcgagccacaacatcctagtagaagtacaggatgacgggaccatgaaaatcaaagacgaggaacgcgacgacaccctaacgatactactcaaagcaacactgttggctgtttctggcgtttaccccctctcaatccccgcaacccttttcgtctggtacttctggcagaagaagaaacagagatcgggggtactatgggatacgcccagtccaccggaggtcgagcgggctgtgcttgatgacggcatatatcgaataatgcaaagaggactgttgggacggagccaagtaggtgtgggagtcttccaggaaaacgtctttcacacgatgtggcacgtgacacgcggagcggtcctgatgtaccaagggaaaagactggagccctcctgggcctccgtcaagaaagacctaatatcgtacggcggcgggtggaggctacaaggctcgtggaataccggcgaagaagtccaagtgatagcagttgagccgggcaaaaaccccaagaacgtgcagaccgctcctggaacattcaagacgtcagagggggaggtaggcgccatagcactggacttcaaaccgggcaccagcggttcgccgattgtaaaccgggaaggaaaaatcgtcggtctttacggcaacggggttgtcacgacatccggaacatacgtgagcgcgatcgcgcaagccaaggcttcccaagaagggccgctaccagaaatcgaagatgaggtgttcagaaaacgaaacctcaccatcatggacctccatcccggctcggggaaaacaaggagatacctgccggcaatagtacgagaggcaattaaacgaaagctccggaccctcatcttagctccaacccgcgtcgtcgccagtgaaatggccgaggcactaaagggaatgcccatacgctaccagaccacggcagttaaaagcgaacacacgggaaaggaaattgtagaccttatgtgccacgcaacatttacgatgagactacttagccccgtaagggtccccaattacaacatgatcataatggacgaggctcatttcacggatccgtcgagcatcgccgcaagaggttacatatccacgagagttggcatgggggaagcggcggctatctttatgacagcgacacctccagggtccgtggaggcgttcccccaatccaacgccgtcatacaggacgaggaacgggatattcccgaaagatcctggaacagcggctacgaatggatcacagatttcccgggaaaaacggtctggttcgtgccgtccataaaatccggaaacgatatcgcgaactgcctccgtaaaaacgggaagagagtaatccaactttcgcgaaagacgttcgacacagagtaccagaaaaccaagaacaacgattgggactacgtcgtcacaacggacatctctgaaatgggtgcgaacttccgagcggaccgggtcatcgatccgcgcagatgcctgaaacctgtaatattgaaggacggcccggagagggtaatcctagccggcccaatgcccgtcacggttgcgtcggcagcgcagaggcgaggcagaatcggccgaaatcataacaaagaaggcgaccagtacatatacatgggccaaccacttaataacgacgaagaccatgcgcactggactgaggcaaagatgctgttagacaacattaacactcccgaaggcataataccagcgctgttcgagcccgaacgtgagaaaagcgccgcaatcgatggtgagtaccgcttaaggggagaggcgagaaaaaccttcgtcgagctaatgcgacggggtgatctaccggtatggctatcatacaaagttgcgtcagaggggtttcagtactcggaccgaaggtggtgcttcgatggagaacgcaataatcaagtgctggaagaaaacatggatgtggagatatggacgaaggaaggagaacgcaagaaactgcgaccccgatggctggacgcccggacgtacagtgaccccttggcattacgagagttcaaggaatttgcagcgggtcggaggtcggtctccggcgacttgatacttgaaataggaaaactaccccaacacttaacacagcgagcccaaaatgctctcgataaccttgtgatgctgcacaactccgagcagggcggcagagcatacagacacgccatggaggagctaccagacacaatcgaaaccctgatgctgttagccttaatcgccgtgctcacaggaggagtcactctctttttcctatcggggagagggctagggaaaacaagcatcggccttctgtgcgtcatggcatccagtgtgctactatggatggcctccgtcgagccgcactggatagctgcctccattatcctcgagttcttcctaatggtgctactaatacctgaacctgatcggcaacggacaccacaggataaccaactagcctatgtagtgatcgggctactatttatgatactaactgtagccgctaatgaaatgggactactagaaacaaccaaaaaggatctagggatcggccacgtagcagtcgaaaaccaccaccacgccgcgatgctcgacgtcgacctacacccagcgtcggcctggacactctacgcggtagcgacaaccattattacaccgatgatgcgccataccatcgagaatacaacggcaaacatatcgctaacagctatcgcgaaccaggccgcaatccttatgggcttagacaagggctggccaatttcaaagatggacatcggagtaccgctacttgcgctgggctgttactcacaagtgaacccactaaccctcacagcggcagtcttaatgctagtagcccactacgcaatcattggaccggggctgcaagcaaaagcgacacgagaagcccagaagagaacggcagccgggattatgaaaaatccgacggtcgatggaattgttgcaatagacctcgatccggttgtatacgacgccaaattcgagaaacaactcgggcaaataatgctgctaatcttatgtaccagccagatcttgctgatgcgcaccacgtgggccctatgtgagtcgatcaccctagcaaccggccccctcactaccctgtgggaagggagcccgggaaaattctggaataccaccattgccgttagcatggccaatatctttaggggctcatatctcgccggagcgggcctcgcgttcagcctgatgaaaagcctaggcggagggaggcggggtacaggagcacaaggcgagacactgggggaaaagtggaaaagacagctaaaccaactatcaaaaagcgagttcaacacctacaagcgaagcgggataatggaagtcgacaggtccgaagcgaaagagggtttaaaacggggcgaaacaacgaaacacgccgtctcccgcggaaccgcaaaactacgctggtttgtggaacgaaacctcgtcaagccagaaggtaaagtcattgatctaggctgtggacgagggggatggtcctattactgcgccgggctgaaaaaggtaacagaggtcaaaggctatacgaaaggaggcccaggccacgaagaaccaatccctatggccacatacggctggaacctagtgaaactacacagtgggaaagacgtattcttcataccacccgagaagtgtgacacgctcctctgcgatatcggcgaatcaagtccaaaccccaccatcgaagaagggaggactcttcgggtcctaaaaatggttgaaccgtggctaagaggtaaccagttctgcatcaaaatcctgaatccgtacatgccgagcgttgttgaaacccttgagcagatgcaacgcaaacacggaggaatgctggtgcggaaccccttgtcgcggaactcaacccacgaaatgtactgggtttcatgcggcacaggaaatatcgtctccgccgttaacatgacatcgagaatgttgctcaaccgcttcacaatggcccacagaaaaccaacatacgagagggacgtagacttaggcgcagggacaagacatgtcgccgttgagcctgaggtggcaaacctagacatcataggacaacggatcgagaatataaagcacgaacacaaaagtacgtggcattacgatgaagataacccgtataaaacgtgggcgtaccacggatcatatgaggtgaaaccgagtggaagtgccagcagcatggtcaacggcgtggtgaaattactaaccaaaccttgggacgttatacccatggtaacccaaatcgcaatgacagatacaaccccattcggccagcagcgcgtcttcaaagagaaggtcgacaccagaacacccaaggccaagcgcgggacggcccagatcatggaagtaacagccaaatggctgtggggcttcctctctcgaaataagaaaccacggatatgcactagggaagagttcacccgaaaagtaaggagtaacgcggccattggcgcagtgttcgtggacgaaaaccaatggaacagcgcaaaagaagcagtcgaagacgaacgattctgggatttagtccacagggaaagagaactgcacaaacaaggtaagtgcgcgacgtgtgtatataacatgatgggaaaaagggaaaagaaactaggggagttcggcaaagccaaaggctcacgggcaatctggtatatgtggctcggagcccgcttcctggagttcgaggccctcggattcatgaacgaagaccactggttctcgcgtgaaaacagtctatcaggcgtcgaaggggaagggcttcacaaattaggttatatactgagggacatctcaaaaatccccggcgggaacatgtacgccgacgacacggcgggctgggacacccgcataaccgaagacgacctgcaaaacgaagcgaaaataaccgacatcatggagccagagcacgcgctactggcgaaaagcatcttcaaactaacttaccaaaataaagttgtccgcgtacaacgccctgccaaaaacggaactgtaatggatgtcatctcgcgacgagaccaacgcggctcgggccaggtcggaacatacggcttaaatactttcacgaacatggaggcacaactcatacgacagatggaatcggaaggaatcttcagcccgagcgaactcgaaacacctaatctcgcaggtagagtattagattggcttgagaagcacggagtagagagactgaagagaatggccataagtggagacgattgcgtagttaaacccatcgacgaccgattcgccgcggccctcacagcgctcaatgacatgggaaaagtccgaaaagatataccgcaatgggaaccatcaaagggctggaacgactggcaacaagtaccattctgcagccaccactttcaccagctgatcatgaaggacggaagagagatagtagtcccctgtcggaaccaagacgagttagtcgggagggctcgggtcagccaaggggccggatggtccctgcgggaaacagcatgtttaggcaaaagttacgcccagatgtggcaacttatgtatttccacagacgcgacctccggctagcagcaaacgccatatgctctgcagtaccggtagactgggtcccaacgagccgaacaacctggtctatacatgcgcatcatcaatggatgaccacagaggacatgctctcagtctggaatcgggtctggattgaagaaaacccgtggatggaggacaaaactcatatctcaagctggggcgatgtcccgtatctgggcaaaagagaggatcaatggtgcggaagcctgatcggactaaccgcccgagccacatgggctacaaacatccaagtagcgatcaaccaagtgaggcgactaataggcaacgaaaactacctggactatatgacctccatgaaaaggtttaaaaacgaaagcgatccggaaggagcactgtggtag

SEQ ID NO: 24447 - RNA, 9879 nt, synthetic construct
  misc_feature 1..9879: note = derived and/or modified CDS sequence (opt11) from DENV-1__GU131738__SS-prME
  source 1..9879: mol_type = other RNA
agcgtcaccatgttgctcatgctcatgcccacggccttggcattccatttgactacacggggaggagaaccgcacatgatcgtgacaaaacaggagcgggggaaatccctactgtttaaaacgtcggctggagtaaacatgtgcaccctaatagccatggaccttggcgaactctgtgaagatactatgacctacaaatgcccaaggattacggaggccgagcccgacgacgttgactgctggtgcaacgccacagacacgtgggtcacatacggaacatgctcacagacgggagagcaccgacgcgacaaacggagcgtagctctggccccacacgtaggccttggattagaaacacggacggaaacatggatgagcagcgaaggagcgtggaaacaaatccaaagggtggagacttgggcgctacgccaccctggcttcactgtaatagccctgtttttggcgcacgcgatcggaacgagcataacgcagaaagggatcatcttcatcttattgatgctagtcacccccagcatggccatgaggtgtgtcgggataggatcaagagattttgttgaaggcctcagcggagcaacgtgggtggacgtggtcctcgagcacggcagttgcgtaaccaccatggcaaaagataaaccgacactagacattgagctgctaaaaacggaagtgacaaacccggccgtcctacgcaaactgtgcattgaggcgaaaatttccaacacgacgaccgactccagatgccccacacaaggagaggccacactaatggaagaacaggacgcgaattttgtgtgcagacggacattcgtagaccgcgggtggggcaacggctgtggccttttcggaaaaggctccctaattacctgcgccaaattcaaatgtgtgacaaaactggagggtaaaatagtgcaatatgagaacctgaaatacagcgtcatagttaccgtccataccggcgaccaacatcaggtagggaacgaaagcaccgagcacggcacgactgccacgatcacaccacaagccccaacgtcagaaatacagctcaccgattacggagcactaaccctggattgtagtccacgaacggggttagactttaacgaaatggtcctactgacaatgaaagagaaaagttggctcgtacacaaacagtggtttttagacctcccgctaccctggacgtctggggcgtctacgagccaagagacatggaaccgccaagacctcttagtaacgttcaaaacagcgcacgctaaaaagcaggaggtcgtagtgttgggctcgcaagaaggagccatgcacacagccctaacgggcgcaacggaaatacaaacgtcaggtaccacaaccatcttcgctggacacctgaagtgcaggttaaagatggataaactaacgctaaaaggaatgagttatgtgatgtgtacaggttcgttcaaactagaaaaagaagtcgccgagacacaacacggtaccgtcctagtacagatcaagtatgagggaacggatgctccttgtaaaataccgttcagtactcaggacgaaaagggagtgatacagaacggacgcctcatcacggcaaacccgatagtaaccgacaaagagaaaccggtgaacatagaggcggaaccgccctttggcgaatcctacatagttataggcgcgggcgagaaagccctcaagctgtcttggttcaagaaaggctcctcgataggaaaaatgtttgaggcaactgcccgcggggcgagacgtatggcaatcttaggcgatacagcgtgggacttcggcagcgtaggaggcgtctttaccagcgtagggaaactcgttcaccaaatcttcggcaccgcctacggcgttctattctcaggcgtaagctggacaatgaagataggaataggagttttactcacctggttaggactgaactctagatcaacatctctatccatgacatgcatcgcggtgggactggtcacgctataccttggtgtgatggtgcaagcagacagcgggtgtgtaataaattggaaaggccgagaactcaaatgcggcagcggtatattcgtcaccaatgaagtccatacttggacggaacaatacaagttccaagccgacagcccgaaacgactgagtgctgcaatcggaaaggcatgggaagagggagtctgcgggataagatccgccacccgtcttgagaatatcatgtggaaacaaatctctaatgaacttaaccacatcttgctcgaaaacgatatgaagttcacagtagtggtgggggacgtggttgggatacttgctcagggcaagaaaatgatcaggccacaacctatggaacacaagtacagctggaaatcgtggggcaaagccaaaatcataggggcagatgttcaaaacaccacctttataattgacggaccgaacacgccggaatgtcctgatgatcaacgcgcctggaacatatgggaggtcgaagactatggtttcgggatctttacgacaaacatctggctcaaactcagagattcctatacacaagtatgcgaccacaggctgatgagtgcagccattaaagactccaaagcagtgcacgccgacatgggatactggatcgagtcagagaagaatgaaacatggaagttagcgagagcaagtttcatagaggtaaaaacatgcatttggccaaaaagccacaccctatggagcaacggcgtgttagagagtgaaatgatcatccccaagatctatggtggacccatcagccagcacaactaccgtcctggatacttcacacaaacggctgggccgtggcatctcgggaagctggagctagattttgacctatgtgaagggaccacagtggtggttgacgaacactgcgggaaccgcggaccatccctaagaacaactacagtcacgggaaagataatacacgagtggtgctgtagatcttgtacactaccaccgttacgcttcaaaggggaagacgggtgctggtatggtatggaaatacgcccggtcaaggaaaaggaggagaacctcgtcaaaagcatggtctcagccgggtcgggagaagtcgacagcttctcactagggctgttgtgcatatcaataatgatcgaggaagtcatgcggtccagatggagccgtaaaatgctgatgaccgggacactcgcagtctttcttttacttatcatggggcagcttacctggaacgacctaatacgattatgtattatggttggggcaaacgccagcgaccgcatgggaatggggacgacatacttagcactgatggccacgttcaaaatgagaccgatgttcgccgtagggctactgttcagaagactgacgagcagggaagtcctactacttacgattggactaagtctagtagccagtgtagaactgccaaactcgctagaggagctcggagatggcctagcaatgggaataatgatactaaaattgttaacggacttccagagtcaccaactatgggctacactactgagcctaacgtttataaaaacaactctaagcctacactacgcatggaaaacaatggcaatggtgctcagcatcgtaagcctgtttcccctatgtctttccacgacaagccagaagaccacgtggctcccggtcctgctcggcagcctggggtgcaaaccgctcacgatgttcctaataactgagaacaaaatctggggaaggaaaagttggcccctgaacgagggcataatggcagtgggcgtcgtgagcatactgttgagcagcttgctcaaaaatgatgtacccctagcaggcccgttaatagcgggaggcatgctcatcgcttgttatgtaatcagcgggtccagcgccgacttgagtcttgaaaaggcagctgaagtaagctgggaagaggaggccgagcactccggcgcgagccataacatcttagtcgaagtccaggacgacggtacaatgaagattaaagacgaagagagggacgacaccttaaccatacttctcaaagccacgttacttgcggtaagcggcgtctatccactatcaatcccagctacgctattcgtatggtacttctggcaaaagaagaagcaacgctcaggtgttctatgggacacaccatctccgccagaggtggaacgggcagttctcgacgacggtatataccgaatcatgcaacggggcctacttgggcgaagtcaagtcggtgttggcgtattccaagaaaacgtctttcatacaatgtggcacgtaactagaggggctgtattaatgtaccaggggaaaagactggagccaagctgggccagcgtcaagaaagacctaatcagctacggaggaggctggcggctgcaaggctcttggaacactggagaggaagtacaggtgatcgcagtggagcccggcaaaaacccaaagaacgtgcagacagcgcccggaacattcaagacaccggaaggagaagtaggggcgatagcgctggacttcaagccaggaacgagcgggagccccatagtgaatcgcgaaggcaagatagtgggcctatacggcaacggggtggtgacaacaagtggaacgtacgtaagtgcaattgcgcaagcaaaagcatcacaggagggacctctgcccgaaatagaagacgaagtgttccgaaagagaaacctaaccatcatggacctccatccgggtagcggaaaaacacgcaggtacttaccggctatagttagggaagcaataaaacggaagctaaggaccctaatcctagcacccacgcgcgtagtggcgagtgaaatggcggaggcgctgaagggaatgcctatccgctaccagacgacggcagtgaaatccgaacacacagggaaggaaatagtagacctaatgtgccatgcgacgttcaccatgcgactactcagccccgtcagagtacccaattacaatatgatcattatggatgaggcgcactttacagatccctcaagcatcgcagcacgaggctacatcagcacgcgagtcgggatgggggaagcggccgcaatcttcatgacagcaaccccaccaggaagcgtcgaagccttcccacaatcgaacgcagtaatccaagatgaggaacgagacatcccgggacgcagctggaacagtggttacgaatggataacggacttcccgggaaaaactgtctggttcgggccaaccataaagtccggaaacgacatcgcaaactgtctccgtaaaaacgggaaaagagtgatccaactatccaggaagaccttcgacacggaatatcagaagacgaaaaataatgactgggactacgtagggacaactgacataagcgaaatgggtgcgaacttccgagcagatcgagtcatagaccctcgccgatgtctaaagccagtgatccttaaggacggcccagaacgagtcatactagcagggccgatgcccgtaacagtcgcttccgcagcacagagacgaggccggatcggacgcaaccacaataaggagggagatcaatacatatatatggggcaacccttgaacaacgacgaggatcatgcgcactggacagaagccaagatgcttctagacaatattaacaccccggaaggaatcatccctgcactattcgaacccgagagagaaaagtcagccgccatagacggagagtatcgcctaagaggtgaggcaagaaaaacattcgtagagctaatgcgccgaggagatctccctgtgtggctatcatacaaagtagctagcgaaggcttccagtacagcgatcgaagatggtgctttgacggggaaagaaataaccaggtcttagaggaaaacatggacgttgaaatatggaccaaggaaggggagcgaaagaaactacggccgagatggctagacgcacgaacttactcagaccctctcgccctacgtgagttcaaggaatttgcggcgggacgacgcagcgtaagcggagatttgatactagaaattggaaagctaccgcagcacctaacacagcgtgctcaaaatgctttggataacctagtaatgctccataacagtgaacagggaggcagagcatacagacacgcaatggaggagctaccagatacaatagaaacactcatgttactcgccctgatcgcggtcctaacaggaggggtaacactcttcttcctaagtggtagaggcctaggtaagacgtctataggattgctctgtgtcatggcgagttcagtactcctgtggatggccagcgtagagccacactggattgccgcttcaataattctagagttctttctcatggtgctcctcattccagagccggacagacagcgaacacctcaagataaccaactagcatacgtagtcatcggcctgctatttatgatactgacggtagccgctaatgaaatgggcctcctcgaaaccaccaagaaagacctagggatcggtcacgtcgcagtcgagaatcaccaccacgccacaatgctggacgtcgacttgcacccggcatccgcgtggacattatatgcagtggcgaccaccataataacaccaatgatgagacacaccatagaaaacacaacagcaaatatcagcctaaccgcgatcgctaaccaggcggccatcctcatgggactggacaaagggtggcccataagcaaaatggacataggcgttccactgctggcattgggctgctacagccaggtcaatccgctaacgcttaccgccgcggttttgatgctagtggcgcattacgcaataataggccccggcctacaggccaaagcaaccagagaagcccaaaagaggaccgcagcgggaatcatgaagaacccgacagtagatggcatagtggctatcgacctagacccagtagtctacgacgcgaaattcgagaaacaactgggacaaatcatgttgctcatcctctgcacgtcccaaattctcttgatgcgaacaacctgggcgctctgtgaatctataacattggcgaccgggcccctaaccacgctctgggagggcagcccggggaaattctggaacaccacaatcgctgtctctatggccaacatattccgggggagctacctagcaggcgccggactagcgttcagtctaatgaagtctttgggcggcggacgaaggggcaccggcgcccaaggggagacactaggggaaaaatggaaacggcaactcaaccaactctcaaaatcggaatttaatatttataagcgaagcggcattatggaggtagacagaagcgaggcaaaggagggacttaaacgcggagagacgaccaggcacgccgtcagccgcggaacagctaagctcaggtggtttgtagaacgaaatttagtcaaacccgagggaaaagtaatagatctgggctgcggaagaggtggttggtcgtattactgcgcgggcctcaagaaagtgacagaggtcaaaggatacacgaagggcggaccaggccacgaagaacccatcccaatggccacatatggctggaacttggtcaaactgcatagtggaaaggacgtattcttcaccccacctgaaaaatgcgacacattgctatgcgacattggcgagtcatcaccaaacccaacaatagaagaaggacggactctccgtgtcttaaagatggtcgagccctggctcagaggaaaccaattctgcataaaaatcctcaatccatacatgccatctgtagtagaaacactggaacagatgcaacggaagcatggcgggatgctagttcgaaacccccttagtcgtaacagtacccacgaaatgtactgggtaagctgcgggacaggaaatatcgtgtcagccgtgaacatgacatcgagaatgttgttgaatcgattcaccatggcgcacagaaagcccacatacgagcgcgacgtagacctaggagcagggacccgtcacgtagccgttgagcccgaggtggcgaacctagacataataggccaacgaatagagaatataaaacatgagcacaagtcgacatggcactacgacgaagataatccgtataaaacatgggcgtaccacggcagctacgaagtcaagccgtcggggagcgcgagcagtatggtcaatggcgtggtgaagctactgactaaaccgtgggacgtcatcccaatggtcacacaaatcgccatgaccgataccactccatttggacagcaaagagtgttcaaggagaaagttgataccagaacgcctaaggcgaaaagggggacagcgcaaataatggaagtcacggcgcgatggctgtggggatttctcagccgtaataaaaagccaagaatttgcactcgagaggagtttacgaggaaggtaaggtccaacgctgcgataggagccgtgttcgtggacgagaaccaatggaacagcgccaaggaagcagtggaggacgaaagattctgggatctgggccagaaggaacgggagcttcataagcaaggcaaatgcgcgacgtgtgtgtataacatgatggggaagagagagaagaaactgggagagttcggtaaagccaagggaagcagggcgatatggtacatgtggctgggagcacgattcctcgagtttgaagccctcggcttcatgaacgaggaccactggtttagccgagagaacagcttatccggtgtagagggagaaggcctccataaactgggatatatactgagagacattagtaagattccaggcggcaacatgtacgcagacgacacagcgggatgggacacacgaataacagaggacgacctccagaatgaagcgaaaataacagacataatggagcccgaacacgcgctcctagcaacgtcaatattcaaactcacgtaccagaataaagtggtgcgagtccagaggcctgccaagaacggaactgtaatggacgtcatctcgcgccgagaccaaagaggaagtggacaagtagggacctacggcctgaacacattcaccaacatggaggcgcagttaatcaggcaaatggaatccgagggcatcttcttaccgtccgagctagaaacgcccaacttagcggaaagagtcctcgactggctagagaagtacggtgtcgaaagactcaagcggatggccatatcaggggatgattgtgtggtcaaacctatagacgaccggtttgccacggcactcacagccctgaatgacatgggtaaagttcggaaggacatcccacagtgggaaccctccaaagggtggaacgactggcaacaggtgccattctgctcgcaccacttccaccagctaataatgaaggatggtagagaaatcgtggtaccctgccggaaccaagacgaactggtgggaagggcgcgtgtaagccagggggcgggctggtccctcagagagaccgcctgcctcggaaagagctacgcacaaatgtggcaactaatgtatttccaccgccgcgatcttaggctagccgccaacgcaatttgcagtgcagtaccggtagactgggtcccgacatcgcgcacgacctggtcaatacatgcccatcaccagtggatgacaacagaagacatgttaagcgtatggaacagggtatggattgaagaaaatccctggatggaagacaaaacccacgtctccagttggggagacgtaccatacctcggaaagcgcgaagaccaatggtgcggtagcctgataggcctaacggcacgagcgacgtgggcgagtaacattcaagtagccataaaccaagtgagaagacttatcggaaacgaaaactacctagactacatgacgagtatgaaacgattcaaaaacgaaggggaccccgaaggtgctctgtggtga

SEQ ID NO: 24448 - RNA, 9879 nt, synthetic construct
  misc_feature 1..9879: note = derived and/or modified CDS sequence (opt11) from DENV-1__JF937604__SS-prME
  source 1..9879: mol_type = other RNA
agcgtgaccatgctgctcatgctgatgcccactgccttagcctttcacctcaccacccggggcggggagccccatatgatcgtatccaagcaagaacggggcaaatccctgttgttcaaaacctcagctggggtgaatatgtgcacgctcatcgccatggacctgggcgagctgtgtgaggacaccatgacttacaagtgcccccgtatcactgagaccgagcccgatgacgttgactgctggtgcaacgccacggacacttgggtcacctacggcacctgtagtcagacgggcgagcaccggagggataagcggtcagtcgccctggcgccgcacgtgggcttaggcctggagacccgcaccgagacctggatgagctccgagggagcctggaagcagattcaacgggtcgagacgtgggccctgcgccaccccgggttcaccgtgatcgccttattcctggcccacgcgattggcacgtcaatcacccagaaggggattatcttcatcttactgatgctggtgacgccctccatggccatgcggtgtgtcgggatcggctctcgcgactttgtggaaggcctgagtggcgcgacctgggtggatgtagtgctcgagcacgggagctgcgtgaccaccatggccaaggacaagcccacgctcgatatcgagctcctgaagaccgaagtcaccaatcccgcagtgctgcgaaagctctgcatcgaggcgaagatctccaacaccacaacagacagccgctgtccgacccagggcgaggccactctagtcgaggagcaggacgctaacttcgtctgccggcgcacgtttgtcgatcggggctggggtaacgggtgcgggctattcggcaagggatctctcataacgtgcgctaagtttaaatgcgttacaaagctggagggtaaaatcgtccaatacgaaaacctgaagtacagcgtgattgtgaccgttcacacgggcgaccaacaccaggtggggaacgagtccaccgagcatggcaccaccgccacgatcacgccccaggccccaacgaccgagatccagctcaccgactacggggccctaacgcttgactgctctccccggaccggactagatttcaacgagatggtcctgctgaccatgaaagagaagtcctggctcgtgcataagcagtggttcctggacctgccgctaccctggaccagcggtgcttcgacgtcccaggagacctggaaccggcaggacctgctggtgaccttcaaaaccgcccacgccaaaaagcaggaggtagtggtcctcggcagccaggaaggtgcgatgcacacggccttaaccggggcaacagagattcaaacctccggcacgaccaccatcttcgccgggcacctgaagtgcagactcaaaatggataaactgaccctaaaaggcatgagctacgtgatgtgtacggggtcctttaagctagagaaagaagtggctgagacccagcacggaaccgtgttagtgcagatcaagtacgagggtacagatgctccctgtaagatccccttcagcacgcaagatgagaagggtgtgacgcagaacggtcggctcatcaccgctaatccgatagtcacggacaaagagaagcccgtgaacattgaagccgagccgcccttcggtgaatcatacatcgtgatcggcgccggcgagaaggccctgaagttgagctggttcaagaaggggtcctcgatcggcaagatgttcgaggctacggcccgcggggcccgtcgcatggccatccttggcgatacggcatgggacttcgggtccataggcggcgtgttcaccagcgtggggaaactggtgcaccagactttcggcacggcctacggagtcctgttctccggtgtgtcctggaccatgaagattggcatcggggtgctgctgacgtggctcggactaaattcccgctccacctccctgagcatgacatgcatagcagttggcctcgtcaccctgtacctgggtgtgatggtccaggccgactccgggtgtgtcataaactggaaaggccgggagctgaagtgcgggagcggcatcttcgtgaccaacgaagtgcatacctggacggagcagtacaagttccaggctgacagcccgaagcgcctttccgccgccatcgggaaggcatgggaggagggcgtctgcggcatccgaagcgccacgcgcctcgaaaacatcatgtggaagcagatctccaacgagctcaaccacatcctgctggaaaacgacatgaagtttacggtcgtggtcggggacgttgccggcattttagcgcaggggaagaaaatgatacgcccccagcccatggaatacaagtacagctggaagtcctggggtaaggctaagatcattggcgcggatgtgcaaaacaccaccttcataatagacggtcccaacacgccggaatgccccgacgaccagcgcgcctggaacatatgggaggtcgaggactacggcttcgggatcttcaccaccaacatctggttaaagctccgagatagctatacccaggtctgcgaccatcgcctcatgtccgcggctatcaaagacagcaaggcagtacatgcggacatgggctactggatcgagtccgagaagaacgagacgtggaagttagcccgggcgtcattcatcgaggtcaagacatgcatctggccaaagtcccacaccctgtggagcaacggcgtcctcgaatccgaaatgatcatccccaagatctacgggggccctatctcacaacacaactatcgccccgggtacttcacacaaaccgccggcccttggcacctggggaagctggagcttgacttcgacctgtgtgagggcacaacggttgtggtagatgagcactgtggcaatagggggccgtccctgcgcaccacgaccgtgaccggtaaaataatccacgagtggtgctgccgaagctgcaccctgccgcccctccgtttcagaggggaagatggctgctggtacgggatggaaatccgccccgtcaaagagaaggaagagaacctggtgaagtccatggtctcggctggtagcggggaagtggactccttctctcttgggcttctgtgcatctccattatgatcgaagaggtgatgcggagccgctggtcaagaaagatgctcatgactggcacactggctgtcttcttcctcctcatcatggggcagctgacctggaatgatctgatccgcctctgcatcatggtcggcgctaacgcgagcgatcgcatggggatgggaactacgtacctggcactgatggccacgttcaaaatgcggccgatgttcgccgtaggattattgttccgccgcctaacgtctcgcgaggtcctcctgctgaccatcggactcagcctggtggcatccgtggagctgcccaatagcctcgaggaattgggagacgggctggcgatgggaatcatgatactgaagctcctgacggacttccagtcctatcagctctgggctacactgctgagcctcacattcattaagaccactttcagtttgcactacgcctggaagacgatggccatggtcctgagcatcgtgtccctcttccccctgtgcctgtctaccacctcccagaaaacgacgtggctccccgtgctgctgggcagcctcggatgtaagccgctgaccatgttcctgatcgcggaaaacaagatctgggggcggcgatcctggcccttgaacgagggtattatggccgtcggcattgtgagcatactgctgagctccctcctgaagaatgatgtgcccctggccggacccctcatagcgggcggtatgctcattgcctgctatgtcatcagcgggtccagcgcggatttatccttggagaaggccgccgaggttagctgggaagaggaggcagagcatagcggcgccagccataacatcttggtggaggtccaggacgatgggacgatgaaaatcaaagatgaggaacgggacgacacccttacgatcctcctgaaggctacactgctggccgtgtccggggtgtacccgctaagcatcccggctacactgttcgtgtggtacttttggcagaagaagaagcagcgctccggggtgctctgggatacgccctcaccgcccgaagtggagcgggcggttctggacgatggtatctaccgcatcatgcagcggggactgctggggcgctctcaggtgggcgtcggggtcttccaggagaacgtttttcatacgatgtggcacgtgacacggggcgccgtcctcatgtaccaagggaagcgactggaacccagctgggcgtccgtcaagaaagatctgatcagctacggcggcgggtggcggctccaagggttctggaacacgggggaggaggttcaggtgatcgccgtagagcccgggaaaaaccccaagaacgtgcagaccgcccccggaacgttcaagacccccgagggcgaagtcggagccatagccctggattttaaacccggtacctccggctcacccattgtcaaccgtgaaggcaaaattgtaggcctctatggcaacggggtcgtgaccacatccggcacatacgtgagcgcgatcgcccaggcgaaggcaagccaggaggggccgttacccgagatcgaggatgaggtcttccggaagagaaacctgactatcatggacttgcatcccggaagtggcaagacccggcgctacctcccggcaattgtccgcgaagccataaagcgcaagctgcggacgctgattctcgcccccacacgggtggtggccagcgagatggccgaagcgctaaagggcatgccaattcgctatcagaccaccgccgttaagtccgagcatacggggaaggagatcgtggacctaatgtgccacgcgacgtttacaatgcggctcttgagccccgtccgcgtgccgaactacaatatgatcatcatggacgaggcgcacttcaccgaccccagtagcatcgcggcgagggggtatatctctacgagggtgggcatgggcgaggcagccgctatctttatgaccgccaccccgcctggcagcgtcgaggcgtttccccagagtaacgccgtgattcaggatgaggagcgggacatacctgagcgaagctggaacagtggttacgagtggatcaccgacttcccaggcaaaacggtgtggtttgttcccagcatcaagtcaggcaatgacatagccaactgcctgcggaagaacgggaagcgcgtcatccagctcagccgaaagaccttcgataccgagtatcagaagaccaagaacaatgactgggactatgtggtcacgaccgatatcagcgagatgggagcaaatttccgggcggaccgggtaatagacccacgacgttgcctgaagcccgtgatactgaaggacggccccgagagagttatattggcgggcccaatgccggtcaccgtcgcgagcgccgcccaacggcgagggcgaatcgggcgcaaccataacaaggaaggcgaccagtacatttacatggggcagcccctaaacaacgacgaggatcacgcccactggacggaggccaagatgcttctcgacaacatcaacacgcccgagggcataatccccgccctgttcgaacccgagcgcgagaagtccgccgccatcgacggggagtaccggcttcgcggtgaggctcggaagacatttgtggagctcatgcgccgcggggacctgcccgtttggctgagctacaaggtcgctagtgagggctttcagtacagcgaccgccggtggtgctttgatggtgaaaggaacaaccaagtcctcgaagagaatatggacgtggagatttggacaaaagagggggaacggaaaaagctgcgcccccggtggttggacgcacggacctatgcagacccgctcgcgttacgggagttcaaagagttcgcagccggacgccggagcgtcagtggggacctgatcctcgagatcggtaagctgccgcaacaccttacgcaacgcgcccagaacgccttggacaacctggttatgctgcataacagcgagcaaggcgggcgagcgtaccgccatgccatggaggagctgcccgacaccatcgagacactgatgctgctcgccctgatcgccgtgctgaccggcggggtcaccctcttctttctgtccggccggggacttggcaaaacgtcgatcggcctcctgtgcgtgatggcctccagcgtgctcctctggatggcgtccgtcgagcctcactggattgccgccagcatcatactggagttcttcctgatggtgttattaatccctgagccggaccgccagcgcacaccccaggataaccagctggcctacgtggtcatcgggctgctgttcatgattctgacggtagccgcgaacgaaatgggccttctggagaccacgaagaaggatttggggatcggacacgtagctgtcgagaaccaccaccacgccgcgatgctcgacgtggacctgcaccccgcctccgcatggacactatacgccgtggcaaccaccatcatcacgccgatgatgcgccacaccattgagaacaccaccgccaacatttccctcacggccatcgcgaaccaggccgcaattctaatggggctagacaagggatggcccatctccaaaatggatatcggggtaccgctcctggcccttgggtgctacagtcaggtgaacccgctcaccttaactgcggccgtgcttatgctcgtcgcccactacgccatcatagggccgggactgcaggccaaggcgacccgtgaggcgcagaagaggacggctgctggcatcatgaaaaaccccacagtggacgggattgtggctatcgacctggacccggtcgtatatgacgcaaaattcgagaagcagctaggtcaaatcatgttgctgatattgtgcacctcccagatcctactgatgcgcaccacgtgggccttatgcgagtccatcacattggcaactgggcccctgaccacgttgtgggaagggagccctggaaagttctggaacaccaccatcgcagtaagcatggctaatatcttccgggggtcctacctggcgggagccggcctggccttcagcttaatgaagtccctcgggggagggcgccgggggactggtgcccagggtgagaccctgggtgagaagtggaagagacagctcaaccagctaagcaagtctgaatttaatacttacaaaaagtccgggatcatggaggtcgacagaagcgaggccaaagaaggactaaagcgcggcgaaaccacgaagcacgccgtgtcccggggaacggcaaagctccgctggttcgtggagaggaaccttgtcaagcccgagggcaaggttatagaccttggctgcggccgcgggggctggtcttactactgcgccgggctgaaaaaggtgaccgaggtcaaggggtacaccaagggcggccccggccacgaggagcccatccctatggctacctacgggtggaacctcgtgaagctgcactccggcaaggacgttttcttcataccccctgagaaatgcgatacattactgtgcgacatcggggagagctccccgaacccgactatcgaggagggaagaaccctgcgcgtcctgaaaatggtggagccatggctccgggggaaccagttctgcatcaagatcctgaacccctacatgcccagcgtggtagaaaccctggagcagatgcaacgcaagcacggcggcatgctcgtgcggaacccgttatcccggaacagcacccatgagatgtactgggtatcctgcgggacgggcaacatcgttagcgcagtgaacatgacctcccggatgctgctgaatcgcttcacgatggctcacagaaaacccacctacgagcgggacgtagacctgggggccggtacgcgccacgtcgccgttgaaccagaggtggccaacctagacatcattggccagaggatcgagaacattaagcacgagcacaagagcacgtggcactatgacgaggacaacccgtacaagacctgggcttatcacggctcctacgaagtcaagccgagtggctccgcgtcatccatggtgaacggggtcgtgaagctcctgacaaagccctgggacgtgatccccatggtcacgcagatcgccatgaccgacacaaccccattcggccagcagcgcgtttttaaggagaaagtagacacgcggaccccgaaggccaagcaggggaccgcgcaaatcatggaggtcaccgctaagtggctgtggggcttcctgagccgcaacaagaaaccccgcatctgcactcgggaggagttcacccgcaaggtgaggtctaacgccgcaataggtgctgtctttgttgacgagaaccaatggaactccgccaaggaggccgtggaggacgagcgcttctgggacctggttcaccgcgagcgcgagttgcacaagcaagggaagtgcgctacctgtgtctacaacatgatgggcaaacgcgaaaagaaactcggggagtttggtaaggccaaggggagccgggccatctggtatatgtggctgggggcacgcttcctggagttcgaggccctcggcttcatgaacgaggaccactggttctctcgggagaacagcctgtccggcgtggagggcgaagggctgcacaaactaggctacatcctgcgagacatcagccagatcccgggtggcaatatgtacgccgacgacaccgctggatgggacacgcggatcacagaggacgaccttcaaaatgaggcccgtatcacggacatcatggagccagagcacgctctcctggccaagtccatcttcaaactgacctatcagaataaggtggtccgggtgcagcgccctgccaagaacgggacggtgatggacgtaatcagcaggcgggaccagaggggctcgggtcaggtgggcacctacggcctgaacaccttcacaaacatggaagctcagctgattcggcagatggagagcgaggggatcttctccccaagcgagctggaaacgccaaaccttgccgagagagtgctggattggctggagaagtacggcgtagagcgtctcaagaggatggcgatttccggggacgactgcgtggtcaagccaatcgacgatagattcgccacagccctgaccgccctgaacgacatgggcaaggtcaggaaggacatcccccagtgggagcctagcaagggttggaacgactggcagcaggtcccgttctgctcccaccacttccaccaactcatcatgaaggacggcagagagatcgtggtcccgtgccgaaaccaggacgagctggtaggccgggcccgggttagccagggagcgggctggtccctgcgtgagaccgcctgcctaggaaagagctatgcccagatgtggcagctgatgtactttcaccgccgtgacctgcgtctcgccgcgaacgccatctgcagcgccgttccagtagactggatccccacgtcccggaccacctggtcaatacacgcccatcaccaatggatgaccaccgaggacatgctgtccgtgtggaatcgcgtatggatagaggaaaacccgtggatggaggacaagacccatatcagctcctggggcgacgtaccttacctggggaagcgggaggatcagtggtgcgggagcctcatcggcctaaccgcccgggcgacatgggccaccaacattcaggtggccatcaaccaagtccgccggttgataggtaatgagaactacctcgactacatgacgtccatgaagcgcttcaagaacgagagcgaccccgagggcgccttgtggtga

SEQ ID NO: 24449 - RNA, 9879 nt, synthetic construct
  misc_feature 1..9879: note = derived and/or modified CDS sequence (opt11) from DENV-1__JF937605__SS-prME
  source 1..9879: mol_type = other RNA
agcgttacaatgctgctcatgctgatgcccacggccctggcgttccacctcaccacacgtggtggggagccccacatgatcgtcagcaagcaggagcgggggaagagtcttctgttcaagacctccgccggcgtcaacatgtgcaccctcatcgccatggatttaggcgagctttgcgaggatacgatgacctataagtgcccccgcatcaccgaaaccgagcccgacgacgttgactgctggtgcaacgccacggatacctgggtgacctatgggacctgctcccagacgggcgagcaccggcgcgacaagcgttcagtggcgctggctccccacgttggcctggggttggagacgagaaccgagacttggatgagcagcgagggcgcatggaagcagattcaacgggtggagacgtgggcactccgccaccccgggttcacggtgatcgccctgttccttgcccacgcgatcggcactagcatcacccagaaggggattatcttcatcttactgatgttagtaacaccttccatggcaatgaggtgtgtgggcatcggcagccgcgattttgttgaggggctgtccggcgccacctgggtggatgtggtgctggagcacgggtcgtgcgtcaccaccatggccaaggacaagcccacgctggacatagagttgctgaagaccgaagtcaccaatcccgccgtgttgcggaaactatgcattgaggcgaagatctccaacaccacgacggacagccgatgtcctactcagggcgaggcaaccctggtggaggaacaggacgcgaacttcgtttgcaggcgcacgtttgtggacaggggctgggggaacggctgcgggctgttcggtaaggggtccctcatcacgtgcgccaagtttaagtgtgtaaccaaactggagggcaagattgtccagtacgaaaacctgaaatactctgtgatcgtgaccgtccacacgggcgatcagcatcaggtgggaaacgagagcactgagcacggtacgaccgccacgatcacgccccaggcgccgaccactgagatccagctcaccgactacggtgccttaacgctagactgcagcccccgcaccggcctcgatttcaacgagatggtcctcctgaccatgaaggagaaatcctggctcgtgcataagcaatggttcctcgacctgcccctcccctggaccagcggcgccagcacgctgcaggagacctggaaccgtcaggacctgttggtgacattcaaaacagcccacgccaaaaagcaagaagtcgtggtgctgggctcccaggagggcgcaatgcacacggccctgactggggctaccgagatccagaccagcggaacgaccaccatcttcgcggggcatctcaagtgccgcctgaagatggacaagctgactctcaagggcatgtcctacgtcatgtgcacgggcagcttcaagctggagaaggaagtggccgaaacccaacacggcaccgttcttgtccagatcaaatacgagggcaccgacgccccctgcaagatccccttttcaactcaggacgagaagggggtgacccagaatggacggctgatcaccgccaacccgatcgtaacagacaaggagaagcccgtcaacatcgaagccgagccgccctttggtgagagctacattgtgatcggggccggcgagaaggcgttaaagttgagttggttcaagaaagggtcctcaatcggcaagatgttcgaggctacggctcgcggggcccgccgtatggctatcctgggcgataccgcatgggactttgggagcatcggcggcgtgtttaccagcgtagggaaactcgtgcaccagatattcggcaccgcctatggggtgttattcagcggtgtttcctggactatgaagatcgggatcggcgttctgctcacatggctgggtctgaactcacgctcgaccagtctctcaatgacatgcatcgccgtggggctggttacgttatacctcggcgtgatggtgcaggccgactccgggtgcgtgatcaactggaagggccgggagttgaagtgtgggtccgggatctttgtgaccaacgaggtgcacacctggacagagcagtacaagttccaggccgacagtccgaaacgcctgagtgcggccatcgggaaggcctgggaggagggggtctgcggcatccgatcggccaccaggctcgagaacatcatgtggaagcagatcagcaacgagctaaaccacatactcctcgagaacgacatgaagtttacagttgtagtcggggacgtcgccggcatcctggcccaggggaagaagatgatcagaccccagcccatggagtacaagtacagctggaagtcctggggcaaggccaagatcataggcgccgacgtgcagaacaccacatttatcattgacggacccaacacccctgagtgtcccgacgaccagagagcctggaacatttgggaagtggaggactacggcttcgggatattcacgactaacatctggttgaagctgcgggacagttacacccaagtttgcgaccaccgcctgatgtcggcggccattaaggactccaaggccgtacatgcggatatgggctactggatcgaaagcgagaagaacgagacctggaagttagcgcgggcgtccttcatagaggtcaagacgtgcatctggcccaaatcacacacgctctggtccaacggggtgctggaaagcgagatgatcataccaaagatatacggggggccgatctcccagcacaactatcgccccgggtatttcacacaagctgccggcccctggcacctggggaagctcgagctcgactttgacctgtgcgaggggaccacggtagtcgtggacgagcactgcggcaacagagggccgagcctccggaccactaccgtgaccgggaagataatacacgagtggtgctgccggtcttgcacgctgccgcccctgcgattccgtggggaagacggctgctggtatgggatggagattcgccccgtcaaggagaaggaggagaacctcgtcaagagcatggtgtccgccggcagcggcgaagtagacagcttctctctggggttgctctgcataagcatcatgatcgaagaggttatgcggtcccgctggagccggcgcatgctgatgactggcacccttgccgtgttcttcttgttaatcatgggtcagctgacgtggaacgacctgatcaggctgtgcattatggtcggggctaatgcctccgaccggatggggatgggcaccacctacttagccctcatggcgaccttcaaaatgcgcccgatgtttgccgtgggcctcctgtttcggcgactcaccagccgcgaggtgctgctactcacaatcgggctatccctggtcgcctctgtggagttacccaactcgctggaggaactgggagacggtctcgccatggggataatgatactgaagttactcaccgatttccaatctcaccagttgtgggccacactgctgtcactgacgttcatcaagaccacctttagcctgcattacgcttggaagaccatggcaatggtcctttcaatcgtgagcctcttcccgttatgcctctccacgaccagccagaagactacgtggctgcccgtgcttttaggctcattagggtgtaagccgctgaccatgttcctcattgccgagaacaagatctggggccgccggagctggcccctgaacgaagggatcatggccgtcggcatcgtgtccatcttactctctagcttactgaagaatgacgtacccctggcagggcccttgatcgccggcggtatgttgatagcatgttacgttatctccgggagctccgccgacctcagcctggagaaggccgccaaagtttcctgggaggaggaggccgaacatagtggggcctcacacaatatcctggtggaggtccaagacgacgggaccatgaaaatcaaagacgaggagcgcgacgacacgctcaccattctgctgaaggccacgctcctggccgtgtcaggcgtctacccgttatccataccagcgactctgttcgtctggtacttctggcagaagaagaagcagcgtagcggggtgctgtgggatacgcccagtcctcccgaggttgagcgcgccgtattggacgacggcatctatagaatcatgcagcgcggcttgttaggccgaagccaagttggcgtgggggtcttccaggaaaacgtgttccacaccatgtggcacgtgacccggggcgcggtcctgatgtaccaggggaagcggctggaaccctcctgggcaaacgtgaagaaagacctcatcagctacggcggcgggtggcgcctccagggctcctggaacacgggggaggaggttcaggtcatcgcagttgagccgggcaagaatcccaagaacgttcagaccgctcccgggacattcaaaacccccgagggagaggtcggcgctatcgctctggacttcaagcccggtacgagcggctccccgatcgtgaaccgggaggggaagatcgttggactctatgggaatggggtcgtgaccactagcggcacctacgtgtccgccattgcacaggcaaaggccagccaggaagggcctctgcccgagatcgaggacgaggtattccgcaagcggaacctgacgattatggacctgcatccaggctcaggcaagacccgtcgttacctgccggcaatcgtgcgcgaggccatcaagcgcaagctacggaccctcatcctggcccccacccgcgtggtcgcatccgagatggcagaggccttaaagggcatgcctataagataccagacgaccgccgtcaagagcgagcacactggcaaagagatcgtggatctgatgtgccatgccacctttaccatgcgcctgctgtcgccagtccgggtgcccaattacaacatgatcatcatggacgaggctcacttcaccgaccccagctccatcgcggcccgcggctacataagcaccagggtgggtatgggggaggcagccgctatcttcatgaccgcgacgccccctggaagtgtcgaggcgttcccgcaaagcaacgccgtcatacaggacgaggaacgcgacatccccgagaggtcctggaacagcgggtacgagtggataaccgacttccccggcaagaccgtctggttcgtaccgtccataaagagcggcaacgatatcgccaactgtttgcgcaaaaacgggaagcgggtaatacagctgtcacgcaagacattcgatacggaataccagaagaccaagaacaacgactgggactacgtggtgaccaccgacatcagcgagatgggggcgaacttccgtgccgaccgcgtgatcgaccctcggcgctgtctgaaacccgtaatcctcaaggacgggcccgagcgggtcattctggccggccccatgccagtaacggtcgcgtccgcagcgcagcgcagggggcgcatcggccgcaaccacaacaaagagggtgaccaatacatctacatggggcaaccgctgaacaacgacgaagaccacgcgcactggaccgaggccaagatgctcctagacaacatcaacacccccgagggtatcatccccgctctgttcgagccggaaagagagaagtcagccgcgatcgacggggagtacagattgcgaggcgaggcccgcaagaccttcgtggagctgatgagacgcggcgacctgccagtgtggctctcctacaaggtcgccagcgaggggtttcaatactccgaccggcgctggtgtttcgacggagagcggaacaaccaggtgctggaagagaacatggacgtagagatctggacgaaggaaggggagcgcaagaagctgagaccccgctggctcgacgcacggacctattctgaccccctggcgctgagagagtttaaggaattcgccgccggaaggcgctcagtctcaggcgacctcatactggagatcggcaaactcccgcagcatctcacccagcgggcccagaacgctcttgacaaccttgtgatgctccacaacagcgagcagggcgggcgcgcgtatagacacgccatggaggagctgcccgacaccatcgagacactgatgctcctcgcgctgatcgcagtgctgaccggcggggtaacactgttcttcctgtccggccgcgggctcggcaagaccagcataggcctgctgtgcgttatggctagtagcgtgctcttgtggatggcgtcggtcgagccccactggatagcagccagcatcatcctggagttcttcctcatggtcctgctgatcccagagcccgaccggcagcgcactccccaggacaaccagctggcctacgtggtcattggactgctgttcatgatcctcacggtcgccgcgaatgagatgggcctgctggagaccaccaagaaggacttggggatcggccacgtggccgtcgagaaccaccaccacgccgcgatgctggacgtagacctgcaccccgcgtccgcctggaccctctacgcagtcgccacgaccattatcaccccaatgatgcgccataccatagagaacactaccgcgaacatatcactgaccgcaatcgcgaaccaggcggccatcctgatggggctagacaagggttggcccatctccaagatggacatcggagtccccctactggcgctcgggtgctactcgcaggtcaatcccctgaccctgacggctgccgtgcttatgctcgtcgcccactacgcaatcatcggtccggggctgcaggcaaaggcaaccagagaggcccagaagcgcaccgcggccggcatcatgaagaaccccacggtggacgggatcgtggccatcgacctcgaccccgtcgtgtatgacgcgaagttcgagaagcagcttgggcagataatgctgctgatcctgtgcacgtcacagatcctgctcatgcggaccacctgggcgctgtgcgagtctatcacgctagcaacgggtccccttacgaccctctgggaaggttccccgggcaaattctggaacaccacaatagccgtgagcatggccaacatcttccgcgggtcctacctggcgggcgccggcctggcgttcagcctgatgaagtcgcttggtggcggacggcgcgggaccggcgcccagggcgagaccttgggcgaaaagtggaaacggcagctgaaccagctaagcaaaagcgagtttaacacctacaaacggtccggcatcatggaggtcgatcggagcgaggcgaaggagggcctcaagcgcggtgagacgacaaagcatgccgtgtcccgcggtaccgccaagctgcgctggttcgtggagcggaatctggtcaagcccgaggggaaggtgatcgacctgggctgcggccgcgggggctggagctactactgcgccgggctcaagaaggtgacggaggtcaagggctacacgaaaggcgggcccggccacgaggaacccatcccgatggcgacgtatggctggaacctggtgaaactgcactccgggaaagacgtcttcttcatcccgccggagaagtgcgacaccctcctgtgcgacatcggggagagctcacccaaccccaccatcgaggagggccggacgctgcgcgtcctcaagatggtggagccctggctgagagggaaccagttctgcatcaaaatcctgaacccctatatgcccagcgtggtcgaaaccctcgagcagatgcagcgcaagcacggcggcatgctggttcgaaacccgctaagccgcaatagcacccacgagatgtattgggtgtcctgcgggaccggcaacattgtctccgcggtgaatatgacgagccggatgctcctgaaccgtttcacgatggcgcaccgcaagcccacctacgagcgggacgtggacctgggtgcgggcacccgacacgtagccgtggaaccggaggtggccaacctcgatatcattggccaacggatcgagaacatcaaacacgagcacaaaagcacctggcactacgacgaggacaacccctataagacgtgggcgtaccacgggtcctacgaagtcaagccgtcgggctccgccagcagtatggtgaacggcgtcgtgaagctgctgaccaagccctgggacgtgatccccatggtcactcagatagccatgaccgatacgacccccttcggccagcagcgcgtgttcaaggagaaggtggacacgcgtaccccgaaggccaagcgtgggacggcccagatcatggaggtcaccgcaaagtggttatggggcttcttaagccggaataagaagccccgcatttgcacccgcgaggagtttacgcgcaaggtgcggagcaacgccgccataggggccgtattcgtggacgaaaatcagtggaactctgcgaaagaggcggttgaagacgagcgcttctgggacttagtgcaccgtgagcgggaactccacaaacaggggaagtgcgccacgtgcgtctacaacatgatgggtaaaagagagaaaaagttaggggaattcggcaaggctaaggggagccgcgccatctggtacatgtggctgggcgcgcggttcttagagttcgaggccctgggtttcatgaacgaggaccactggttctcccgcgagaacagcctgagcggggttgagggcgaggggctccataagcttggctacatcctgagggatatcagcaagatcccgggggggaatatgtacgccgacgatactgcaggctgggacacacgcatcaccgaggacgatctccagaacgaggcccgcatcacggatatcatggagccggagcacgcgctgctggccaagtctatcttcaagctcacatatcagaacaaggtggtccgggtgcaacgccctgcaaagaacggcaccgtgatggacgtcatcagccgacgcgaccagcggggctccggacaggtagggacctatggactgaacacgtttactaacatggaggcccaactgatccgccagatggagagtgaggggatattctcccccagcgagctcgagactcccaacctggccgagcgggtgctggactggttagagaagtacggggttgagcgtctgaagcgcatggctatttccggcgacgactgcgtggtaaagccgatcgacgaccgctttgctacggccttaacggcgctcaacgacatgggcaaagtccgtaaagatattcctcagtgggagcccagcaaggggtggaacgactggcagcaggtcccgttctgcagtcatcactttcatcaattaatcatgaaggacggccgcgagatagtggtcccgtgcagaaaccaggatgaattggtgggcagagccagagtgtcgcagggcgcgggctggtcgctccgcgagactgcctgtttaggcaagagctacgcccagatgtggcagctgatgtatttccaccgtagagacctccggctggccgcgaacgccatatgcagcgccgtccctgtggactggatacctacctcccgcaccacgtggtcaatccacgcccatcatcagtggatgaccaccgaggacatgcttagcgtgtggaaccgcgtatggatcgaggagaacccctggatggaggacaagacgcacatcagctcctggggagacgtgccgtacctcggtaagcgggaggaccaatggtgcggcagtttaatcggcctgacggccagggcgacctgggccaccaatatccaagtcgccatcaaccaggtccggagattaataggcaacgagaactacctggactacatgacttccatgaagcggttcaaaaacgagagcgatcccgagggcgccctgtggtga

SEQ ID NO: 24450 - RNA, 9879 nt, synthetic construct
  misc_feature 1..9879: note = derived and/or modified CDS sequence (opt11) from DENV-1__JF937608__SS-prME
  source 1..9879: mol_type = other RNA
tcggtgaccatgctactcatgctgatgcccacagccctggccttccaccttaccacacgtggcggggagccccacatgatcgtgagcaagcaggaacgcggcaagagcctgctgttcaagaccagcgccggtgtgaacatgtgtaccctcatcgccatggacttgggcgaactatgcgaggacaccatgacctacaagtgccctcgcatcacggagaccgaacctgacgacgtggactgctggtgcaacgccaccgacacctgggttacctatggtacctgcagccaaacgggcgagcaccggcgcgacaagcggtcggtggccctagcgccccacgtcggcctggggttagagacccgcaccgagacctggatgagctccgagggtgcttggaagcagatccagaaggtggaaacttgggccttgcggcatcccgggttcaccgtgatcgcgctgttcctggcccacgcgatcggaaccagcatcacccagaaggggatcatcttcatactcctcatgctggtgacgccctcaatggcgatgcgctgcgtcggcataggcagccgggacttcgttgaggggctctccggcgccacatgggtagacgtcgtgctggaacacgggagctgcgtgaccactatggcgaaggacaagccgactctggacattgaactccttaagaccgaggtaaccaaccccgccattctgcgcaagctctgtatcgaggcgaagatctccaacactacaaccgacagccggtgcccgacccagggcgaggctaccctggtggaggagcaggacgccaacttcgtgtgcagacgtactttcgtcgaccgcggctgggggaatggctgtgggctgttcggcaaggggtccttaatcacctgcgctaagttcaagtgcgtaactaagttggagggaaagatagtgcagtacgagaatctgaagtacagcgtcatcgtaacggtgcatacgggcgaccagcaccaagtcgggaacgagtctaccgagcatggtaccaccgccaccataacgccccaggcgccgacgaccgagatccagctcaccgactacggggccctgacgttggactgctccccccggaccggcctcgacttcaacgagatggtgctgctgactatgaaggagaagtcctggctcgtccacaagcagtggttcctggacctgccgttgccatggacaagcggggcatctacgtcccaagagacatggaacaggcaagatttgctggtgactttcaagaccgcacacgccaagaagcaggaggtggtcgtgctaggtagtcaagagggcgcgatgcacacggccctgacgggggccaccgagatacagacctccggcaccaccaccattttcgccgggcacctgaagtgtcggctcaagatggacaagctcaccctgaaggggatgagctacgtaatgtgcaccgggagttttaagctcgagaaggaggtcgctgagactcagcacggtaccgtcctggtgcagatcaaatacgagggaaccgacgcgccctgtaagatacccttcagcacgcaggacgagaagggggtcacgcagaacggccgcctgatcaccgccaacccaatagtgacggacaaggagaaacccgtgaacatcgaggccgagccgccctttggtgagtcctacatcgtcatcggcgccggggaaaaggcgctgaagctctcgtggttcaagaaggggtccagcatcgggaagatgttcgaggccacagccaggggggcacgccggatggccatcctgggcgacaccgcgtgggactttgggtctattggtggcgttttcacaagcgtgggaaagctggtacaccaaatcttcggcaccgcctatggggtactcttctccggcgtgtcatggacgatgaagatcgggatcggcgttctgttgacttggctcggcctgaactcccgtagcacctcgctgagcatgacctgtatcgccgtggggctagtgactctgtacctgggcgtcatggtgcaggccgactccgggtgcgtgattaactggaagggccgcgagctcaagtgcgggagcggcatattcgtcaccaacgaggtgcacacctggaccgagcagtacaaattccaagccgatagccccaagcggctgtccgcggccatcggcaaggcctgggaggagggggtgtgcggcatcagaagcgccacccggctggagaacattatgtggaaacagatctccaacgagctcaaccacattctgttagagaacgacatgaagttcacggtggtggttggggatgtagccggcatcctcgctcaaggcaagaaaatgatccgcccccagcccatggaatacaagtacagctggaagtcatggggcaaggccaagatcattggggcagacgtgcagaacaccaccttcatcatcgacgggcccaacaccccggagtgcccagacgaccagcgggcctggaatatctgggaggtggaggactacgggttcgggatcttcacaacgaacatctggctgaagctgcgcgacagttacacgcaggtctgcgaccaccgactcatgtcggcggccatcaaggactcgaaggctgtacacgccgacatgggctactggatcgaatccgaaaagaatgagacctggaagctggcccgcgccagctttatcgaggtgaagacgtgtatctggcccaagtcccatactctgtggagcaacggcgtcctcgagtctgagatgatcatacccaagatctacggggggccgatcagccagcacaactaccggcccgggtacttcacccagaccgccggtccctggcacctcggtaagctggagctcgacttcgacctgtgtgaggggacgaccgtggtggtcgacgagcactgcgggaaccgcgggcccagccttcggaccaccactgtgaccgggaagatcatccacgagtggtgctgtcgtagctgcaccctccctcccctacggttccgcggggaggacggctgctggtacgggatggagatacgacccgtgaaggagaaggaggaaaacctggtaaagtccatggtaagcgccgggagcggcgaggtggactccttcagcctcgggctgctgtgtatctccatcatgatcgaagaggtcatgcgcagccggtggagtcgcaagatgctcatgaccggtacgctggccgtgtttttgctcctgatcatggggcagctgacctggaacgacctcatacggctgtgtatcatggtgggtgccaacgcgagcgaccgaatggggatggggaccacctatctggcgctcatggccacgttcaagatgcgcccaatgttcgccgtcggactgctgttccgaaggctcacatcgcgggaggtgctgctgctgacaatcggcctgagcctggtggcctccgtcgagctccccaactcactggaggagctgggtgacgggctcgcgatgggcattatgatcttaaagctgctcaccgacttccagtcccaccagctatgggcgacgctgctctctctgactttcatcaagaccaccttttccctgcattatgcctggaagacgatggccatggtgctcagcatagtctccctgttcccactgtgccttagcaccacatcccaaaagaccacttggctgcccgtgctgctcggaagcctgggctgcaagccgttgaccatgttcctcatcgcagagaacaaaatctggggccgccggtcctggcctctgaacgaggggatcatggccgtgggtatcgtcagcatcttgctcagctcactgctgaagaatgatgtgcccctcgctgggcccttgattgcgggcgggatgctgatcgcctgctatgtcatctccggctccagcgccgacctctccctggaaaaggcagccgaggtcagctgggaggaggaggccgagcattccggtgccagccataacatcctggttgaggtgcaggacgacgggaccatgaagattaaagacgaggagcgggacgatacgctcactatcctactgaaggcgaccttactggctgtcagtggcgtctatccgctgtcaattcccgccaccctattcgtgtggtacttttggcagaagaagaagcagcggtccggcgtcctgtgggacaccccaagcccgcccgaggtggagcgcgccgtgctggacgacggcatctacaggataatgcaacgcggtctgctcgggcggtcgcaggtcggagtgggggtattccaggagaacgtctttcacaccatgtggcacgtgacgcgtggcgccgtgttgatgtaccaagggaagcggctggagccctcctgggcgtccgtcaagaaggacctcatcagctacggcggcgggtggaggctacagggctcatggaacaccggggaggaggtccaagtgatcgccgtcgagcccggcaagaaccccaaaaacgtgcaaacaacccccgggacgttcaagacccccgagggcgaagtgggcgccatcgccctggacttcaagcccggcaccagcggctcccctatagtcaaccgggagggaaagattgtgggtctctacggcaacggagtggtcaccacgagtggcacctacgtgagtgccatcgcgcaggcgaaggcctcccaggaggggccgctgcccgagatcgaggacgaggtgttccgcaagcggaacctgaccataatggacctacaccccggcagcgggaagacccgaagatacctgccggccatcgtccgcgaggcaatcaagcggaagctgcgcacgcttatcctcgcccccactcgcgtggtggcctccgagatggccgaggcgctgaagggaatgcccatccggtaccagacaaccgcggttaagagcgagcacacgggtaaggagattgtagacttgatgtgccacgccaccttcaccatgcgcctgttatcccccgtgcgggtcccgaactacaacatgatcatcatggacgaggcccatttcacagaccccagttccatcgccgcccgaggatacatcagcacgcgggtaggcatgggggaggcggccgccatcttcatgaccgccaccccgcccgggtccgtggaggccttccctcagagcaacgcggtcatacaggacgaggagcgcgacatccccgagcggtcctggaacagcggttacgagtggatcaccgacttccccggcaaaacggtgtggttcgtaccctccatcaagagcgggaacgacatcgccaactgcctccgcaagaacggcaagcgggtcatccagctgtcccgcaagaccttcgacaccgagtaccagaagaccaaaaacaatgactgggattatgtggtgacgaccgacattagcgagatgggcgccaacttcagagccgaccgcgtcatcgacccgcgacgctgcctgaagcccgtgatcctaaaggacgggcccgagcgggtgatcctcgcgggccccatgccggtcacggtggcctcggcagcacagcgccggggtaggatcggcaggaaccacaacaaggagggcgaccagtacatatacatggggcagcccctgaataatgacgaggaccacgcccactggaccgaggcgaagatgctcctcgacaacataaacacgcccgagggcattatacctgccctgttcgagcctgagcgcgagaagtccgccgcgatcgacggggaatatcgcctgcggggagaggctagaaagacttttgtcgagctgatgcggcgcggggacctgcctgtgtggttgtcctacaaggtggcttcggagggcttccagtactcggaccggcgctggtgcttcgatggcgagcggaacaatcaggtcctggaggagaacatggacgtggagatttggaccaaagagggagagcgcaagaagctccggccacgctggctcgatgctcggacgtactcggaccccctcgctctgcgcgaattcaaagagtttgccgcaggccggcgcagcgtgtccggggacctcatcctggagatcggcaagcttcctcagcatctcacgcaacgggctcagaacgccctggacaacctggtcatgctccacaacagcgagcagggcggccgcgcctatcgacacgccatggaggagctgccagacaccatcgagaccctgatgctcctggcgctgatcgccgtgctcaccggcggtgtgacactgttcttcctgtccggccgcgggctcggcaagacgagcataggactcctgtgcgtcatggcctcgagcgtactcctgtggatggcctccgtggagccgcattggatcgctgcgagcatcatcctggagttcttcctcatggtcctgctgatcccggagccagaccggcagcgcacgccccaggataaccagttagcctacgtggtgatagggctgctgttcatgatcctcaccgtcgccgccaacgaaatgggcctcctggagaccactaagaaagacttggggatcggccacgttgccgtggggaatcaccaccacgcggccatgcttgatgtcgatctgcaccccgccagtgcctggacgctctacgccgtggcgaccacgatcatcaccccgatgatgcggcacactatcgagaacacaaccgccaacatcagcctgacggccatcgccaaccaggccgcgatcttgatggggctcgacaagggctggcccatctccaagatggacatcggtgtgcccctgctggccctaggctgctacagccaggtcaaccctctgaccttaacagccgctgtgctcatgctggtggcgcactacgcaatcatcgggccgggcctgcaagccaaggccaccagagaggcacagaagcgcaccgcggcaggtatcatgaagaaccccaccgtcgatggcatcgtggccatcgacttagacccagtggtctacgacgctaagtttgagaagcagctgggccagatcatgctgctcatcctgtgcacctcccagatactgctcatgcggactacgtgggcgttatgtgagagcatcacgctggccaccgggccccttaccacactgtgggaagggtccccggggaagttctggaacaccaccatcgccgtgagcatggccaacatcttccgcggctcctacctggccggcgccgggctcgcattcagcctgatgaagtctttaggcggaggccggcgcgggaccggcgcccaaggcgagacgctcggggaaaagtggaaacggcagctgaaccagctgtcaaaaagcgagtttaacacctacaagcgctccggaatcatggaggtggaccggagcgaggccaaggaggggttaaaacgcggcgagaccaccaaacacgccgtatcccgggggacggcgaaactgcgctggttcgtggagcggaacctggtgaagcccgaaggcaaggtcatcgacctgggctgcgggcgcggcggatggagctactactgcgccggactcaaaaaagtgaccgaggtgaaggggtacacgaagggcggccccgggcacgaggagcccatcccgatggcgacctacggctggaacctggtcaagctgcactccgggaaggacgtgttcttcataccgcccgagaaatgtgacactctcctgtgcgacatcggcgagagctccccgaacccgactatcgaggaggggcggaccttgagagtgctcaagatggtcgagccctggctgcgtggcaaccaattctgcattaagatcctgaacccctatatgcccagcgtagtggaaaccctagagcagatgcagcgcaagcacggcgggatgctggtccggaacccgctgtcccgcaacagcacccacgagatgtactgggtgtcctgcggcacgggcaatatagtgagtgccgtcaacatgaccagccggatgctcctgaaccgcttcaccatggcccatcgcaagcccacctacgagcgggacgtggatctaggcgctgggactcgccatgtggccgtcgagccggaggtagccaacctcgacatcatcgggcagcggatcgagaatattaagcacgagcacaagagcacctggcactatgacgaggataacccctacaagacatgggcctaccacggctcctacgaggtgaagccgtcagggtccgcatcgagcatggtcaacggcgtggtcaagttgctgactaagccctgggacgttatcccgatggtgacgcagatcgcgatgaccgacaccacccccttcgggcagcagcgcgtcttcaaggagaaggttgacacgcggactccgaaagccaagcgcggcactgcccagataatggaggtgaccgccaagtggctatggggcttcctgtcccggaacaagaaaccccgcatctgcacgcgggaggagttcacgcgcaaggttcggagcaacgccgcgataggagccgtgttcgtagatgaaaaccagtggaactccgcaaaggaggccgtagaggacgagcgcttctgggacctggttcaccgggaacgcgagctccacaagcagggcaaatgcgcgacctgcgtgtacaacatgatggggaagagagagaagaagctgggcgagttcgggaaggccaagggctcccgcgccatctggtacatgtggctgggcgccagattcctcgagttcgaggccctgggtttcatgaacgaggatcactggttctcccgcgagaacagcctgtccggcgtcgaaggggagggcctgcacaagttggggtacatcctgcgggacatctcgaaaatccccggtggtaacatgtacgcggacgacaccgccggctgggacacgcgcatcaccgaggacgatttgcagaacgaggctcggattaccgacattatggagccggagcacgcgctgctggcaaagtccattttcaagttgacttaccagaacaaggtggtgcgcgttcagcgcccggcgaagaacggtacggtgatggatgtgatctcgcggagggatcaacggggatccggccaggtaggtacctacgggctgaacaccttcaccaacatggaagcccagctgatccgccagatggagagcgagggcatcttctcccccagcgagctggagacgccaaacctggccgaacgggtgctggactggctggagaaatatggggtggagcgcctgaagcggatggccatctccggcgacgactgcgtcgtcaagccgatcgacgacaggttcgccaccgcgttgaccgcactcaacgacatgggcaaggtacggaaggacatccctcagtgggagcccagtaagggctggaacgactggcagcaggtcccgttttgctcccaccacttccaccagctgatcatgaaagacggtcgcgagatcgtggtgccatgccggaaccaggacgagctggtcgggcgcgccagggtgagccaaggtgccgggtggagcctccgagagaccgcctgcctgggaaagtcctacgcgcagatgtggcagctgatgtacttccaccggcgcgacctccggctggccgcgaacgcaatctgcagcgctgtgcccgtcgattggatccccacctcccgcacaacctggagtatacatgcacaccaccagtggatgaccacggaggacatgctgtcggtgtggaatcgagtgtggatcgaggagaacccgtggatggaagacaaaacccacatcagcagttggggcgatgtcccgtacctcggcaagcgcgaggaccagtggtgcggctcgctgatcgggcttaccgcccgcgccacctgggccaccaatatccaggtggcgatcaaccaagtgcgtagattgatcggcaacgagaactatctggactacatgacgtccatgaagcggttcaagaacgaaagcgaccccgaaggggccctgtggtga

SEQ ID NO: 24451 - RNA, 9879 nt, synthetic construct
  misc_feature 1..9879: note = derived and/or modified CDS sequence (opt11) from DENV-1__GU131739__SS-prME
  source 1..9879: mol_type = other RNA
agcgtgaccatgctgctgatgctgatgcctacagccctggccttccacctcaccacccgtgggggtgagccacacatgatcgtgagcaagcaggagcggggcaagagcttattgtttaagacatccgccggggttaacatgtgcaccctcatcgcgatggaccttggggagctgtgtgaggataccatgacatacaagtgcccccggatcaccgagaccgagccagacgatgttgactgctggtgcaacgccacggatacgtgggtgacctacgggacctgcagccaaacgggggagcaccggcgcgacaagcgttctgtggccctcgcgccacatgtggggttggggctcgaaacacgcacagagacgtggatgtcatccgagggggcctggaagcaaatccagagggtagagacgtgggccctccggcaccccgggttcaccgtgattgcccttttcttggcccacgcgataggcaccagtatcacccagaaggggatcatattcatactgctgatgctcgtgacgccctctatggccatgcggtgcgtcggcatcggcagccgcgatttcgtggaggggttatccggcgccacctgggtggacgtagtgctggagcacgggagctgcgtcacaaccatggccaaggacaagccaacgctggacatcgagctcttaaagactgaagtaaccaatcccgccgtgctgcggaagttatgcatcgaggcgaaaatctccaacacaacgactgacagccgttgcccgacacagggcgaggcaaccctggtggaagaacaggacgcaaattttgtctgccggcgcacattcgtggacagggggtgggggaacggctgtgggctgtttggtaaagggtccctcatcacatgcgccaaattcaagtgcgtgaccaagctggagggcaagatagttcagtacgaaaacctgaagtacagcgttatcgtgaccgtccacacgggcgaccagcatcaggtcgggaacgagtccactgagcacgggacgaccgccaccatcacgccccaggcaccaaccacggagatccaactcaccgactatggggccctgacgcttgattgcagcccccgcaccggtcttgacttcaacgagatggtcctgctcacaatgaaggagaaaagctggctcgtacacaagcagtggtttctggacctgccgttaccctggaccagcggagccagcacgtcccaggagacctggaatcggcaggacctgctagtgaccttcaagaccgcgcacgctaagaagcaggaagtcgtggtgctcggctcccaggagggcgcgatgcatacggcccttaccggcgccacagagatccagacctccggcactaccaccatcttcgccgggcacctgaagtgccggctcaagatggacaaactgaccctcaagggcatgtcttacgtgatgtgcactgggtcctttaagttggagaaagagttagccgaaacacaacacgggacggtgctagtgcagatcaagtacgagggtacagacgctccctgcaagatccccttctccacgcaggacgagaagggagtaacccaaaacggccgactgatcacagccaacccgattgtaaccgacaaggaaaagccggtcaacatcgaggccgagccgcccttcggggagtcctacatcgtcatcggcgcaggcgagaaagcgctcaagctgtcatggttcaaaaagggttcttcgatcggcaagatgttcgaggccacggcccgcggggcccggcgcatggccatcctgggggacactgcgtgggacttcggctccatcggcggggtgttcaccagcgtggggaaacttgtgcaccagatcttcggcacggcctacggagtgctgttctccggtgtttcatggaccatgaagatcggaatcggcgtcctgctcacctggttgggactaaattcccgcagcacctccctcagcatgacttgtatcgccgtggggctagtgactctatacctcggcgtcatggtgcaggccgacagcgggtgcgtgatcaactggaagggccgggagcttaaatgcgggagcggcatcttcgtcaccaacgaagtgcacacctggaccgagcagtacaagtttcaggccgacagcccaaagcgcctgagcgcggccatcggcaaggcctgggaggaaggggtgtgcggtattcgcagtgccacccgcctggagaacatcatgtggaagcagatctccaatgagctgaaccacattctgctcgaaaacgacatgaagttcactgtcgtagtgggggatgtcgcgggcatcctcgcgcaggggaagaaaatgataaggccccagcccatggagtataagtacagctggaagtcctggggcaaggccaaaatcataggcgcagacgtacagaacactaccttcatcatagatgggcccaacaccccggagtgtcccgacgaccagcgcgcctggaacatctgggaagtggaggactacggattcgggatctttacaaccaacatctggctgaagctccgcgacagctacacacaggtctgcgaccaccgtctgatgtccgccgctatcaaggacagcaaggccgtccacgctgacatgggatactggatcgagtccgaaaagaacgagacctggaagctggcccgggcaagtttcatcgaggtgaagacgtgcatctggcccaagtcgcacaccttatggagcaacggtgtcctggagtccgagatgatcattcccaagatatacggagggccgattagccagcataactaccgccccgggtacttcacccagaccgcgggcccctggcacctgggaaagctcgaactggacttcgatctgtgcgagggcacgaccgtggtagtcgacgagcactgcggcaaccgggggccgtccctccgcaccactacagtgaccggaaaaatcatccacgagtggtgctgccgcagctgcacgttgccgcccctgcgtttccgcggggaggacggctgctggtacgggatggaaatccgaccggtgaaggagaaagaagagaacctcgtcaagtccatggtgagcgccggctcaggtgaggtggatagtttcagcctagggctgctctgcatctccatcatgatcgaagaggtcatgcggagccgctggtcccgtaagatgctgatgacaggcacgctggccgtgttcttcctcctgattatggggcaactgacctggaacgacttaatacgcctgtgtataatggtgggcgcaaacgcttccgaccgcatgggtatgggcaccacgtacctggcactcatggccacgttcaagatgcggccaatgttcgccgtcggcctactcttccgccggctgacctctcgcgaggttctgctgctcacgatcgggctaagcctggtggccagtgtagaactccccaacagcctggaagaactgggtgacggactcgcgatgggcatcatgatcctgaagctgctcacagacttccagagtcaccaattatgggccacgctgctctcactgaccttcataaagaccacgttctccctgcactatgcttggaagactatggcgatggtgctcagcatagtctccctgttcccgctgtgcctctcaaccacctctcagaagaccacgtggttgcccgtgctgcttggcagcctgggttgtaagccgctgaccatgttcctcatcgcagagaacaagatctggggccggaggtcctggcccctgaacgagggcatcatggccgtgggcatcgtcagtatcctgctctcatcccttctgaagaacgatgtaccactcgcggggcccctaattgccggcggcatgctgatagcatgctacgtgataagtgggtcaagtgccgacctctccctggagaaggccgccgaggtaagctgggaggaagaagccgagcattccggcgcgagccacaacatacttgttgaggtccaggacgacgggaccatgaagatcaaggacgaggagcgggatgacacccctaccattctcctgaaggcgacgttgctcgctgtgtcaggggtctacccccttagcatcccagctaccctgttcgtgtggtacttctggcagaagaagaagcagcgctccggtgtcctctgggacaccccctccccgcccgaggtggagcgggccgtgttagacgacggcatctaccgcatcatgcagcgtggccttctggggcgatcacaggtaggcgtgggggtctttcaggagaacgtcttccacaccatgtggcacgtgacgcggggcgcagtgctaatgtaccagggaaagcgcctagagccctcatgggcgtccgtcaagaaggacctgatatcatacggcggagggtggaggctccagggctcctggaacaccggggaggaggtccaagtgatcgccgttgagcccggcaagaacccgaagaacgtacagaccgccccggggaccttcaaaacgcccgagggcgaggtcggcgctatcgcacttgatttcaagcccgggacgtctggaagccctatcgtcaaccgcgaggggaaaatcgtgggcctgtacggcaatggcgtggtcaccactagcggcacgtacgtgagcgcgatcgcccaggctaaggcctcccaggaggggcccctacctgaaatcgaggacgaggtattccggaaacgcaacctaaccattatggatttgcacccgggctcggggaaaacccgccggtacctccccgccatcgttcgggaggccattaagcgcaagctccgcaccttgatcctcgcgcccacgagggtagttgcctccgaaatggccgaggcgttaaagggcatgcccatccgctatcagacaaccgccgtcaagtcagaacacaccggcaaagagatcgtggacctgatgtgtcatgctacgttcacaatgcggctcctgtcgccggtgcgagtcccgaactataacatgatcatcatggatgaggctcacttcaccgacccatctagtatagctgcgagggggtacatcagcacccgagtgggtatgggggaggccgccgcaatattcatgacggctactccgccgggtagtgtggaggcgttcccccagtccaacgccgtgatccaagacgaggagcgggacatacccgagcgctcgtggaatagcggatacgagtggatcacggacttccccgggaagaccgtgtggttcgtgccatccatcaagtcgggcaacgacatcgccaactgcttgcggaagaacgggaagcgagtcatccagctctcacggaaaacgttcgataccgagtatcagaagacgaagaacaacgactgggattatgtcgtgaccactgacatctccgaaatgggcgccaatttccgcgcggaccgggtcattgacccgagaaggtgcctgaagcccgtgatcctgaaggacggtcccgagcgcgtaatcctcgccggcccgatgccggtcaccgtggcgtccgcggcccagagacgcgggcggataggccgcaatcacaacaaagagggcgaccagtacatctacatggggcagccgctgaacaacgacgaggaccacgcgcactggactgaggctaagatgcttctagataacatcaacacacccgaggggatcataccggccctgttcgaacccgaacgcgagaaatccgccgccattgacggggagtatcggctgcgtggcgaggcgcggaagacgttcgtcgagctcatgcgccgcggtgacctgcctgtgtggctgtcctacaaggtggccagcgagggcttccaatactccgatcgccggtggtgctttgacggtgagagaaacaatcaggtcctcgaggagaacatggacgtagagatctggacaaaggagggtgagaggaagaagttgcgcccacggtggctggacgcccgcacctactccgaccctctcgccctgcgggagttcaaggagttcgcagcgggccgccggagcgtgagtggggacctaatactagagatcggcaagctaccacaacacctgacccagcgcgcacaaaacgccctcgataacctggtcatgttacacaatagcgagcagggcggccgggcctaccggcacgcgatggaggagctccccgatacgatcgagaccctgatgttactcgccctgattgccgtgctgaccggcggggttaccttattcttcctgtccggccgggggctgggaaagacaagcattggcctcttatgtgtcatggcctccagcgtcctcctttggatggcctccgttgagccccactggatcgcggccagtatcatccttgagttcttcctgatggtgctcctgatacctgagcctgaccgccagcgcacgccccaggataatcagctggcctatgtggtgatagggctcctgttcatgattctgaccgttgcagcgaacgagatggggctcctagagactaccaagaaggacctggggatcggccacgtggcggtagagaaccaccaccacgctgccatgctcgatgtagacctgcacccggcctccgcctggacgctgtacgccgtggccactacgatcatcacccccatgatgcggcacacgatcgaaaacaccaccgccaacataagcctcaccgccatcgctaaccaggcggccatcctgatggggctggacaagggctggcccatctccaaaatggacattggagttccgttgctggccctggggtgctactcacaagtcaaccctctcacgctcaccgccgcggtgttgatgctcgtggcccactacgccatcatcggccccggtttgcaagcaaaggccacacgggaggcgcagaagcggaccgccgccggcattatgaagaaccccacggtcgatggaatcgtggccatcgacctggaccccgtggtctatgatgccaagttcgagaagcagctaggtcagataatgctgctaatcctctgcacttctcagatcctgctaatgcgcaccacctgggccctctgcgagagcatcacattggcaacaggcccgctgaccaccctctgggaggggtccccagggaagttctggaacacgaccatcgccgtgtctatggccaacatcttccgggggtcctacctagccggagcgggcctggccttcagcctcatgaagagtctagggggcgggcgccgggggaccggggcccagggcgagaccctaggagagaagtggaagcggcaactgaaccagctctccaagagcgagttcaacacttacaagcgatcaggtatcatggaagtggataggagcgaggcaaaggagggccttaagcgcggcgagacaaccaagcacgcggtatcccgcgggacggccaagctccgctggttcgtggagcgcaaccttgtgaagcccgaagggaaagtcatcgatctgggctgcggccgcgggggctggagctactactgcgccgggctaaagaaggtgacggaagtgaaaggctacaccaagggcggacccggccacgaggaaccgatacctatggccacctacgggtggaacctcgttaagctgcacagcggcaaggacgtgtttttcatcccgcccgagaagtgcgacactcttttgtgtgacatcggggagagctccccgaatcccacgatcgaggagggccgcactttacgggtgctgaagatggtcgaaccctggctccgagggaatcagttctgcatcaagatcctgaacccgtacatgccgagcgtggtggaaactctggagcagatgcagcggaagcatggcggaatgctcgtcaggaaccccttatcccggaactcaacacacgaaatgtattgggtgtcctgcggaaccggcaacatcgtgagcgccgtcaacatgacgtccagaatgctgctcaaccgcttcacgatggcacaccgtaagccaacatacgaacgcgatgtggacctaggagccggcacgaggcatgtggccgtcgagcccgaagtcgccaatctggacatcatcggccagaggatcgagaatatcaaacacgagcacaagagcacgtggcactacgacgaggacaatccttataaaacatgggcctaccacgggagttacgaggttaagcccagcggctccgccagcagcatggtcaacggggtcgtcaagctcctgaccaagccctgggacgtgatccccatggtgacccagatcgcaatgacggacaccactccgttcggtcagcagcgggtcttcaaggagaaggtggacacccgcacgcccaaggcaaagcggggcaccgcccagattatggaggtgaccgccaagtggctgtggggcttcttaagtcgcaataagaagccccgtatatgcacccgcgaggagtttacgcggaaggtccgcagcaacgcggccatcggcgcggtgttcgtggacgagaaccagtggaacagtgccaaggaggcggttgaagacgagcggttctgggacctggtgcaccgcgaacgagagctgcacaagcaggggaagtgcgcgacctgcgtgtataacatgatgggcaagagagagaagaaactcggggagttcggcaaagccaaggggagccgggccatctggtacatgtggctgggcgcccgctttctagagttcgaggcgctcggtttcatgaacgaggaccactggttttcccgggagaactctctgtccggggttgagggcgaagggctgcacaaacttggatacatcctgcgagacatctcgaagataccgggaggcaatatgtacgccgacgacaccgccggttgggacactcggattacggaggacgacctgcagaacgaggcccgcatcaccgatataatggagcccgagcacgccctcctggcgaagtctatcttcaagctgacctaccaaaacaaggtcgtgcgggtccagcggccagccaagaacggcaccgttatggacgtaatatcgcgccgggaccagcgcggctccggacaggtgggcacatacggactcaacaccttcaccaacatggaggcccaacttatccgccagatggagagcgaagggatcttctcacccagcgagctggagaccccgaacctcgccgagcgcgtgttagactggctggaaaagtacggggtggagagactcaaacgcatggccatcagcggggacgactgcgtcgtgaagcccatagacgaccggtttgctacggcactgaccgcactgaacgacatgggcaaggtgcgcaaagacatcccacaatgggaacccagcaaggggtggaacgactggcagcaggtccccttctgctctcatcacttccaccaactgatcatgaaggacggacgggaaatagtggtaccttgccgcaaccaagacgagctcgtcggccgggcccgcgtgagccagggagcagggtggtcgctgcgggagaccgcgtgcctcggcaagagctacgcgcagatgtggcagctgatgtacttccatcgccgggacctccgcctcgccgcaaacgcgatctgcagcgccgtgcccgtcgattggatccccacctcccggacgacctggagcatacacgcgcaccaccagtggatgaccaccgaggatatgctgtccgtgtggaacagggtttggatcgaagagaacccatggatggaggacaagacgcacatctcgtcctggggcgacgtcccctacctggggaagcgggaggaccagtggtgcggcagcctcatcggtctgaccgcgcgggctacctgggctaccaacatccaggtggccatcaaccaggtacgccgtctgatcgggaatgagaactatcttgactacatgacctccatgaagcgcttcaaaaacgagagcgaccccgagggcgccctgtggtga

SEQ ID NO: 24452 - RNA, 9879 nt, synthetic construct
  misc_feature 1..9879: note = derived and/or modified CDS sequence (opt11) from DENV-1__GU131740__SS-prME
  source 1..9879: mol_type = other RNA
tccgtgacgatgctgttgatgctgatgcccaccgccctcgcttttcacctgacgaccagaggtggggagccccacatgatagtgagcaagcaggaacggggcaaatcgctgctgttcaagacctctgcgggggtgaacatgtgcaccctgatagccatggatctgggcgagttctgtgaggacacgatgacatacaaatgcccccgcatcaccgaagctgagcctgacgacgtcgactgctggtgcaatgccacagacacttgggtaacttacggcacttgcagccagactggggagcatcggcgggacaagcggagcgtggcactggccccccacgtggggctcgggctggagacgcgcacggaaacatggatgagcagcgagggcgcctggaagcagatccagcgggttgagacctgggccctgcgccacccgggtttcacggtaatcgccctcttcttggcgcacgccatcggcaccagcatcacccagaaggggatcatcttcatcctgctcatgctggtgacccccagcatggccatgcggtgcgttggaatcggctcacgcgacttcgtggagggtctgtccggcgccacgtgggtggacgtcgtgctggaacatgggagctgcgtgaccaccatggccaaggataagcccaccctggatatcgagctgctcaagacggaagtcaccaaccccgcagtgcttcggaaactgtgcatcgaggccaagatcagtaataccaccacggacagccgctgtccgacccaaggcgaggcaacgctcgtagaagagcaggatgccaacttcgtctgcagacgcacctttgtggaccggggctgggggaacggatgcgggttgttcggcaagggatccctgatcacttgcgccaagttcaagtgcgtgacgaagcttgagggcaaaaccgtgcagtacgaaaacctgaagtacagcgtgatcgtgaccgtccacacgggcgaccaacaccaggtggggaacgagagcaccgagcatggcactacagctacgatcaccccccaggccccctctaccgagatccagctgaccgactacggggccctaaccctggactgcagcccacggacgggtctggacttcaatgagatggtcctcctgaccatgaaggagaagagctggctggtgcacaagcagtggttcctcgatttgccgctgccctggacctccggggcctccactagccaggagacgtggaaccggaaggacctcctggtgaccttcaagaccgcccacgccaagaagcaagaggtcgtggtgctggggtcccaggagggcgcaatgcacaccgccctcactggggccaccgagatccagacctcaggcaccacgaccatcttcgcggggcacttgaagtgccgcctgaagatggataagttaacattgaagggcatgagctacgtcatgtgcaccgggagcttcaagctggagaaagaagttgcggagacgcagcatggtaccgtgttagtccagataaagtacgagggcaccgacgtgccctgtaagatcccgttttccacacaggacgagaagggggtcacgcagaacggccggctgatcaccgccaacccgattgtcaccgacaaagagaagcctgtcaatatcgaagccgagccgcccttcggcgagagctacatcgttatcggagccggcgaaaaggcgctgaagctgtcctggttcaagaaagggagctccatcggcaaaatgttcgaggccaccgcccgcggggccaggcgcatggccatcctcggcgacacggcgtgggacttcgggagcatcggcggggtcttcacttccgtagggaagctggttcatcagatcttcggcaccgcctatggggtcctcttcagcggcgtgtcctggaccatgaagatcgggatcggcgtgctcctgacgtggctgggcctcaactcacgctccaccagcctatccatgacctgcatcgccgtcgggctggtcaccctatacctgggcgtgatggtccaggccgacagcgggtgcgtgatcaactggaaggggcgggagctgaagtgcgggagcggcatcttcgtaacgaacgaggtccacacctggaccgagcagtacaagtttcaggcagactccccgaagcgcctctcggcggccatcggcaaggcctgggaggagggggtgtgcggcatacgctccgccactcgcctggaaaacatcatgtggaagcagattagcaatgagctgaaccacatcctcctggagaacgacatgaagttcaccgtggtcgtgggggatgtagccggcatcttggcgcaggggaagaagatgatccggccccagcccatggagtacaagtacagctggaagtcctggggcaaagccaagatcatcggcgccgacgtccagaacacgacattcatcatcgacgggccgaacaccccggagtgtcccgacgaccaacgcgcctggaacatctgggaggtggaggactacggctttgggatcttcaccacgaacatctggctaaagctgcgggactcctacacccaggtgtgcgaccaccgcctgatgagcgcggccatcaaagactccaaagccgtccacgccgacatgggctactggatcgagagcgagaagaacgagacctggaagctcgcccgggcgtccttcatcgaggtgaagacatgcatctggcccaagagccacactctgtggtccaacggcgtgctggagagcgagatgatcatccccaagatctacgggggcccgatttcccagcacaattaccggcccgggtacttcacccaaacagccggcccctggcacctcgggaagttagagctggacttcgacctctgcgagggaaccacggtcgtcgtggatgagcactgcggcaaccgggggccgagtctgcgcaccaccaccgtcacgggcaagatcattcacgagtggtgctgccggtcctgcaccctgccccccctgcgtttcaagggggaggacgggtgttggtacgggatggagatacgacccgtgaaggagaaggaggagaacctggtcaagagcatggtgtcggccggttccggcgaggtggacagcttctcactggggctcctgtgtatcagcataatgatcgaggaagtcatgcgctcccggtggagccgtaagatgctgatgaccggcaccctcgccgtcttcttccttctaataatggggcagctcacgtggaacgatctgatccggctctgcatcatggtgggcgccaacgcgtccgaccgcatggggatgggcaccacctacctcgccctgatggccaccttcaagatgcgcccgatgttcgccgtgggccttctgttccggcgcctgacgagccgggaggtcctactactgaccatcggtctgtcactcgtggccagcgtcgaactgcccaactccctggaggagctcggcgacgggctggcgatgggcattatgatcctgaaactcctgaccgacttccagtctcaccagttatgggccaccctcctgtcctttacgttcatcaagaccaccttcagcctgcactacgcatggaagaccatggccatggtactctccatcgtaagcttgttccccctgtgcctctccacgacctcacagaaaaccacctggctccccgtcctgctcggctccctggggtgcaagccgctgacgatgttcctcatcgcggagaacaaggtgtggggccgcaagtcgtggccactgaacgaggggatcatggccgtgggcatagtttcgatattgctctccagcctgctcaagaacgacgtgcccttggccgggcccctgatcgctggcggcatgctgatagcctgctacgtgatttccgggagctccgcggatctaagtctggagaaggccgccgaggtctcctgggaagaggaggccgagcacagcggcgcgagccacaatatcctggtggaggtgcaggacgatgggaccatgaagatcaaggacgaggagcgggacgacaccctcacaatcttactgaaggctaccctccttgccgtctctggcgtgtacccgctgtccatccccgccacgttattcgtgtggtacttctggcaaaagaaaaagcagcgcagcggtgtcctttgggacacgcccagcccgcccgaggtggagcgggcggttctggacgacggcatctaccgcattatgcagcggggactactggggcgcagccaggtcggcgtaggggtgttccaggagaacgtcttccacaccatgtggcacgtgacccggggcgccgttctgatgtaccaggggaagcgactggaaccctcctgggcgagcgttaagaaggacctcatctcctacgggggcgggtggcggctgcagggcagctggaacacgggggaggaggtccaggtgatcgcggtggagccgggaaagaaccccaagaacgtgcagaccgcccccgggaccttcaagacgtccgaaggcgaggtcggcgccatcgccctggacttcaagcccgggacgtcggggtcgccaatcgttaaccgcgagggaaagatcgtgggcctctacggcaacggggtggtgacgacctccggcacctacgtgagcgcgatcgcccaggccaaggcctcccaggaggggcccctgccggagattgaggacgaggtgttccggaagcgcaacctgactatcatggacctccaccccggcagcgggaagacccggcgctacctgcccgcgatcgtccgggaggcgatcaagcgcaagctgcggaccctcatcctggccccgacccgcgttgtggcatccgagatggctgaggcgcttaaaggcatgcctatccgctaccaaacgacagccgtgaaaagcgagcacaccggcaaggagattgtggacctcatgtgtcacgccaccttcacgatgcgactgctgtcccccgtgcgcgtccccaactataacatgatcattatggacgaagcccatttcaccgacccgagctccatcgccgcgcgggggtacataagcacccgcgtgggcatgggggaggccgccgcaatcttcatgaccgccacgccgcccggcagcatggaggccttcccccagagcaacgccgttatccaggacgaggagcgggacatcccggagcgctcctggaattcggggtacgagtggattacagacttccccggcaaaaccgtctggttcgtgccctccatcaaaagcggcaacgacatcgccaattgtctcagaaagaacgggaagcgcgtgatacagctgtcccggaagaccttcgacacggagtaccagaagaccaagaacaacgattgggactacgtcgtgaccactgatatcagcgagatgggcgccaacttccgcgcggaccgggtgatcgacccccgccggtgtctgaagccggtcatcctcaaggacgggcctgagcgcgtgatcctggcaggccccatgcccgtcacggtagcgtccgccgcccaacggcgcgggcggatagggcgtaaccacaacaaggaaggcgaccagtacatctacatggggcagcctttgaacaacgacgaggaccacgcccactggaccgaggccaaaatgctactagacaatatcaacacccccgagggcatcattccggcactgttcgagcccgaacgggagaagtccgccgcaatcgacggggaataccgcctccgcggcgaggcgagaaaaaccttcgtggagctgatgcgccgcggggacctgccggtatggctcagctacaaggtggcctccgagggcttccagtacagcgaccgccggtggtgcttcgatggcgagcgcaacaaccaggtgctggaggagaacatggacgtagagatatggacgaaggagggggaaagaaagaagctgcgcccccggtggctcgacgcccgcacctactccgaccccctggccctgagggagttcaaggagttcgccgcgggccgccggagcgtgtccggtgacctcatcctggagatcggcaagctgccccagcaccttactcagcgcgcccagaacgcccttgacaacttagtgatgttgcacaacagcgagcagggcgggcgggcctaccgccacgcgatggaggagctgccggataccatcgaaacgctgatgctgctagccctgatcgccgtcctcaccggaggggtcaccctgttcttcctgtcaggccgggggctcggcaagaccagcatcggcctgctgtgcgtgatggcttccagcgtcctcctgtggatggccagcgtggagcctcactggatcgcggctagcataatcctggagtttttcctcatggtgctgctgatacccgagcctgatcgccagagaaccccgcaggacaaccagctcgcctacgtcgtgattggacttctgtttatgatcctcacggtggccgccaacgagatgggcctgctggagaccaccaagaaggacctagggatcgggcacgcggccgtagagaaccaccaccacgccgccatgctggacgtggacctgcaccccgcctccgcctggaccctctacgccgtggccactaccataataactcccatgatgcgccacaccatcgagaacactacagccaacattagcctcaccgccattgcgaaccaggccgcaatcctgatggggctcgataagggctggccaatctcgaagatggacattggtgtgcccttactggcactcgggtgctacagccaggtgaacccccttaccctcacggcggccgtgctcatgctggtcgcacactacgccataatcggccccgggctgcaggccaaggcgacccgggaggcccagaagcgcaccgccgccggcatcatgaagaacccgaccgtagacgggatcgtggccattgacctcgaccccgtcgtgtacgacgcgaagttcgaaaagcagctgggccaaatcatgctgctcatcctgtgcacgtctcagatcctactcatgcgcacgacctgggccctgtgcgagagcatcaccctggccacaggccccctcacaaccctgtgggaggggtcccccggtaagttttggaacaccactatcgccgtgagcatggccaacattttccgggggtcgtacctggcgggcgccggcctcgcattctcgctgatgaagtcactaggaggcggacgccgggggaccggcgcccagggcgaaaccctcggcgagaagtggaagcgccagctgaaccagctgtccaagtcagaatttaacacctacaagcggtccgggataatggaggtcgaccgcagcgaggccaaggagggcctcaagcgcggggagactaccaagcacgccgtgtcccgcggcaccgcgaagctgcggtggttcgtggagcgcaacctggtcaagccggaggggaaggtgatcgacctcggctgcggccgcggcgggtggagctactactgcgccgggctgaagaaggttaccgaggtcaaagggtatacgaagggcggtcccggtcacgaggagcccatccccatggccacctacgggtggaacctggtgaagctgcactccggcaaggatgtgttctttatcccccccgagaagtgcgacaccctcctgtgcgacatcggggagagctcccccaacccgacaattgaggagggccgcactctccgggtcctcaaaatggtggagccgtggctgaggggcaaccaattctgcatcaagatcctgaacccatacatgccctcagtggtcgagacccttgagcagatgcagagaaagcacggcggcatgttggtgcgcaaccccctgtcccggaactctacccacgagatgtactgggtgtcctgcgggaccggcaacatcgtaagcgcggtgaacatgacctcacgcatgttgctgaaccggttcacgatggcccaccgcaagccgacatacgagcgcgacgtggacctgggggccgggacccggcatgtcgcggtagagcccgaggtggccaacttggacatcataggccagcgcatcgaaaacatcaagcacgagcacaagagcacctggcactacgacgaggataacccctacaagacgtgggcgtaccacgggtcctacgaggtcaagccctcgggaagcgcctccagcatggtgaatggggtcgtgaagctgctgaccaagccgtgggacgtgatccccatggtcacccagatcgccatgaccgacacaaccccctttggccagcagagagtgttcaaggaaaaggtggacacccgcacccccaaagccaagcgggggacggcccagattatggaggtcaccgccaagtggttatggggcttcctgtcccgaaacaagaagccgcggatttgcacccgcgaggagttcacccgtaaggtgcgcagcaacgccgccatcggcgccgtcttcgtcgacgagaaccaatggaactccgcgaaggaggccgtagaggacgagcggttctgggacctggtgcaccgcgagcgggagttgcacaagcaggggaagtgcgcgacgtgcgtctacaacatgatgggcaagcgcgagaagaagctgggggagtttggaaaagccaaggggagccgggccatctggtacatgtggctgggcgcccgcttcctcgaattcgaggctctcgggttcatgaacgaggaccactggttcagtcgggagaacagcctgtccggggtggagggcgaggggcttcacaagctggggtacatcttacgcgatatcagcaagatcccggggggcaacatgtacgccgacgacacggccggatgggacacccggatcaccgaggacgatctccagaacgaggccaagatcacggacatcatggaacccgagcacgcgctgctggccaagtccatcttcaagctcacctaccagaacaaggtcgtccgcgtacagagacccgctaagaacgggaccgtgatggatgtcatcagccgccgcgaccagcggggctccggccaggtgggcacctacggcctgaatacgttcaccaacatggaggcccagctgatccgccagatggagagcgaggggatcttctcccccagcgagttggaaacccccaatctggccggcagagtgctggactggctcgagaagcacggggtcgagagactgaagcggatggcgatctccggcgacgactgtgtggtgaagcccattgacgaccgcttcgccaccgccctgactgctcttaacgacatgggtaaggtcaggaaggacatcccgcaatgggagccgtctaagggctggaacgattggcagcaggtccccttttgcagccaccacttccatcagctgatcatgaaggatggccgcgagatcgtggttccctgccggaaccaggacgagctggtggggcgcgcccgggtgtcccagggcgcggggtggagcctccgagagaccgcctgcctgggcaagtcctatgcccaaatgtggcagctgatgtattttcaccggcgtgacctccggctggccgccaacgccatatgtagtgcagtcccagtggactgggtgcccacctcccgcaccacgtggagcatccacgcccaccaccaatggatgaccaccgaggacatgctgtcggtctggaatcgggtgtggatagaggagaacccctggatggaggataagacccacatcagctcctggggcgacgtgccttatctcggcaagcgcgaggatcagtggtgcggctcactgattgggctgactgcccgggcgacctgggccaccaacatccaggttgccatcaaccaggtgcgccgcctcatcggcaacgagaactacctagactacatgacctccatgaagcggttcaaaaatgagtcggacccggagggggccctgtggtga

SEQ ID NO: 24453 - RNA, 9879 nt, synthetic construct
  misc_feature 1..9879: note = derived and/or modified CDS sequence (opt11) from DENV-1__GU131741__SS-prME
  source 1..9879: mol_type = other RNA
agcgtaaccatgctactcatgctcatgcccaccgccttggcctttcacctcactacgcggggcggggaaccccatatgatcgtttcaaaacaggaacggggcaaatcactgctgttcaagaccagcgccggggtgaacatgtgtactctgatcgccatggatttaggcgagttctgcgaggacaccatgacctacaagtgtccccgcattaccgaagctgaaccagacgacgtcgattgctggtgcaacgccaccgacacatgggtgacatatggaacgtgcagccagaccggggaacatcgccgggacaaacggtccgtcgcactagctccccacgtgggcttgggtctggagacacgcaccgaaacgtggatgtcatctgagggagcgtggaagcagatccagcgggtagaaacctgggccctgcgccatcccgggttcacggtgatcgcactctttctggcgcacgccatcggcacctcgatcacccaaaagggaattatcttcatactgctcatgttggtaactccctccatggccatgcggtgcgttgggatcggcagccgcgacttcgtggaggggttatccggtgccacgtgggtcgacgtcgtcctcgagcacggctcgtgcgtcaccaccatggccaaggataagcccaccctagatatagagctgctcaagaccgaggtaactaaccccgcggtgctgagaaagctttgcatagaggccaagatctcaaataccacgacggactcccgttgcccgacccagggcgaggcgaccctcgtggaggagcaagacgcaaatttcgtctgccggcgcacctttgtggaccgtgggtgggggaacggctgcggtctgtttggcaaagggtccttaatcacgtgcgccaaattcaagtgcgtaacaaaactcgagggtaagatcgtccaatatgagaacttaaagtatagcgtgatcgtgacggtgcacacaggcgaccaacaccaggtgggaaacgagtcgacggaacatggcaccaccgcgaccatcacgccacaagctcctagcacggagatacagctaacggactacggggcactcacactggactgcagcccgagaaccggcctggacttcaacgagatggtccttctcaccatgaaggagaaaagttggctggtacacaagcaatggttcctcgacctgccgctgccttggacgagcggggtgtccacaagccaggagacctggaacaggaaggacctcctggtgacgttcaaaaccgcacatgccaagaagcaggaggtagtagtcctcggctcccaggagggcgccatgcacaccgccctcaccggggccaccgagatccaaaccagcggcaccaccacgatcttcgctgggcaccttaaatgccggctgaaaatggataagctgacactgaaaggcatgtcctacgttatgtgcaccgggagcttcaagctggagaaggaagtcgccgagacccagcatggtactgtcctcgttcagattaagtatgagggtaccgacgcgccctgcaagatacccttctccacccaggacgagaagggggtgacccagaacggtcgtctgataacggccaacccgatcgtcaccgacaaggaaaaacctgtgaacatcgaagcagagccgccattcggtgagagctacattgttattggcgcgggcgagaaggcgctgaagctgtcctggttcaagaagggtagctccatcggtaagatgttcgaagcgaccgcccgtggggccagacgaatggcaatcctcggggacactgcttgggacttcggctcaataggcggcgtcttcacgagtgtggggaagctggtacaccagattttcgggacagcctatggggtacttttctcaggcgtctcctggaccatgaagatcgggattggagtgctcttaacatggctaggactcaactccagaagtacgagcttatccatgacctgtatcgcggtaggtctggttactctctacctgggcgtaatggtccaggctgacagcgggtgcgtgatcaactggaaggggcgggagctgaagtgcgggagcggcatattcgtgaccaacgaggtccatacgtggactgaacagtacaagttccaggccgattccccgaaacgtctcagcgccgccattggcaaggcctgggaggagggggtttgcggcatccggtccgcgaccagactagagaacatcatgtggaagcaaattagcaatgaactgaaccacatccttctggagaacgatatgaaattcaccgtggtggtcggggacgtggccggcatcctggcgcaggggaagaagatgatccgtccccagcccatggagtacaagtacagctggaagagttggggcaaggcgaagataatcggcgccgacgtccaaaacaccactttcataatcgacgggcctaataccccggagtgccccgatgaccagcgggcctggaacatctgggaagttgaagactacggcttcgggattttcaccaccaatatctggctcaagctgcgtgattcttacactcaagtgtgcgatcaccggctgatgagcgctgccatcaaggactccaaagccgtccacgccgacatgggctactggatcgaaagcgagaagaacgagacctggaagctcgcccgggcgagcttcatcgaggtgaaaacgtgcatctggcccaagtcccatacactgtggtccaacggcgtgttagagtcggagatgatcatacccaaaatctacggtggccctatcagccaacacaactaccgccccgggtatttcacgcagacggccggtccctggcacctcgggaagctagaattagacttcgacctctgcgagggcaccaccgtcgtggtggacgaacattgcgggaaccgggggccatcgctgagaacgaccacagtcaccggaaaaatcatccacgagtggtgctgtcggtcctgcacgctaccgccactgcgcttcaagggggaggacggctgctggtatggaatggagattcgtccggtaaaggagaaagaagagaacctggtcaagagcatggtttctgccggtagtggtgaggtagacagcttctccctagggttactgtgtataagcatcatgatagaggaggtgatgcgctcacggtggagccgcaagatgctgatgaccggcactctcgctgtattcttccttctgatcatggggcaacttacctggaacgacctaattcggctgtgcattatggtgggtgcgaacgcgtccgatcggatggggatgggcacaacttatctcgcactcatggccaccttcaaaatgagaccgatgttcgcggtgggcctccttttcaggcgcctgacttcgcgggaggttctcctcttgacgataggactgtccttagtcgcctctgtcgagttacctaactccctggaagaactgggagacggactggccatggggattatgatactcaagctcttgacggatttccagagccaccaactctgggccacgctcctgtcgctgaccttcatcaagacgaccttttcgctccactacgcttggaagaccatggctatggtcctgtccatcgtaagccttttccccctctgcttatcaacaacgagccaaaaaacaacctggctgcccgtcctcctgggctccctagggtgcaagccgctgaccatgttcctaatcgcggaaaacaaaatctggggccggaaatcgtggccactgaacgaggggatcatggccgtgggcatagtgagcattttgttatccagcctgctcaagaacgacgtccccctggccgggccccttatcgcgggcggcatgctcatcgcctgctacgtgatctcagggagctcggcggacctgagcctggagaaggccgcggaggtctcctgggaggaggaggccgagcatagcggcgcctcccacaacatcttggtcgaggtccaggacgatgggacgatgaagatcaaagacgaggagcgggacgacaccctgacaatcctcctcaaggcgacactgctagcggtgtctggcgtctatccgctctccatccctgctacgctgttcgtgtggtacttctggcagaagaagaagcagcgaagcggggtcctatgggacacgcccagcccgcctgaagtcgaacgggccgtgcttgacgacgggatatatcgaatcatgcagcgcgggctactcggtcggagccaggtgggcgttggcgtattccaggagaacgtgttccacaccatgtggcacgtcacacggggcgcagtgttaatgtaccagggcaaaaggctcgaaccttcctgggcgagcgtgaagaaggacctgatatcctacggtggggggtggcggttgcagggcagctggaacaccggggaagaggtccaagtgattgctgtggagcccggcaagaaccccaagaacgttcagacggcccccggtacgttcaaaacctccgagggcgaggtgggagccatcgctttagactttaagcctgggactagcggatctccaatcgtgaaccgcgaagggaagatcgtcggactgtacgggaacggagtggtgaccacatccggcacctatgtcagcgcaatcgcgcaagcaaaggcctcccaggagggacccctgccggagatcgaggacgaggtgttccgaaagcggaacctcaccatcatggacctgcacccgggttcagggaagacccgccgttacctacccgcgatcgtgcgggaggccatcaaacgcaagttacggacactgattctggccccgacccgcgtcgtagcttccgaaatggccgaagctctcaaaggcatgcccattcgctaccaaaccacggcagttaagtcggagcatacaggaaaagagatcgtcgacctgatgtgtcacgccactttcaccatgcggctgttatcccccgtgcgcgtgcccaattacaatatgatcataatggacgaggcccactttacggaccccagctccattgccgcgaggggttacatctccaccagggtcggcatgggggaggccgccgccatctttatgactgccacgccgcccgggagtgtcgaagcgttcccccaaagcaacgcagttatccaggacgaggagcgggacattcccgagcgctcctggaactccgggtatgagtggataactgatttccctgggaaaaccgtctggttcgtgccatccatcaagagcggtaacgacatagccaactgcctgaggaagaacgggaagcgcgtaatccaactgtcccgaaaaacctttgacaccgagtaccagaagactaagaacaacgactgggactacgttgtaacgaccgatatctcggagatgggcgcgaacttccgcgccgatcgagtgatcgacccacgccggtgcctcaaaccagtgattctcaaagatgggcccgagcgcgtgatccttgccgggcccatgcccgtcaccgtggcctccgccgcccagaggcgcggcagaatcggccgcaaccacaacaaagagggagaccagtatatatacatggggcagccgctcaacaacgatgaagaccacgcccactggacggaggccaagatgctgctggataacatcaacacacctgagggcataatccctgccctgttcgagcccgaacgggaaaagtccgccgcgatcgatggtgagtataggttacgaggcgaggcgcgaaagacgttcgtggagcttatgagacgcggggacctcccggtctggttatcatacaaggtagcatcagaaggctttcagtactccgacagacgatggtgcttcgacggtgagcggaacaaccaggtgctggaggaaaacatggacgttgagatctggacaaaggaaggcgaacggaagaaattacgcccccggtggctggacgcccgcacgtactccgatccactggctttgcgggagttcaaggagtttgccgccggcaggcggtccgtgtccggggacctgatcctggagataggcaaattgccgcagcacctgacccagcgcgcccagaacgcccttgacaacctcgttatgctgcacaacagcgagcaaggcgggcgggcttaccgccacgcgatggaggagctgccggacaccattgagaccctcatgctgctggccttgatcgccgtcctgaccggcggtgtgaccttgttcttcctctccggccgcgggctcggcaagacctcgatcggtctgctctgcgtgatggcttcgagtgtactgctctggatggcttccgtggagccccactggattgcggcgtccatcattttagagttctttctaatggtactactcatccccgaaccagaccgccaacggaccccgcaggacaatcaactggcctatgtcgtcatcgggttgctctttatgatcctgaccgtggctgccaacgagatgggactgcttgagacgaccaagaaagacctggggatcggccatgtcgcagtggagaaccaccaccacgccgcgatgttggacgttgacttgcaccccgcatcagcttggaccctgtatgcggtcgcgacgacaatcatcacccccatgatgcgtcatacaatcgagaatacaacagccaatataagcctgacagccatagccaaccaggccgctatcctcatgggcttggacaagggctggccgatctccaagatggacatcggcgtgccactgcttgccttggggtgctacagccaagtaaatcccttgacactcaccgccgcggtcctgatgttggtggcccactacgcgataatcggcccaggactccaggcgaaggctactcgggaggcccagaagcgcacggcagctggcatcatgaaaaacccgaccgtggacgggatagtcgccatagacctagatcccgtggtgtacgacgccaagttcgagaaacagttaggacagatcatgctcctgatcctttgcacatcccagatcttgcttatgcgcacgacctgggcgctgtgcgaaagtattacgctagccacagggccgctgacgaccctgtgggaggggtcgcccggcaagttctggaatactaccattgcagtgagtatggccaacatcttccgggggagctacctcgccggcgcgggcctcgccttttccctcatgaagtccctcgggggcgggcgccgaggcacgggggcccagggagagaccttaggagagaagtggaaaaggcagctgaaccagctctctaagagcgagttcaacacctataaacgtagcgggattatggaggtagaccgcagcgaggccaaggagggtctgaagcgtggagagacgacgaaacatgcggtgtccaggggcacagccaaactacgttggttcgtcgaaagaaatctcgtgaagccggaggggaaggtgatcgacctgggctgcggccgcggcgggtggagctactactgcgcggggctcaaaaaagtcacggaggtgaaggggtacacaaagggcgggcccggccacgaggagcccatccctatggctacgtatgggtggaatctggtgaaactgcacagcggcaaggacgttttttttatccctccggagaaatgcgacaccttgctgtgcgacatcggggagtcttctcctaaccctaccattgaggaaggcagaaccttacgggtgttaaaaatggtggaaccgtggctccgcgggaaccagttctgcatcaagatcctcaacccctacatgccaagcgtcgtcgagacgctggagcagatgcaaagaaaacatggaggcatgctggttagaaaccccctatcgcggaatagcacccacgagatgtactgggtctcctgtgggaccggcaacatcgtaagcgcggtaaacatgacctcccggatgctgctgaaccgatttaccatggcgcaccgcaaaccgacgtacgagagagacgtcgatctcggggctggcacccggcatgtggccgtggagcctgaggtcgcgaacttggacatcattggccagcgcatagaaaacatcaaacacgagcacaagtcgacttggcactacgacgaggataatccgtacaagacctgggcctaccacgggtcttacgaagtgaagccctcaggcagcgcttccagcatggttaacggcgtggtgaagctgttaacgaagccgtgggatgtcatccccatggtgacgcagatcgccatgacggataccacgccattcggacaacagcgggtgttcaaagaaaaggttgacacacggacgcccaaggccaagcgcgggactgcccagatcatggaggtcacggcgaaatggctatggggcttcctatcccgaaataagaagccccggatctgtaccagggaggagttcacccggaaggtgcgcagcaacgcggccatcggcgccgtcttcgtggacgaaaaccagtggaactccgccaaggaagcggttgaagatgagcggttctgggatttagtccaccgcgagcgggagctgcacaagcaagggaagtgcgcgacgtgcgtatacaatatgatgggcaagcgcgagaagaaattaggcgaatttgggaaggctaaggggagccgcgccatctggtacatgtggctcggcgcccgtttcctggagttcgaggcgctgggcttcatgaatgaagaccattggttctcccgggagaatagcctgagcggggtggaaggagaagggctacacaagctggggtatatactacgcgacatctcaaagattcccgggggcaatatgtacgccgacgatacggctggctgggacactcgtatcaccgaggacgacttacaaaacgaagccaagatcaccgatatcatggaacccgaacacgcgttgctcgcaaaatccatattcaagctaacgtaccagaacaaggtcgtgagagtgcagcggccagccaagaacggaaccgtcatggacgtcatcagccgccgagaccagcgtggctcaggccaggtgggcacttatggcttgaacacctttacgaatatggaggcacagctcatccggcaaatggaaagcgaagggatcttttcccccagcgagttagagacccccaacctcgccggacgggtcctcgactggttggagaagcacggggtagagcgcctaaagcgcatggcgatctccggggacgactgcgtcgtcaaacccatagatgatcgattcgctaccgccctcaccgcactgaacgacatggggaaggtgcggaaggacatcccgcagtgggagccctcaaagggctggaacgattggcagcaagtacccttctgcagccaccacttccatcagcttatcatgaaggacggccgggagatcgtcgttccctgccggaaccaggacgagttggtagggagagcccgggtctcacagggcgccggttggagtctgcgcgagactgcttgtctgggaaaatcttacgcccagatgtggcagctcatgtactttcaccggagggatctccggctggcggctaatgcgatctgtagtgccgttcccgtcgattgggtgcccacctctcgaaccacctggagcatccacgcccatcaccagtggatgacaaccgaagacatgctctcggtgtggaaccgggtgtggattgaggagaacccctggatggaggacaagacccacatcagctcctggggcgacgtgccctacctgggcaagcgcgaggaccagtggtgcggcagcttgatagggctcaccgcccgggcaacgtgggcgaccaatatccaggtcgccatcaaccaggtgcgccgtttgatcggcaacgagaattacctagactacatgacatcaatgaaacggttcaagaatgagagcgacccagagggggctctctggtag

SEQ ID NO: 24454 - RNA, 9879 nt, synthetic construct
  misc_feature 1..9879: note = derived and/or modified CDS sequence (opt11) from DENV-1__GU131743__SS-prME
  source 1..9879: mol_type = other RNA
agcgtgactatgctgctcatgctgatgcccacagcactggcctttcacctcaccacccggggaggcgaaccgcacatgatcgtgtcaaaacaagaacggggtaagtcattgctattcaagaccagcgcgggtgtgaacatgtgcaccctcatcgcaatggacctaggcgagctgtgcgaggacaccatgacatacaagtgcccccgcatcaccgagaccgagcccgacgatgtggactgctggtgcaacgccacggacacctgggtgacctacgggacctgcagccaaaccggagagcaccggcgcgacaagcgctccgtggccttagcgccacacgtgggcctggggctggagacccgcacagaaacatggatgagctctgagggcgcgtggaagcagatccagcgggtagagacgtgggccctccgccaccccgggtttaccgtgattgccctgtttctggcacacgccatcggtaccagcattacccagaagggtatcatcttcatcttactgatgctggtgacaccctccatggccatgcggtgtgtcggcatcggtagccgcgacttcgtggaaggcctctccggcgccacctgggtggacgtcgtgttggagcatggatcgtgcgtgacaaccatggccaaggacaaacctactctggacatcgagctactgaagaccgaggtcacaaaccccgccgtgcttcggaagttatgcatcgaggccaaaatttccaataccacgaccgacagtaggtgcccgacccagggcgaggccaccctcgtggaggagcaagacgccaacttcgtgtgcagacgaacgtttgtggaccggggctgggggaacggctgtgggctgttcggcaaagggtccctcatcacgtgcgccaagtttaagtgcgtgacgaagctggaggggaagatcgtccagtacgaaaacctgaagtactccgttatcgtgaccgtccacacgggcgaccagcaccaggtgggtaacgagtccacagagcatggcaccaccgccacgatcacgccccaggcgcccaccaccgagatccaactcaccgactatggggccctgacgctggattgcagcccccggaccggactcgacttcaacgagatggtcctgctaaccatgaaggaaaagtcttggcttgtgcataagcagtggttcctggacctgccgcttccatggaccagcggtgcctctacttcacaagagacctggaatcggcaggacctgctggtaaccttcaagaccgcccatgccaagaagcaggaggtcgtggttctcggcagccaggagggcgcgatgcacacagccctgactggggccaccgagatccagacttccggaacgaccacaatattcgccgggcacctgaagtgccggctcaagatggacaagctcacactaaagggcatgagctacgtgatgtgcacggggtccttcaagctcgagaaggaggtggccgagactcagcacggcaccgtgctggtccagataaagtacgaaggcaccgacgcgccctgcaagatccccttcagcacgcaggacgagaaaggtgtgacccagaacggcaggttaatcactgccaaccccatcgtgaccgacaaggagaagccggtcaacatagaggccgagccgcctttcggggagtcctacatcgtgattggcgccggcgagaaggctctgaagctcagctggttcaagaaggggtcgagcatcggaaagatgttcgaggccacggccagaggggcgcggcgcatggccatccttggcgacaccgcgtgggacttcgggtccatcggcggcgtgtttaccagcgtggggaagctggttcaccagatcttcggcactgcctacggggttcttttctctggggtcagctggacgatgaagatcgggatcggcgttttgcttacctggctgggcctgaactcccgaagcacctccctgagcatgacctgcatcgcggtggggctcgtcacgctgtacctgggagtgatggtccaggccgactccggctgcgtaatcaactggaagggccgggagctcaagtgcgggagcggaatattcgtcaccaacgaggtgcacacctggactgagcagtacaagttccaagccgattctccgaaacgcctgtccgcggccataggcaaggcctgggaggagggggtctgcggcataaggtccgccacccggctagagaacatcatgtggaagcaaatatccaatgagctcaaccacatcctgctggaaaacgacatgaagttcactgtggtagtcggagacgttgcgggcatcctcgcgcagggcaagaaaatgattcggccccagccaatggaatacaagtatagttggaaatcctgggggaaggccaagattatcggcgccgacgtgcaaaacaccaccttcatcatcgatgggccaaacaccccggagtgccccgacgaccagcgcgcctggaatatttgggaggtcgaggactacggcttcgggatcttcacgaccaatatctggctgaaactgcgggattcctacacccaggtgtgcgaccaccgcctgatgtccgcagccattaaagactctaaggccgtacacgccgacatggggtactggatcgagtctgagaaaaacgagacatggaagctggcccgggccagcttcatcgaagttaagacgtgcatttggcccaagtcccacaccctgtggagcaacggcgtgttagagtccgagatgatcatccccaagatatacgggggccccatcagccagcacaactatcggcccgggtatttcacacaggccgccggcccctggcacctggggaagctggagctcgattttgatctgtgtgagggcacaacggtggttgtagacgaacactgcggaaatcgggggccgtcactgcgcacaactaccgtgacgggaaagatcatccacgagtggtgctgccggagctgtaccttgccgcccttacgattccgcggggaggatggctgctggtacggaatggagatcagacccgtcaaggaaaaggaggagaacctggtgaagtccatggtaagtgccggcagcggcgaggtcgactccttcagcttagggttactgtgcatctctatcatgatcgaagaagtaatgcggtcccgttggtcccggcgcatgctcatgaccggcaccttagccgtgttcttcctgctcatcatggggcagctaacgtggaacgacctgatacgattgtgcatcatggtaggcgctaacgcaagcgataggatggggatgggcaccacctaccttgccttaatggccacctttaagatgcgcccgatgttcgcagtgggcctcctgttccggcgcctcacgagccgggaagtgctcctgctgaccatcggcttatcacttgtcgcgtccgtggagctgcctaatagcctcgaggagctgggcgatgggctggccatgggcatcatgatcctgaagctgttgaccgacttccaatcccaccagctctgggccaccttattatctctcacgttcataaaaaccacattttccctgcactacgcctggaagacgatggcgatggtcctgagcatcgtctccttgttccccctgtgtctgtccacaacctctcagaagacgacgtggctccccgtgctgctgggcagcttggggtgcaagccgctgacaatgttcctgatcgctgagaataagatctggggacgccggtcctggccattgaacgaggggatcatggccgtcggaatcgtgagcatcctgctgagcagcctcttgaagaacgacgttcccctggccggtcccctcatcgcgggcggcatgctcatagcgtgctacgtgatcagcgggtcctccgccgacttatctctcgagaaggccgcagaagtgtcatgggaggaagaggccgaacactccggcgcgtcccataacatcctggtggaggtgcaggacgacgggaccatgaaaatcaaggatgaggaacgcgacgataccttaacaatcctcctgaaagccactctactcgccgtgagcggcgtctaccccctgagcattcccgcgactcttttcgtctggtacttctggcaaaagaagaagcaacggtccggggtgctctgggacaccccttcgccgcccgaggtggagcgagccgtcctggatgacggcatctaccgcatcatgcagcgcggcctgctgggacggtcccaggtcggcgtcggggttttccaggagaacgtgtttcacaccatgtggcacgtgacgaggggcgcggtactcatgtatcaaggcaagcggttggagccttcatgggcttccgtgaagaaggatctgatcagctacggcggcggctggcgccttcagggctcctggaacacgggggaggaggttcaagtgatcgccgtggagcccggcaagaatcccaagaacgttcaaacggcccccggtacctttaaaacgccagagggcgaggtcggggctatcgcgctggacttcaagcccgggacgagcggttcccccatcgtgaaccgcgaggggaagatcgtgggcctgtacggcaacggtgtagtgaccaccagcggcacctatgtgagcgcgattgcccaagccaaggcctcccaggagggccccctccccgagatcgaggacgaggtgttccggaagcgaaacctgacgataatggatctgcaccccggcagcgggaagacccgacggtacctcccggcaatcgtgagagaggcgatcaagcgtaaactacggaccctcatcctcgcccccacccgcgtcgtagcctcggagatggcggaagcgctgaagggcatgccaattcggtaccaaacgacggcggtcaagagcgaacacaccggcaaggagatcgtggacctgatgtgccacgccacctttaccatgcgtctcctgtcccccgtcagagtgcctaactacaacatgatcatcatggacgaggcccactttaccgacccctcgtccatcgcggcacgcgggtacatcagtacccgggtcggcatgggcgaggccgccgccatctttatgacagcgacgccacccggcagtgtcgaggccttcccgcaaagcaacgccgtcatccaggacgaggagcgcgacatacccgagcggtcctggaactcagggtacgagtggatcacagacttccccggtaagaccgtctggttcgttccctcaatcaagagcggcaacgacatcgccaactgtctgcgcaagaacggaaagcgggtcatccaactctcaaggaagacgttcgacacggagtaccagaagacgaagaacaacgactgggactacgtggtcaccaccgacataagcgagatgggcgcaaactttagggccgatcgcgttatagacccgcgccgttgcttgaagcccgtgatcctgaaagacgggcccgagagggtcatcctcgccgggcccatgcccgtgaccgtcgcctccgccgcgcagcgacgggggcgcataggccgcaatcacaacaaggagggcgaccagtacatctacatgggccagcccttaaacaatgacgaggaccacgcgcattggactgaggctaagatgctgctcgacaacataaacactcccgagggcataatccccgccctatttgagccggagcgggagaaatccgccgcgatcgacggtgagtatcgcttgcggggcgaagctcgcaagacctttgtggagttgatgcggcgcggtgacctgcccgtgtggctgtcgtataaggtcgctagcgagggcttccaatatagcgacagacgctggtgcttcgacggcgagagaaacaatcaagtcctcgaggagaatatggacgtggaaatctggacgaaggagggggaacgcaagaagttacgcccccgttggctggacgcccggacctactccgacccgctcgccctgcgcgagttcaaggagttcgccgccggaaggcgcagcgtctccggggacctgatactagagatcggtaagctgccgcagcatctgacccagcgtgcccagaatgccctcgacaacttggtgatgttacacaattctgaacagggagggagggcgtaccggcacgccatggaagagttgcccgacaccatcgagacactcatgctgctcgccttaatagctgtgctgacgggcggggtcaccctcttcttcctgtcgggtcgtgggctgggcaagaccagcatcggtctcctgtgcgtgatggcttcctcggtgttgctctggatggcgtcagtagagccgcactggattgccgccagcattatcctggagttcttccttatggtgttgttaatacccgagccggaccggcagcgcacgccccaagacaaccaactggcctatgtggtcatcgggctcctcttcatgatccttacggtggccgcaaacgagatgggcctcttagaaaccaccaagaaggacctggggattggccacgtggctgtcgagaaccatcaccacgcggcgatgctcgacgtggacttgcaccccgcgagtgcgtggaccctgtatgccgtggccacgaccatcatcaccccgatgatgcgccacaccatcgagaacacgaccgccaacatttcgctcaccgcgattgcaaaccaggccgccatcttgatggggctggacaagggctggccgatctccaagatggacatcggcgttcccctcctggcgctgggttgctacagccaggtaaacccgcttaccctgacggcggccgttctgatgttggtcgcccactacgccatcataggccccgggcttcaggccaaggccactcgtgaggctcaaaaacgtaccgcggccggcatcatgaagaaccctacagtggacgggatcgtagcaattgacctggacccagtagtgtacgacgcgaagttcgagaagcagcttggccagataatgctgctgattctctgcacgtcccagatactgctgatgcggaccacctgggctctttgcgagagcatcaccctagccacgggccccctgaccaccctctgggagggttcccctggcaaattctggaacaccacgatcgcagtgagcatggccaacatctttcgcgggtcctatttggcgggggccggtctggccttttcgctcatgaagtccctcggaggcgggcggcgcggaaccggggctcagggagaaaccctgggcgagaagtggaaacggcagctcaaccagctgtccaaatcagagttcaacacctataagcgctccggaataatggaggtcgaccgaagcgaggcgaaggaaggcctgaagcgaggtgagacgaccaagcatgccgtgagccggggcaccgccaagctacgctggttcgtggagagaaacctcgtcaagcccgagggcaaggtgatcgacttaggctgcggccgagggggctggagctactactgcgcggggttaaagaaggttaccgaggtaaagggctacactaagggcgggcccggccatgaggagccgatccctatggccacctatgggtggaacttggtgaagctgcactccggtaaggacgtgttcttcataccgcccgagaagtgtgacaccctattgtgcgacattggtgagtcatcccccaatcccaccatcgaggagggcaggactctgcgcgtcctgaagatggttgagccctggctccggggaaaccagttctgcataaaaatactcaacccctacatgccaagcgtggtcgagaccctggagcagatgcagcgcaaacacggtggcatgttggtgcgaaatcctttatcgcgcaactcgacccacgaaatgtattgggtgtcctgcgggacgggcaacatcgtcagcgcggtgaacatgacctcccgcatgctccttaaccggtttaccatggcccaccgcaagcccacgtacgagcgggacgttgatctgggagccggcaccaggcacgtcgctgtggagcccgaggtggccaacctggacgtcataggccagcggatcgagaacatcaagcacgagcacaaatccacctggcactacgatgaggacaacccatacaagacttgggcgtaccacgggtcctacgaggtgaagccaagcggcagtgccagctcgatggtcaacggggtagtgaagttgctgaccaagccctgggacgtcatccccatggtgacccagatcgcaatgactgacacgactccgttcgggcagcagagggtgttcaaggaaaaggtcgacacccggaccccgaaggccaagcgcgggacggcccagatcatggaggtgactgctaagtggctgtggggcttcctctcgcgcaacaagaagccccgcatctgcacccgggaggagttcacccgcaaggtgcggagtaacgccgccattggcgccgtcttcgtggacgagaaccaatggaactctgcgaaggaggccgtggaggacgagcgcttttgggatctagtccaccgggagagggaactgcataaacaggggaagtgcgccacgtgcgtttacaacatgatgggtaaacgggagaagaagctgggcgagttcggcaaggctaagggaagccgcgccatctggtacatgtggctgggcgcgcggttcctcgagttcgaagccctcggattcatgaacgaagatcactggttctctcgcgagaacagcctgtccggggtggagggcgaggggctacacaaacttggctatatcctgcgggacatcagcaagatccccggaggtaacatgtacgccgacgacaccgccggctgggatacccgcatcacagaagacgacttacagaacgaggcccgtatcacggacattatggagccggaacatgcactactggctaagtccattttcaagctgacctaccagaacaaagttgtacgagtgcagcgccccgctaagaacgggaccgtcatggacgtcatcagccggcgcgatcagcggggctccggccaggtggggacctacggtttgaacacgttcaccaacatggaggcacagctgatccgccaaatggagagcgaggggatcttctctcccagcgaactcgaaacccccaatctcgccgagcgggtcctcgactggctgggcaagtatggggtagagcgcctcaagcggatggcgatatccggtgacgactgcgtggtcaagccaattgacgaccgcttcgccaccgccctgacggccctgaacgacatggggaaggtgcggaaagacatcccccagtgggagccatcaaagggctggaacgactggcaacaggtccccttctgcagtcaccacttccaccagctcattatgaaggacggccgcgagatcgttgtgccgtgccgaaaccaagacgagctggtgggtcgcgcgcgggtcagtcagggcgcgggctggagccttcgcgaaaccgcgtgcctcggcaagtcctacgcccaaatgtggcagctgatgtacttccatcggcgcgatctacgtcttgccgccaacgccatctgcagcgcggtgccagtggattggattcccacatcacgcactacgtggtctatccacgcccaccaccagtggatgaccacggaggacatgctgagtgtctggaacagggtgtggatcgaggaaaacccctggatggaagacaagacacacatcagctcatggggcgacgttccgtacctgggcaaaagagaggaccagtggtgcggcagcctcattgggttgacggcccgcgcaacctgggccaccaacatccaggtcgccattaaccaggtccggcgtctgatcggcaacgagaactacctcgattacatgacctccatgaagcgattcaagaacgaaagcgaccccgagggggcattatggtga

SEQ ID NO: 24455 - RNA, 9879 nt, synthetic construct
  misc_feature 1..9879: note = derived and/or modified CDS sequence (opt11) from DENV-1__JN093516__SS-prME
  source 1..9879: mol_type = other RNA
agcgtgaccatgctgttgatgctgatgcccaccgcgctggcattccatctcacgaccagagggggtgaaccgcacatgatcgtctccaagcaggaacggggcaagtccttgttgttcaagaccagcgccggagttaacatgtgcaccctcatcgccatggacctgggcgagttctgcgaggacactatgacctacaaatgcccgcgaattaccgaggccgaaccagacgacgtggactgttggtgcaacgccacggacacgtgggtgacctacgggacctgcagccaaacgggcgaacacaggagggacaagcggtccgttgcactggcgcctcacgtggggctcgggttagagacgcgcaccgagacctggatgagctccgagggtgcctggaagcaaatccaaaaagtggagacctgggcactgcggcacccggggtttacggttatagccctctttcttgctcacgcgatcggtacctccataacccagaaggggatcatcttcatactgctcatgctggtgaccccctccatggccatgcgatgcgttggcatcggaagccgggacttcgtggaggggctgtctggcgccacatgggtggacgtcgtgcttgagcacgggagctgcgtcaccaccatggccaaggacaagcccactctggatatcgagctgctgaagactgaggttaccaaccctgcggttttacgcaaactttgcatcgaagcaaagatatcaaacaccacaaccgatagccgttgcccgacacagggcgaggccaccctcgtggaagaacaggatgccaactttgtgtgccgaaggaccttcgtggataggggatgggggaacggctgtgggctgttcgggaaggggtcgctgattacgtgcgccaagttcaaatgcgtgaccaaactcgaggggaagaccgtccagcatgagaacttaaagtactcagttatagtaaccgtacataccggggatcaacaccaagtgggtaacgagtctaccgagcacggaaccactgcgactatcacgcctcaggccccctctaccgagatccagctgaccgactatggagctttaacactcgactgcagcccccggacaggcctggacttcaacgaaatggtcctcctgaccatgaaagagaagtcttggctggtgcacaaacaatggttcctagacttgccgctgccctggaccagcggggccagcacttcgcaggagacatggaaccgcaaggacctcctcgtgaccttcaagaccgcccacgcgaagaagcaggaggtggtggtgctgggctcccaggagggcgccatgcacaccgccctgacgggcgcaactgagattcaaaccagcggcaccacgaccatattcgccggtcacttaaagtgtcggctaaaaatggacaagctcacccttaagggcatgtcctacgtcatgtgtactggctcctttaagctggaaaaggaagtagccgagacgcagcatggcaccgtgctcgtccagataaagtatgagggaacagacgcgccatgcaagatcccattttccacccaggatgagaagggtgtaacgcagaacggccgcctcatcaccgccaatccgatagtgacagacaaggagaagcccgtaaacatcgaggccgaaccgccctttggagagagctacatcgtgatcggcgccggtgaaaaggcactaaagctgagctggttcaagaaagggtcatcgatcggcaagatgttcgaggccaccacgcgcggggcccgacggatggctatcttgggcgacaccgcatgggactttgggagcatcggtggcgtgttcacgtccgtgggcaaactcgtgcaccaaatattcggcaccgcctacggggtcctcttcagcggggtcagctggacgatgaagatcgggatcggggtactactgacctggctgggcctcaacagccgctccacctctctgagtatgacctgcatcgccgtggggctcgtcacgctttacctaggggtgatggtgcaggccgacagtgggtgcgtaatcaattggaaaggacgcgagctgaagtgcggatccgggatcttcgtgacaaacgaagtgcacacttggacggagcaatacaagttccaggcagattccccgaaacgactaagcgctgcaatcggcaaggcatgggaagagggtgtctgcggcatccgtagcgccacccggctggaaaacatcatgtggaagcagatcagcaacgagctgaatcatatcctcctggaaaacgacatgaagtttacagtggtagtcggggatgttgccgggatccttgcgcaagggaagaagatgatccggccccaacccatggagtacaaatacagctggaagtcctggggcaaagcgaagataatcggagccgacgtgcaaaataccactttcatcattgacggacccaacaccccggaatgtcccgacgaccagcgggcttggaacatctgggaggtggaggactacggtttcgggattttcacgactaacatttggctcaagctccgcgactcctatacccaggtatgcgaccaccgactgatgagcgcggcaatcaaggactcgaaggccgtacacgccgacatgggatattggatcgagagcgaaaagaatgagacgtggaagctcgcccgcgcgtcctttatcgaggtcaaaacgtgcatttggcccaaaagccatacactgtggtccaatggcgtgctggagagcgagatgatcatacccaagatatacggcggcccgatctcccaacacaactatcggcctgggtacttcactcagaccgccggcccctggcacctcgggaaattggagctagactttgacctctgtgagggcacaaccgtggttgtcgatgagcactgcggcaacagaggtccttcccttcgtactaccactgtgacaggtaagattatccatgagtggtgctgccgctcctgcacgctgcctcccctgcggttcaaaggtgaggacggctgctggtatggaatggagattcgcccagttaaagagaaagaggagaacctggtcaagagcatggtgtcggccggctccggcgaagtagacagtttctcgctgggccttctatgtatcagcataatgatcgaggaggtgatgcggtcccgctggagccgcaaaatgctgatgacgggcacactcgccgttttctttctgctgataatggggcagcttacgtggaacgacctgatccgtctgtgcatcatggtgggcgcaaacgcgtccgatcggatggggatgggcaccacctacctcgcgctaatggctacgttcaagatgcgcccgatgtttgcagtggggctgctgttccgccggttaacttcacgcgaggtgctcctcttaacgatcggactgagcttagtcgccagcgtagagctgcccaactccctagaggagttgggcgacggcctagcgatgggcataatgatcctgaagctgctgaccgacttccagagccaccaactgtgggccacgctcctgtccctgacgttcattaagaccaccttctcgctacactacgcctggaagacaatggctatggtcctgtccatcgtgtcactgttccccctctgcctgtccactaccagccagaagacgacgtggctgcctgtgctcctgggctccctgggttgtaaaccgctcactatgtttctgatcgcggaaaacaagatttgggggcgcaaaagctggccactgaacgaggggatcatggccgtcggcatcgtctcgatactactgtccagcctgttaaagaacgatgtgccactggcggggcctctgattgcgggcggcatgcttatagcttgctatgtcatctcgggaagttctgccgacctgagcctggagaaggccgcggaggtgtcctgggaggaggaagccgagcacagcggcgcctcccataacatccttgtggaggtacaggatgatgggaccatgaagataaaggacgaggagcgcgacgatacgctcaccattctgctcaaagcgacactcctggccgtgagcggcgtatacccgctgagtatccctgccaccttgtttgtctggtacttctggcagaagaagaaacaacggagcggtgtcctgtgggatacccctagccctccggaggtggagcgcgccgtcttggacgacgggatctaccggatcatgcagcgcggcctgctggggcggtctcaggtgggcgtgggggtctttcaggagaacgtgttccacacaatgtggcacgtcacgcgcggagccgtccttatgtaccagggaaagcgactcgagccttcctgggcgagcgtaaagaaggacctgatcagttacggcggcggctggcgcctgcaagggtcctggaacaccggcgaagaggtacaggtgatcgccgtggagcccgggaaaaatcccaagaacgtgcagaccgcccccggaaccttcaagacatccgagggcgaggtgggtgccatagccctcgatttcaaacccgggaccagcggctctcctatcgtgaaccgggaagggaagatcgtggggctgtacggaaacggtgttgtgaccacatcaggcacgtatgttagcgccatcgcccaggccaaggccagccaggagggacccctgccggagatcgaggatgaggtgttccgcaagcggaacctcaccattatggacctgcatcctggcagcgggaagacccgccgctacctgccggcgatcgtgcgcgaagccatcaagcgaaagctccgcacgctgatactggccccaacaagggtggtcgcctccgagatggccgaagctctcaaaggcatgcctatccgctaccaaacaactgccgtgaaaagcgagcacaccggaaaggagatcgtcgacttaatgtgccacgccacgtttaccatgcgactgctctcccctgtgcgtgtgcccaactataacatgatcataatggatgaggcccacttcaccgacccgagctccatcgcggccaggggatacatcagcactagagtgggcatgggggaagccgctgccatcttcatgactgccacgcctcccgggtcggtcgaagcatttcctcaaagtaacgccgtgatccaagacgaggaacgtgacatcccggagcggtcctggaacagcgggtacgagtggataacggactttcccggaaagaccgtgtggttcgtcccctccattaaaagcggcaacgacatcgccaactgcttgcggaagaacggtaagcgggtaatacagcttagccgcaaaacatttgacacggagtaccagaagaccaagaataacgactgggactacgtagtcaccacggacataagcgagatgggcgccaacttccgcgctgaccgcgtaatcgatccgcggcgatgtcttaaaccggtgatcctcaaagacgggccagagcgcgtcatcctggccggccccatgccggtgactgttgcaagcgcagcccagcgccgggggcgcataggtcgcaaccacaacaaggagggcgaccaatatatctacatggggcagcccctgaacaacgacgaggaccatgcccactggaccgaagcgaagatgttgttagataacatcaacacccccgagggcatcatccccgccctctttgaacccgagcgcgagaagtccgccgccatcgacggggaatacaggctccggggcgaggcgaggaagacgttcgttgagctcatgcggcgcggggacctccccgtttggctgagttacaaagtcgcatccgagggctttcagtactcagaccggcgttggtgctttgacggtgaacgaaacaaccaggtacttgaagagaacatggacgtggagatctggacaaaggaaggggaacgcaagaagctccggccccgatggctggacgcccggacgtactccgaccctctggcgctccgggagttcaaggagtttgcagcgggtcggcgcagcgtctccggtgacctcatacttgagatcggtaagctcccccagcaccttactcagcgggcgcagaatgccctggataacctcgtcatgctgcacaacagcgagcagggcgggcgcgcctaccggcatgcgatggaggagctgccggacacgatagagaccctaatgctgctggccctcatagcggtactgaccggcggggtcacactcttctttctcagtggcagggggctgggcaagacaagcatcgggctgctctgcgtgatggcgtcctctgccctgctctggatggcatccgtggaacctcactggatcgccgccagcatcatcctagagttcttcctgatggtgctgctcatccccgagcccgaccggcagcgcacgccacaggataaccagcttgcatacgtggttatcgggcttctctttatgattctgaccgtcgctgcaaacgagatggggcttttagagaccacaaagaaagatttagggatcggccacgtcgccgtggagaaccatcaccacgccacgatgctggacgtcgacttacaccccgcctccgcttggaccctgtatgcggtcgccaccacaatcatcacgcccatgatgcggcacacaatcgaaaacaccaccgccaacataagcctgacggccatcgccaaccaagcggccatacttatgggacttgataaaggctggccgatctccaagatggacatcggcgtgcccctgctcgccttagggtgctacagccaggtcaaccccctcactctcaccgctgcagttctgatgctagtggcccactacgccatcattggccctggattgcaggccaaggccacccgcgaagcgcagaaacgaacggcagctggcattatgaagaatccgaccgtagacgggatcgtcgccatcgatctggaccccgtagtttacgatgccaaattcgaaaagcaactaggccagataatgttgctcatcttatgtaccagccagatcctgctgatgcgcactacgtgggcattatgcgagagtatcaccctcgctacaggccctttgacgaccctgtgggaggggtcacccggcaagttctggaacaccacaatcgctgtgtccatggccaatatattccgtgggagctacctagccggcgctggcctggcctttagcctgatgaagtccctcgggggcgggcgtaggggaactggggcccagggcgagacactaggcgagaagtggaagcgacaactgaatcagctgagtaaaagtgagtttaacacgtataagcgctccggaatcatggaggttgaccggagcgaggctaaggaaggcctgaagcgcggggagaccaccaaacacgccgtctccagaggcaccgccaaattgcgctggtttgtcgagcggaacctcgtgaagccggaagggaaggttatcgacctgggctgtggcagagggggatggagctactattgcgcaggactgaagaaggttaccgaggtcaagggctacacgaagggcgggcccggccacgaggagcccattcccatggccacatacgggtggaacctcgtgaagctccatagtggcaaagatgtgttcttcattccgcccgaaaagtgcgacacactgctttgtgacatcggggagagctcgccaaacccgacaatcgaggagggccggaccctcagagtactaaagatggtagagccttggctgcgaggtaaccagttctgtataaagatcctcaatccctacatgccctccgtagtggagaccctggagcagatgcagcggaagcacggcggtatgctggtccggaaccccttgtcccgcaattccacccacgaaatgtactgggtgtcctgcgggaccggaaacatcgttagcgctgtcaacatgacctcacgcatgctgttaaaccgcttcaccatggcgcaccggaagccgacttacgagcgcgacgttgacctcggggccggcacgcggcacgttgccgtggaacccgaggttgcgaacttggacatcatcggccagcggatcgagaatataaagcacgagcacaaaagcacctggcactatgacgaagataacccctacaaaacctgggcctaccatgggtcctacgaggtgaaaccctcaggctcggcgtccagcatggtcaatggcgtggtcaagctcttgacaaagccgtgggacgtgatccccatggtgacgcagatcgcaatgacggacacaacccccttcggacagcagcgcgtctttaaggagaaggtggacactcggacccccaaggccaagcgggggaccgcccagattatggaagtgacagccaagtggctttggggcttcctgagccgaaataagaaaccgagaatttgtacgcgggaggagttcacccgcaaagtccgttctaatgcggcgatcggcgccgtgttcgtggacgagaaccaatggaactcggccaaggaggcggtcgaggacgagcgcttctgggacctcgttcaccgggagcgcgaattacataaacaggggaagtgcgctacctgcgtgtacaatatgatgggcaagcgggagaagaagctaggagagttcggcaaggccaaggggagccgcgccatctggtacatgtggctcggtgcaaggttcctagagttcgaggccctgggattcatgaacgaggaccactggttctccagagaaaactcgctcagcggagtcgaaggcgaggggctgcacaagctgggctatatcctccgggacatcagcaagatcccaggaggcaacatgtacgcagacgataccgccgggtgggacacgaggataaccgaggatgatctacaaaacgaggcgaagatcacggacatcatggaaccggagcacgccctgctcgcgaagagtatcttcaagctgacgtaccagaacaaggtggtacgcgtccagcgcccggccaagaatggaacggttatggatgtgatcagccggcgcgaccagcgggggagtgggcaagtgggtacctacggactgaataccttcaccaacatggaagcacagctaatccggcagatggagagcgagggtatctttagtcctagcgagcttgagactcccaaccttgccgggcgcgtgctcgactggctagagaaacatggagtggagcggctaaagcgcatggccatatccggcgatgactgcgtcgttaagcccatcgacgataggttcgccaccgccctcaccgccttaaacgacatgggcaaggtgcggaaagacatcccgcagtgggagccctcgaaaggatggaatgattggcaacaggtgcccttctgcagccaccactttcaccaactgatcatgaaggacggccgggaaatcgtcgttccttgccgcaaccaggacgagcttgtcggccgggctcgcgtcagtcagggcgccgggtggagcctccgggagaccgcgtgcctaggcaagtcgtacgcccagatgtggcagctcatgtactttcatcgccgcgatctgcgcctggcggccaacgcaatctgcagcgccgtcccggtcgaatgggtaccaacctcccggacaacttggagcattcacgcccaccatcagtggatgaccaccgaggacatgttatcagtctggaaccgtgtctggatcgaggagaatccctggatggaagacaagacgcacatctctagctggggcgatgtgccctacctgggcaagcgcgaggaccagtggtgcggttctctgatcgggctcaccgcaagagcgacctgggcgacgaacatccaggtggcaatcaaccaggtgaggcgcctgatcgggaacgaaaactacctggactacatgacctctatgaagagattcaaaaacgagagcgacccggagggggccctctggtga

SEQ ID NO: 24456 - RNA, 9879 nt, synthetic construct
  misc_feature 1..9879: note = derived and/or modified CDS sequence (opt11) from DENV-1__GU131746__SS-prME
  source 1..9879: mol_type = other RNA
agcgttactatgctgctaatgctgatgcccaccgccctggcttttcatctcaccacccggggtggtgaaccccacatgatcgttagcaagcaggaacgaggcaagagcttactgttcaagacctcagccggggtgaatatgtgcaccctcatagcgatggacctgggggagctgtgtgaggacacaatgacatacaaatgcccccgcatcaccgagaccgaaccagacgatgtggattgttggtgcaatgccacggacacgtgggtaacctatgggacttgcagccaaacgggcgagcaccgccgcgacaagcgatccgtggccctcgctccgcacgtaggactgggcctcgagacccgcaccgagacctggatgagcagcgagggagcctggaagcagatccagcgggtcgagacgtgggccctccgccaccccggattcaccgtgattgccctgtttcttgctcacgcaatcggcaccagcatcactcagaaggggatcatcttcattctgctcatgctggtgaccccctccatggcgatgcggtgtgtcggtatcggcagccgcgacttcgtggaggggctctccggagcaacgtgggtggacgtcgtcctcgaacacgggagctgcgtaaccaccatggccaaggacaagcccacgttggacatagaacttctgaagactgaggtcaccaaccccgccgttctgcggaagctctgcatcgaagcaaaaatatcgaataccactacagactcccgctgcccgacccagggcgaggccaccctggtagaggagcaggacgctaacttcgtttgccggaggacgttcgttgacagaggatgggggaacggctgcgggctgttcggcaaagggagtcttatcacatgcgccaagttcaaatgcgtaacaaaactggaaggcaagatcgtccagtacgagaatctgaagtactctgtaatagtgaccgtacacacgggcgaccagcaccaggtaggaaatgagagtaccgaacacggtaccaccgccaccatcacgccccaggcgcccactaccgagatccagctcaccgactacggggcgctgacgctggactgcagccccaggactggcctcgacttcaatgagatggtcctgcttaccatgaaggaaaagtcgtggctcgtgcataagcaatggttcctggacctgcccttaccctggaccagcggcgccagtacatcccaagagacctggaaccggcaagatctgctcgtgaccttcaagacagcccacgcgaagaagcaagaagtcgtagtgctcggctcgcaagagggagcgatgcacacagccctgactggggccacggaaatccagaccagcggtacgaccacaatcttcgccgggcatctgaagtgtcgcctcaagatggacaagctcaccctgaagggaatgagctacgtcatgtgcacggggtccttcaaattggagaaggagctggccgaaacccagcatggcaccgttctcgtgcagatcaagtacgagggcacagacgcgccatgcaaaatccccttttcgacgcaggacgagaaaggggttacccaaaatggccggctgatcaccgccaatcccattgtgaccgacaaagaaaaacccgtgaacatcgaggctgagccgcccttcggggagtcatacatagtcatcggcgcgggtgagaaggctttgaaacttagctggttcaagaagggatcgtcgataggcaaaatgttcgaggcgactgctcgaggggccagacgcatggccatcctgggcgacaccgcttgggactttggaagtatcggcggcgtgttcactagcgtggggaagctagtccaccaaatctttggcacagcgtacggggtgttattctccggcgtgagctggacgatgaagatcggcatcggtgtgctgctgacgtggctgggcctgaactcccgcagcacgtccctcagcatgacctgcatcgccgtagggctggtgaccctgtacctcggagtcatggtgcaagctgattccggatgcgtgatcaactggaagggccgggagttgaagtgtggctcgggaattttcgtcaccaacgaggtgcatacctggactgagcagtataagtttcaggccgatagtccaaagcgactgtctgcagccattggcaaggcctgggaggagggggtgtgcggcattcggagcgccaccagactcgaaaacatcatgtggaagcagatctccaacgagttgaaccacatcctgctcgagaacgatatgaagttcacagttgtggtgggcgacgtcgccgggatcctcgcccaggggaagaaaatgatccggccgcagccaatggagtacaagtattcttggaaatcgtggggcaaagctaaaataatcggcgccgatgtccaaaacaccaccttcatcattgacgggcccaacacaccggagtgcccagatgaccagcgagcctggaacatctgggaggtggaggattacggtttcggcattttcacgaccaatatatggctgaaactccgggacagctacacacaggtgtgtgaccaccgcctcatgagcgcggccatcaaggacagcaaagccgtgcacgcagatatgggctactggatcgagtccgagaagaacgaaacgtggaagctggcccgggccagcttcattgaggtgaagacgtgtatctggccaaagtcccacaccctctggtccaacggtgttctggaatccgaaatgataatcccaaagatctacggagggccgatctcacaacacaactacaggcccggatacttcacccagaccgcgggcccatggcacctggggaagctcgagttagatttcgatttgtgcgagggaacgacggtcgtggtcgacgagcactgtggcaaccgggggccgtccctccgcaccaccacggtgaccggcaaaatcatccacgagtggtgctgccggtcatgcaccctgcctcctctgcgcttccggggagaagatggatgctggtatgggatggagatccgccccgtcaaggagaaagaggaaaacctcgtcaagagtatggtgagcgccggctcaggcgaggtggactccttcagcctggggttgctgtgcatctctatcatgatcgaagaggttatgaggtcccgctggtcacggaagatgcttatgaccggcacactggccgtgttcttcctcctgataatgggtcagttaacctggaacgatctcatccgcctgtgtattatggtgggcgccaatgcgagtgacaggatggggatgggaaccacatacctggccctcatggccactttcaagatgagacctatgttcgcggtcgggctgttattccgccggttaacttccagggaggtgcttctgctgaccatcgggctgagcctggtggccagcgtcgagctacccaatagcctggaggagctgggcgacgggctcgctatgggtataatgattcttaagctgcttaccgactttcaatctcaccagctgtgggcaacgctgcttagcctgacatttataaagaccaccttttccctgcactacgcctggaaaacgatggccatgatactcagtatcgtgagtctttttcccctctgcctaagcaccacgtcccagaagaccacgtggctgcccgtactgctcggctctctggggtgcaagcctctgactatgtttctcattgcggagaataagatctggggccggcgctcatggcctctgaacgaggggatcatggctgtgggcatcgtgagcatcctgctgagctccctactgaagaacgacgtcccgctcgcgggacctcttattgcaggcggcatgttgatcgcctgttacgtgatcagcgggtccagcgccgacctctccctagagaaggctgccgaggtgagctgggaggaggaggcggaacactctggcgcgagccacaacatcctggtcgaggtgcaggacgatgggaccatgaaaataaaagacgaggagcgggatgacaccctcacgatccttctgaaggcaacgttgctggccgtgtccggggtctacccgctgagcatccccgccaccctgttcgtgtggtacttttggcagaagaagaagcagcggtcgggggtcctgtgggatacccccagtccgcccgaggtcgagagggccgtgttagacgacgggatctaccgtatcatgcaacggggccttttagggcgatcccaagtgggcgtcggagtatttcaagagaacgtgttccacactatgtggcatgtcacccgcggcgccgtactcatgtaccaggggaagcggctggaacctagctgggcgtccgttaagaaagacctcatctcttacggcggcgggtggcgcctgcaaggctcctggaacaccggggaggaggtccaagtgatcgcagtagaaccaggcaaaaaccccaaaaacgtgcaaaccgccccaggaacgtttaaaacgcccgagggagaggtgggcgccatcgccctagatttcaagcccggcacaagtggcagccccatcgttaacagagaggggaagatcgtcggcctctacggcaatggggtcgtgacaaccagcggcacgtacgtctcagcgatcgcccaggccaaagcctctcaggaggggccgctacccgagatcgaagatgaagtattccggaagcgcaatctgactataatggacctccaccccggttctgggaagacccgccggtaccttccggcgatcgtacgggaggccatcaagcggaaattacgcaccttgatcctggctcccacgcgggtcgtggcctccgaaatggccgaggcgctaaagggcatgcccatcagatatcagaccaccgccgtcaagagcgaacacacgggcaaggagatagtggatctcatgtgtcacgccacgttcacaatgcgattactgtccccggtgcgagtgcctaattacaacatgatcatcatggacgaggcacacttcaccgaccccagctcaatagccgcgcggggttatatcagcactcgcgtaggaatgggggaagccgccgccatcttcatgaccgccacgcctcccggctccgtggaagcctttccccagagcaatgccgtgatccaggacgaggagcgggatatccccgaacgttcgtggaacagcgggtacgagtggatcacggactttcccggcaagaccgtatggtttgtccccagtatcaagagcggaaacgacatcgccaactgcttaagaaagaacgggaagcgcgtgatccaactgtcccgcaaaacgttcgataccgaatatcagaagaccaagaataatgactgggactacgttgttaccacggacatcagcgagatgggcgccaacttccgagccgaccgggtgatcgacccgcggagatgcttaaagcctgtaatacttaaggatggacccgagcgggtcatcctcgccggcccgatgccagtgactgtcgcgtccgccgcccagcgcagggggaggattggacgtaaccacaacaaagaaggtgaccaatacatctacatgggacagcccctcaacaacgatgaggaccatgcgcactggaccgaggcgaaaatgttactggacaacatcaataccccagagggcatcatccccgctttattcgagcctgagcgcgagaagtccgcggccatcgatggggaatataggctccggggcgaggcgcggaaaacgtttgtagagttgatgcgccgtggcgacctgcccgtgtggctcagttacaaagtcgccagcgaagggttccagtacagcgaccgccggtggtgcttcgatggagagcgcaataaccaggtactggaggagaacatggacgtcgagatctggaccaaggagggggaacggaagaagctccggcccaggtggttggacgcccgcacttacagcgaccccctggccctccgggagttcaaggagttcgccgcgggtcgccggtctgtgagtggagacctcatcctagaaatcggcaagctgccgcagcacctaacccagaaggcacagaacgcattggacaacctggtgatgttacataatagtgagcagggtgggcgcgcgtaccgtcacgcgatggaggagctgcccgacaccatagagaccctcatgttgctggccttaatcgcagtcctcaccggcggggtgacgctgttcttcctttccggccgcggcttaggcaaaacctcaatcggcttactgtgcgtgatggcctcgagtgtactcctgtggatggcctccgtggagccccactggatcgctgctagtatcatactggagttcttcctcatggtgctgctaatcccagagcccgaccggcagcgcaccccgcaggacaaccaactcgcctacgtagtaatcgggctgctattcatgatcctcaccgtggccgcaaacgagatgggcctgctagaaactacgaagaaggacctcggcatcggccatgtcgccgtcgagaatcaccaccacgccgcgatgttagacgtggatctgcacccagcctccgcatggacgctttacgcggtcgccaccacgatcatcaccccgatgatgcggcacacgattgaaaacacaaccgcaaacatcagcctgactgccatcgctaatcaagcggccatcctgatggggctagacaaggggtggcccatctccaagatggacatcggggtgcctttattagccttaggttgctattcacaggtgaatcccctgacccttaccgcagctgtgctgatgctggtggcacattacgcaataatcggcccggggctgcaggcaaaggcgacccgcgaggcgcagaagcgtacggcggctggcatcatgaagaatcccacggttgacgggatagtcgcgattgatctcgaccccgtggtatacgatgccaaattcgagaaacagctgggccaaattatgctgctcattctgtgcacatcccagatccttctcatgcggaccacctgggcgctgtgcgaaagcatcaccctagcgaccggcccccttactaccctgtgggaggggtccccgggaaaattctggaacacgaccatcgcggtgtcgatggccaatatttttcggggctcctacctggccggcgcgggcctcgcgttctcgctgatgaaaagcctaggtgggggccggcgcgggaccggggcgcagggagagaccctcggcgagaaatggaagcggcagctgaaccagctgtccaagagcgagttcaatacctacaaacgctccgggatcatggaggtggaccggtcagaagccaaggagggactcaagagaggggaaaccaccaagcacgctgtttcgcggggcaccgcaaaactgcgctggttcgtcgagcgtaacctggtaaaacccgaggggaaagttatcgacttgggctgtggacgcgggggttggagctactattgtgccgggttaaagaaggtcacggaagtgaagggctataccaaaggcggcccgggtcacgaggaacctatcccaatggccacatacggatggaaccttgtgaagctgcactctggcaaagacgtcttctttataccacccgaaaagtgtgacactcttctgtgcgacatcggcgagtctagccccaacccgacgatcgaggagggccggacactgcgcgttctcaagatggtggaaccctggcttcgcgggaaccagttctgcatcaagatcctgaacccgtacatgccgagcgtagttgagaccctcgagcagatgcaacgcaagcacggcggtatgttggtccgaaacccgttaagtcgtaattcgacccacgagatgtactgggtctcctgcgggaccggcaacatcgtgagcgcagtgaacatgacgtcccggatgctactgaaccggttcaccatggcgcaccgcaaacccacctacgagcgtgatgtcgatctgggagctgggacacgccacgtggccgtggagccggaggtcgcgaacctagatattattggccagcggatcgaaaatatcaagcacgagcacaagagcacgtggcactacgacgaggacaacccgtacaaaacatgggcctatcatggttcgtacgaggtgaagccgtcaggcagcgcgagcagcatggtcaacggggttgtcaaactcctgactaagccgtgggatgtcattcccatggtgacacagatcgccatgacggacaccaccccgttcggtcagcaacgtgtgttcaaggagaaggtcgacacccggactccaaaggccaaacgcgggacggcccagatcatggaggtgaccgccaagtggctctggggctttctgtcccggaacaagaagccacggatctgtacccgggaggagttcactcgcaaggtgcggagcaacgcggctatcggcgcagtctttgtggacgagaaccagtggaactccgccaaggaggctgtggaggatgaacgcttctgggacctggtccatcgcgagcgcgaactacacaagcaggggaagtgtgcgacctgcgtatacaacatgatgggcaaacgggaaaagaagctgggggagttcggaaaggcgaagggaagccgcgccatctggtacatgtggctgggcgccagattcttagagtttgaggctctgggctttatgaacgaggaccactggttcagtcgcgaaaattcgctgagcggcgtcgagggcgaggggcttcacaagttgggttacatcctgcgcgacatcagcaagataccgggcggaaacatgtacgccgatgacactgctggatgggacacccggataacggaggacgacctccaaaacgaagcacggatcacggacatcatggagcctgagcacgcgctgttagcgaagtccattttcaagctcacctaccaaaataaggttgtacgcgtgcaaagacccgcaaagaatggcactgtaatggacgtcattagcaggcgggatcagcgcggatccggccaggtaggtacttacgggctgaacaccttcacaaacatggaggcgcagctgatcaggcagatggagagcgagggaatcttctccccaagcgagcttgaaaccccaaatctggcagagcgggtcctggactggctcgagaagtacggcgttgagagactgaaacggatggccatcagcggggatgactgcgtggtcaagccgatagatgaccgctttgcgactgcactgaccgcactcaacgacatgggaaaggtgcggaaggacatcccccagtgggagcccagcaaggggtggaacgactggcagcaagtcccgttctgctcgcatcactttcaccagctcatcatgaaggacggccgcgaaatagtagtgccttgtcggaaccaagacgaactcgtgggccgcgcccgggtcagccaaggggcgggctggtcactccgcgagaccgcgtgcctgggtaagagctacgcccagatgtggcaactgatgtatttccacaggcgcgacctaagactggccgccaacgcgatttgtagcgccgtaccggtggactggatcccaacatccaggactacctggtctatccacgcccaccatcagtggatgaccaccgaggacatgctctccgtctggaatcgggtgtggatagaggagaacccctggatggaagataagacacacatcagcagttggggcgacgtgccgtacttggggaaacgcgaagaccagtggtgcggcagcctgatcggtctgaccgcccgcgcaacctgggcgaccaatattcaggtggctatcaaccaggtgcggcgcctcataggcaacgagaactatctggactacatgacgtctatgaagcggttcaaaaacgaaagcgatccagagggagccttgtggtag

SEQ ID NO: 24457 - RNA, 9879 nt, synthetic construct
  misc_feature 1..9879: note = derived and/or modified CDS sequence (opt11) from DENV-1__JF937609__SS-prME
  source 1..9879: mol_type = other RNA
agcgtgactatgctgctcatgctgatgcccacggccctggcctttcacctcacgacacggggcggggaaccccatatgatcgtgagcaagcaggaacggggcaagagcctgttgttcaagaccagcgccggggtgaacatgtgcaccctcatcgccatggacctgggggaactgtgcgaggacaccatgacgtacaagtgccccagaatcaccgagaccgagcctgacgacgtggactgctggtgtaatgccaccgacacctgggtgacatatggtacctgcagccagacgggcgagcacagacgagacaaacggtccgtggccctcgcaccccacgtgggcctgggcctggaaacgcgcacagagacatggatgagctccgagggcgcctggaagcaaatccagagggtcgaaacctgggcgctgcgccaccccgggtttaccgtgatcgccctgttcctggctcatgctatcggcacaagtatcacccagaaggggatcatctttatcctcctgatgctggtgacgccctcaatggcgatgcggtgcgtcggcatcggcagccgcgacttcgtggaggggctgtccggggcaacctgggtggatgtggtgctggagcacgggagctgtgtgaccactatggccaaagacaagcccacgctggacatcgagctcctgaaaaccgaggtcactaaccccgcgatcctgcggaagctctgcatagaagccaagatttccaacaccacgaccgacagccgctgtcccacacaaggcgaggccacactggtggaggagcaggacgccaatttcgtgtgccggcgcacgttcgtagaccgggggtgggggaacggctgcgggctgttcggcaaggggtccctcataacgtgcgccaagttcaaatgcgtgaccaaactcgagggcaaaattgtgcagtacgagaaccttaaatacagcgtcatcgtaaccgtgcacacgggggaccagcaccaggtagggaacgagtcaaccgagcacggcaccaccgcaaccatcacgcctcaggcgcccaccaccgagatccagctcacggactacggggcgctgacgctggactgcagcccccgcactggactcgatttcaacgagatggtgctgctgacgatgaaggagaagagttggctggttcacaagcaatggttcctggacttgccgctcccctggacctctggggccagcacatcgcaagagacctggaaccggcaagaccttctggtgacgtttaagaccgcccatgccaagaagcaggaagtcgtcgtgctcggcagccaggaaggcgcgatgcacacggctctgactggcgcgactgagatacaaacctccggcacgaccaccatctttgccggacatctgaagtgccgcctcaagatggacaagttgaccctcaagggcatgagctacgtgatgtgcacgggatccttcaaactcgagaaagaggtggcggagacccaacacggcaccgtgctggtacaaataaagtatgagggcacagacgcgccctgcaaaatccccttcagcacgcaagacgagaagggggtcacccagaacgggaggctgataaccgccaacccgattgtgaccgacaaagagaagccggtgaacatcgaagcagagccgcctttcggggaatcctacatcgtcatcggtgccggtgagaaagcgctgaagctgtcgtggtttaagaaggggtccagcataggcaagatgttcgaggccacggccagaggggccaggcggatggcgatcctcggcgacaccgcgtgggacttcgggtcaatcggcggcgtattcacctcagtggggaagctagtccaccaaatatttggtaccgcctacggggtccttttctccggagtcagctggacgatgaaaatcgggataggcgtactgctgacctggctcggcctgaactcccggagcacgtccttatcgatgacttgcattgccgtggggctcgtgacgctctatctgggcgtcatggtgcaagccgactccgggtgcgttatcaactggaagggacgggagctcaagtgcgggagcggcatcttcgtcaccaacgaggttcacacctggacagaacagtacaaattccaggccgacagcccgaagcgcctgtccgcggccatcggcaaggcctgggaagagggggtgtgcggcataaggagtgccaccaggttggaaaatatcatgtggaagcaaatctcgaatgagctgaaccacatcctgttagagaatgacatgaaattcacggtcgtggtgggcgacgtcgccggcatcttggctcagggcaagaagatgatccggccccagcctatggaatacaagtactcgtggaagtcctggggcaaggccaagatcatcggagccgacgtgcagaacaccaccttcattatcgatggtcccaacaccccggagtgccctgacgaccagcgcgcctggaacatttgggaagtggaagactatgggttcggcatcttcacgaccaacatctggctgaaactgagagacagctacacccaggtttgcgaccatcgcctcatgtccgcggccatcaaggacagcaaggccgtgcacgccgacatgggctactggatcgagtccgagaagaacgaaacctggaagttggcccgggcgagctttatcgaggtgaagacgtgcatatggcccaagtcccacaccctgtggtccaacggcgtcctcgaatccgagatgataatcccgaaaatttacgggggcccgataagccagcataactaccgccccgggtacttcacccaaaccgccggcccctggcacctggggaagctggagttagatttcgacctgtgcgagggcaccaccgtggtggtagacgagcattgtggcaaccggggcccgtcccttcgcaccaccacggtgaccggcaagataatccacgaatggtgctgtcggagctgcaccctgccgccgctccgcttccgcggggaggacggctgctggtacggaatggagatccgaccggtgaaggagaaggaggagaacttggtcaaatccatggtgagcgccggcagcggcgaagtggattcttttagcctcggcctgttgtgcatatcaatcatgatagaagaggtcatgcggagccgctggtccagaaaaatgctcatgaccggcacgcttgccgtgttcctgctcctaatcatggggcagctgacctggaacgacttgatccgtctctgcatcatggttggggccaacgccagcgaccgcatggggatgggcaccacctacctggcactcatggccacgttcaaaatgcggcccatgttcgccgtcgggctgctgttccgccgtctaacctcacgggaggtgctgctgcttacaatcgggctgagcctggtcgcgtccgtcgaactccccaatagcctagaggagctgggcgatggactggcgatgggaatcatgatactgaagctgctgaccgacttccagtctcatcagctgtgggccacgctgctcagcctgaccttcatcaagaccaccttctccctccactacgcctggaagacgatggcaatggtgctcagcattgtctccttattccctctgtgcctcagcaccaccagtcagaaaaccacgtggctgccagtgcttctgggcagcctggggtgcaagccgctcacgatgttcctcattgccgaaaataagatctggggccggaggtcctggccgctgaacgaggggatcatggccgtgggcatcgtcagtatactgcttagctccctgctaaagaacgacgtaccactcgccgggcccctgatagccggcggcatgctgattgcctgttacgtaataagcgggtcttctgcggacctctccctggagaaagccgccgaagtaagctgggaagaggaggccgagcactccggagcgtctcacaacatcctggtggaggtgcaggacgacgggaccatgaagataaaagacgaggagcgcgatgacacgctcaccatcctgttgaaggcgaccctcctggccgtctccggcgtgtacccgttaagcatccccgccaccctcttcgtgtggtacttctggcagaagaagaagcagagatctggcgtcctctgggatacccccagcccgcccgaggtagagcgggcagtgctggacgatggaatctacagaatcatgcaacggggcctcctcgggcgctcccaggtgggtgtgggggtcttccaggagaacgtgttccacaccatgtggcatgtgacgcgaggggcagtcctgatgtaccaggggaaacgcctggagcccagctgggcgtccgtcaaaaaggatctcatcagttacggcggagggtggcggctgcagggatcatggaacaccggggaggaggtacaggtgatcgccgtcgagcccggtaagaaccccaagaatgtgcagaccactccagggacgttcaaaacccccgagggcgaggtgggcgccatcgccctggactttaagcccgggaccagcggcagccccatagtcaaccgcgaagggaagatcgtgggcctctacgggaacggggtcgtcacgacgagcggcacctacgtgagtgctatcgcgcaggctaaggcgagccaagaggggccgctgcccgagatcgaagacgaggtctttcggaagcgcaaccttaccatcatggacctccaccccggaagcgggaagacacgacgctaccttccggccatcgtgagggaagcgatcaaacgcaaactgaggacgctcattctggctcccactcgagtggtggcctccgaaatggccgaggctctgaagggcatgcccattcgttaccagaccaccgcggtaaagagcgagcataccggcaaagagatcgtggatttgatgtgtcacgccacctttacgatgcgtctgctgtcccccgtgcgcgttccgaactacaacatgatcatcatggacgaggcccactttaccgaccctagctccatcgccgcacgggggtatatctcgacgcgcgtgggaatgggggaggcggccgcgatatttatgaccgccacgccacccggatccgtggaggccttcccacagagcaacgcggtaatccaggacgaggagcgggacatccccgagcgctcttggaatagtggttacgagtggatcacggacttccccggcaagacggtgtggttcgtgccctccattaagagcggcaacgacatcgccaactgcctccgtaaaaacggaaaacgcgtcatacagttgtcccggaagacgttcgacaccgagtaccagaagaccaagaacaacgactgggactatgtcgtgacgacggacatcagcgagatgggcgcaaacttccgcgccgaccgggtcatcgatccacgccggtgcctgaagcctgtgatcctcaaggacggccccgaacgcgtgatactggccggccccatgcccgtaaccgtggcgtccgcggcccagcggcgcgggcggatcggccgtaaccacaacaaggagggcgatcagtacatctatatggggcagcctctgaacaatgacgaggatcacgcccactggaccgaggcgaaaatgctccttgacaatatcaacacgccagagggtataattcccgccctgttcgagccggaacgcgaaaagtctgcagccatcgacggggagtaccgtctgcgaggcgaggcccgcaagaccttcgtcgaactgatgcgtcgcggcgacttaccggtgtggctttcctacaaggtggcgtccgagggctttcagtatagcgaccgccggtggtgcttcgacggagagcgcaacaatcaggtcctggaggagaatatggacgtagagatttggacaaaggagggcgagcggaagaagctgagaccccggtggctggacgcccgcacctactccgaccccctggcgctgcgggagttcaaagagttcgcggctggcaggcggtcggtgtccggggacttaatcctggaaatcgggaaactgccccagcacctcactcagagagcgcagaacgccctagataatctggtcatgctccacaacagtgaacagggcgggcgcgcctaccgccacgccatggaggagctgcccgatactatagagaccctgatgcttttggcgctgatagcagtcctcaccggaggggtgacgctgttcttcctgtccgggcgggggctaggaaagacgagcataggattgctgtgtgtcatggcctccagcgtgttgctatggatggcctcggtcgagcctcattggattgccgcgtcaatcattctggagttcttcttaatggtgttgctaatccccgagccggaccgccaaagaacgccccaggataatcagctcgcctacgtggtgatcgggttattgttcatgattctcaccgtcgcggccaacgaaatgggcctcctggaaaccacgaagaaggatctcgggataggccacgtggccgtggggaaccaccaccatgcggccatgcttgacgtcgatctgcaccccgcgtctgcctggaccctctacgccgtggcgaccaccattatcacgccaatgatgcgccacaccatcgagaatacgaccgccaacatttcgctgacggccatcgccaaccaggccgccatcctgatggggctcgacaaggggtggcccatctcaaagatggacataggagtgcctcttctggccctcggctgctacagccaggtcaaccccctgaccctaacagccgcagtactcatgctggttgcacactatgcaatcatcggcccgggcctgcaggcgaaggccacccgcgaggcgcagaagcggacggctgccgggatcatgaagaacccaaccgtcgacggtatcgtggcaatcgacctcgaccctgtcgtctatgacgccaagtttgagaaacagctgggtcaaataatgctgttaatactgtgcaccagtcaaatcctgctcatgcgaacaacgtgggccctttgtgagtcaatcaccctggcgaccgggcccttaactacgctgtgggaggggagtccggggaaattctggaacaccaccatcgctgtgtcgatggccaatatattccgggggtcctacctggccggcgcagggctcgcgttcagcctgatgaagtctctgggcggaggccgccggggaaccggcgcacagggcgagacgctcggggagaagtggaaacgccagctgaatcagctttccaagagcgagttcaacacctacaagaggtccggcatcatggaggtggaccgctccgaggcgaaggaggggctaaaacgcggggaaaccaccaagcacgccgtctcacgggggacggcgaagctccggtggtttgtggagcgcaaccttgtgaagcccgagggcaaggtcatcgacctgggctgcggccggggcgggtggtcttactactgtgccggactgaagaaagtaaccgaagtgaaggggtacacgaagggcggccccgggcacgaagaaccaatccccatggctacctatggctggaacctggtcaagttgcattccgggaaggacgtgttcttcatccctcccgagaaatgcgacacgctcctgtgcgacatcggcgaatccagtcctaaccccactatcgaggaggggcgcaccctgcgggtgctcaagatggtcgagccctggctgcgcggcaatcagttctgcattaagatcctgaacccctacatgccctctgtcgtggagaccctcgagcagatgcagcgtaaacacggagggatgctggttcgcaacccgctgtccagaaacagcactcacgaaatgtactgggtgtcatgcggcacggggaacatcgtgagtgcggtcaacatgacctcccgcatgttgctgaacaggtttaccatggcccaccggaagcccacctacgaacgcgatgtggacctgggcgcggggacccggcatgtggccgtcgagcccgaggtggctaacctcgacatcatcgggcaacgcatcgagaatataaagcacgagcacaagagcacttggcactatgatgaggataacccatacaagacctgggcttaccacggatcctacgaggtgaagccgagcgggtccgccagctcgatggtcaacggggttgtcaaactgctgaccaagccttgggacgtgataccgatggtgacgcagatcgcgatgaccgacaccacccccttcgggcagcagcgggtctttaaggagaaagtggacacacgcaccccaaaggccaagcggggcaccgcccagatcatggaagtgaccgccaagtggctctggggctttctgtcccgcaataagaagccccggatctgcacgcgcgaggagtttacccggaaggtccgcagtaacgccgcgatcggagcagttttcgtggacgagaatcagtggaactccgccaaggaggcagtggaggacgagagattctgggaccttgttcaccgcgagcgcgagctccacaagcagggcaaatgtgcgacctgcgtgtacaacatgatggggaagcgcgagaaaaagttgggcgagttcggtaaggccaaggggagcagagccatctggtacatgtggctgggcgcacgcttcctggagttcgaggccctgggattcatgaacgaagaccactggttctccagggagaactccctctccggggtggagggggagggcctccacaaattagggtacatcctgcgcgacataagcaagatccccggcggcaacatgtatgcggacgacaccgccgggtgggacacgcggataaccgaggacgacctccagaacgaggctcgaatcaccgacattatggagcccgagcacgccctgctggccagaagtatcttcaagctgacctaccagaacaaagtggtgcgcgtccagagaccggcgaagaatggcacggtgatggacgtgatcagccggcgcgaccagcgggggtccggccaggtcggcacctacgggctgaataccttcaccaacatggaggcccaactgattcggcagatggagagtgagggaatcttctctccctctgagctagagacgccgaacctcgccgaacgggtgctggactggcttgagaagtacggggtggagcgtctgaagcggatggcaatatccggggacgactgcgtcgtgaagcctatcgacgacagattcgccaccgctctgaccgccctaaacgacatggggaaggtgagaaaggacatcccccagtgggagcccagtaagggctggaatgattggcagcaggttcccttctgctcgcaccacttccaccagctgatcatgaaggatggccgcgagattgtggtgccatgccggaaccaagacgagctggtcggccgtgcccgggtgtcccagggcgccgggtggagcctccgcgagacagcttgcctgggcaagtcgtatgcgcagatgtggcagctgatgtacttccaccggcgcgacctccggctggccgcgaacgccatctgcagcgcagtgcctgtcgactggatccccacgtcccgaaccacctggtcaatacatgcgcatcaccagtggatgaccacggaggacatgctgtcagtttggaaccgcgtgtggatcgaggagaatccgtggatggaagacaagacccacattagctcctggggcgacgtcccgtacctaggcaagcgggaagaccagtggtgcggcagcctgattgggctcaccgcacgcgccacgtgggccaccaacatccaagtggcgatcaaccaggtgcggagactcatcggcaacgagaactaccttgactatatgacgtcaatgaagcgttttaagaacgagtctgaccccgaaggggccctgtggtga

SEQ ID NO: 24458 - RNA, 9879 nt, synthetic construct
  misc_feature 1..9879: note = derived and/or modified CDS sequence (opt11) from DENV-1__KF921949__SS-prME
  source 1..9879: mol_type = other RNA
tcggtcaccatgcttctcatgctgatgcctacagccttagccttccatctcacgacacgaggcggggagcctcacatgatcgtgagcaagcaggaacggggcaagagcttgctgttcaagacgtctgccggggtcaacatgtgtaccctgatcgccatggacctgggcgagctgtgcgaggacaccatgacatacaagtgccccagaataaccgaaaccgaacccgacgatgtggactgctggtgcaacgccacagatacctgggtcacgtacgggacgtgcagccagacaggcgagcaccggagggacaaacggtccgtagccctcgcgccgcatgtgggcctgggtctggagactaggaccgagacctggatgagctctgagggggcttggaagcagatccagagggtcgagacgtgggccttgcgtcaccccgggttcaccgtgattgcactgtttctggcccatgcgatcggcaccagtatcacccagaaagggatcattttcatcctcctgatgctggtgacgccttcaatggcaatgcggtgcgtcggtatcggcagccgcgacttcgtggagggcctctccggggccacctgggtggacgtagtgctggagcacggctcctgcgtgaccaccatggctaaggataagccaacgttggacatcgagctcctgaagaccgaggtcaccaatcccgccgtgctgcggaaattatgtatcgaggctaagatctccaataccacgaccgatagcagatgtccgacccaaggcgaagccaccctggttgaagagcaagatgcaaactttgtgtgtcggagaacgttcgtggacagaggatggggtaacgggtgtggtctgttcggtaaggggtccctcataacgtgcgccaagttcaagtgtgtgaccaagctggagggaaagatcgtccaatacgaaaacttgaagtactccgtgatcgtgaccgtccacactggcgaccaacaccaggtggggaacgaatccacagagcacggcaccaccgcaacaatcacgccccaggcccccacgaccgagattcaactcaccgactacggggctctgacgctggactgttcgcccagaaccggcctcgacttcaacgagatggtcctgttgaccatgaaggaaaagagttggctcgttcacaagcagtggttcctggacctgccgctcccgtggaccagcggggcctctacgtcccaggagacttggaatcggcaggaccttctggtgacattcaagaccgcccacgccaagaagcaggaggtcgtggtgctcggctctcaggaaggcgcgatgcacaccgccctgaccggggccaccgaaattcagacatccggcacgaccaccattttcgccgggcatctaaagtgccgcctcaagatggataagctgaccctgaagggcatgagttacgtgatgtgcaccgggagcttcaagctcgagaaggaggtagccgagacccagcacggcaccgtgctggtccagatcaagtacgagggaacggacgcgccatgtaagatccccttcagtacgcaggacgagaagggggtgacccagaacggccggctgataacagcgaacccgatcgtgaccgacaaggaaaagccggtcaacattgaggcggagccgcccttcggagagtcgtacatcgtgataggcgccggtgagaaggcgttgaagctctcctggtttcgcaagggatccagcatcgggaagatgtttgaagcgacggctcgcggggcccgccgcatggccattctgggtgacaccgcgtgggatttcggctccataggcggcgtgttcaccagcgtcgggaagctggttcaccaaatttttggcaccgcatacggtgtgctgttctccggcgtcagctggacgatgaaaatcgggatcggcgtgctgttaacttggctcggcctgaactcacgcagtacctcgctgtccatgacctgcatcgccgtggggctggtcacgttatacctgggcgtaatggtgcaagccgacagtgggtgcgtcataaactggaagggccgagaactcaaatgcgggtccggcattttcgtgaccaatgaagtgcacacgtggaccgagcaatataaattccaggcggacagcccgaagagactcagcgcagccatcggcaaggcgtgggaggagggagtctgcggcatcagaagtgccaccaggctggagaacattatgtggaagcaaatctccaacgaactgaaccacatcctattagaaaatgacatgaagtttaccgtggtggtcggcgacgtaaccggaatcttggcccaggggaagaagatgatccgcccccaaccgatggagtataagtattcatggaagtcctggggtaaagcgaaaatcatcggtgcagacgtgcagaataccacctttatcatcgacgggcccaacacgcccgaatgccccgacgaccaacgggcctggaacatctgggaggtcgaggactacggtttcgggatcttcacaaccaacatttggctaaagctacgcgatagctatacccaggtatgcgaccaccggctgatgtccgcagctattaaggactcgaaggccgtgcacgctgatatgggctattggatcgaaagtgagaaaaacgagacctggaagctggcccgcgcgagcttcatcgaggtgaagacctgcatctggcccaagagccacaccctgtggtccaatggtgtgctcgagagcgaaatgatcatccccaagatctacgggggcccgatcagccagcataactaccggccgggatacttcacacagactgcgggcccctggcacctaggtaaacttgagttagatttcgacctatgcgagggcacgaccgttgtcgtggacgagcattgcggcaataggggtccgagcctgcggaccaccactgtgaccggcaagataatccacgagtggtgttgccgcagctgtaccttgcctcccctccggttccgcggggaggacggctgctggtatgggatggaaatccggccagtcaaggagaaggaggagaatctggtgaagtccatggtgagcgccggcagcggcgaggtcgactccttcagtttggggctgctgtgcatatccatcatgatcgaggaggtgatgcgcagccggtggagtcgcaagatgctcatgaccggcactttggctgtgtttctgctcctcatcatggggcagctgacgtggaacgacctgatccgcctgtgcattatggtaggggcgaacgcaagcgacaggatggggatgggcaccacgtatttggcgctcatggccacctttaagatgcgaccgatgttcgccgtcggcctgctgttccggagactcacctccagggaggtgcttctgctcaccatcgggctgtcactggtcgcctccgtagagctccccaattcactggaggagctaggagatgggctcgcgatgggcatcatgatcctgaagctactcacagacttccagtcccatcagctgtgggcgaccctgctgagcctgaccttcatcaagaccacattctccctgcactacgcgtggaagacgatggctatggtcctaagcatcgtgtcccttttccccctgtgtctcagcaccacatcacaaaagacgacctggctccccgtgctcctcggctcactgggctgcaagccgctaaccatgttcctcatagccgaaaacaagatctggggacgccggtcctggcccctgaacgaggggatcatggcggtgggcatagtcagcatcttgttaagctccctgctgaagaacgacgtgcccttggccggccctcttatcgccggcggaatgcttatcgcgtgctacgtcatctcggggagtagcgccgacctctccctagaaaaggcggccgaggtgagctgggaagaagaggccgagcattcaggcgccagtcacaacattctagtagaagtccaagacgacgggaccatgaaaatcaaggatgaggagcgcgacgacaccctcacgatcctgctgaaggccaccctcctggcggtgtccggtgtttacccgttatccatccccgccacgctattcgtctggtatttctggcagaagaaaaaacagcggtccggagtgctgtgggatacccccagccctcccgaagtggaacgcgccgtcctggacgacggcatctatagaatcatgcagcgcgggctgctcggacggtcccaggtaggcgtgggggtcttccaggagaatgtgttccatacaatgtggcacgtaacccgcggcgccgtcttaatgtaccaagggaagcgtctggagccctcttgggcctcggtgaagaaagacctcatcagctacggcggcgggtggcgcttgcagggcagttggaacacgggggaggaagtgcaggtcatcgcggttgaacccggtaagaatcccaaaaacgtacagaccgcccccggtacgttcaagacacccgagggcgaggtcggagccatagcgctggattttaagcccgggacttctggatcgcccatcgtaaatcgggagggaaagattgtcggcctctatggtaacggcgtcgtgaccactagcggaacctacgtgtcggcaatcgcgcaggccaaggcttcacaagaagggcctctgccggagatcgaggatgaggtctttcgcaagaggaatctcaccatcatggaccttcatccgggtagcgggaagacgaggcgatacctacctgctatagttcgcgaggcgatcaagcgcaagctgcgcaccctcatcctggcccccacccgcgtggtggcctccgagatggccgaggccctgaagggcatgcccatccggtaccagaccactgcggtaaagagcgagcacacgggcaaggagatcgtggacctcatgtgccacgccactttcaccatgcgcctgctgtcccccgttcgggttccgaactacaacatgatcataatggacgaggcccacttcaccgacccctcctccatcgccgcccgtgggtacatcagcactcgcgtgggcatgggagaagccgctgccatcttcatgacggccacgccgcccggttccgtcgaagcctttccgcaatctaatgctgtcatacaagacgaggaacgcgacatacctgagcgctcctggaatagcggctatgagtggatcacagacttccccggaaagacagtctggtttgtgccttccatcaagagcggcaacgacattgcaaactgcctccgcaaaaatggtaagcgtgtgatccaactgtcgcgcaagaccttcgacacagagtaccagaaaactaagaacaatgactgggactacgtggtcacgaccgacatctccgagatgggcgccaacttcagggcagaccgggtgatcgacccgcggcgctgcctgaaacccgtgatcctcaaggacggtcctgagcgggtcattctggcgggcccaatgccagtgaccgtcgcctccgcagcccagcgccgggggcgcattggccgcaaccacaacaaagagggcgaccagtacatatatatggggcagcccctgaacaacgacgaagatcacgcgcactggaccgaagcgaagatgctcctggacaatatcaatacgcccgagggtatcatcccggccctattcgaaccggaacgggagaagtctgccgccatagacggcgaataccgcttgcggggggaggcacgcaagacgttcgtggagttgatgcggcgcggggacctgccagtctggctctcctacaaggttgcatctgagggctttcagtactcagatcgtcgttggtgctttgacggcgagcggaacaaccaggtcctggaggagaacatggacgtggagatttggacaaaggagggcgagcgaaagaaactgcggccccgctggctagacgcgcggacttacagtgaccccctggcactgcgcgagttcaaggagtttgccgcaggcagacggagcgtgtcaggcgatctcatcctggagatcggcaagctgccgcagcacctcacgcagcgagcgcagaatgccctggacaacctggtaatgctccataacagcgaacaaggcgggagggcttaccggcatgccatggaggagctgcccgataccatcgagaccctgatgctcctggcgctaatcgcggtgctaacgggcggggtcaccttgttctttctgtcaggcagagggctcggcaagacaagtatcggactgctgtgcgtgatggcttcctcggtcctcttgtggatggcatccgttgagccccactggatcgccgcgagcatcattctggaattcttcctcatggttctgctgatcccggagcccgaccggcagcgcacgccccaagacaatcaactcgcttacgtggtcatcgggcttctgttcatgatcctcaccgtagcagcgaacgagatgggcctgctggaaactacgaagaaggatttgggaattggtcacgtcgcggtggagaatcaccaccacgccgcgatgctcgatgtggacctgcaccccgcgtccgcatggaccctctacgccgtggcgacaaccataatcacgcccatgatgaggcacaccatagagaataccaccgccaatattagcctgacagccatcgccaaccaggccgccatcctgatggggctcgacaaggggtggcccatctccaagatggacatcggggttccactactggccctcgggtgctacagtcaagtgaaccctcttacgctgaccgccgcagtgctcatgctggtcgcgcattacgccatcatcggtcccggtctgcaggccaaggccaccagggaggcccaaaaacgcacagctgccggcatcatgaagaacccgactgtcgatgggatcgtcgccatcgacctcgaccctgtagtatacgacgccaagttcgagaaacagctggggcagatcatgctcctcatcttgtgcacatcccagatcctgctaatgagaactacttgggccctatgtgagagcatcaccctcgcgacaggccccctcacgacgctgtgggaggggtccccgggcaagttctggaacaccacgatcgccgtgagtatggccaatatcttccgcggaagctacctggccggcgccggtctcgcgttcagcctgatgaagtcgttggggggcgggcgcagagggaccggagctcagggcgaaacgctcggcgagaagtggaaacggcaactgaaccagctgtccaagtcagagttcaacacctacaagagatcggggatcatggaggtcgaccggtcagaggcaaaggagggcctaaagcgaggggagacgaccaagcacgccgtgtcccgaggcacggcaaagcttcgctggttcgtggaacggaacctagtcaagcccgagggaaaggtcatagacctgggctgcggccgcgggggctggagctattactgcgccgggttgaagaaggtgactgaggtcaaaggctacaccaagggagggcctggccacgaggagccaattccaatggccacctacggttggaacctggtgaagttacactctgggaaggacgtgttcttcatcccccccgaaaagtgtgatacgctcttatgtgatatcggagagagttcccccaacccgaccatcgaggagggccggacactgcgcgtcctcaagatggtcgagccctggctccgcgggaaccagttctgcatcaaaatcctgaacccttatatgccttccgtggtagagaccctcgagcagatgcagcgcaagcacggtggcatgttagtgcggaatcccctgtcccgcaacagcacccacgagatgtactgggtgtcttgcggaacgggcaacatcgtcagcgccgtgaacatgacctcccgcatgctccttaaccgattcactatggcccaccggaagcccacctatgagcgggacgtggacctgggagcgggcacacgtcacgtagccgtggaacccgaggtggcaaacctcgacatcatcggtcagcggatcgagaacattaagcacgaacacaagagcacctggcactacgacgaagacaacccatacaagacctgggcctaccacggatcctacgaggtgaagccgagcgggtccgccagcagcatggtgaacggcgttgtgaagctgctgaccaagccctgggatgtgatcccaatggtcacgcagatcgcgatgaccgacaccacccccttcggccagcagcgggtttttaaagagaaggtggacacaaggaccccgaaggccaagcgcggcaccgcccagataatggaggtgacggccaaatggttatggggcttcctatcccgcaacaaaaagccccgcatctgtacgagggaagagttcacaaagaaggtgagatcaaacgccgcgatcggcgccgtgttcgtcgacgaaaaccaatggaactccgccaaggaggccgtggaggacgaacgattttgggatcttgtgcaccgcgagagggagctccacaagcagggcaagtgcgccacgtgcgtctacaacatgatgggtaagcgcgaaaagaagttaggggagttcggcaaggccaaggggagccgtgccatctggtacatgtggctgggagctcggttcttagaattcgaggccctgggtttcatgaacgaggaccattggttctctcgggaaaacagcctgagcggagtggagggcgaggggctccacaagctaggctacatcctgcgagacatctctaagatccccgggggcaacatgtacgcagacgacaccgccggatgggacacgagaatcaccgaagacgacctccagaacgaggcaaggatcacggacatcatggagccagagcacgccttactcgccaagtccatcttcaagctgacctaccaaaacaaggtggtccgcgtccagagacccgcgaagaacgggacggtgatggacgtcatcagccgccgggaccaacgcgggtccggccaggtgggcacgtacgggctgaacacctttaccaacatggaggcccagctgatacgtcagatggagagtgagggtatcttctccccctccgagctcgagacgcccaacctggccgagcgcgtgttagactggctcgagaagtacggcgtcgagcggctgaagcgcatggccatttctggtgacgattgcgtggtgaagccgatcgacgaccggttcgccactgcactgacggccctaaacgacatgggcaaagtcaggaaggacatcccccagtgggagccgagcaagggctggaatgactggcagcaggtccccttttgcagtcatcactttcaccagctgatcatgaaagacggtcgagaaatcgtggtcccgtgcaggaaccaggacgagctggtgggccgggccagagtgagccaaggagccggctggagcttacgggagaccgcttgtctggggaagagctacgcgcagatgtggcagttgatgtacttccaccgccgggacttacgcctggcagccaacgccatctgcagcgcggtacccgttgactggatccccacgtcccggaccacttggagcatccacgcccaccaccagtggatgaccacggaggatatgctgtccgtgtggaatcgcgtctggatagaagagaacccttggatggaagacaagacgcatatctcgtcctggggggatgtgccgtacctcgggaagcgagaggatcagtggtgtggctctctgatcggcctgacggcgcgggctacttgggccaccaatatccaagttgccataaaccaggtccgcaggctcatcgggaacgaaaattatctagactacatgacatccatgaaaaggttcaaaaacgagagtgatcccgagggggccctgtggtga

SEQ ID NO: 24459 - RNA, 9879 nt, synthetic construct
  misc_feature 1..9879: note = derived and/or modified CDS sequence (opt11) from DENV-1__GU131747__SS-prME
  source 1..9879: mol_type = other RNA
agcgtgactatgctgctgatgctgatgcccaccgccctggcctttcacctcaccacccgcggcggggaaccccacatgatcgtgagcaagcaggaacggggcaagagcttgctgttcaagacctctgcgggggtaaacatgtgcaccctcatagcgatggacttgggcgaactgtgtgaagacaccatgacctacaagtgcccgagaatcaccgagaccgaacccgacgacgtggactgctggtgcaacgccacggacacgtgggtcacatacgggacctgcagccagactggcgagcaccggcgcgacaaacggtccgtggcgttggcaccccacgtgggcctcgggctggagacccgtaccgagacgtggatgagctccgagggcgcgtggaagcagatccagcgggttgagacctgggcactccggcacccagggttcaccgtgatcgccctattcctggcgcatgctatcggaacctcaatcacccagaaaggtatcatttttatcttgctgatgctcgtgacgccatctatggccatgcggtgtgtcggtatcgggagccgcgacttcgttgaggggttgtcgggcgccacctgggtagacgtcgtgctggagcacgggagctgcgtaaccacaatggccaaggataagcccacgctggacatcgagcttctgaaaaccgaagtgaccaaccccgctgtactgcggaagctctgcatcgaggcgaagatcagtaacaccactaccgacagccgctgcccgacacagggcgaagccacgctagtagaagaacaagacgccaacttcgtttgccggcgcacgtttgtggatcgtggatgggggaatggatgcgggctattcggcaagggctccctcatcacgtgcgctaaattcaagtgcgtgaccaagctggaaggcaagatcgtccagtacgagaacctgaaatacagcgtgatagtaaccgtgcacacgggcgaccaacaccaggtgggcaacgagtccaccgagcacggcacaacggctaccatcaccccacaggcgcccaccaccgagatccagctcaccgactacggggccctgactctggattgttctccccgtactgggctcgatttcaatgaaatggtcttactcacaatgaaggagaaatcctggctcgtgcacaagcagtggttcctggacctgcccctcccctggactagcggagccagcacatcccaggagacctggaaccggcaggatttactggtaaccttcaaaacagcccatgccaagaagcaggaagtggtagtgctcggctcacaggagggcgctatgcacacggcgcttacgggggctacggagatccaaacctccggcacgaccacaatattcgcagggcacttgaaatgccgcctaaaaatggacaagctgactctgaagggcatgagctacgtcatgtgcacggggtccttcaagctcgagaaggagctggcggagacccaacacggcaccgtgctagtgcagatcaagtatgaaggcacggacgcgccctgtaagatccccttttcaacacaggacgagaagggtgtcacacagaacggccggctgatcacggctaatccgatcgtgactgacaaggagaagcccgtaaacatcgaggccgagccgcccttcggggagtcctacatcgtcatcggcgccggcgagaaggcgctcaagctgagctggttcaagaagggttcctcgatcggtaagatgttcgaggccacggcgcgcggtgcccggcgcatggcaatcctcggagacaccgcgtgggacttcggaagtatcggaggagtgttcaccagcgccgggaagctagtgcaccagatatttggcaccgcttacggggtcctgttctccggcgtgagctggacgatgaagatcgggattggcgtactgctcacatggttgggcctgaactccagaagcacctccttaagcatgacctgcatcgccgtggggctggtaaccttgtacctcggcgtgatggtccaggccgactcggggtgcgtgatcaattggaagggcagagaactgaagtgcgggtcgggcatcttcgtgacaaacgaagtccacacctggacggagcagtacaagttccaggcggacagcccgaagcgcctgtctgccgccatcggcaaggcttgggaggagggggtgtgcggcatacgcagcgcaactcgcctcgaaaacatcatgtggaagcagatctccaacgagctaaaccatatcctactcgagaacgacatgaagtttacggtggtcgtgggggatgtggctggtatcctggcccaggggaagaaaatgatccgacctcagcccatggaatataagtatagttggaagtcttggggaaaagctaagataattggtgccgacgtacagaacaccaccttcataatcgatgggcctaataccccagagtgccccgatgaccagcgagcatggaacatctgggaggtggaggattacggcttcggaatcttcacgaccaacatctggctgaagttacgggatagctatactcaggtgtgcgaccatagactgatgtccgctgccattaaggacagtcgggccgttcacgccgacatgggctactggatcgaatccgagaagaacgagacatggaagctggccagggccagcttcatagaggtaaagacgtgcatctggcccaaatctcacaccctctggtccaacggcgtgctcgagtcagagatgatcatccccaagatctacgggggcccgataagccagcacaattatcgcccagggtacttcacccagaccgccggcccctggcacttagggaagctcgagctggactttgatctatgcgaaggcaccaccgtcgtggttgacgagcactgcggaaaccggggcccgtccctccggaccaccaccgtcactgggaaaattatccacgagtggtgctgccgctcttgcaccctgcctcccctgcgatttcgaggggaagacggctgttggtacgggatggagatcagacccgtgaaggagaaagaggagaacctagtgaagtccatggtcagcgccggtagcggcgaggtggattccttcagcctggggttactctgcatctctataatgatcgaggaggtgatgcgtagccggtggtcccgtaagatgctgatgaccggcacgcttgcggtcttcttcctcctcatcatggggcagttaacgtggaacgacctcatccgactgtgtatcatggtgggcgcgaacgccagcgatcggatggggatgggtaccacctaccttgccctcatggccacttttaagatgaggccgatgttcgccgtaggcctgctgttccggcgccttaccagccgtgaggtcctgctccttaccatcgggctcagcctggtcgcttccgtggagctcccaaacagtctggaggagctgggagacgggcttgccatggggatcatgatactgaagctgttgaccgatttccaaagtcaccagctatgggccactctgctcagcctgaccttcatcaagaccaccttctccctgcattacgcctggaagacgatggcgatggtccttagcatagtgtccctgtttcccttgtgcttaagcaccacctcccagaaaaccacgtggctgcccgtctttctgggcagccttggatgtaagccactgaccatgttcctgatcgcagagaacaagatctggggcagacggtcctggcccctaaacgaagggatcatggcggtgggcattgtttcaatcctgcttagctccctcctgaagaacgatgtccccctggccggacccctgatcgccggcggaatgttaatcgcgtgctacgtgattagcgggtccagcgccgacctctccttggagaaggctgcggaagtatcttgggaggaggaggccgagcatagcggcgcgagccacaacattctggttgaggtgcaagatgacgggacaatgaaaatcaaggacgaggagcgcgacgacactctgaccgtgctcctgaaggccacactgctcgccgtttccggcgtgtacccgctgagcattcccgccaccctgtttgtctggtacttctggcagaagaagaagcagcggtccggggtcctttgggacacccccagcccgcccgaggtagagcgcgcagtgctggacgacggcatctaccggatcatgcagaggggccttttggggcggagccaggtcggagtgggggtgttccaggagaacgtcttccataccatgtggcacgttactcgcggcgcggtgcttatgtaccaggggaagcgtctggagccgtcctgggcctccgtgaagaaagacctcatcagctacggcggtggttggcgactccagggctcctggaacaccggggaggaagtccaggttattgctgtcgagcctggcaagaaccccaagaacgtgcagaccgcccccggaaccttcaagactccagagggcgaggtcggtgctatcgcgctagactttaaacctgggacatcaggctcgcctatcgtcaaccgggaagggaaaatcgtgggtctgtacggcaatggtgtggtcacaaccagcggaacctacgtgtctgcaatcgcacaggccaaggcatcccaggagggcccgctccccgagatcgaggacgaggtcttccggaagcggaacctgacaattatggacctgcatcccggctccgggaagacccgtcgctatctcccggccatcgtgagggaggccataaagaggaagctgcggactctgatactcgccccgacgcgcgtagtagcctccgagatggcggaggctcttaagggaatgccgatcagataccagaccaccgccgtcaagagcgagcacaccgggaaggagatcgtggacctcatgtgccacgctacattcaccatgcgcctcctgtcaccagtgcgagtcccaaactataacatgatcataatggacgaggcacacttcacggacccaagctcaatcgccgcccgcggttacatcagcacccgggtgggcatgggggaggccgccgccatcttcatgacggctaccccgcccggctccgttgaggccttcccgcagagcaacgccgtaatccaggacgaggagagggacatccccgagcggtcctggaactccgggtacgagtggatcaccgacttcccgggcaagaccgtgtggttcgtgccctccataaagtccggaaacgatatcgccaactgcctgcgaaagaacggtaagcgagtgatccagctgtcccgcaagacgttcgacacagagtatcaaaagacgaagaacaacgactgggactatgtagtgaccactgacatcagcgagatgggcgcgaatttccgtgccgaccgtgtgatcgacccccggcgctgcctgaagcccgtaattcttaaggacgggcccgagcgggtgatcctcgccggccccatgcccgttaccgtggcctcggccgcgcagcgccgggggagaatcggcagaaatcacaataaggagggggaccaatacatctacatgggacagcccctcaacaacgacgaagaccacgcgcactggaccgaagccaagatgctgctcgacaacataaacacccccgaaggcataatcccagcgcttttcgagccagaacgggagaagtccgcagcgatcgacggagagtaccgtctgagaggggaagctcgaaagacgtttgtcgagctcatgcggcgcggggacctgcccgtgtggctgagttataaagtggccagtgaaggcttccagtacagcgaccggcgatggtgttttgacggcgagagaaacaaccaggtactggaggaaaacatggacgtggagatctggacaaaggaaggggagagaaagaagttgcggcctagatggctggacgcccggacctattccgatcccctggccctgcgcgagttcaaggagttcgcggcaggccggcggtcggtatccggggacctgattctggaaattgggaagctgccgcagcacctaacccagcgggcccagaatgccctcgacaacttggtcatgctgcataactcggagcagggcgggcgagcgtaccggcacgcgatggaggaactcccagacacgatagaaaccctgatgctcctcgccctgatcgccgtgctgaccggtggggtgaccctcttcttcctgtctggccgggggttagggaaaaccagcatcggcctcctgtgcgtcatggcctctagcgttctgctctggatggcgtccgtggaaccacactggatagccgccagcatcatcctggagttcttcctaatggtcctcctgatccccgagccggaccgccagcgcacgcctcaggacaaccagctggcctacgtggtaatcgggctactcttcatgatcctgacagtcgccgcgaacgagatgggactcctggagactaccaaaaaggacctggggatcggtcacgtcgccgtggagaatcaccatcacgccgcaatgttagacgtcgaccttcaccccgcctccgcatggacgctgtatgccgtggccaccaccataattaccccgatgatgcgccatacgatagagaacaccactgccaacatcagcctcaccgccatcgccaatcaggccgccattctcatggggctggataagggatggcccatctccaagatggacatcggggtgcctctattggccctagggtgttacagccaggttaaccccctcacgcttaccgcggccgtgctgatgctcgttgcccattacgccataatcggcccggggttgcaggccaaggctacccgggaagcgcaaaagcgcaccgcggcaggcattatgaagaaccccacggtcgatggcatcgtagcgatcgatctagaccccgtggtgtacgatgcgaagttcgagaagcagctcggccagatcatgctgttaattctctgcacctcccaaatcctgttaatgagaactacctgggccctctgcgaaagtatcactctggctaccggccccctgaccacgttatgggagggttccccgggcaagttttggaatacgaccatcgccgtgtctatggccaacatctttcgcggctcctacttggctggagccggcctggccttctctctcatgaagagtctagggggcgggcggcgcgggaccggggcccaaggtgagactctgggtgaaaaatggaagcggcagttgaaccagctctccaagagcgagttcaacacgtacaagcgctccgggatcatggaggtggacagaagcgaggcaaaggagggcctgaaacgcggggagaccactaaacacgccgtctcgcggggcaccgctaagctgcgctggtttgtggagcggaacttggtgaagcctgagggaaaggtgatcgatttgggctgcggccgcggaggctggagctactactgcgccgggctgaagaaggtcacagaggtgaagggatacaccaagggcggacccggccacgaagaacccataccaatggccacatacgggtggaacttggtcaagctgcacagtggcaaggatgtgttcttcatccctccggagaagtgcgacaccctactctgcgacattggggagagctcccccaacccgacgatcgaagagggccgaaccttaagagttttgaagatggtggagccgtggctcagaggaaaccaattctgcataaagatcctgaacccctatatgccctctgtagtagaaacacttgagcagatgcagcgcaaacatggcggcatgctcgttcggaaccccttatcacgcaattccacccatgagatgtactgggtgtcctgcgggaccgggaatatagtaagcgcagtcaacatgacttccaggatgctgctcaatcgatttaccatggcccaccgcaagccgacctacgagcgggatgtagacctgggggcgggcacccgccacgtggccgtcgagcctgaggtggctaacctggacatcattggccagcggatagagaacatcaagcatgagcataagagcacttggcactacgacgaggacaacccctataaaacctgggcctaccatgggtcctatgaggttaaaccgagcggctccgccagcagcatggtaaacggtgtggtcaagctcctgacaaagccatgggacgtaatccccatggtcacccagatcgcgatgactgacaccacgcccttcggccagcagcgcgtatttaaggagaaggtggacactcggacgccgaaggccaagcgagggaccgcccaaattatggaggtgaccgcaaagtggctgtggggctttctctccaggaacaagaagccacgcatctgcacccgggaggagttcacgcgcaaggtgcggtctaacgccgcgatcggagccgtgttcgtggacgagaaccagtggaactccgcgaaggaggcggtagaggacgaacgcttctgggaccttgttcaccgggagcgggagctgcacaagcaagggaagtgtgcaacgtgcgtgtacaatatgatgggcaagcgggagaagaaactcggcgagttcggcaaagccaaggggagccgcgccatctggtacatgtggcttggcgcccggttcctcgagttcgaggccctcggcttcatgaatgaggatcactggttctcccgtgaaaacagcctctccggggtcgagggcgaggggctgcacaagttggggtacatcctgcgggacattagcaagatccccgggggcaacatgtacgccgacgacacggctggctgggacacccggatcacggaggacgaccttcagaacgaggcccgcatcaccgacataatggaaccagaacacgcactcctggccaagtccatttttaagctgacttaccaaaacaaggtggtgcgggtccagcggcccgccaagaacgggaccgtgatggacgttatcagccgtcgcgatcagcggggctccgggcaagtgggcacgtacgggctcaacacattcaccaacatggaagctcagctgatccgccagatggagagcgaaggaatattctcgccaagcgagttagagacccccaacctagcagagcgggtgttagactggcttgaaaagcacggcgtggagcgcctcaaacggatggcgatcagcggagatgactgtgtcgtgaagcccatcgacgatcgcttcgccacggcgctgactgccctgaatgacatgggcaaagtccggaaggacatcccgcaatgggagcccagcaagggatggaacgactggcagcaggtcccgttctgctcccaccatttccatcagctcataatgaaggacggacgtgaaatcgtggtgccatgccgtaaccaggacgagctggttggacgcgccagggtatcccagggggcaggctggtcactgcgcgagaccgcctgcctcgggaagtcgtacgcccaaatgtggcaactaatgtactttcaccgtcgcgatcttcggctcgccgcgaacgccatatgtagcgcagtgcccgtggactggatccccacgtccaggacgacgtggtcgatccacgcccaccatcagtggatgaccaccgaggatatgctgtccgtgtggaatcgcgtgtggatcgaggaaaatccgtggatggaggataagacgcacattagctcctggggtgacgtcccttacctggggaagagagaggaccagtggtgcggctcactcattgggctgaccgcacgtgcaacgtgggccaccaacatccaggtggccatcaatcaggtgcggcgtttgatcggaaacgaaaactacttggactatatgacctccatgaaacggttcaagaacgagagcgacccagagggcgccctgtggtag

SEQ ID NO: 24460 - RNA, 9879 nt, synthetic construct
  misc_feature 1..9879: note = derived and/or modified CDS sequence (opt11) from DENV-1__GU131748__SS-prME
  source 1..9879: mol_type = other RNA
tctgttaccatgctgttcatgctcgtgcccacagccctcgcctttcacctgaccacccggggcggggagccccacatgatcgtgtccaagcaggagcgaggcaagtcactcttattcaagacctcggccggggtgaacatgtgcaccctgatcgccatggacttaggagagctgtgcgaggacaccatgacctacaagtgcccccgtatcaccgagaccgagcccgatgacgtggactgctggtgcaacgcgaccgacacctgggtgacatatggcacctgcagccagaccggtgagcatcggcgggacaagaggtcagttgccctggcgccgcacgtcggccttgggctcgaaacccgcaccgagacctggatgagctccgagggcgcctggaagcagatccagcgggtggagacgtgggccctgcggcaccccggtttcaccgtaatcgcactcttcttggcccacgcgatcggcacctcaatcactcagaagggtatcatattcatcctactaatgctcgtgacgccctccatggccatgcgttgcgtaggcatcggcagccgcgacttcgtggaaggactgtccggggccacctgggtcgacgtggtgctagaacacggtagctgcgtcactaccatggccaaggacaagcccacgctggacatcgaactgctcaagaccgaggtcaccaacccggcagtgctgcggaagctttgcatcgaggcgaagatctccaataccacgaccgacagccgctgccctacccaaggagaggccaccctcgtcgaggagcaggacgccaatttcgtgtgtcggcgcacgttcgtggaccggggttgggggaacggctgtgggctgttcggcaaggggtccctgatcacgtgcgcaaagttcaagtgcgtcaccaagttggagggcaagatcgtgcaatatgaaaacctgaagtactccgtcatcgtcactgtgcacacgggcgaccagcatcaggtcggaaacgagtccaccgagcatggaacgaccgccaccatcacacctcaagcgcccaccacggagattcagctaacggactacggggccctcaccctggactgcagcccccgcaccggcctggactttaacgagatggtgctcctgaccatgaaggaaaagtcctggctggtgcacaagcaatggtttctagacctgcccctgccctggacaagcggggccagcacgtcgcaggaaacctggaatcgacaggaccttctggtcacctttaaaaccgcccacgccaagaagcaggaggtggtggtcctgggcagccaggagggcgcgatgcacacggccctcaccggggccaccgagatccagacctctggcacgacgaccatcttcgccggtcatttgaagtgccgactgaaaatggacaagctgaccctcaaaggcatgagctacgtgatgtgcacggggtctttcaagctagagaaggaggtggccgagacccagcacgggaccgtcttagtgcaaatcaaatacgaaggcaccgacgcgccctgcaagatccccttttccacgcaggacgagaagggggtgacccagaatggcagattaatcaccgccaacccaattgtgaccgacaaagagaagcccgtgaatatcgaggcagagccgcctttcggggagtcctatatcgtgatcggtgccggcgagaaggccttaaagctgagctggttcaagaagggatcctccataggcaagatgttcgaagccacggcccgtggagcccgtcgcatggccatattaggggacaccgcatgggacttcgggtccatcggcggcgtcttcacaagcgtgggtaagctggtgcaccagatcttcgggaccgcgtatggggtgctcttctccggggtgagctggacaatgaagatcgggatcggcgttctcctgacctggctgggcctcaattccaggtccacctctctgagcatgacttgcatcgccgtcggtctggtgacgctctaccttggcgtgatggtccaggctgactccggttgcgtgatcaactggaaaggacgggagttgaaatgcgggagcggcatctttgttaccaacgaggtacacacctggaccgaacagtacaagttccaggccgactctccgaagcgcctctccgcagccatcggcaaagcctgggaggaaggggtgtgcgggatccggagcgccacccgcctggagaacatcatgtggaagcagatcagcaacgagctgaatcacatcctcctggagaatgacatgaaatttaccgttgtagtaggagatgtggccggcatccttgcccaggggaagaagatgatccgcccccagcccatggagtacaagtatagctggaagagctggggcaaggccaagatcatcggcgccgacgtccagaacaccaccttcatcatagacggtcccaacaccccggaatgccccgacgaccagcgcgcatggaacatctgggaagtggaggactacggcttcgggatcttcaccaccaacatctggctcaagcttcgggactcctatacccaggtctgcgaccataggctgatgtccgctgccatcaaggatagcaaggccgtccacgccgatatgggctattggatagagtcggagaagaacgaaacgtggaagctcgcgcgggcgagcttcatcgaggtgaaaacttgcatatggccaaaatcccacaccctgtggagcaacggcgtgctagaaagcgagatgataattcccaagatctacggaggaccgatcagccagcataactaccgcccggggtacttcactcagactgccggtccttggcacctcgggaagttggagctggacttcgacctctgtgagggcactactgtcgtggtggacgagcactgcggcaaccgggggccgtccctgcggactaccacggtaacaggcaagatcatccacgagtggtgctgccggagctgcaccctgccgccactgcgcttccgaggggaggacggttgctggtatggtatggagatacgacccgtgaaggagaaggaggaaaacctagtgaagtcaatggtcagcgcaggcagcggcgaggttgactctttcagcctgggacttctgtgcatcagtataatgatcgaggaggttatgcggtctcgctggtccaggaagatgctaatgaccggcacgctcgccgtgttcttcctgctgatcatgggacaactcacctggaacgacctgatccgcctgtgtataatggtaggcgcaaacgcgagcgacagaatggggatgggcaccacatacctcgctctcatggccacgttcaagatgcggcctatgtttgcggtgggcctcctgtttcgccggctgacctcccgtgaggtcctgctcctgaccatcggcttaagcctcgtggcgtccgtcgagctacccaactccctggaagagttaggggacgggctggcgatgggaataatgatccttaaattgttgaccgactttcagtctcatcaactgtgggccacgcttttatcactgaccttcattaagacaaccttcagcctccactacgcctggaagacgatggccatggtgctgagcatcgtgtctctctttcccctctgcctgagcaccacctcccagaagacgacctggctaccggtgctcctggggagcctggggtgcaagcccttgaccatgttcctgatcgcggagaacaagatatgggggcggcgctcctggcccctgaacgaggggatcatggcggtgggcatcgtgagcatcctcctgagttccctgctcaagaacgacgtcccgctggctgggcccctgattgccggcggcatgttaatcgcctgttacgtgatcagcggatccagtgcggatctgtccttagagaaagccgccgaggtgagctgggaagaggaggccgagcactcaggggccagccacaacatcctagtcgaggtgcaggatgacgggaccatgaagatcaaggacgaagagcgggatgacaccctgaccatcctgctgaaggcgacgctactcgcagtatccggcgtctacccgctaagcatccccgccaccctgttcgtttggcacttctggcagaagaaaaagcagagatccggggtgctgtgggacacccccagccccccagaggtcgagcgagccgtgctcgacgacggcatatatcgcataatgcagcgtggcctgttagggcgctcccaggtaggcgtaggggtgttccaggaaaacgtgttccataccatgtggcacgtcacgcgaggcgccgtcctgatgtaccaaggaaagcgcctagaacctagctgggcgtccgtgaagaaggacctgatatcatatggcggcgggtggagactgcagggctcgtggaacaccggggaagaagtccaggtgatagccgtggaacccggcaaaaatccaaagaatgtccagaccgcccccgggacgttcaagacacccgagggggaagtgggcgccatcgccctcgacttcaagccggggactagcggttcccctattgtaaatagagaggggaagatcgtgggcctgtatggcaacggggttgtgaccacctcaggcacgtacgtaagcgcgatcgcccaggcgaaagcctcccaagaagggccgctgccagagatcgaggatgaggtgttccgaaagcgaaacctcaccatcatggacctacaccccggctccgggaagacccggcgatacctgcccgcgatcgtacgtgaggccatcaagcgcaaactccgaaccctaatactggcgcccacaagagtcgtggcctccgagatggctgaggcgctcaaaggcatgcccatccgctaccagaccaccgccgtcaaatcggaacacaccggcaaggagatcgtcgacctgatgtgccacgctacgttcacgatgcggctgctctcgcccgtgcgcgtgccgaactacaacatgatcatcatggacgaggcccacttcaccgaccccagttccatcgccgcgcgggggtacatctccacccgcgtcggcatgggggaagccgctgccatcttcatgaccgccacgccgcccgggtccgtggaggccttcccgcagagcaacgccgtgatccaggacgaggagcgggacatccccgagcgctcttggaacagcgggtacgagtggatcaccgacttccccgggaagacggtctggttcgtgccctccatcaagagcggcaatgatatcgcgaattgcctgaggaagaacggtaagcgtgtgatccagctgtcccggaagactttcgataccgagtatcagaagactaagaacaatgactgggactacgtggtgaccacagatatcagcgagatgggtgccaacttccgcgcggaccgggtgatcgacccgcgccggtgcctcaaacccgtcatactgaaggacgggcccgagagagtgattctagccggccccatgccggtaaccgtggcctcagccgcccagcgtcgcgggcggatcggccgcaaccacaacaaggagggcgaccagtacatctatatggggcagccgctcaacaacgacgaagatcacgcgcactggaccgaggccaagatgctgctggataacatcaatacccccgaaggcataatacccgccctattcgagccggagcgcgagaagtccgccgccatcgacggtgaataccgattacgtggcgaggcccgaaagaccttcgtggaactgatgcgccgcggggacctacctgtctggcttagctacaaggttgcctctgagggcttccagtattctgaccgccggtggtgcttcgacggcgagcgcaacaaccaggtgttagaagagaacatggacgtggagatctggaccaaggagggggagcggaaaaaactcagaccccgttggctggacgcccgcacctactccgatccccttgccctccgggagttcaaggagttcgccgcgggccgccggagcgtgagtggggatctaattctggagataggcaagctaccacagcacctgacacagagggcccagaacgccctggacaatcttgtgatgctccacaacagcgagcagggcgggcgcgcctatcgccacgcgatggaggagctgcccgacacgatcgagactctcatgctcctggccttaatagccgtcctgaccggcggggtgaccctgttcttcctcagtggtcgggggctgggcaagactagcattggtttactttgcgtaatggcctcatcggtcctgttatggatggcctcggttgagccccactggatcgcggcctctatcatactcgaattcttcctgatggtgctgcttattcccgagccggaccgccaacggacgccccaagacaatcagctggcctatgtggtcatcgggctcttgttcatgatcctgaccgtggcagccaatgagatgggtctgctcgagacgaccaagaaggacctggggatcggtcacgtcgcggtggagaatcaccaccatgccgccatgctcgatgtggatctccaccccgccagcgcctggaccctgtacgcggtcgctaccaccattatcacccccatgatgcgccacacgatcgagaacacaaccgcgaacatatcgcttaccgccatcgctaaccaagcagcaatcctgatggggttggacaaaggctggcccatctccaagatggacatcggcgtgccgctgctcgccctgggctgctacagccaggtcaacccactgacgctcacagcagcggtcctgatgttggttgcccactacgccatcatcggcccggggctccaggccaaggccacccgggaggcccaaaagcgcacggccgccggcataatgaaaaatcctacagtggacggtatcgtcgccatagacctagatcccgtggtgtatgatgccaagtttgagaagcagctggggcaaatcatgttactgatcctctgcacctcccaaatcctcctgatgcgcaccacctgggcgctgtgcgagagcatcacgctcgccaccggccccctgaccaccctgtgggaggggtctccgggcaagttctggaacactacaatcgccgtcagcatggccaacatattccggggttcctacctcgccggtgcggggctggccttttctctgatgaagtccctcggcggggggcgccgaggcaccggggcccagggcgagactctgggcgagaagtggaaacgccagctgaaccaactctccaagagcgagttcaacacgtacaagcgatccgggatcatggaagttgatcgcagcgaggccaaggagggcctcaagaggggggaaaccaccaagcacgcggtatcccgcggcaccgcaaaattacggtggttcgtggagcgcaacctcgtaaagcccgaggggaaggtgatagacctgggctgtggccgcggcgggtggagctactactgcgctgggctgaagaaggtcacggaagtgaagggatacaccaagggagggcccggacatgaggagcccatcccgatggccacctacggatggaacctcgtcaagctccactccggcaaagacgtctttttcatcccaccagagaagtgtgacaccctgctgtgcgacatcggggagagctcacccaacccgacgatcgaggaggggcggaccttgcgggttctaaagatggtggaaccctggctgcgcgggaatcagttttgcatcaaaatcctgaacccctatatgcccagcgtcgtggaaaccctggagcagatgcagcggaaacacggagggatgttagtgcgcaaccctctctcccggaacagtacacatgaaatgtattgggtctcctgtgggaccggcaacatcgtgagcgccgtgaacatgacgtcccgcatgctgctgaaccgctttaccatggcgcatcggaagcccacctacgaacgcgatgtcgatctcggggccggcacccggcacgttgccgtggagccagaggtcgccaatctggacatcatcggccagcgcatcgagaacataaaacacgaacataagagcacgtggcactacgacgaagacaacccctataagacctgggcctaccacggttcctacgaggttaagccgagcggctccgcgagttctatggtcaacggagtagtgaagctgctcaccaagccctgggacgtgatcccgatggtgacacagatcgccatgacggacaccaccccctttgggcagcaacgggtatttaaggagaaggtcgacacccgaacgccaaaggccaagcgggggactgcccaaataatggaggtgactgcaaagtggctgtggggcttcctttcccgcaacaaaaaaccccgtatatgcacccgcgaggaattcacccgcaaagtgaggtcaaacgctgccatcggcgccgtgttcgttgacgagaaccagtggaactccgccaaggaggcggtagaggatgagcgcttttgggatctagttcaccgggaacgggagctgcacaaacaagggaagtgtgctacttgcgtatataacatgatgggaaagcgcgagaagaagctgggggagttcggcaaggccaaggggagccgggccatctggtacatgtggctcggcgctcgtttcctggagttcgaggcgctgggcttcatgaacgaggatcactggttcagcagggagaactcattgtcgggggttgagggcgagggcctgcacaagctagggtacatcctgcgagacatctcaaagatccccgggggcaacatgtatgctgacgatactgccggctgggacacccggatcacggaggacgaccttcaaaacgaggcccgcattaccgacatcatggagccggagcacgccctgttggcaaaatccatcttcaagctgacctaccagaacaaggtggtgcgcgtgcagcgcccagccaagaacggtaccgttatggatgtcatcagccgccgagaccaacgcggctccggccaggttgggacatacggcctgaacaccttcaccaacatggaagctcagctcatccggcagatggagagcgaagggatcttttcccccagcgagctggagacccccaacctggcagaacgggtgctcgactggctggagaaatacggcgtcaagcggctgaagcgcatggccatctccggcgacgactgtgtggttaagccgattgacgaccgattcgcgacggccctaaccgccctgaacgatatgggcaaagtgcgcaaggacatcccccagtgggagccgtctaaggggtggaacgactggcagcaggttccattctgctcccatcactttcaccagctgatcatgaaggacggccgtgagatcgtagtgccgtgccggaatcaggacgagttagtgggccgagcccgcgttagccagggggccggatggagcttaagggaaaccgcgtgcctcgggaagagctacgcccagatgtggcagcttatgtacttccaccgcagagacctacgcttagcagccaacgccatctgtagcgccgtgcccgtggactggatccccacttcacggacgacctggagcatccacgcccaccaccagtggatgaccaccgaggatatgctctccgtgtggaaccgcgtctggatcgaggagaacccctggatggaagataagacccatataagctcctggggagatgtgccgtacctggggaagagggaggaccagtggtgtggttcactgatcggcctcaccgcccgggccacctgggcgaccaacatccaggtcgccatcaatcaagtgcgccggttaatcgggaacgagaactacctagactatatgacatccatgaagcgcttcaagaatgagagcgaccccgagggagcactctggtga

SEQ ID NO: 24461 - RNA, 9879 nt, synthetic construct
  misc_feature 1..9879: note = derived and/or modified CDS sequence (opt11) from DENV-1__GQ868615__SS-prME
  source 1..9879: mol_type = other RNA
tccgtgaccatgctgctgatgctgatgcccaccgcactggccttccacttgaccacacggggcggagaaccccacatgatcgtcagcaaacaggagcggggcaagagcctgctgttcaagacatccgccggggtgaacatgtgcaccctcatcgcaatggacctcggagagctttgcgaggacaccatgacctacaagtgccctcgaatcaccgagaccgagcccgacgatgtggactgttggtgtaacgcgactgacacttgggttacctacggcacatgcagccaaacgggcgagcatcgccgggacaagcggtccgtggccctcgcgccccatgtgggcctagggctcgagacccgaactgagacctggatgagctccgagggcgcctggaaacagatccagcgggtggagacgtgggcactccggcacccggggttcaccgtgatcgccctgttcctggcccacgcaatcggcaccagcatcacccagaaggggatcattttcatcctcctgatgctggtgacgccctccatggccatgcggtgtgtaggaatcggcagccgcgacttcgtggaggggcttagcggcgccacctgggtggacgtagtactggaacacgggagctgcgttaccaccatggccaaggacaagcccacgctggacatagagcttttaaagaccgaggtcaccaaccccgcggttctgcggaaactctgcattgaggcgaagatctccaataccactacagactcgcgctgccctacccaaggcgaggcgaccttggtggaggaacaagacgccaacttcgtttgccggcgtacatttgtggaccggggctgggggaacggctgcggtctgttcggtaaagggtccctcatcacgtgcgccaaattcaaatgcgttacaaagctggaaggaaagatcgttcagtacgagaacctgaagtactctgtgattgtgaccgtccacacgggggaccagcaccaggtggggaacgagtcgaccgagcatggtaccactgccaccatcaccccgcaagcccccaccaccgagatccaactaactgactacggggccctcacccttgattgcagtcctcgcaccggcctcgattttaacgaaatggtcctgctaaccatgaaggagaaatcctggttagtccataaacagtggttcctggaccttcccctgccgtggacaagcggcgccagcacgtcccaggagacctggaaccggcaggaccttctggtaaccttcaagaccgcccacgccaagaagcaagaggtcgtggtgcttgggagtcaagaaggggccatgcacacggctctcaccggcgctaccgagatccaaacctccggcacaaccactattttcgccggtcacctgaagtgccgcctcaagatggacaaacttaccctgaagggcatgagctacgtcatgtgcacggggtccttcaagctcgagaaggagctggccgagacccagcacggcacggtgcttgtacagatcaagtacgagggcaccgacgcgccctgcaagatccccttctctacacaggacgagaagggggtaacccagaatggccgcctgataactgccaaccccatcgtgaccgacaaggaaaagcccgtgaacatcgaggccgagccgccgttcggcgaatcctacatagtcatcggcgcgggcgaaaaagcgctcaagctgagctggtttaagaagggttcctcgatcggcaagatgttcgaggccacggcccgcggggcccggcgaatggcgattttgggcgatactgcatgggactttggttccatcggtggcgtgttcaccagcgtgggcaagctcgttcaccagatcttcggaaccgcctacggagtactgttttccggcgtgtcatggacgatgaaaatcggaatcggcgtcctgctcacctggctgggtctcaactcccgcagcacatccttgtctatgacctgcatcgccgtggggctggtgaccctgtacctcggcgtcatggtgcaagcagactccggctgcgtgatcaactggaaaggccgggaactcaagtgcggaagcggcatcttcgtcaccaacgaggtgcacacttggaccgagcagtacaagttccaggccgacagcccgaaacgcctgtccgcggccatcggcaaggcctgggaggagggcgtgtgcggcatccggagcgccacccgcttggagaacataatgtggaagcagattagcaacgagctgaaccacatcctgctcgagaacgacatgaagttcacggtcgtggtgggggacgtcgcaggcatactggcgcaggggaagaagatgatccggccccagcccatggagtacaagtacagctggaagtcctggggcaaggccaaaatcatcggcgccgacgtacagaacacgacctttatcatcgacgggcccaacaccccggaatgtcccgacgaccaacgcgcatggaacatctgggaggtggaggactacggttttgggatcttcacgaccaatatctggcttaagctccgggacagttatacccaggtctgcgaccaccgcctgatgtccgctgctatcaaggacagcaaggccgtgcacgccgacatgggctactggatcgagtccgagaagaacgagacctggaagctggcccgggcaagcttcatcgaggtgaagacgtgtatctggcccaagtctcacaccctctggagcaacggagtcctggaatcagaaatgatcatccccaagatctacgggggtcccataagccaacacaactaccgacccggttacttcacgcagaccgccggcccctggcacctggggaagctcgagctggactttgatttatgcgagggaacgacagtcgtggtcgacgagcactgcggcaatcgtgggccgtccttacgcaccacaacggtgaccggcaagattatccacgagtggtgctgccggagctgcaccctgccgcccctgcgcttccgcggggaggacggctgttggtacggcatggaaatccgccccgtcaaggagaaggaggagaacctcgtaaagtccatggtgagcgcaggcagcggggaagtggactccttcagcctgggtctgctatgcatctccataatgatcgaagaggtaatgcggagccgctggtccagaaagatgttaatgaccggcacgctggccgtgttcttcctcctaattatggggcagctgacctggaatgacctcatcagactatgcatcatggtgggcgccaatgcgtcggaccgcatggggatgggcaccacctacctggccctgatggccacgtttaagatgcggccgatgttcgccgtaggtctgctctttcggcggctcacctcccgagaggtattactgctgacgatcgggctgagcttggtggcctccgtcgaactgccgaacagccttgaggagctgggcgacgggctagcgatgggcatcatgatccttaagttactcaccgacttccagagtcatcagttgtgggccactttactcagcctcaccttcatcaaaaccaccttctccttacactatgcctggaaaacgatggccatgatcctttccatcgtgagccttttccccttatgtctctccaccacctcccagaagaccacgtggctgccagtactgctcggcagtctggggtgtaagccactgaccatgttccttatcgcggagaacaaaatctggggtagacgctcctggccactgaacgaggggattatggcagtgggtatcgtgagcatcctgctcagctccctgctgaagaacgacgtccccctcgcggggcctctgatcgccgggggcatgctgatcgcctgctatgtgatcagcggttcctctgcggacctctccctggagaaggccgccgaggtgagctgggaggaagaggccgagcactctggcgccagccacaacatcctggtcgaggtgcaggacgacgggaccatgaagatcaaggacgaggagcgtgacgacaccctcacaatcctgctgaaggcgacgctgctggccgtgtccggtgtctacccgctgagcatcccggcaacgctcttcgtgtggtacttctggcagaagaagaagcagcgctctggggtgctgtgggacaccccctctccacccgaggtcgagcgggccgtgctggacgacggcatctaccgcataatgcagcggggcctgctcgggcgctcccaggtgggcgtcggggtgttccaggagaacgtgtttcacacaatgtggcacgtcacgcggggtgctgtgctgatgtaccagggaaagaggctggagcccagctgggcgagcgtgaagaaggatctcatcagctacggcggcgggtggcggctgcagggctcctggaacacaggggaggaggtccaagtgatcgccgtggagcccgggaagaaccccaagaatgtccagaccgcacccgggacgttcaagacacccgaaggggaggtgggtgccatcgccctggacttcaagcctgggaccagcggctcccccatcgttaaccgcgagggcaagatcgtcggactctacggcaacggagttgtgaccaccagcggaacgtacgtctcagcgattgcacaagccaaggcttcccaggagggaccgctgcccgagatcgaggacgaggtgttccggaagcgcaacctgactatcatggacttgcaccccggcagcgggaagaccaggcgctacctaccggccatcgtgcgggaagccatcaagcgcaagttgcgcaccctaatcctggcccccacgcgagtggttgccagcgagatggcggaggcgctgaagggcatgcccatccgctaccagaccactgccgtcaaatcagagcacacgggaaaggaaatcgtcgacctcatgtgccacgccacgttcactatgcggctgctgagccccgtgcgggtgccgaactacaacatgatcatcatggacgaggcccacttcacggacccgtcaagtatcgccgccagggggtacatcagcacccgcgtcggcatgggggaggccgccgcaatattcatgacggccacgcctcctggcagtgttgaggcgttcccgcaatctaatgccgtaatccaggatgaggagcgggacatccccgagcgctcctggaatagcgggtacgagtggatcaccgatttccccggcaagaccgtatggttcgtgccatccatcaagagcggcaacgacatcgccaactgcctacggaaaaacgggaagcgcgtgattcagctgtcacggaagacgttcgacacagagtaccagaagaccaagaacaacgactgggattacgtcgtgaccacggacatctcagagatgggcgccaacttccgcgcggaccgggtcatcgaccctcgccggtgtctgaagcccgtcatcctcaaggacgggcccgaacgtgtgatcctagccggccccatgcccgtgaccgtcgcctcggcagcccagcggcgcgggcgcatcggccgcaatcataacaaggagggcgaccagtacatctacatggggcagccgctgaacaatgacgaggatcacgcacactggaccgaggccaaaatgctcctggacaacatcaacacccccgagggtatcatccccgccctgttcgagccggagcgcgagaagtcggccgccattgacggagaataccggctccgcggggaggcgcggaagacgttcgtggaactgatgcgccgtggggacctgcccgtatggctgtcctacaaagtagccagcgagggcttccagtacagtgaccgccggtggtgcttcgatggcgagcgaaacaaccaagtgctcgaggagaacatggacgtcgagatttggaccaaagagggggagcggaagaagcttcgcccccggtggttagacgcccgcacctactccgaccccctggctctgcgggaattcaaggagttcgccgccggacgccggagcgtctcgggggacctcatcctggaaataggcaaactgccgcagcacctcacccagcgggcccagaatgccctggacaacctggtgatgctccacaacagcgagcagggcgggcgggcctaccgccacgcgatggaggagctgcccgatacgatcgagaccctcatgctgctagccctgatcgcagtcctcacggggggggtgaccctgttttttctgtccggtcgcggtctcggaaaaaccagcatcggcctgctgtgtgtgatggcgtccagcgtcctcctgtggatggcctccgtggaaccccactggatcgcggccagcatcatcctggagttcttcctcatggtcttactgatccccgagccggaccgccagcggacgccccaggacaaccaactcgcttacgtcgttatcgggcttctctttatgatcctcactgtggccgccaacgagatgggcctgctggaaaccaccaagaaggacctcgggatcggccacgttgcggtggaaaaccaccaccacgcggcgatgctggacgtcgatctgcatcccgcctctgcctggacgctgtacgcggtcgccaccaccatcatcaccccgatgatgcgccacacgatcgagaacaccaccgccaacatcagcctgaccgccatcgcgaaccaggcggctatcctgatgggactcgacaagggctggcccatatccaagatggacatcggcgtaccgctgctagccctcggctgctacagccaggtgaaccccctgacgctaaccgccgcggtgctcatgttggtggcccactacgccattatcggcccggggttacaagcaaaggccacgcgcgaggcacagaagcggactgccgccggcataatgaagaaccccacggtcgacgggatcgtcgccattgatttggacccagtggtgtacgatgccaagttcgagaaacagctggggcagatcatgctgctcatcctgtgcacctcccagatactgctcatgcgcacaacctgggcgctgtgcgagagcatcacgctggctacgggccctctcacaaccctgtgggagggttcccctggcaaattctggaacacgactatcgcggtcagcatggcaaacatattccggggctcctacctcgcaggcgcgggcctcgcatttagcctgatgaagtcactcgggggtgggcgccgggggaccggggcccagggcgagaccctcggcgagaagtggaagcgccagctaaaccagttgtccaagagcgagttcaacacgtacaagcggtccgggatcatggaagtggaccgcagcgaggccaaagagggcctcaagcgcggggagaccaccaagcacgcggtgtcccgcggaaccgccaagcttcgatggttcgtcgagcggaacttggtgaagcccgagggtaaggtgatagacttgggctgcggccgtggggggtggagttactactgcgcgggcctcaagaaggtcacggaggtgaagggctacaccaaaggcgggcctggccacgaggagcccatcccgatggccacctacgggtggaacctcgtcaagttgcattccggcaaagacgtcttcttcatcccgcctgagaagtgtgataccctcctgtgcgacatcggggagagttcccccaacccgacgatcgaggaaggccgtaccctgcgggtgctcaagatggtggagccctggcttcgcgggaatcagttctgcatcaagatcctgaacccttacatgccgtcggtcgtggagaccctcgagcagatgcagcggaaacatggcggcatgttggtgcgcaacccgctgtcccggaacagcacccatgagatgtactgggtctcctgcggaaccggcaacatcgttagtgccgtgaacatgacgtcccgcatgttattaaaccgcttcaccatggcgcaccggaagcccacctacgagcgcgacgtcgacctgggggccggtaccagacacgtcgccgtggaaccagaggtcgccaaccttgacatcatcggccagcgcatcgagaacatcaagcatgagcacaagagcacgtggcactacgacgaagacaacccctacaaaacctgggcttaccacgggtcctacgaggtgaagcccagcggctccgcgtccagcatggtgaatggtgtggtgaagctgctgaccaagccctgggacgtcatccccatggtgacccagatcgccatgactgacaccacccccttcggccagcagcgggtttttaaggagaaggtcgacactcgcacgccgaaagcaaagcggggcaccgcccagatcatggaggtgaccgccaagtggctctggggcttcctgtcccgcaacaagaagcctcgaatatgtacccgtgaggagttcacgcgaaaggtccgcagcaacgcggccatcggcgccgtcttcgtggacgaaaaccaatggaactccgccaaggaggcggtggaggacgagcgtttctgggacctggtccatcgcgagcgggagctccacaagcaggggaagtgcgccacctgcgtgtacaacatgatgggaaagcgcgagaaaaagctgggggagttcggcaaggcaaaggggagccgggcaatctggtacatgtggctgggcgcccgcttcctcgagttcgaggccctgggcttcatgaatgaggaccactggttctcccgggagaacagcctgtccggggtggaaggcgaggggctccacaagctgggctacatcttgcgcgatattagcaaaatccccgggggcaacatgtacgccgacgacaccgccggctgggacacccggatcacggaggacgacctccagaacgaggcgcgtatcaccgacatcatggagccggagcacgccctgctggcgaagtccatcttcaagctcacctaccagaacaaggtggtgcgcgtgcagaggccagccaagaacgggaccgtcatggatgtgatctcgcgtcgagaccagcgcgggtccgggcaggtgggcacgtatggcctgaacaccttcaccaatatggaggcccaactgattcggcagatggagagcgaagggatcttctcccccagcgagctcgagacccccaacctggccgagagggtcctggactggctcgagaagtacggagtggagcgtctaaagcgcatggccatctccggggacgactgcgtggtcaagccgatcgacgatcggttcgcaactgccctgaccgccttaaatgacatgggcaaggtacgcaaggacatcccccagtgggagcccagcaaggggtggaacgactggcagcaggtgcccttctgctcccaccacttccaccagctgatcatgaaagacgggcgggagatcgtcgtgccgtgccgaaaccaagacgagctcgtgggacgggcccgcgtcagccaaggggccggctggtcactccgggagaccgcgtgtctgggaaagtcctacgcccaaatgtggcagctcatgtacttccacaggcgggacctgcgcctcgccgcgaacgcgatctgcagcgccgtgcccgtggattggatccccacctcccggacgacctggagcatacacgcccatcaccagtggatgaccaccgaggacatgctgtccgtctggaatcgggtgtggatagaggagaacccctggatggaggacaaaacgcacatcagctcctggggcgacgtgccgtacctcgggaagcgcgaagaccagtggtgcggcagcctgatcggcctgaccgcccgggcaacctgggcgaccaacatccaggtcgccatcaaccaggtgagacgactcatcgggaacgaaaactacctggactacatgacgtctatgaagcgcttcaagaacgagagcgatcccgagggtgccctgtggtaa

SEQ ID NO: 24462 - RNA, 9879 nt, synthetic construct
  misc_feature 1..9879: note = derived and/or modified CDS sequence (opt11) from DENV-1__GU131749__SS-prME
  source 1..9879: mol_type = other RNA
agcgtgaccatgctgttaatgctgatgcccaccgccctggccttccacctcaccacccgggggggggagccccacatgatcgtgtctaagcaggagcggggtaagagcctgctattcaagacaagcgccggggtaaacatgtgcacacttatcgctatggacctgggcgagctgtgcgaggacacgatgacctacaagtgcccccggattactgaggctgagccagatgacgtggactgctggtgcaacgccaccgatacgtgggtcacctacgggacctgcagccagaccggcgagcaccggcgcgagaagcggtccgtggcgctcgcgccccacgtgggtctgggtctggagacgcgcaccgagacctggatgagcagtgagggtgcctggaaacagatccagcgggtcgagacctgggccctcaggcacccggggttcacggtgatcgccctgttcctggcgcacgccatcggcaccagcatcacccagaaggggattattttcatcctcctgatgctggttacccccagtatggccatgcggtgcgtcggcatcggcagccgcgatttcgtggaagggctctccggggccacgtgggtggatgtagtgctggagcacggtagctgcgtgaccaccatggccaaggacaagcccaccctggacatcgaactcctgaagacggaggtcactaatcccgcggtgctgagaaagctctgcatcgaggccaagatctccaacaccaccacggacagccgctgccccacccagggcgaagccaccctggtagaggagcaggacgcaaacttcgtctgccggagaactttcgtagaccggggctgggggaacggctgcgggctgttcggcaagggctcccttctgacgtgcgccaagttcaagtgtgtgaccaagctcgaaggcaagatcgtccagtatgaaaacctcaagtacagcgtgatcgtcacagtccacaccggagaccagcaccaggtagggaatgagtccacggagcacggcaccacagcaaccatcacgccgcaggcccccacgaccgagatccagctgaccgactacggagccctgaccctggactgcagcccccgcacgggcctggacttcaacgagatggtcttactcactatgaaggagaagtcgtggctggtgcacaagcagtggttcctggacctccccctgccctggaccagcggggccagcacctcccaggagacgtggaacagacaggacctgttagtgactttcaagaccgcccacgcgaaaaagcaggaggtcgtggtcctgggcagccaggagggtgccatgcacaccgcgctgacgggggcaaccgaaatccagacatccggtacaactacgatattcgctgggcatctcaagtgccgcctgaagatggacaagctgacgttgaagggcatgagctacgtcatgtgcaccgggagcttcaagctggagaaggaagtggcggagacgcagcacggcaccgtactggtccagatcaagtacgagggcaccgacgccccctgcaagatccccttcagcacccaggacgagaagggggtgacgcagaatggacggctgatcactgcaaatccgatcgtgaccgataaggagaagcccgttaacatcgaggccgagccgcccttcggagagtcctacatcgtgatcggcgcgggcgagaaggcgctcaagctgtcgtggttcaagaaggggtccagcatcggcaaaatgttcgaggccaccgcccgcggggcccggcgcatggcgatcctgggcgacacggcctgggacttcgggtcgatcggcggcgtgtttaccagcgtcggcaagctcgtgcaccagatattcggcaccgcctaccgcgtgctgttctccggggtcagctggaccatgaagatcggcatcggggtgctgcttacgtggctgggcttaaacagtcggtctacctccctgagcatgacgtgcatcgccgtgggcctggtcaccctctacctcggggtgatggttcaggccgactccggctgcgtcattaactggaaggggcgcgagctgaaatgcggcagcgggattttcgtgacgaacgaagtccacacctggaccgagcagtacaagttccaggcggacagcccgaagaggctgtccgccgccatcggcaaggcctgggaggagggcgtctgcgggatccgctccgcaacccggctcgaaaacatcatgtggaaacaaatctccaacgagctgaatcacatcctgctcgagaacgacatgaagtttaccgtggtggtcggcgacgtggcggggatcctggtgcaaggcaagaagatgatccgcccccaacccatggagtacaagtacagctggaagagctgggggaaggccaagatcatcggcgccgacgtccagaacagcacgttcatcatagacggccccaacacccccgagtgccccgacgaccagcgggcgtggaacatctgggaggtggaggactacgggttcggtatcttcaccaccaacatctggctgaagctccgggattcatatacacaggtgtgcgaccaccggctgatgagcgcggccatcaaggactccaaggcggtccacgccgacatggggtactggatcgagtccgagaagaacgagacctggaagctggcacgcgcgtccttcatcgaggtgaagacctgcatctggcccaaatctcacaccctctggtctaacggcgtgctggagagcgagatgatcatccccaagatccacggcgggccgatctcccagcacaactaccggcccggctacttcacgcagaccgccgggccatggcacctgggcaagctcgagctggacttcgacctttgcgagggaaccaccgtcgtagtggacgagcactgcggcaaccgcggcccgagcctccggacgaccacagtcactgggaaaatcatccacgagtggtgctgtcgctcatgcacgctgccgcccttgcggttcagaggagaggatggttgctggtatggcatggagatccggcccgtgaaggaaaaggaggagaacctcgtcaagtccatggtcagcgccgggagcggagaggtcgacagcttttccctgggcctgctctgtattagcattatgatcgaagaagtgatgcgctcccgctggagccgcaagatgctgatgaccggcaccctggccgtcttctttctactgatcatgggccagttgacctggaacgacctcatccgcctgtgcattatggtcggggccaacgcgtccgaccggatgggaatggggacgacctacctggccctcatggcaaccttcaagatgcgcccaatgttcgccgtgggcctcctgttccggcgcctcacgagccgggaggtcctgctgctcacgatcggcctgtccctagtggccagcgtcgagttacccaactccttggaggagctgggggacggcttggcgatggggatcatgatcctgaagctgctcaccgacttccagagctaccagctgtgggccaccctcctctcgctgacctttatcaagacgaccttcagcctgcactacgcctggaagaccatggccatggtgctctccatcgtgagcttgttccccctgtgcctctccaccacgagccagaagaccacctggctgcccgtgctgctcggctccctgggatgcaagccgctgacaatgttcctcatcgcggagaacaagatctggggacgcaagagctggcccctgaacgagggcatcatggccgtggggatcgtgagcatcctgctcagtagcctgctgaagaacgacgtccctttggcgggccctctgatcgccgggggcatgctcatcgcctgctacgtgatctccggcagctcggcggacctcagcctggagaaagccgccgaggtttcctgggaggaagaggccgagcatagcggggcctcccacaacatcctggtcgaggtgcaggacgacggaacaatgaagatcaaagacgaagagcgggacgacacactcacgatcctgctgaaagcgaccctcttagccgtgagcggggtctatccgctgtccatccccgccactctcttcgtgtggcacttttggcagaagaagaagcaacgctcgggcgtgttgtgggacacgcccagcccccccgaggtggagcgggccgtgctcgacgacggcatctaccggatcatgcagcggggcctgctcggaaggagccaggtgggggttggcgtgttccaggagaacgtcttccacaccatgtggcacgtcacacgcggggccgtgctgatgtaccaggggaagcgcctggagcctagttgggcgagcgtgaagaaggacctaatctcctacggaggcggctggcgcttccaggggtcctggaatactggcgaggaggtccaggtgatcgcagttgagcccgggaagaaccccaagaacgtccagacggcccccggcaccttcaaaacccccgagggggaggtgggtgccatagccctggacttcaagccgggtacctccgggagccccatcgtgaatcgcgagggcaagatcgtggggctgtacggcaacggggtggtcacgacgagcgggacctacgtttccgcgatagcccaggccaaggcctcgcaggagggcccgctcccagagatcgaggacgaggtcttccgaaaacgaaacctgaccatcatggacctgcaccccgggtccggcaagacgcggcgctacttgccggcgatcgtgcgggaagccatcaagcgcaagctgcgcacgctgatcctcgctcccacccgagtcgtggcctctgagatggccgaggcgctgaagggcatgcccatccgctaccagaccacggccgtgaaatctgagcacaccggcaaggaaatcgtcgacttgatgtgccacgccaccttcaccatgcgactcctcagccccgttcgcgtaccaaactacaacatgatcatcatggacgaggcccacttcacggaccccagttcgatcgcggcgcggggctacatctccacccgcgtcgggatgggtgaggccgccgccatcttcatgacggccacgccgcccggcagcatggaggcgttcccgcagtccaacgccgtcatccaggatgaagagcgggacatccccgagaggagctggaactccggctacgaatggatcaccgactttcccgggaagaccgtctggttcgtgccctctatcaaggccggcaacgacatcgcaaactgccttcggaagaacggcaagcgcgtgatccagttatcccggaagaccttcgacaccgagtaccagaagacgaagaacaacgactgggattacgtggtcaccaccgacattagcgagatgggggcgaacttcagggccgaccgggtgatcgaccctaggcgctgcctgaagcctgtgatactgaaggatggccccgagcgtgtcatcctcgccgggcccatgccggttaccgtggcatccgctgcccagcggcgcggtcggatcgggcgcaatcacaacaaggagggcgaccaatatatctatatgggccaacccctgaacaacgacgaggaccacgcccactggacggaggccaaaatgctgctcgacaacatcaacactcccgaggggatcatccccgccctgttcgagccggagcgcgagaagtccgccgcgatagacggcgagtaccggctgcgcggggaggcccggaaaaccttcgtagagctcatgcgccggggcgacctccccgtgtggctgtcctacaaggtggccagcgaggggttccagtatagcgatcgccggtggtgcttcgatggcgaacgcaacaaccaggtgctcgaggagaacatggacgtggagatctggaccaaggagggcgagagaaagaagctgcgcccccgatggctggacgcccgtacgtactccgaccccctcgcgttgcgggagttcaaggagtttgcagccgggcgccggagcgtctccggcgacctgatcctcgagatcgggaagctgccgcagcacctgacccagcgcgcacagaatgccctggacaacctagtgatgctgcacaattccgagcaggggggtcgggcgtaccgccacgccatggaggaactcccggataccattgaaaccctgatgctgttagccctcatcgccgtgctgaccggcggtgtcaccctattctttctgtcagggaaggggctggggaagaccagcatcggcctcctgtgcgtcatggccagcagcgtgctgctctggatggcgagcgtcgagccgcactggatcgccgcctctatcatcttggagttcttcctgatggtgcttctgatcccagaaccggaccggcagcgcacgccccaggacaaccagctggcgtacgtggttatcggcctcctgttcatgatcctgactgtggccgcgaacgagatgggtctcctggagacgaccaagaaggacctgggcatcgggcacgtggctgtcgagaaccaccatcacgccgccatgttggacgtggatctccaccccgcgtccgcgtggaccctatatgccgtggcgaccacgatcatcaccccgatgatgcggcacaccatcgaaaataccacggccaacatcagcctcacagcaatcgcgaaccaggcggccatcctgatgggtctggacaaggggtggcccatctccaagatggacatcggcgtgccccttctggccctgggctgctacagccaggtgaacccccttaccctgaccgcggccgtgttgatgctcgtggcccactacgccatcatcgggccgggccttcaggccaaggcgacgcgcgaggcccagaagagaaccgccgccgggatcatgaagaaccccaccatcgatggtatcgtggccatcgatctggaccccgtggtctacgacgcgaagttcgagaaacagctcggccagatcatgttgctgatcctctgcacctcccagattctactcatgagaacgacctgggcactctgcgagagcatcactctggccaccggccccctgacgaccctctgggagggctcgccggggaagttctggaacaccaccattgccgtgtctatggccaacatcttccgcggaagctacctggcgggggccggcctcgccttcagcctcatgaagtccctaggcgggggccggcgcgggactggcgcccaaggagagaccttgggcgagaaatggaagcggcagctcaaccagctgtccaagtcggagttcaacacctacaagcgctccggcatcatggaggtggaccggtcagaggcaaaggaggggctgaagcgcggcgaaacgacgaagcacgccgtttcccgggggaccgctaagctccgctggtttgttgagcggaaccttgtgaagcccgagggaaaggtcatagacctggggtgcggccgcggcgggtggagctattactgcgccggcttgaagaaggtgacagaggtgaaggggtataccaagggcgggcccggccacgaggagccgatcccgatggccacgtacggctggaacctcgtcaagctgcacagtgggaaggacgtgttcttcatcccgcccgagaaatgcgacaccctgctctgcgacatcggcgagagctcccccaaccctacaatcgaggaagggcggaccctgcgcgtgctcaagatggtcgaaccatggctccggggcaaccagttctgcatcaaaatcctgaacccctacatgcccagcgtggtggagacgctagagcagatgcagcggaaacacgggggcatgctcgtccggaacccgctgtcccgcaatagcacccacgagatgtactgggtgtcctgcggtactggcaacatcgtgagcgcgatcaacatgacctcccggatgctgctgaatcgctttaccatggcccaccgcaagcctacgtatgaacgggacgtggacctgggcgccgggacccgccacgtggccgtcgagcccgaagtcgccaacctggatatcatcggccagcggatcgaaaacattaagcacgagcacaagtcaacctggcactatgatgaggacaacccctataagacctgggcctaccacgggtcctacgaagtgaagccgagcgggtccgccagcagcatggtgaacggcgtagtgaagctcctgacgaagccctgggacgtaatccccatggttacgcagatcgccatgaccgacaccacgccctttgggcagcaacgcgtgttcaaggagaaggttgacacccggaccccgaaggccaagcgcggcaccgcccagataatggaggtcacggcgcggtggttgtgggggttcctctcccgcaacaagaagccgaggatctgtacacgagaggagttcacccggaaggtgcgtagcaacgccgccatcggcgccgtcttcgtggacgagaaccagtggaactccgcgaaggaggccgtggaggacgaccggttctgggacctggttcaccgcgagcgggagctgcacaaacagggtaagtgcgcgacctgcgtgtacaacatgatggggaagcgcgagaagaagctcggcgagtttgggaaggccaagggcagccgggcgatctggtacatgtggctcggggcgcgattcctggagtttgaggccctcggcttcatgaacgaagaccactggttctcgcgggagaacagcctgtccggagtggagggggagggcctgcacaaactcggatacatccttcgcgacatcagcaagatccccggcgggaacatgtacgccgacgataccgccggctgggacacccggataaccgaggacgacctacagaacgaggccaagatcaccgacatcatggagccggagcacgcgctcctggccaagtccatctttaagctgacgtaccagaacaaggtcgtgcgcgtgcagcgccccgctaagaatggcaccgtcatggacgtgatcagccgcagggaccagaggggatccggccaggtggggacctacggcttgaacaccttcacgaacatggaggcccagctgatccgccagatggagagcgagggaatcttcctgcccaacgaactcgagacccccaatctcgctgggcgggtcctcgactggctcgagaagtacggcgtggagcgcctgaaacggatggcgatctctggggacgactgcgtggtcaagccgatagacgaccgcttcgccaccgcactgaccgctctcaacgacatgggcaaggtgcggaaggacatcccccagtgggagcccagcaaaggctggaacgactggcagcaggtccccttctgctcccaccacttccaccagctgatcatgaaggacggtcgcgagatcgtcgtgccgtgccggaaccaggacgagctggtgggtcgcgcccgcgtcagccagggggcaggctggtccctccgcgagacggcctgcctgggcaagagctacgcccaaatgtggcagctgatgtactttcaccgcagagacctccggctggccgcgaacgctatatgcagcgccgtgcccgtggactgggtccccacctcccggaccacctggagcatccacgctcatcaccagtggatgacgaccgaggacatgctgtccgtgtggaacagagtgtggatcgaggaaaacccgtggatggaagacaagacccgcatcagctcatgggaggacgtcccgtaccttggcaagcgcgaggaccagtggtgtgggagcctaatcggcctgacggcccgggccacgtgggccaccaacattcaggtggccatcaatcaggtccgccggcttatcggaaacgagaactacagtgactacatgaccagcatgaagcgcttcaagaacgaatctgagcccgagggggccctgtggtga

SEQ ID NO: 24463 - RNA, 9879 nt, synthetic construct
  misc_feature 1..9879: note = derived and/or modified CDS sequence (opt11) from DENV-1__GU131750__SS-prME
  source 1..9879: mol_type = other RNA
agcgtgaccatgctgctcatgttaatgcctactgcactggccttccatctcaccactcgaggcggagagccacacatgatagtgagcaaacaggagcgcgggaagagcctgctgttcaagaccagcgccggggtaaacatgtgtaccctcatcgcaatggacctcggcgaactgtgtgaggataccatgacatacaagtgcccccggattacagagactgaacccgacgacgtggattgctggtgcaacgccaccgacacctgggtgacctatggaacttgctctcagacaggcgagcaccggcgcgacaagcggtccgtggccctcgcgccccacgtgggcctggggcttgagacccgaaccgagacctggatgagttccgagggcgcatggaagcagatccaacgggtggaaacctgggccctccgccaccccggattcaccgtgattgctcttttcctggcccacgcgattgggaccagcatcactcagaaggggatcatcttcatcttgctgatgttagtcacgccctccatggccatgcggtgtgtcggcataggtagccgcgactttgtggagggactctccggcgccacgtgggtggacgtcgtactggagcacgggtcttgcgttaccaccatggccaaggacaagcccacactggatatcgaactccttaagacagaggtcaccaatcccgccgtgctgcgtaagttatgcattgaggccaaaatctccaacaccactaccgacagcaggtgcccgactcagggagaggccaccctggtcgaggagcaggacgcaaacttcgtgtgccggcgcacgttcgtggaccggggctgggggaatggctgcgggctgttcggcaaggggtccctcatcacgtgcgccaagttcaagtgtgtgaccaagctcgaaggcaagatcgtccagtacgagaacctcaagtacagcgtgatcgtgaccgtacacacgggagaccagcaccaagtcggaaacgagtccaccgagcacggaaccaccgccaccataacgccccaggcgcccaccaccgagatccaactgaccgattacggggctctgacgctggactgctctccacgcaccggtctcgacttcaacgagatggtcctgctgaccatgaaggagaagtcctggctcgtacacaagcagtggttcctggacttacccttaccctggacctcgggcgccagcacgtctcaggaaacctggaatcggcaggacctgcttgtgacattcaagaccgcccacgcgaagaaacaagaggtcgtcgtgctcggctcccaagaaggcgcgatgcacacggccctaacgggggcaactgagatccagacctccggtacgaccaccatctttgctgggcatttaaaatgccgcctcaagatggacaagttgaccctaaagggaatgagctacgtcatgtgtacaggatcctttaaacttgagaaggaggtagcagagacgcaacacgggaccgtattagtccagatcaagtacgagggcaccgacgcgccatgtaagatccccttcagcacgcaggatgagaagggcgtgacccagaacggccggctgatcacagccaacccgatcgtgaccgataaggaaaagcccgtcaacattgaagctgagccgcccttcggtgagagttacatcgtaatcggtgccggcgagaaagcgctaaagctgagctggttcaagaagggaagtagcatcggcaagatgtttgaggccacggcccggggggcccggcgcatggccatcctgggcgacaccgcgtgggacttcgggtccataggcggcgtcttcacgagcgtcgggaagctggtgcaccagatcttcggcaccgcatacggggtcctgttctccggagtgagctggactatgaagatcggcatcggtgtgcttctgacctggctcggcctgaactctcgctccacctccctgagcatgacgtgcatcgccgtagggctcgtcactctgtacctgggtgttatggtgcaggccgactccgggtgcgtcatcaactggaagggccgggagctcaagtgcgggagcggtatctttgtgacaaacgaagtgcacacctggaccgagcaatacaagttccaggccgactcgcccaagcggctgagtgcggccatcggcaaggcctgggaagaaggggtctgtggtatccgaagcgccactcgacttgagaatatcatgtggaaacagattagtaacgagctcaaccacatattgctggagaacgacatgaagttcacggtggtggtcggggatgtcgccggaatcctcgcgcagggcaaaaagatgatccgccctcagcccatggagtacaagtatagctggaaaagctggggcaaggccaaaatcatcggcgcagacgtgcagaacaccaccttcattattgacgggcccaacaccccggagtgtcccgatgaccagcgcgcgtggaatatctgggaagtcgaggattatggcttcgggatcttcaccacgaatatctggcttaaactgcgtgacagctacacccaggtgtgcgaccaccgccttatgtccgcggccataaaggacagcaaggccgttcacgcggacatgggctactggatcgagtccgagaaaaacgagacatggaagcttgcccgggcgagcttcatcgaagtgaaaacgtgcatttggcccaagagtcacacactgtggagcaatggcgtgctcgagtccgagatgatcatccccaagatctacggaggtccgatcagccaacacaactacagacccgggtacttcacgcagaccgccggcccctggcacctggggaagctagagctcgatttcgacctgtgcgagggcacgaccgtggtcgtggacgagcactgtggcaaccgggggccctcgctgcgcacgaccacggtgaccggcaagataatccacgaatggtgctgtaggagctgcaccctgccgcccctccgcttccgcggggaggacggctgttggtacgggatggaaatccgacccgtaaaggagaaggaggagaacctggtgaagtccatggtgagcgccggatcaggcgaggtggactcattcagcctcgggctgctttgcatttcgatcatgatcgaggaggtgatgcgttcccgctggtcccgtaagatgttgatgaccggcaccctggccgtgttcttcttactcatcatgggccaactgacatggaacgacctcatccgactctgcatcatggtcggcgctaacgcatctgaccgcatggggatgggaaccacctacctagccctgatggccactttcaaaatgaggcccatgttcgccgtggggctcctcttccgcagacttacctcacgcgaagtgctcctgctgaccataggcctcagcctagtcgcctccgtcgagttgcccaattccctcgaggagctaggcgacgggctagccatgggcatcatgatcctcaaactgctgaccgacttccaatcgcaccagctctgggccactctgctgagcctcacatttatcaagacgacgttctccctgcactacgcctggaagacgatggctatggtactgagcatcgtatcgctcttccccctgtgcctcagcaccacgtcccagaagaccacttggctaccggtgctgctggggagcctagggtgcaagccgctgaccatgttcctgatcgcggaaaacaagatttggggtcggcggtcctggcccctcaatgaggggataatggccgtcggcatcgtgagcatcctgctgagctcactgctgaagaacgacgtgcccctggccgggcccctcatcgcaggtggaatgctgatcgcatgctacgtcatcagcgggtccagcgcggacctgtccatcgagaaagccgcagaggtgtcatgggaggaggaggcagagcactccggcgcctcgcacaacatcctcgtagaggtccaggacgacgggactatgaagatcaaggacgaggagcgggatgataccctgaccatcctgctcaaggcgacgctgctggccgtgtccggcgtgtacccgctttcaatccccgccaccttattcgtctggtacttctggcagaagaagaagcaacgctctggcgtcctctgggacacccccagcccgccggaggtgggacgggccgttctcgatgacggaatctacagaatcatgcagagggggctgctgggcagatcccaggtgggggtgggcgtcttccaggagaacgtgtttcatacaatgtggcacgttactcgcggggccgtcctgatgtaccagggcaagcgtctcgagccaagctgggcttcggtgaagaaggatttaatcagctacggcgggggatggcggttgcaaggcagttggaacacaggggaggaggtgcaagtcatcgcggtggagcccggtaagaacccaaagaacgttcaaactgcgcctgggacctttaaaacgccagagggcgaggtcggggccattgccctcgacttcaagcccggcaccagcggttcccccattgtgaatcgcgaaggaaaaatcgttggcctgtacgggaacggcgtcgtaaccacgtccggtacgtacgtgtctgctatcgcccaggccaaggcttcccaggaaggtcctttacccgagatcgaggacgaggtattccggaagcgcaacttaaccattatggacctgcatccggggtcgggaaagacccggcgttacctgcccgcgatcgtgcgcgaggctatcaagaggaagctccgcaccctaatcctggccccgacgcgggtggtcgcctccgagatggccgaggcgttgaaggggatgcccatccgataccaaactaccgctgtaaagagcgaacacacggggaaggagatcgtcgacctgatgtgtcacgccacgttcaccatgcggctgttatcgcccgtgcgcgtgccgaactacaacatgatcatcatggacgaggcccacttcacggacccaagctccatcgccgcgcgggggtatatcagcacccgcgtgggaatgggagaggcagccgcaatctttatgacagccacaccgcccgggtccgtcgaggcgtttccgcaaagcaacgccgtgatccaggacgaggagcgggacatccccgaaagatcctggaacagcggctacgaatggattaccgattttcccggcaagacggtttggttcgtcccatccatcaagagcgggaacgatatagcgaactgcctgcggaagaacggaaagcgcgttatccagctcagtagaaaaacgttcgacacagaataccagaaaaccaagaacaatgactgggactacgtggtcaccacggatatttcggagatgggggccaactttcgcgcggaccgggtaattgacccgcgccgatgtctcaagcccgtgatactgaaggacggccccgagcgggtcatcctggccgggcccatgccggtgaccgtcgcctctgcagcccagcggcgcggccggataggccgtaaccacaataaagaaggggaccagtacatttacatgggccagcccctcaacaatgacgaggaccacgcccactggaccgaggccaagatgcttctggacaacatcaacacccccgagggtatcatccccgccctcttcgaaccggagcgcgagaagtccgccgccatagacggcgagtatcggctacgcggggaggcgcggaagaccttcgtggagctgatgcgacgtggtgatctccccgtctggctgtcctacaaggtcgctagcgagggcttccaatactcagaccgacgatggtgcttcgacggggagaggaataatcaggttctggaggagaacatggatgtggagatctggaccaaagagggcgagcggaagaagctccgcccgcggtggctggacgctcgcacctactccgaccccctggccctccgggagttcaaggaattcgccgcggggcgccggagtgtctccggcgacctcatcctggaaatcggaaagttaccgcagcacctgatgcagcgcgcccagaacgccctggacaacctcgtgatgctgcacaacagcgagcagggcgggcgcgcctaccgccacgctatggaagagttgcccgacaccatcgagacgctgatgctgctggccctcatcgccgtcctgacagggggcgtcacgctgttcttcctctccgggagaggcctgggcaagaccagcatcgggcttctctgcgtgatggcctccagcgtgctgctgtggatggcttccgtcgagccccattggatcgcagccagcatcatcctcgaattcttcctgatggtgctgctcatacccgagcctgaccgccagcggacgcctcaggacaaccaactggcctatgtggttatcggcctcttatttatgatcctgacggtggctgccaacgagatgggcctgctcgaaacaaccaagaaagacctcgggatcgggcacgtcgccgtcgagaaccaccaccacgccgccatgttggacgtggacctgcatccggcgtcagcctggactctgtacgcggtcgccacgacaatcatcacgccgatgatgcgacacacgatcgagaacacaactgccaatatcagccttaccgccattgccaaccaggcggccatcctcatgggattggacaaaggctggcccatctccaagatggacatcggcgtccccctgctcgccctggggtgctatagccaggtgaaccccctgaccctaacagccgcggtgctgatgctggtcgcccattacgctataatcgggccgggcctccaggctaaagccacgcgggaggcgcagaaacggacggccgccggaattatgaagaatcccaccgtggacggcatcgttgccatcgacctggaccctgtcgtgtacgacgccaagtttgagaagcagctgggccagataatgctactgatcctgtgcacgtcccagatccttctgatgcgcacaacctgggcgctgtgcgagagtatcaccctcgcaacgggacccctgaccactctgtgggaagggtccccggggaagttttggaacacaacgatcgccgttagcatggccaacatcttccggggctcatatctggccggcgcaggactggctttcagcctcatgaagtccttgggcggtgggcgccgagggaccggcgcgcagggcgagacactgggtgagaagtggaaacgccaattgaaccagctctccaagagcgaattcaacacctacaagcggtcaggcattatggaggttgaccgtagcgaagcaaaggaggggctgaagaggggtgagacgaccaagcacgcggtgtcccgcgggacggccaagctgcggtggtttgtggagcgcaatctggtgaagcccgaaggaaaggtaatcgacctgggatgcggtcggggcgggtggagctactattgcgccggcctgaagaaagtgaccgaagtcaagggctatactaaaggcgggccagggcacgaggagcctatcccgatggccacctacggctggaacctggtgaagttgcactcagggaaagacgtgttcttcataccgcccgagaagtgcgacaccctgctgtgtgatatcggcgaaagctcccccaacccgactatagaggaggggcggacgctccgggtcctgaagatggttgagccttggctgagaggcaatcagttctgcatcaagattctcaacccctatatgcccagcgtggtcgagaccctggagcaaatgcaacgcaagcacggcgggatgctggtgcgcaacccgctctcccggaactccacacacgaaatgtactgggtctcctgcggcaccgggaacatcgttagcgccgtgaacatgacctcccgaatgctgctgaaccgcttcacgatggcacaccggaagcccacctacgagcgcgacgtagacctcggcgccggcacccggcacgtcgccgtggaacccgaggtggctaacctggatatcatagggcagagaatcgagaacataaagcacgagcacaaaagcacctggcattacgatgaggacaatccctacaagacttgggcataccacgggtcctacgaggtcaaaccgtcgggatccgcgtcctcgatggtaaacggcgtggtgaagctgcttaccaagccgtgggacgtgatccccatggttacccagatcgccatgaccgacaccacccccttcgggcaacaacgggtcttcaaggagaaggtagacacccgcactcccaaggccaaacggggaacggcccagatcatggaggttaccgccaagtggctgtggggcttcctgagccgtaacaaaaagccacgtatctgcacacgcgaggagttcacccggaaggtacgctcgaatgcggctatcggggccgtgttcgtcgacgagaaccagtggaacagtgcaaaggaggccgtggaggacgagagattttgggacctcgtgcatcgagaacgagaattgcataagcagggcaaatgcgcgacgtgcgtctacaacatgatgggtaagagggagaagaagctcggagagttcggtaaggccaagggcagccgtgccatttggtacatgtggctcggcgcccgcttcttagaattcgaagcgctgggattcatgaacgaggatcattggttcagtcgggagaatagcctctccggagtggagggggagggactgcacaagctggggtacattctccgcgatatcagtaagatccctggaggcaatatgtacgccgacgacaccgctggctgggatacccggatcaccgaggacgatctgcagaacgaggctcgaatcacagacacgatggagccggaacacgccctgcttgcaaagtccatattcaagcttacataccaaaacaaggtggtccgtgtgcagcggcccgcaaagaacggcaccgtgatggacgttatcagccgacgggaccagcgcgggtccggccaagtgggcacgtacggattaaacactttcactaacatggaggcccaactcatacggcagatggagagcgagggcatctttagcccaagtgagctggagaccccgaacctggccgagcgcgtgctcgactggctggagaaatacggagtcgagaggctgaagcgcatggccatctccggggatgactgcgtggtaaaaccaatagacgaccgattcgcgacggccctcaccgccctgaacgacatggggaaagtccgtaaggacatcccccagtgggaaccttctaagggctggaacgactggcagcaggtccccttctgtagtcaccattttcaccagctgatcatgaaggacggccgggagatcgtcgtcccatgccgcaaccaagatgagctcgtggggcgggcccgcgtgagccagggcgccgggtggagcctgcgggagactgcatgcctgggaaagtcctatgcgcagatgtggcagctaatgtacttccacagacgggatctgaggctggcagcaaacgcgatatgctccgccgtccccgtggactggatccccacctcacggacaacctggtctatccacgcccaccaccagtggatgacaaccgaggacatgctctctgtgtggaaccgggtctggatcgaagaaaacccctggatggaggataagacccacatcagctcctggggcgacgtgccgtacctgggcaaacgcgaggaccaatggtgcggttccctgatcgggctcaccgcccgtgccacttgggcgaccaacatccaggtggccatcaaccaggtccgcagactcattggaaatgagaactacctggactacatgacctccatgaagcgcttcaagaacgagagcgacccagagggtgccctctggtag

SEQ ID NO: 24464 - RNA, 9879 nt, synthetic construct
  misc_feature 1..9879: note = derived and/or modified CDS sequence (opt11) from DENV-1__GU131751__SS-prME
  source 1..9879: mol_type = other RNA
agcgtcaccatgcttctcatgctgatgccaaccgccttggccttccacctgaccacccgaggtggggagccccatatgattgtgagcaaacaggagcgtggcaagtcactgctgttcaaaacaagcgccggggttaacatgtgcaccctaatcgccatggatctgggggagttttgcgaggacacgatgacctataagtgccccagaatcaccgaggcagagccagacgatgtggattgctggtgcaacgcaacggacacctgggtgacctatgggacttgcagccagaccggggagcaccggcgcgacaaacggtccgtagccctggcgccccacgtggggctgggactggagacgcgtaccgagacctggatgagcagcgagggggcctggaagcagatccagcgggtggagacatgggcccttcgccaccctgggttcactgtgattgctctgttcttagcgcatgcaatcggcaccagcataacgcagaagggaatcatattcatcttgctcatgctggtgaccccttcgatggccatgcgatgtgtgggcattggcagcagagacttcgtcgaagggctaagcggcgccacctgggtggacgtagttctcgagcacggcagctgcgtgaccaccatggccaaagacaagcccacattggacatcgagcttctcaaaacggaggtcacaaatcccgcggtgcttcggaagctgtgcatcgaggcaaaaatctccaacaccaccactgactcccgatgccctacccaaggcgaggccaccctagtggaggagcaggacgccaacttcgtctgccggcggaccttcgtggacagaggctgggggaacggctgtgggctgtttggcaagggatccctgataacatgcgccaagttcaagtgcgtgacaaagctcgagggcaagatcgtccaatacgagaacctgaagtacagcgtgatcgtcaccgtccataccggtgaccagcatcaggtggggaacgagtcaacagagcacggcaccatcgcgaccatcacgccacaggctccgagcaccgagatacagctcacagactacggggcactcaccctggactgctctccccgcaccggcctggacttcaacgaaatggtcctgctaaccatgaaggaaaagtcctggttagtacataagcagtggttccttgacctgccgctcccatggactagtggggcaagtaccagccaagaaacctggaaccggcaggatctgctagtaacattcaagacagcgcacgcaaagaagcaggaggtcgtggtcctggggtcccaggagggagccatgcacaccgccctcaccggcgccaccgagatccaaacgagcggcaccaccaccatcttcgccggacacttgaagtgccgcctgaagatggacaaattaacgctaaagggcatgagttacgtgatgtgcactgggagcttcaagctcgagaaggaggtggctgagacccagcacggcaccgtgctcgtacagataaagtacgaaggcacggacgccccctgcaagattcccttctccacccaggatgaaaagggggtaactcagaatggccggctgataaccgccaatccgattgtgactgacaaagagaagcccgtcaacatagaagccgagccaccctttggggagagctacatcgtgatcggagcgggcgaaaaagccctgaagctgtcctggttcaaaaaggggagcagcataggcaagatgttcgaggccaccgcgcgcggggcccgaagaatggccattctaggggacacggcatgggatttcgggtctatcggcggcgttttcacctccgtcgggaagcttgttcaccaaatcttcggaacggcctacggcgttttgttttctggcgttagctggaccatgaagatcgggatcggtgtcttgcttacctggttgggcttgaacagtcgctcgacaagcctgagtatgacgtgcatagctgtgggactagtcacgctatacctgggcgtaatggtgcaggccgatagcgggtgcgtcatcaattggaagggccgggaactgaaatgtggcagcggtatcttcgtgaccaatgaggttcacacctggacggaacaatacaagttccaggcggactctcctaagagactgagtgccgccatcggcaaggcctgggaggagggggtctgcggcatccggtccgccacccgcttagagaacatcatgtggaagcagatcagcaacgagctgaaccatattttactagagaatgatatgaaattcaccgtggtggtaggggatgtagcgggcatcctggcgcaaggcaagaaggttattcggccacagccaatggagcataagtacagctggaagtcctggggcaaggccaagataatcggcgccgacgtgcagaatacgacctttatcatcgacgggcccaacacgccggaatgccccgacgaccaacgtgcgtggaacatctgggaggtggaggactacggcttcgggatcttcaccacaaacatctggctcaagctgcgggacagctacacgcaggtgtgcgatcaccgcctgatgagcgcagccattcgggactccaaggccgtccatgctgacatgggctactggatagagagcgagaaaaacgagacttggaaacttgcgcgcgcctcgtttatcgaggtgaagacatgcatctggcccaagtcacataccctgtggtctaacggtgtgctggagagcgagatgattatccccaagatctacgggggcccgatctcgcagcataactaccggccaggctacttcacccaaacggccggtccctggcatctcggcaaactggagttagacttcgacctctgcgagggcacaactgttgtggtggacgaacactgcggcaaccgcggtccaagcctgaggacaacaaccgtcaccgggaagatcatacacgagtggtgctgtcgatcctgcaccctgccacccctgcggtttaaaggcgaggacggctgctggtacgggatggagatccgccccgtgaaagagaaagaggagaatctagtcaagtccatggtcagcgccggctccggtgaggtagactcattctctctaggcctcctgtgcattagcatcatgatcgaggaagtaatgcggtccaaatggagccgcaagatgttaatgacgggcaccctcgccgtgttcttcctcttgatcatggggcaattaacctggaacgacctgatacgactgtgcataatggtaggcgcgaacgcctccgatcggatggggatgggaaccacgtacctcgccttgatggccacctttaaaatgcgcccgatgttcgctgtgggcctcctgttccggcgcctgaccagccgggaggtcctgttgctgacgatcggtctgtccctagtggcgtcggtcgagctgcccaactccttagaggaattaggagatgggttggccatggggattatgatcctgaagctcctgacggatttccaaagtcaccaactctgggccaccctcctttccctgaccttcattaagacaacattcagcctccactacgcgtggaagaccatggcaatggtgctgtccatcgtgagcctgtttcctctatgcctgtccaccaccagccagaagacgacctggcttccagtcctcctgggctccctaggctgcaagccgctcaccatgtttctgatcgccgaaaacaagatttgggggcgcaaatcatggcccctgaacgagggtataatggccgtaggcatagtgagcatcttgctgtccagcttgctaaagaatgacgtccccttggccgggccgctgatcgccggcggcatgttgatcgcgtgttacgtgatctccgggagctccgcagacctgagcttagagaaggccgccgaagtcagttgggaagaggaagcagagcatagcggcgcgtcccacaacattcttgtcgaggtgcaggacgacgggaccatgaagatcaaagatgaggagcgggacgacacgctgacgatcctgctcaaagccacgctgctggctgtaagcggcgtatatccgctctccatccccgcgaccctgttcgtgtggtatttctggcagaagaagaagcaacgcagcggggttctctgggacatccccagcccgcccgaggtcgagcgggccgtgctcgatgatgggatctatcgcatcatgcagcggggtctgctgggccgtagccaggttggcgtcggggtgttccaggaaaacgtgtttcacacaatgtggcacgtcacgcggggcgcggttctcatgtaccaggggaagaggctcgagccgtcctgggctagtgtgaagaaagaccttatttcctacggcggcgggtggcggctgcagggctcttggaacaccggggaagaggttcaggtgatcgcagtggagcctggaaagaatcccaaaaatgtccagaccgcccccgggacctttaaaacgtctgagggagaggtaggggctatcgccttagacttcaagcccgggaccagcggcagtcccatcgtgaaccgcgaagggaagattgttgggctatacggaaacggggtcgtgaccaccagtgggacgtacgtcagcgccattgcccaggctaaggctagtcaagaggggcccctcccggaaatcgaggacgaggtgtttaaaaaacgtaaccttacaatcatggacctgcatccaggcagcgggaaaacccgcaggtacctgccagccatcgtacgcgaggccattaagcggaagctcaggaccctgatcctagccccgactcgggtcgtggcctctgagatggcggaagcccttaagggcatgcccatccgataccagaccaccgccgttaagagcgaacacaccggtaaggagatcgtcgatctgatgtgccacgccacgttcacgatgcgcctgctctcccccgtgagagtgcccaactacaacatgataattatggacgaggcccacttcacggacccgagctctatcgcggcccggggatacattagcacccgggtaggcatgggggaggccgccgccatcttcatgaccgcgaccccgccaggttccgttgaggcattcccccagagcaacgcagttatacaggacgaggagcgcgacattccggagaggtcctggaacagcggttatgaatggatcaccgacttccccggcaaaaccgtctggttcgtgccctcaatcaagtcagggaatgacatcgcaaattgcctgcgcaagaacggaaagcgtgtgatccagctttcacgcaaaacgttcgacaccgagtaccagaagaccaagaacaacgactgggattacgtcgtgacaaccgacatcagcgagatgggcgcgaacttccgggccgacagagtgatcgacccgcgccgctgcctcaaaccggtcatcctgaaggacggacctgagcgggtgattctggccgggccaatgcccgtcaccgtggcttctgccgctcagcgacggggacgtatcggcagaaaccacaacaaagagggcgaccagtacatctatatggggcaaccgctcaacaacgacgaggatcacgcacactggaccgaggcaaagatgctgctggacaacattaacactcccgaaggcatcatcccggccctcttcgaacccgagcgcgagaagtccgccgcgatcgacggcgagtaccggctgcgcggtgaagcccgaaaaacgttcgtggagctgatgcgaagaggtgatttgccggtctggctgagttacaaggtggcctccgaaggatttcagtattcagaccggcgctggtgctttgacggagaacgcaacaaccaagttctggaggagaacatggacgttgagatctggaccaaggagggagagcgcaagaagctccggccccgctggctggacgcgcggacatactccgacccgctcgccctccgcgagttcaaggaatttgccgccggcaggcgcagcgtgtccggggacctgatcctggaaatcggtaaattaccccagcacctgacccagcgggcacagaacgccctggacaacctggtgatgcttcataatagcgagcaaggcgggcgcgcgtaccggcacgccatggaggagctgccggacacgatcgaaaccctcatgctgctggccttaatcgcagtattgaccggtggagttacactgttcttcttgtccggcagggggctgggaaaaacgagcatagggctgctctgcgttatggcttcctcggtactgctatggatggcctccgtggagccccactggatcgccgccagtattatcttggagttcttcctgatggtgctgctcatccccgaacccgaccgccagcgcacgcctcaagataaccaactggcctacgtcgtgatcgggctcttatttatgatcctcacagttgccgcgaacgagatgggtctgctcgagactactaagaaagacttggggatcggccacgtcgccgttgagaaccaccatcacgccgccatgctggacgtggacttgcatcccgcctccgcgtggaccctgtatgccgtcgctaccaccatcatcacccccatgatgcggcacacgattgagaatactaccgctaacatctcgctgaccgcaatcgcgaaccaggccgctatcctcatggggttagacaaaggctggccgatcagtaagatggacataggcgtgcccctgctcgccctgggatgctacagccaggtgaaccccttaacgctcacggcgaccgtcctgatgctggtggcccactacgcaattatcggccccgggctccaggccaaggccacccgcgaggcgcagaagcggacggccgccgggatcatgaagaatccgaccgtggacgggatcgtggctatcgacctggaccccgttgtgtacgacgccaagttcgagaagcaattgggtcagattatgttgctgattctgtgcacctcccagatactcttgatgcgtacaacgtgggcgctgtgcgagtcaataactctggccactggccccctcacgacgctgtgggaggggagtcctggcaagttttggaataccactatcgccgtcagcatggcaaacatctttcgcgggagctacctcgccggtgccgggctggccttctccctgatgaagtccctcgggggcgggcggcgcggcaccggggctcagggtgagacgctgggtgagaagtggaagcggcagctgaaccagctatccaaaagcgagttcaacacgtacaagaggtccgggataatggaagttgaccggtcagaggccaaggagggcctgaagcgcggagaaacgaccaagcatgctgtgtcccggggcacggccaaactgcgctggttcgtcgagcggaacctcgtgaagccggaagggaaagtaatcgaccttgggtgcggccgcgggggctggagctactactgcgccggactgaagaaggtcaccgaggtaaagggctacaccaagggcggccccggccacgaggagccgattcccatggccacctacgggtggaacctggtgaagctgcactcggggaaggacgtcttcttcatcccgcctgaaaagtgcgacacgctgctgtgcgacataggtgagagttcccccaacccaacgatcgaggagggccggaccctccgcgtcctcaagatggtggagccgtggctgcggggcaatcaattctgcattaagattctcaacccctacatgcccagcgtcgttgaaaccctggaacagatgcagcgcaagcacggcggcatgttagtgcggaaccccctctcccgaaactctacccacgagatgtactgggtctcctgcgggaccggaaatatcgttagtgccgtcaacatgacctcccggatgctgctgaaccgatttaccatggcgcaccgaaagccgacgtacgagcgcgacgtcgacctcggagccggcacgagacacgtggcggtggagcccgaggtcgcgaacctggatattatcggacaacggattgaaaatatcaagcacgagcacaaaagcacctggcactacgatgaagacaacccatacaagacctgggcataccacgggtcctacgaggtgaagcccagtggctcagcgtccagcatggtcaacggcgtggtgaagctgttaaccaagccgtgggacgtcatccccatggtgacgcaaatagccatgaccgatacgaccccattcggacagcagagggtcttcaaggagaaagtcgatacgcgcaccccgaaagcaaagcgcggtacggcccaaatcatggaggttaccgctaaatggctgtggggcttcctgtcccggaacaaaaaaccgcgcatctgcacgcgtgaagagtttacccggaaggtgcggagcaacgccgccatcggcgccgtctttgtagacgaaaaccagtggaactccgccaaagaggccgtggaagatgagcgcttctgggatctcgtccacagggagagagagctgcacaagcagggtaagtgtgcgacctgtgtttacaatatgatgggaaagcgggagaagaagctgggggagttcggcaaggcgaaagggagccgcgccatatggtacatgtggcttggcgcccggttcctggaattcgaagcgctgggcttcatgaacgaagatcactggttcagtcgcgagaacagcctctccggggtggaaggcgaggggctgcataagctgggttatatcttgcgggacatcagcaaaatccctgggggcaatatgtacgcggacgacaccgcaggctgggacacgcgtatcacggaggacgacctacagaatgaagcaaagatcaccgacattatggaacctgagcatgctctgctcgcgaagtccatttttaagctgacctaccagaacaaggtcgtgcgggtgcagaggccggcaaagaacggaacagtcatggacgtgatcagccggcgagaccagaggggttccggccaggtgggcacctacggcttgaacaccttcaccaacatggaggcccagctcatccgccaaatggagagtgaggggatattctccccgagtgagctggagacccccaatcttgccggccgagtcctcgactggctggaaaagtacggcgttgaacggctaaagcgcatggctatcagcggggacgattgcgtagttaaaccgatcgacgatcggttcgctactgcactcaccgccttgaatgacatgggcaaggtgcgtaaggacatcccgcagtgggaacccagtaagggatggaacgactggcagcaggtcccattctgtagccatcactttcaccagctgatcatgaaggacggccgggagatcgtcgtgccgtgccgcaaccaggatgagctcgtggggcgggcccgcgtctctcagggtgccggctggtctctgagggagaccgcgtgcctgggcaagtcctacgctcagatgtggcaactcatgtacttccaccgcagggacttacggctggcggccaacgccatctgtagcgccgtaccggtggactgggtccccacgagtcggactacctggagtattcacgcccaccaccaatggatgaccactgaagacatgctgtccgtatggaaccgcgtatggatcgaggagaacccctggatggaggacaagacccacatttcctcatggggtgacgttccttacctcggcaagcgggaggatcagtggtgcggtagccttatcgggttaacagctcgcgccacctgggcaacgaacatccaggtcgccattaaccaggtccggcgattaattggaaatgagaactatttggactatatgacctccatgaaacgtttcaagaacgagagcgacccggagggggccctatggtga

SEQ ID NO: 24465 - RNA, 9879 nt, synthetic construct
  misc_feature 1..9879: note = derived and/or modified CDS sequence (opt11) from DENV-1__GU131753__SS-prME
  source 1..9879: mol_type = other RNA
agtgtgaccatgctgctcatgctgatgcccaccgccctggccttccacctcaccacccggggcggcgaaccacacatgatcgtgaccaagcaagagcggggtaagagcctactcttcaagactagcgccggggtgaacatgtgcaccttaatcgccatggacctgggagagctgtgcgaggacaccatgacttacaagtgcccccgcattaccgaggctgagcccgacgacgtggactgctggtgcaacgccactgacacctgggtgacctatgggacctgcagccagaccggtgaacaccggcgcgataagcggagcgtggccttggcgcctcacgtgggtctggggctggagacccggaccgagacctggatgtcctcagagggggcctggaaacagatccagcgcgtcgagacgtgggccctccgccatcccgggtttaccgtgacggccctgttcctggcgcatgctatcggcacctctatcactcagaaggggattatctttattctcctgatgctggtcacccctagcatggctatgcggtgtgtcggcatcggcagccgcgacttcgtggaggggctcagcggcgcgacctgggtggacgtagtactggaacacggctcctgcgtgaccacgatggccaaggacaagcccaccctggacatcgagctcctcaaaactgaggtcaccaaccccgcggtgctgcggaaactctgcatcgaggccaaaatcagcaacacgaccaccgactccagatgtcccacccagggtgaggccacgttaatggaggagcaggacgccaacttcgtgtgccgtcgcaccttcgtagaccggggctgggggaacggctgcggcctgttcggcaaggggagcctcattacctgcgccaagtttaagtgcgtaaccaagttagaaggcaagatcgtgcagtacgagaacctgaaatatagtgtcatcgttacagtacacactggcgaccagcaccaggtcggtaacgagagcaccgagcacggcaccaccgcgacgatcacgccccaggcacccacctccgagatccaactcaccgactacggggccctcacgctggactgctcgccccgtaccggcctcgatttcaatgaaatggtgctgctcaccatgaaggagaagagttggctggtccacaagcagtggttcctggacctgccgctgccctggaccagcggcgccagcacgtcccaggagacctggaaccggcaagacttgttggtaacgttcaagaccgcccacgccaagaaacaggaggtggtcgtgctcggaagccaggagggagccatgcacacggccctgaccggagcaaccgagatccagacctccggcacgaccacgatcttcgccgggcacttgaagtgccgcctcaaaatggacaagctgaccctgaagggcatgagctacgtgatgtgcacggggtccttcaagttggagaaggaggtcgcggagactcagcatggcaccgtgctggtccagataaagtacgagggcactgacgcgccgtgtaagatccccttcagtactcaggacgagaagggtgtcacacagaacggccggctgatcaccgccaaccccatcattacagacaaggagaagcccgtgaacatcgaggcagagccgcccttcggggagtcctatattgtgatcggcgccggcgagaaggccctgaagctcagctggttcaaaaaggggtcctccatcggcaagatgttcgaggcgacggcacgcggagcccggcgtatggccatactcggcgacaccgcgtgggatttcggatccataggaggggtcttcaccagcatcggcaagctggtccatcagatctttggcaccgcctacggtgtgctgttctccggagtcagctggacgatgaagattgggatcggcgtgctgctgacctggctcggactgaactcccgcagtacatccctctccatgacctgcatcgccgtgggcctcgtcacgttgtacctgggcgtgatggtgcaggccgacagtggctgcgttatcaattggaagggccgagagctgaagtgcgggagcggcatcttcgtgactaacgaagtgcacacatggacagagcagtataaattccaggcggattccccgaagcgcttatcggccgccatcggcaaagcctgggaggagggggtctgcgggatccggagcgccacccggctggaaaacatcatgtggaagcagatctccaacgagctcaatcatattctgttagagaacgatatgaagttcacggtggtggtcggcgacgtcgtgggcatactcgcgcaggggaaaaagatgatacggccccaacccatggagcacaagtacagctggaagtcctggggcaaggccaagatcataggcgccgacgtacagaacacgaccttcatcatcgacgggcccaacactccggagtgccctgacgatcagcgcgcctggaacatctgggaggtggaggactatggcttcgggatcttcacgaccaacatctggctgaagatgcgggacagctatactcaagtgtgtgaccacagactgatgtccgcggccatcaaagacagcaaggccgtccatgcagatatgggatactggatcgagtccgagaaaaacgagacctggaagctcgcccgggcttctttcatcgaggtgaagacgtgtatatggcctaagagccacactctgtggagcaatggcgtgctggagtccgagatgatcattcctaagatctacgggggccctatcagccagcacaattaccgccccgggtacttcacccagacagctggcccctggcatctcggcaagctagaactggatttcgacctttgcgagggcacgaccgtcgtagtggacgagcattgcggcaaccggggaccgtccctgcggaccacaacggtcacagggaagatcatacacgagtggtgctgccggagctgcaccctgccacccctccgcttcaagggggaggatgggtgctggtatgggatggagatccggcccgtgaaggagaaggaagagaacctggttaaatccatggtcagcgccggcagcggcgaggtggactctttcagcctgggcttactgtgcatctccatcatgatagaggaggttatgcgcagccggtggtcacgtaagatgctgatgaccggcacgctcgcggtgtttctgctactcatcatggggcagttgacctggaacgacctgattcggctctgtataatggtgggcgccaacgcaagcgaccgcatggggatgggcaccacctacctagccctcatggccacgtttaagatgcgccccatgttcgccgtgggcctcttattcaggaggctgacctcccgggaggtccttctgctgaccatcgggctcagcctggttgcctccgtggagctgcccaatagcctcgaggagctgggtgacgggctggcgatgggcatcatgatcctcaaactgctgacggacttccagtcacaccagctctgggctacgttgctgagtctcacctttatcaagaccacactgtccctgcactatgcctggaagacgatggccatggtcctctcaatcgtgtcattgatccccctgtgcctcagcaccacctcccaaaagaccacctggctgcccgtcttactcggcagcctgggttgcaagccgttaacgatgttcttgatcgcggaaaacaagatttggggccgcaagtcgtggcccctgaatgaggggatcatggccgtgggcgttgttagcattctgttatcgtccttgttaaagaacgacgtgcccctagccgggccgctgatcgccggcggcatgctgatcgcctgctatgtgatctcggggtccagcgcggacttgtccctggagaaagccgctgaggttagctgggaggaggaagcggagcactcaggcgcaagccacaacatcctggtggaggtgcaggacgacgggaccatgaagatcaaggatgaggagcgggacgacaccctgaccattctgctgaaggcgacgctcctggccgtctccggtgtgtatccgctgagcatacctgcgaccctcttcgtgtggtacttctggcagaagaagaagcagcgttccggggtcctgtgggacacccctagcccgcccgaggtcgagcgtgccgtcctagacgacggcatctaccgaatcatgcagcggggcctgctcgggcgcagccaagtcggcgtgggggtgttccaggaaaacgtcttccacaccatgtggcacgtgacgcgtggagcagttctgatgtaccaggggaagaggctggagcccagttgggcgtccgtcaagaaggacctcatcagctacggaggagggtggcggctgcaaggatcttggaacaccggtgaggaggtccaagtgattgccgtcgagcccggaaagaaccctaagaatgtgcagaccgcccccgggaccttcaagacccccgagggcgaggtaggcgcaatcgccctggactttaaacccgggacaagtggctcccccatcgtcaaccgcgaggggaagatcgtgggcctctacggcaacggggtagtcaccactagcggcacgtacgtgagcgctatcgcccaggccaaggcctcccaggaggggccactgcccgagatcgaagacgaagtgtttcggaagcgcaacctgaccatcatggacctccaccccggtagcgggaagacccgccgatacctgcccgcgatagtccgggaggccatgaagagaaaacttagaaccctcattctggcgcccacgcgggtggtcgcctccgagatggccgaggcgctgaagggaatgcccatccgctatcagaccaccgctgtcaagagcgagcacaccggcaaggagatagtggacctcatgtgccacgcgacgttcaccatgcggctgctgtcacccgttcgcgtgccgaactacaacatgataatcatggacgaagcccatttcaccgacccgagctccatcgccgcgcgggggtatattagcacccgtgtgggcatgggggaggccgcggccatcttcatgaccgccacgccgcctggctccgtggaggcgttcccgcaaagcaacgccgtcatccaggatgaggaacgcgatatccccgagcgctcctggaacagcgggtacgaatggatcaccgactttcccggcaagacggtgtggtttgtgccctccatcaagtccggcaacgacattgccaactgcctccggaagaacgggaagagggtgattcagctgtctagaaagacatttgacaccgagtaccagaagacgaagaacaacgactgggattatgtagtgaccacggacatcagcgagatgggcgccaacttccgcgcggatcgcgtcatcgacccgcgccggtgcctgaagcccgtcatcttgaaagatgggccagagcgcgtgattttagccggccccatgccggtcaccgtggcctcggccgcccagcggcgcgggcggatcggccggaaccacaataaggagggcgaccagtacatctacatggggcagcccctgaacaacgacgaggaccacgctcactggaccgaggccaagatgttactggacaacatcaacacgcccgaaggcatcatccccgccttatttgagccggagcgggagaaatccgccgccatcgacggggaataccgcttgcgcggcgaggcgcggaagacattcgtcgagctgatgcgccgcggggacctgcccgtgtggctctcatacaaggtggcctccgagggatttcagtatagcgaccgtcggtggtgcttcgacggcgagcgcaacaatcaggtcctggaagaaaatatggatgtggagatttggaccaaggagggggagcggaaaaagctgcgccccagatggctcgatgcccgcacctattccgacccgctggccctgcgggagttcaaggagttcgccgctggccgccggagtgtctccggcgatctcatcctggagatcgggaagctgccgcagcacctgacccagcgcgcccagaacgccctggacaacctggtcatgctccacaactccgagcaaggagggcgggcctatcgccacgcgatggaggaactgcccgacacgatcgagaccctgatgctcctggccctgatcgccgtgctcaccggcggggtgaccctgttcttcctgtccggccggggactcggcaagaccagcattggtctgctgtgtgtcacggcttccagcgtcttactgtggatggcaagtgtggagccccactggatcgccgcgtccatcatcctagagttcttcctcatggttctgctgatccccgagccggaccgccagcgaacaccccaggacaaccaactggcctacgtggtgatcgggctgctgtttatgatcctgacagtcgccgccaacgagatgggcctgttggaaaccaccaagaaggatctcgggataggacacgtggcagtggagaaccaccatcacgccactatgttggatgtagacctgcacccggcctccgcctggactctgtacgccgtggcgaccacaatcatcacaccgatgatgcgccacaccatcgagaacaccacggcaaacatttcgctgaccgccatcgccaaccaggcagcgatcctgatggggttggacaagggctggcccatctccaagatggacatcggcgtccccctgctggcattggggtgctacagccaggtaaacccccttacactgaccgccgccgtgctcatgctggtggcgcactacgctataatcggcccggggctgcaggccaaggcaacgcgggaagcccagaaacgcaccgcggccggcatcatgaaaaaccctaccgtcgacggaatagtagcaatcgacctcgaccccgtggtctatgacgccaagttcgagaagcagctgggccagatcatgctgctcatcctgtgcacctcacagatcctgctgatgcgcacgacctgggccctttgcgagagcataaccctggcgaccggccccctcacaaccctgtgggaggggtccccgggcaagttctggaacactacaatcgccgtgtcaatggccaacatcttccgggggtcatacctggccggtgccgggctcgcgttcagcctgatgaagtccctcggaggcgggagacgggggactggggctcagggggagacccttggcgagaagtggaagcgtcagctgaatcagctgtccaagagtgagttcaatatctacaagcggtctggcatcatggaggtggaccgcagcgaggccaaggagggcctcaagcgcggggagaccacgaagcatgccgtctcccgcggtacagcgaagttgcggtggttcgtggagcgcaacctcgtgaagcccgaggggaaggtcatcgatctggggtgcggccgcggcgggtggagctactactgcgcagggctcaagaaggtgacggaggttaaggggtacaccaagggcggacccggccacgaggagcccattccgatggccacctacgggtggaacctggtcaagctgcactcaggcaaggacgtgtttttcacgccgcctgagaagtgcgacacgctgctgtgcgacatcggggagagctcccctaatccgaccatcgaggagggccgcacactgcgggtcctcaagatggtcgagccttggctgcgcgggaaccagttctgcatcaagatcctaaacccctacatgcctagcgtggtggagaccctcgagcagatgcagcggaagcacggcggcatgctggtccgcaacccactatcccggaatagcacgcacgaaatgtactgggtgagttgcgggaccggcaacatcgtgagcgcagtcaacatgaccagccggatgctcctaaatcggtttaccatggcccatcgcaagcccacgtatgagaaagacgtggacctgggggcaggcaccagacatgtggccgtcgagcccgaggtcgccaacctcgacatcatcggccagcggatcgagaacatcaaacacgaacacaagagcacttggcactacgacgaggacaacccctacaaaacctgggcctaccacgggtcctatgaggtcaagccgtcgggctccgccagcagcatggtaaacggggtggtcaagctgctgacgaagccctgggacgtgatccccatggtgacccaaatcgcgatgactgacaccactcctttcggccagcagcgcgtcttcaaagaaaaagtggacacccggaccccgaaggcgaagcgcgggactgtgcagatcatggaggtcacggcccggtggctctggggcttcctcagccgtaacaagaagccccgcatttgcactcgcgaggagtttacccggaaggtgcgcagcaacgccgccatcggcgcggtgtttgtggacgagaaccagtggaactctgccaaggaggccgtggaggacgagcggttttgggacctggttaagaaagagcgagagctccataagcaggggaaatgcgcgacctgtgtctacaacatgatgggaaagcgagagaagaaactgggggagttcggcaaggcgaaagggtctcgcgcgatctggtatatgtggctgggagcccggttcctcgagttcgaggccctgggcttcatgaacgaggaccactggttttcccgtgagaacagcctgtcaggagtggaaggcgaggggctacacaagctgggctacatcctgcgcgacatcagcaagatccccggagggaatatgtacgcagacgacacagcgggatgggacacccgcatcaccgaggatgacctccagaacgaggccaagatcaccgacatcatggaaccggagcacgctctgcttgcgacgtccatcttcaagctcacctaccaaaataaggtggtccgggtgcagcgacccgccaagaacgggacggtaatggacgtcatcagccggcgtgaccaacgcggaagtggccaggtggggacctacggcctgaacacgttcacaaatatggaggcgcagttgatccggcaaatggaaagcgaagggatcttcctcccctccgagctggaaacccccaaccttgccgagcgcgtgtttgactggctcgagaagtacggcgtcgagcggctcaagcggatggccataagcggggacgactgcgtcgtgaaaccgatcgacgaccggttcgccaccgcactgacggcgctcaacgacatgggcaaggtacgcaaagatatcccacagtgggagccctccaagggatggaacgactggcagcaggtccccttctgcagccaccatttccaccagctgattatgaaggacggccgggaaatcgtggtcccctgccgcaaccaggacgagctggtgggtcgggccagagtgtcccagggggccggctggagtctcagggagacggcctgtctcggcaagagctacgcccagatgtggcagctaatgtatttccaccgccgggacctcagactggcggccaacgccatctgctcggccgtacccgtggactgggtgcccacctcccgaaccacgtggtccatccatgcgcaccaccagtggatgactacagaagacatgctgagcgtctggaaccgcgtgtggattgaggaaaacccctggatggaagacaagacccacgtcagtagctggggagacgtcccgtacctcgggaagcgtgaggaccagtggtgcgggtccctgatcggcctgaccgcccgcgcaacgtgggccagcaacatccaggttgccatcaaccaggtcagacgcctcatcgggaacgagaactacctggactacatgacgtccatgaaacgcttcaagaacgagggcgacccagagggggcgctttggtag

SEQ ID NO: 24466 - RNA, 9879 nt, synthetic construct
  misc_feature 1..9879: note = derived and/or modified CDS sequence (opt11) from DENV-1__GU131754__SS-prME
  source 1..9879: mol_type = other RNA
agcgtgacaatgctgctaatgttgatgcctaccgccctggccttccacctcacgacccgcggcggggaaccgcacatgatcgtgtctaagcaggaacgtggcaagtcactgttgttcaagacctccgccggggtgaacatgtgcaccctaattgccatggacctgggcgagttctgcgaagataccatgacctacaagtgcccccgcatcaccgaggccgagccggacgacgtggactgctggtgcaatgccacagacacatgggtgacatacgggacttgctctcagaccggcgagcaccggcgggataagcggtccgtggccctcgcgccccacgtgggcctcggtctggagacccgtacggaaacctggatgagctccgaaggcgcatggaagcagatccagcgggtggagacctgggccctacgccatccggggttcactgtgatcgccctcttccttgctcacgccattgggacctcgatcacccagaaagggatcatcttcatactgctcatgctggtgaccccctcgatggcgatgcggtgcgttggcatcggcagccgcgacttcgttgaggggctatccggggctacgtgggtagacgtcgtgctcgagcacgggagctgcgtgaccacgatggcaaaggacaagcctaccctggatatagagctgctcaaaacggaagtaaccaaccccgcggtgctgcggaaactttgcatcgaggccaaaatctctaacaccacgaccgacagccgctgcccgacgcagggcgaggccaccctcgtggaggagcaggacgccaacttcgtctgccggcgcaccttcgtggaccggggctggggcaacggctgcgggctgttcggaaaggggtcattaatcacgtgcgccaagttcaaatgcgtcacgaagctggagggaaagatcgtccagtatgagaacctgaaatactcggtgatcgtgaccgtccacaccggcgatcagcaccaggtggggaacgagtccacggaacacggcaccacggcgaccatcacgccccaagcccccagcacggagatccaactcaccgactacggagccctcacccttgactgttctccccggaccggccttgactttaacgaaatggttctcctgacgatgaaggaaaagagttggctggtgcacaaacagtggtttctcgacttgccgctaccctggacaagcggggcctccaccagccaagaaacgtggaaccggcaggacctcctggtcacgttcaagaccgctcacgcgaagaagcaggaagtagtggtgcttggctcccaagagggcgccatgcacaccgccttaaccggggccacggagatccagacatctggcaccactacgatattcgcggggcatcttaagtgtcgtctgaaaatggacaagctcacgttaaagggtatgtcctacgtcatgtgcaccgggagcttcaaactggagaaggaagttgcggagactcagcatggcacggtgctcgtccagatcaagtacgagggcaccgacgccccttgtaagatccccttctccacccaggacgagaagggggtgacccagaacggccggttgatcacggcgaaccccatcgtaaccgacaaggataagcccgttaacatcgaggccgagccgccgttcggtgagtcatacatcgtgatcggagccggggagaaggctttaaagctgtcctggtttaagaagggcagctccataggtaagatgttcgaggccaccgcccgcggtgcccggcgcatggcgatactcggagacaccgcctgggacttcggtagcataggaggcgtgtttacgtccgtcgggaagctggtgcaccaaatcttcggtaccgcgtacggggtactgttcagcggagtctcctggaccatgaagatagggatcggcgtgcttctgacctggctgggcctcaacagccgatccacgagtctgtccatgacctgcattgccgtggggctggtcaccctctatttaggcgtcatggtacaggctgatagcggctgcgtcgtgaactggaagggccgagagctgaagtgcgggagcggcatcttcgtaaccaatgaggtccacacgtggacagagcaatacaagtttcaagcggactccccgaagcgtctcagcgccgccatcggcaaagcctgggaagagggagtatgcggcatccggagcgcaacacgcctggaaaatatcatgtggaagcagatttcaaacgaactgaaccacatcctgctggagaacgacatgaagtttacagtggtagtgggcgatgttgcgggcatcctggctcaggggaagaaaatgatccggccccagcccatggaatacaagtactcctggaagtcttggggcaaggccaagattattggcgccgatgtccagaatactacgttcatcatcgacgggcccaacacaccggaatgtcccgacgaccagagagcgtggaatatatgggaggtcgaggactacgggtttgggatcttcaccaccaacatatggctcaagttgcgggacagttatacccaagtgtgcgaccaccgcctcatgtccgccgccattaaagacagtaaggccgtacacgctgacatgggctattggatcgagagcgaaaagaacgaaacctggaagctcgctcgggcatccttcatcgaggtgaagacctgcatctggcccaagagccacacactgtggtccaatggagttctggagtctgagatgatcatccccaaaatctatggtggcccgatttcccagcataactaccgccccggttacttcacgcagacagcaggcccctggcacttggggaagctggagttagacttcgacctttgcgaggggaccaccgtcgtggtggacgaacactgcggcaaccggggtccgtcactgcgcacgaccacagtcaccggcaagatcatccacgagtggtgctgtcggtcctgcacgctgccaccccttcgcttcaaaggggaggacggatgctggtacggaatggaaatccggcccgttaaagaaaaggaggagaacctggtgaagtccatggtatcagccggctccggcgaagtggacagcttctctctgggtctcttgtgcatcagcattatgatcgaagaagtgatgcgctccaggtggagcaggaaaatgcttatgactgggactttagccgtgttctttctgctgatcatggggcagctcacctggaacgacctgatcaggctgtgcataatggtgggcgcgaacgcctccgaccgcatggggatgggaactacttatctcgccctgatggcaaccttcaaaatgcgccccatgttcgccgtcggattgctgttccgtcgcctgacaagccgggaggtccttctcctgacaattgggctgtcccttgtggcttccgttgagcttcccaactccctggaggagctcggcgacgggctggcgatgggcataatgattctgaaattgttgacagactttcaaagccaccagctgtgggccaccctcctgagcctgactttcatcaagacgaccttctccctccattacgcgtggaagaccatggctatggtgctatcaatcgtgtctctgtttcccttgtgcatgtcgaccacgtctcagaagaccacctggctgcccgtcctgctcggctccttagggtgtaagccgctgaccatgtttctcatcgcagagaacaagatttggggccgcaagagctggcccctgaacgaggggataatggccgtgggtattgtaagcatcctcctcagtagtctgctcaaaaatgacgtgccgttggccgggcccctcatcgccgggggcatgctgatcgcgtgctatgttatctccgggtccagcgcagacctcagcctggaaaaggccgcggaggtgtcttgggaggaggaggccgagcacagcggcgcgtcccacaacatcctggtcgaggtgcaggacgacggaacaatgaagataaaggatgaggagcgggacgacaccctcaccatcctgctgaaagccactcttctagcggtgagcggcgtctacccgttaagtattcccgccaccctcttcgtgtggtacttctggcagaagaagaaacagcgcagtggtgtgctgtgggacacacccagcccgcctgaggtggagcgtgctgttctggacgacggcatataccgcatcatgcagcggggcctcctggggcgtagccaagtaggcgtcggtgtgttccaggagaacgtgttccacaccatgtggcacgttacgcggggcgcggtgctgatgtaccaggggaagcgcctggagccctcctgggcctcggtcaagaaagacctcatttcgtatggtggagggtggcggctacaggggagctggaataccggggaggaagtccaggtgatcgctgtggagcccgggaaaaaccccaagaacgttcagacggctccagggacctttaaaacctctgagggagaagtaggcgccatagctctagatttcaagcccggcacaagcggcagccccatcgtgaatcgcgaagggaagatcgtggggctctacggcaatggagtggtcactacatccgggacctacgttagcgctatcgcccaggccaaggcgagtcaggaggggccactgccggagatcgaggacgaggtgttccggaaacgcaacctgaccataatggacctacaccccggctctgggaagacacggcgctatttacccgctatcgttcgagaggccatcaagcgcaagctgcggactctcatcctggccccaacacgcgtggttgcgtccgagatggcggaagccctcaagggcatgcccatacgctaccagacgacggccgtaaagagcgagcataccggcaaggagatcgtcgatctcatgtgccacgcgaccttcaccatgcggctgctgtcccccgtacgtgtccccaactacaacatgatcataatggacgaagctcatttcacggacccatcaagtatcgcggcccgggggtatatcagcactcgcgtcggcatgggtgaggccgcagccattttcatgactgcgacgccacccggctcggtggaggcattcccacagagcaatgccgtgatccaggacgaggagcgggacatcccggagcgctcctggaacagcgggtacgagtggataacggacttccccggcaagacagtctggttcgtgccgtctatcaaatcaggaaacgacatcgccaactgcctgcggaagaacggcaaacgcgtgatccagctatccaggaagacattcgacaccgagtaccagaagacgaagaacaacgactgggactacgtcgtgaccaccgatatctctgagatgggcgcgaacttccgcgcagaccgggtgatcgaccctcgacggtgccttaagccggttatcctcaaagacgggcccgagcgcgtgattctggctgggccaatgcccgttaccgtcgcctccgcagcgcagcggcgcgggcggatagggaggaaccacaacaaggagggcgaccaatacgtgtacatggggcagcctctcaacaacgacgaagaccacgcccactggactgaggcgaagatgctgctggacaacatcaacaccccagaggggatcatacccgccttattcgagcccgagcgggagaagtcagcggcgatcgacggggagtatcgcctcaggggcgaggcccggaagaccttcgtcgaactcatgcgccgcggggacttaccggtgtggctgagttacaaggtggcctcggagggcttccagtatagtgaccggcgctggtgcttcgacggcgagagaaataatcaggtattagaagaaaacatggacgtcgagatctggaccaaggagggggagcggaagaagctcaggccccggtggttagacgcacggacatattccgaccccctggctttacgggagttcaaggagttcgcggccggccgccggagcgtttccggggacctcatactggagattggaaagctgccacagcacctcacgcagagagcccagaatgccttggataacctggtcatgctgcacaacagcgagcaagggggacgtgcctaccgccacgcaatggaagaactgccggatacaatagaaacgctgatgctcctggcccttatcgccgtgctcacaggcggcgtgaccctgttcttcctttcgggccgggggttagggaagacaagcatcggcctgttgtgcgtcatggcctccagcgcgctcctttggatggcctcagtagaaccgcactggatcgcggcttctataatactggagttcttcctcatggtgctgctgatcccggaacccgaccgccagcgcacccctcaagacaatcagttagcctatgtcgtgatcggattattgttcatgatcctcaccgttgcggctaatgaaatgggcctgctagagaccactaagaaggacctcggcattggtcacgttgcagtggagaaccaccatcacgcagccatgctggacgttgatctccatcccgcttccgcctggaccctatatgccgttgccaccacgattattacacccatgatgcgccacactatcgagaataccactgcgaacatcagtctgaccgcgatagccaaccaggccgccatccttatggggctcgacaaaggctggccgattagtaaaatggacatcggagtgccgctgctggctctagggtgttacagccaggtaaatcctctcacccttaccgccgccgtcctcatgctggtggctcactacgccattatcggacccgggctccaggccaaggccacgcgggaggcgcagaagcgcacagccgccgggatcatgaaaaatccgaccgtggacgggatcgtggcgatcgacctcgacccagttgtttacgacgccaagttcgagaagcagctgggccagattatgttgttaatattatgcacctcccagatcttactcatgcgaaccacctgggccctgtgcgagagtataaccttagccaccggcccactcacgaccctgtgggaggggagccccggcaagttctggaataccacaatcgcagtaagtatggctaacattttccggggaagctacctcgccggcgccggcttagccttttcactgatgaagagtttagggggtggacgtcggggcactggggcgcagggcgagaccctcggggagaagtggaagcgccagctgaaccagctttccaagagcgagttcaacacttacaagcggtccgggatcatggaggtggaccgcagcgaggccaaagagggcctaaagcgcggggagacaacgaagcacgctgtgtcacgcggcaccgccaaattgaggtggttcgtcgaacgcaacctcgtgaagccggaggggaaggtgatcgacctgggatgcgggcgcggagggtggagctactactgtgccgggctgaagaaagtcaccgaggtgaaagggtacacgaagggcgggccgggccacgaggagccaatcccgatggctacatacgggtggaacctggtcaagctccactccggcaaagacgtgttcttcataccacctgagaaatgcgacaccttattgtgcgatatcggggaaagctcccccaatcctaccattgaggagggccgcactttgcgggtgctcaagatggtagagccgtggttacgcgggaatcagttctgcataaagatcctgaacccctacatgccctccgtcgtggaaacgttagagcaaatgcaaaggaagcacggcggcatgcttgttcgcaatcccttgtcccggaacagcacgcacgagatgtactgggtgtcctgcgggacaggcaatatcgtgtccgccgtgaatatgacgtcccggatgctcttgaaccggttcacgatggcccaccgaaagcccacttacgagagggacgtagaccttggggccggcacccggcacgttgccgtagagccggaggtcgcgaacctcgatatcattggtcaaaggatcgagaatataaaacacgagcataaaagcacctggcactacgacgaggacaacccgtataagacctgggcctaccacgggtcctacgaggtgaagcccagcggcagcgcctccagcatggtcaatggtgtggtgaaactgctgacgaagccgtgggacgtaatccccatggttacccagatagctatgaccgacaccacccctttcggccaacagagggtcttcaaggagaaggtcgacacccgcacgcccaaggccaagcgggggaccgcgcagatcatggaagtgacggccaaatggctttggggcttcctgtcacgcaacaagaagccgaggatctgcactcgcgaggagttcacccggaaggtgcgaagcaacgcagccatcggcgcggtattcgtggacgagaaccaatggaactccgccaaggaagccgtggaggacgagcggttctgggacctggtccaccgagagcgggagttacacaagcaggggaagtgtgcgacctgtgtgtacaatatgatggggaaacgcgagaagaaattaggggagttcggcaaggcgaaggggagccgggcgatctggtacatgtggctgggcgcccgattcctcgagttcgaagcgctggggttcatgaatgaggaccactggttcagtagagagaactctctgtcgggtgtggagggcgagggcctccacaagctgggctacatcctgcgcgatatcagcaagatcccagggggcaacatgtacgccgacgatacggcgggatgggacacccggataaccgaggacgacctccagaacgaggcgaagatcaccgacatcatggagcccgagcacgccctactggccaaatccatattcaaactcacctaccagaacaaggtggtgcgcgtacaacggcccgccaaaaacgggaccgtcatggacgtgatctcacgccgggaccagcggggatccggccaggtggggacgtacggcctaaataccttcacaaacatggaagcacagctgatccgccagatggagtctgaaggtatcttttcccccagcgagctcgagacccccaacctggccggccgcgttctggattggctcgagaagcatggggttgagcggctgaagcgtatggccattagcggcgacgactgcgtggttaagccgatcgacgaccgcttcgcgaccgccctgactgccctcaacgacatggggaaggtacggaaggatatcccgcagtgggagccaagtaagggctggaacgactggcagcaggtccccttctgcagccaccacttccaccaactaatcatgaaagatggacgcgagatcgtagtaccctgccggaaccaggatgagttggttggacgcgcacgggtctcccagggcgccgggtggagcctccgcgagacggcatgcctgggcaagtcctatgcccaaatgtggcagctgatgtacttccaccggcgcgacctccgactggcagcaaacgcaatatgcagcgctgtgccggtggactgggtccccacttctcgcaccacctggagcatccacgcccaccaccagtggatgacgaccgaagacatgctgtccgtatggaaccgtgtatggatagaggagaacccttggatggaggacaagacccatataagctcgtggggtgatgttccctaccttggaaagcgtgaagaccagtggtgcggcagtctaatcgggcttaccgcgcgggccacgtgggctaccaacattcaggtggccatcaaccaggtacgccggttgatcggcaacgaaaactaccttgactacatgacatccatgaaacggttcaagaacgagagcgaccccgagggggcgctgtggtaa

SEQ ID NO: 24467 - RNA, 9879 nt, synthetic construct
  misc_feature 1..9879: note = derived and/or modified CDS sequence (opt11) from DENV-1__GU131755__SS-prME
  source 1..9879: mol_type = other RNA
agcgtgaccatgctgctcatgctcatgccgaccgccctggccttccacttaaccacccggggcggggagccccacatgatagtgtcaaagcaggagcggggcaagagcctgctgttcaagaccagcgccggggttaacatgtgcacccttatcgctatggacctgggcgagttgtgcgaggacaccatgacctacaagtgtccccggatcaccgagacggagccggatgacgtagactgctggtgcaacgcgactgacacctgggtgacctacgggacctgcagtcagacgggtgagcatcggcgggacaagcggtcagtggccctcgcgccccacgtgggcctggggctggagacccggaccgagacctggatgagctccgagggcgcctggaagcagatccagcgggtcgaaacgtgggccctccgccatcccgggttcaccgtgatcgccctgtttttggcccacgcgatcggaacctctatcacccagaaggggatcatcttcatcctcctgatgctggtgacgcccagtatggccatgcggtgcgtcggaatcggcagccgcgacttcgtggaggggctctccggcgcaacctgggtggacgtcgtgctggagcatgggagctgcgtgaccaccatggctaaggacaagcccacgttggatatcgagctcctgaagaccgaggtcaccaaccccgccgtgctgcggaagctctgcattgaggcgaagatctccaacaccacgaccgacagccgctgcccgacccaaggcgaggcaaccctggtggaggagcaggatgccaacttcgtctgccggcgcacgtttgtggacagaggctgggggaacggctgcgggctgtttggaaaagggtccctcatcacgtgcgccaagttcaagtgcgtgaccaagttggagggtaagatcgtacaatatgagaacctgaagtacagcgtgatcgtgaccgtccacacgggtgatcagcaccaggtggggaacgaaagcaccgagcacggtaccaccgcaaccatcacgccccaggcccccaccacggagatccagctcaccgattacggggccctgacgctggactgtagcccccgcaccggcttagacttcaacgagatggtcctgctgacaatgaaggaaaaatcctggctcgtgcacaaacagtggttcctcgatctgcccctcccctggaccagcggcgcctcgacatcccaagagacctggaaccggcaggacctgctggtgaccttcaagaccgcccacgccaagaagcaggaggtcgtggtgctcggaagccaggagggcgcgatgcatacggcgctgacaggggccaccgagatccagacctccggcacgacgaccatcttcgctgggcacctgaagtgcaggctcaagatggacaagctgaccttgcggggcatgtcatacgtcatgtgcacggggtccttcaaactcgagaaggaggtcgccgagacccagcacggcaccgttctggtacagatcaagtacgaaggtactgacgcgccctgcaagatccccttcagcactcaggacgagaagggggtgactcaaaacggacgcctgatcaccgccaacccgatcgtgacagacaaggagaagcccgtcaacatcgaagccgagccacccttcggcgagtcctacatcgtgatcggcgccggcgagaaggcgctgaagctcagctggttcaagaaggggtccagcattggcaagatgttcgaggccacagcccgcggggcccgcagaatggccatcctgggtgacaccgcgtgggatttcgggtccatcggcggtgtgttcacctcggtcgggaagctggtgcaccagatcttcggcactgcctacggggtgctgttctcaggcgtcagctggacgatgaagatcgggatcggcgtactgctgacctggctcgggctgaactcccggagcacaagtctatcgatgacctgtatcgccgtggggctcgtcacgctgtaccttggcgtgatggtgcaggccgactccgggtgcgtcatcaactggaagggccgcgaactcaagtgcgggagcggcatcttcgtgaccaatgaggtgcacacctggaccgagcagtacaagttccaggccgacagcccgaagcgactgtccgcggccatcggcaaagcctgggaagagggggtctgcggcattcggtcggctacccggctggagaacattatgtggaagcagatttccaacgagctcaaccacatcctgttagaaaatgacatgaagttcacagtggtggtcggagacgtggccggcatcctcgcgcaggggaagaagatgatccgcccccagccaatggagtacaagtacagctggaagtcctggggcaaggccaagataatcggcgccgacgtgcagaacaccaccttcatcatcgacgggcccaacactcccgagtgccccgacgaccagcgcgcctggaacatctgggaggtcgaggactacggcttcggcatcttcaccactaacatctggctgaagctgcgcgactcgtacacccaggtgtgcgaccacagactcatgtcagcggccatcaaggacagcaaggctgtgcacgccgacatgggctactggatcgagtccgagaagaacgagacctggaaactggcccgcgcgagcttcatcgaggtcaaaacctgtatctggcccaagtcccacaccctgtggagcaacggcgtgctcgagagtgaaatgattatccccaagatctacgggggcccgatcagccagcacaactaccggcccggttacttcacccagaccgccggcccttggcacctcgggaaacttgagctcgacttcgacctgtgcgagggcacgacagttgtggtggacgagcactgtggcaatcgcgggccgtccctgcggaccaccactgttacaggcaagatcatccacgagtggtgctgccgcagctgtaccctgccgcctttgcggttccgcggggaggacggctgttggtacggcatggagatacggcccgtcaaggagaaggaggagaacctggtgaagtccatggtgagcgcgggctcgggcgaggtcgactccttcagcctcgggctgctgtgcatttcaatcatgatcgaggaggtgatgcgcagtcgctggtccaggaagatgctcatgaccggcacgctggccgtgttctttctgctcatcatggggcagctgacctggaacgacctgatccggctctgcatcatggtcggcgccaacgcgagcgaccggatggggatgggcaccacgtacttggcgctgatggcgacgttcaagatcaggccaatgttcgccgtgggcctcctgttcagacgcctgacctcccgggaggtcttactgctgaccatcgggctcagcctggtcgcctctgtggagttacccaacagcctcgaggagctgggcgacgggcttgcgatgggcataatgatcttaaagctactaaccgattttcagtcccatcagctctgggccacactactgagcttaaccttcatcaaaaccaccttctccctgcactgtgcctggaaaacgatggccatggtcctgagcatcgtgtccctcttccccctgtgtctgagcaccacctcccagaagaccacgtggctccccgtgctgctgggcagcctgggctgcaagcccctgaccatgttcctgatcgcggagaacaagatctggggccgcaggtcctggccactcaacgaaggaatcatggccgttggaatagtgagcatcctgctgagctcactactgaagaacgacgtgccccttgccgggccgctcatcgccggcggcatgctgatcgcctgctacgtgatcagcgggtccagcgctgacctgtccctcgagaaggccgccgaggtatcgtgggaggaggaggccgagcactccggagccagccacaacatcctggtggaggtccaggacgacgggacaatgaagatcaaggacgaggagcgcgacgacaccctgaccatcctactgaaagcgacgctgctcgccgtgtccggcgtgtacccgctcagcatccccgccaccctattcgtatggtatttctggcagaaaaagaagcagcggtccggggtcctctgggacacccccagcccgcccgaggtagagcgcgccgttctggacgacggcatttacaggatcatgcagcgcggcctgctggggcgatcccaggtgggcgtgggggtcttccaagagaacgtgttccacaccatgtggcacgtgacgcgcggcgccgtcctcatgtaccaggggaagcggctggagcccagctgggcgtccgtgaagaaggatctgatcagctacggcggcgggtggcgcctccagggctcgtggaacaccggggaagaagtgcaggtcatagccgtggagcccggcaaaaaccccaaaaacgtgcagaccgcccccgggacctttaagacgcccgagggcgaggtcggcgccatagccctggacttcaagcccgggacctcgggctcgcccatcgtgaaccgggaggggaaaattgtgggcctgtacggcaatggggtcgtgaccaccagcggcacgtacgtgagcgcgatcgcgcaggcgaaagcctcacaggagggaccgctccccgagatcgaggacgaggtctttcgcaagcggaacctgaccataatggacttacaccccggcagcgggaagacccggcgctatctaccggcgatagtgcgcgaggccatcaagcgcaagctgcggacactgatcttggctcccacgcgcgtcgtcgcctccgagatggccgaagcgctgaagggcatgcccatccggtaccagaccaccgcagtcaagagcgaacacaccggcaaggagatcgtggacctgatgtgccacgcaactttcaccatgcgcctcctgtcccccgtccgggtaccgaactacaacatgatcattatggacgaggcccacttcacggaccccagctccatcgccgcgcgcgggtacatcagcacccgggtgggtatgggggaggccgccgccatcttcatgacggccacgccgcccggctccgtcgaggctttcccgcagagcaacgccgtgatccaggatgaggagcgcgacatacccgagcgtagctggaacagcgggtacgagtggatcacagacttccctggcaagaccgtgtggttcgttccctccataaagagcggcaacgacatagcaaactgcctgcggaagaacgggaaaagggtgatccagctctcccgcaagacgttcgataccgaataccagaagacgaagaacaacgattgggattacgtggtgacgacggacatcagcgagatgggcgccaacttccgagcggaccgcgtgatagacccgcggcgatgcctgaagcccgtgatcctgaaggacgggcccgagcgcgtcatcctcgccggccccatgccggttaccgtcgcctcggccgcccagcgcagggggcgcatcggccgcaatcacaacaaggagggagaccagtacatctacatgggccagcccctgaataacgacgaggaccacgcgcactggaccgaagcaaagatgctgctcgacaatatcaacacccccgagggcatcatccctgccctatttgagccggaacgggaaaagtccgccgccatcgacggggagtaccgcctgcgtggcgaagcacgcaaaacgttcgtggagctcatgcggcgcggcgatctgcccgtgtggctgtcctacaaggtcgcctcagagggcttccagtacagcgaccggcgctggtgctttgatggggagcggaacaaccaggtgctggaggagaatatggacgtggaaatctggaccaaggagggggagcgcaagaaactgcggccccgctggctggacgcccggacctactccgaccctctcgccctgcgcgagttcaaggaattcgccgcgggacggcgaagcgtctccggggacctaattctcgagatcggcaaactgccgcagcacctgacccagcgggcccagaacgccctcgacaatctggtgatgctgcacaactcagagcagggcgggcgcgcctaccggcatgcgatggaggagctccccgacaccatcgagacactgatgctgctcgctctgatcgctgtgctgaccggcggagttaccctctttttcctgtccggccgcgggctaggcaagaccagcatcggcctcctttgcgtgatggcctccagcgtgctgctctggatggcctccgtcgagccacactggatagcggccagcataatcctggaattcttcctgatggtgctcctgatccccgagcctgataagcagcgcacaccccaggacaaccagctggcctacgtggtcattgggctgctgttcatgattctgaccgtggccgccaacgagatgggcctacttgagaccaccaagaaagacctgggtataggacacgtggcggtagaaaaccaccaccacgccgccatgctcgacgtggaccttcaccctgcctccgcctggaccctgtacgcggtcgccaccaccatcatcaccccgatgatgcgccacactattgagaacacaacggccaacatcagcctcaccgctatagccaaccaggcagcgatcctgatggggctggacaagggctggccgatctccaagatggacatcggcgtccccctcctggccctggggtgctacagccaggtgaaccccttgacgctgacagccgcggtactgatgctcgtcgcgcactacgccatcatcggaccggggctgcaggccaaggccacccgcgaggcgcagaagcggaccgccgccggcattatgaaaaaccccacggtggatgggatcgtggcgatcgacctggaccccgtcgtgtacgatgccaagttcgagaaacaactcggccagatcatgctgctgatcctctgcacctcccaaatccttctgatgaggaccacctgggcactctgcgagagcatcacgctggccaccggccccttgaccactctttgggagggttcaccgggcaaattctggaatacaaccatcgccgtgagcatggccaacatctttcgggggtcctacctggccggcgcgggcctggcgttcagcctcatgaagtcccttggaggcgggaggcgggggaccggggcccagggcgagaccctgggcgagaaatggaagcgccagctcaaccagctgtccaagagcgagtttaacacgtacaaacggtccgggatcatggaggtcgaccgctccgaagccaaggagggcctgaagcgcggggagaccaccaagcatgcggtgtcccgcggcacggccaagctccgatggttcgtggagcgcaacctggttaaacccgaggggaaagtgatcgacctgggctgcggccgcggtggttggagctactactgcgccgggctgaagaaggtgactgaggtcaagggctacactaagggcggacccggccacgaggagcccatcccgatggcgacttacgggtggaacctcgtgaaactgcattccggcaaggacgtgttcttcatcccacccgagaagtgcgacaccctgctctgcgacatcggggagagctcccccaacccgacgatagaggagggacgcaccctgcgcgtcttgaagatggtggagccctggctccgcgggaaccagttctgcatcaagatcctgaacccctacatgcctagcgtggtcgagacattagagcagatgcagcggaagcacggcggcatgctcgtgcgcaacccgctgtcccggaacagcacccacgagatgtactgggtgtcctgcggaaccggcaacatcgtcagcgctgtgaacatgacgagccgcatgctgctcaaccgcttcactatggcgcaccgtaagccaacttacgagcgcgacgtggaccttggggcaggcacccggcacgtcgccgtcgagccagaggtggccaacctggacattatcggccagcgcatcgagaacatcaagcacgagcacaagtcgacgtggcactatgacgaggacaacccctacaaaacctgggcttaccacggctcatacgaggttaagccgtctggctccgcgagcagcatggtgaacggcgtcgtgaagctcctgacaaagccctgggacgtgatccccatggtcacccagatagccatgacggacaccacccccttcggccagcagcgggtgtttaaggagaaggtcgacacccgcacgccgaaggccaagcggggaaccgcgcaaatcatggaagtaaccgccaagtggctttggggcttcctctcccggaacaagaagccgcggatctgcacccgcgaggagttcacacgtaaggtgcgcagcaacgcggccatcggcgccgtgttcatagacgagaaccagtggaactccgccaaggaagcggtcgaggacgagcggttctgggacctggttcaccgcgagagggagttacacaagcagggaaagtgcgcaacctgcgtgtacaacatgatgggcaagcgcgagaaaaaactcggggagtttggcaaggccaaggggagccgggccatttggtacatgtggctgggcgccaggttcctggaattcgaggcgctcgggttcatgaacgaggatcactggttctcccgggagaacagcctgtccggggtcgagggcgaggggcttcacaagctaggttacatcctgcgcgacatcagcaagatccccgggggcaacatgtacgcagacgacactgccggatgggacacccggatcacggaggacgacctgcagaacgaggcccgcatcactgacatcatggagccggagcacgccctcctggccaagtccatcttcaagctgacctatcagaacaaggtggtacgcgtccagcgacctgccaagaacggtaccgtgatggacgtgatcagccgccgggaccagcgcggctccggccaggtcggcacgtatggcctgaacacctttaccaacatggaggcccagctgatccggcagatggagagcgaggggatcttctccccgagcgagctggagacccccaacctcgcagagcgcgtgctggactggctggagaagtacggcgtagaacggctcaagaggatggccatctcaggggacgactgcgtcgtgaagccgatcgacgaccggttcgcgacggcgttaaccgcgcttaacgacatgggcaaggtccgcaaggacataccccaatgggagcccagcaagggctggaacgattggcagcaggtccccttctgctcccaccatttccatcagctcatcatgaaggacggccgggagatcgtggtgccatgccgaaatcaggacgagttggtcggccgggcccgcgtaagccagggggccggatggagcctgcgagagaccgcgtgcttggggaagtcctacgcccagatgtggcagctgatgtacttccaccggcgggacctgcgcttagcggccaacgcgatatgcagcgccgtgcccgtcgactggatccccacctcccggaccacctggagcatccacgcccaccaccagtggatgaccaccgaggacatgctgtcagtgtggaatagagtgtggatcgaggaaaacccctggatggaggacaagacgcacatcagcagttggggcgacgtcccttatctggggaagcgcgaggaccagtggtgcggctcattgatcggcctgaccgctcgggccacatgggcgaccaacatacaggtagccattaaccaggtgcgccggctgatcgggaacgagaactacctagattacatgacctccatgaagcgcttcaaaaacgagtctgaccccgagggtgccctgtggtga

SEQ ID NO: 24468 - RNA, 9879 nt, synthetic construct
  misc_feature 1..9879: note = derived and/or modified CDS sequence (opt11) from DENV-1__GU131756__SS-prME
  source 1..9879: mol_type = other RNA
agtgtaaccatgcttctgatgctaatgccgactgcgctagcctttcatttaaccacccgcggcggggaaccccacatgatcgtgtcaaaacaggaaagaggaaaatcactacttttcaaaacttcggctggagtgaacatgtgcacgcttatcgcgatggatctaggcgagttctgcgaagacacaatgacgtacaaatgtcctcgcattacagaagctgaaccggacgacgtagactgctggtgcaacgccacagacacatgggtcacatacggtacatgctcgcaaacaggcgaacaccggcgggataaacgttcagtcgctcttgcaccgcacgtaggactaggtctggaaactaggacggaaacctggatgtcaagtgaaggcgcctggaaacaaattcaacgagtcgaaacgtgggcacttcggcacccaggtttcacagtcatcgcccttttcttagcacacgcaattggaacatcaatcacgcagaagggaataatattcatcctccttatgttggtcacaccaagtatggctatgcgatgcgtcggaatcgggtcacgcgacttcgtcgaaggtttatcaggggctacttgggtcgacgttgtgctcgaacacggctcctgcgtaacaaccatggccaaagacaaacctacgctagacatagaactcctgaaaactgaagtcacgaacccagccgtcctccgcaaattgtgcatcgaagctaaaatcagcaacaccacgaccgacagccgatgtccgacacagggggaagcgacacttgtagaagaacaagatgccaactttgtatgtagaagaaccttcgtagaccgcggctggggaaacggatgcggactattcggaaaaggaagcctaatcacgtgcgctaaattcaaatgcgttaccaaattggaaggcaagatcgtccaatacgaaaatctaaaatactctgtcatcgtaaccgtgcacacaggggatcaacaccaagtgggaaacgaatcaacagagcacggaacaacggccacaatcacaccccaagcaccgagtaccgaaatccaacttaccgactatggtgccttaaccctagactgctcgcctcgtacaggcctggacttcaatgaaatggtccttttaaccatgaaggagaaaagttggctagtgcacaaacaatggttcctcgacttaccccttccatggacttccggcgcgtcaaccagccaggaaacctggaaccgacaagacctgctggtcacattcaaaaccgctcatgcaaagaaacaggaggttgtggttctgggcagccaggaaggggcgatgcacaccgcactgaccggggcaacggagatacagaccagtggaacaaccacaatcttcgcaggacatcttaaatgtagactcaagatggacaagctcacgctaaagggaatgagctacgtaatgtgcacaggcagcttcaaactcgagaaagaagtcgcggagacgcagcatgggacggtattggtgcaaataaaatacgagggcacagacgcaccgtgcaaaataccattctcgacacaggacgaaaagggcgttacacagaacgggcggctcatcaccgccaacccgatagtgaccgataaggagaagccggtgaacatcgaggcggaaccacccttcggagaaagctacatagtaatcggtgcaggagagaaggcactcaagctatcctggttcaagaaagggagcagcataggcaaaatgtttgaagcgacagcccgaggagctagacgaatggccatcctcggagacacggcctgggacttcggttcaataggaggagtcttcacttccgttggaaagctggtacaccagatttttggcaccgcgtacggagttctcttttccggagtaagctggacaatgaaaataggtatcggggtattactaacctggcttggactaaactcacggtcaacctccctatctatgacgtgcatagcagtgggactcgtgacactatacctaggcgtaatggtgcaagcggactccggctgcgtaatcaactggaaaggccgcgaattaaagtgcggaagcggcattttcgtaaccaacgaagtgcacacgtggacagagcagtacaaattccaagcggactccccaaaacggctcagcgccgcaattggaaaagcctgggaagaaggagtgtgcgggatccggtcggcgactagactcgaaaacatcatgtggaaacaaataagcaacgaactcaaccatatactcctcgaaaacgacatgaaactaacggtagtcgtgggggacgtcgcgggaatactcgcccagggcaagaaaatgatacgtccccaaccaatggaatacaaatactcatggaagtcctggggcaaggctaaaatcataggtgctgacgttcagaacaccacgttcataatcgacgggcctaacacaccagaatgcccagatgaccaacgtgcctggaacatatgggaagtcgaggactacggcttcggaatcttcactaccaacatttggctaaaattgagggacagctatacccaagtttgtgaccacaggctaatgtcagcggcgatcaaagacagcaaggcggtgcatgccgacatgggatactggatagagtcggagaaaaatgagacatggaaattagccagggcatcattcatcgaagtcaaaacttgtatatggccaaaatcccacacactctggagcaatggtgttctcgaatccgagatgatcatcccaaaaatctacggagggccgatttcgcaacacaactaccggccaggatatttcacgcaaaccgcaggaccctggcacctgggtaagctggagctcgattttgatctctgtgaagggaccaccgtggtagtcgacgagcactgcggaaacaggggaccatcgctaagaacgaccacagtaactggaaaaattattcacgaatggtgctgtcgaagctgcacactcccgccgctccgattcaaaggggaagacggatgctggtacggcatggaaataagaccggtaaaggagaaggaagagaatctcgtgaagtccatggtaagtgccggttccggcgaagtcgatagcttttcccttggactactttgcatctctatcatgattgaggaggttatgcgatcacgatggtcgcgaaagatgctgatgaccggcacactcgccgcctttttcctactaataatgggccaattaacctggaacgacctaataaggttatgtataatggtgggggcgaacgcatcagaccgaatggggatgggcaccacctaccttgcactcatggccacatttaaaatgagacccatgttcgccgtgggactgctgttcagacgcctaacctcacgcgaggtcctactgctgacaatagggctcagcctagttgcctccgtggaactcccaaactcattggaagaactaggagatgggttagccatgggtattatgatactgaaactgctgaccgacttccaaagtcaccagctctgggcaaccctgctctcactaactttcatccgaacaaccttctccctacactacgcatggaaaactatggcgatggtcttatccatcgtgagtttgttccctctatgcctcagtacgacaagccagaagaccacgtggctgccggtactcctgggcagcctaggctgcaagccgctgacaatgttcttaatcgccgagaacaaaatatggggaagaaagagctggccactaaacgaagggataatggcggtaggcatcgtcagcatacttctctcctcgctactgaagaacgacgttccactagcggggcccctgatagcgggagggatgttaatcgcatgttacgtgatttcagggagctcggctgacctaagtttagaaaaagcagctgtagtgagttgggaagaagaggcagaacacagcggcgcatcccacaacatattggtcgaggtacaagacgacggaaccatgaagatcaaggacgaagaacgtgacgacacattaactatcctgttaaaagcgacgttactggccgtgagcggcgtataccccctaagtatccccgctacgcttttcgtatggtacttctggcagaagaagaaacagcgcagcggggtactgtgggacaccccttcgccacctgaagtggaacgcgccgtactggacgacggaatatacaggataatgcaaagggggttgctggggcgttcccaggttggcgttggggtatttcaggagaacgtattccacacaatgtggcacgtgacacgtggtgccgtactcatgtaccaaggtaagagattagaaccgtcgtgggcgtccgtcaagaaagacctcatcagctacggaggcggatggcgtctgcaagggagctggaacaccggcgaggaggttcaagtaatagctgtggaaccggggaagaatccaaagaacgtccagaccgcccctggtacctttaagaccagcgaaggcgaggtaggcgcgatcgccctggacttcaaacccgggacttccggctcgccaatcgtgaatagagaaggaaaaatcgtgggattgtacggcaatggggtcgttacgacaagtggaacttatgtgagtgccatcgcccaagcaaaggccagccaagagggccccctcccggaaatagaagacgaagtctttagaaaacgtaatctaacgatcatggatttacaccccggctccggaaagacccgacgatatttgccagcaatcgtaagggaagcgataaaaagaaagttacgcaccctgatcctggccccaacaagagtagtcgcaagcgaaatggcggaagcactaaagggtatgccaatccgataccaaacgaccgcagtgaaaagcgaacatacggggaaggaaatcgtcgacctcatgtgtcacgcaacattcaccatgcgactgctatcgccggtccgcgtcccaaactacaacatgattattatggacgaggcccacttcactgatcctagctcaattgccgcccggggatacatcagcacacgcgttggcatgggtgaagctgccgcgattttcatgacggctacgccgcccggttccgtcgaagcatttcctcaaagcaatgccgtaatacaagatgaagaaagagacataccagagcgcagctggaactcgggatacgaatggatcaccgatttcccgggcaaaacagtctggttcgtgccatcaatcaagagtgggaacgatatagctaactgtctgaggaaaaatggcaaaagagtcatccagctatcgcgtaagacctttgacaccgaataccagaaaacaaagaataacgactgggactacgtagtaacgaccgacatcagcgagatgggagcgaatttcagggcggacagggtcattgacccgcgacgctgcttgaagcccgtaatacttaaagacggaccagaaagagtgatcttagcgggcccgatgcccgtaacagtggcttccgcagcccaaaggagaggccgaatcggtcgtaaccacaataaagagggagatcagtacatctacatgggccagccgctgaacaatgatgaggaccacgctcactggactgaggcaaagatgctactcgataacattaatacgcccgaaggaattatcccagccttattcgagcccgagcgggaaaagagtgcagccatcgacggggaatatcgcctgcgtggcgaagcacgcaagacgtttgtcgaacttatgagaagaggggacctaccagtatggctcagttacaaggtcgctagcgaaggcttccaatactcagaccggcgttggtgtttcgacggtgagcgaaacaaccaggtcctggaggaaaacatggacgttgagatctggacaaaagagggcgaaagaaagaaactcaggccccgctggcttgacgcgcggacctacagcgatccgctcgccttaagggagttcaaagagttcgccgcgggacggcgatcagtgtccggagacttaatattggagatcggaaaactgccacaacacctgacacaacgcgcgcaaaacgcattagacaacttagttatgctgcacaacagcgaacagggagggagagcgtatcgacacgcaatggaagaactgccggacacgattgagacccttatgctgctcgccttaatagccgtactgaccggaggtgtaaccctcttctttctcagcgggcggggtctcggtaaaacctcgatagggctactgtgcgtaatggctagctccgtgctactgtggatggcctcagtcgaaccccactggatcgcggcgagcatcatactagagttcttcttaatggtgcttctgatccccgaaccggaccgacaacgaacgcctcaggacaaccaattggcgtacgtcgtcattggactgctctttatgatattaacggtggcggcaaacgagatgggactcttggagacaacgaagaaagatctcggcataggacatgttgctgtcgagaaccatcatcacgcggcaatgctcgatgtggacctacacccagcctcagcctggacactctacgcggtagccacaaccataataacacccatgatgagacatacaatcgaaaacacgactgccaacatatcactgaccgcgattgcgaaccaggctgccatattgatgggattagacaaaggctggcctattagtaaaatggacattggcgtcccgctcctagcgctcggttgttactcacaagttaacccactcacgttgactgcagccgtactgatgctggtcgcccactacgcaatcatcggacccgggttacaggcaaaagctacacgggaggcacaaaagagaacagcagcaggaatcatgaaaaacccaactgtcgatgggatagtggccatagacctcgacccagttgtctacgacgcaaaattcgaaaaacaactcgggcaaattatgctcctaatattgtgtacaagccagattctcctcatgcgaacaacttgggccctctgcgagtcaatcacactggcaacaggccctctcactacactttgggaaggaagtccaggcaaattctggaacacgaccatagccgtctctatggctaacattttcagagggagttacctcgccggcgcaggccttgcattcagcctgatgaagtccttgggtggcgggaggcgtggaactggcgcccaaggagaaacgctgggcgaaaaatggaaaagacagctaaaccaactgagcaaaagcgagttcaacacatataagcgatctggcataatggaagtcgatcgctcagaggcaaaagaagggctcaagagaggagagactacgaaacacgccgtcagtagaggtacagcaaaactccgctggttcgtagaacggaatctagtaaagcccgaaggcaaggtaatagacctgggatgcggacgaggcggatggagctactactgtgcaggactcaagaaagtaacagaggttaagggatacacaaaaggaggacccgggcacgaagaacccatcccaatggccacctatggctggaacctggttaagttgcactcaggcaaggacgttttcttcatcccaccagaaaaatgtgacactctcttgtgcgacattggagaatctagcccgaaccctaccatcgaagagggtcgcactctgcgggtcctgaaaatggtcgaaccgtggctccgaggtaatcaattttgtatcaaaatcctaaatccatacatgcccagtgtcgttgagactctagagcaaatgcaaaggaaacatggagggatgctcgtccggaaccccttgtcgcgaaactccacacatgaaatgtactgggtgtcatgcggaacagggaatatagtgagtgcggtcaacatgacgtcgcggatgttattgaaccgtttcacaatggcacaccgcaaacccacgtacgaacgagacgtggacttaggggcagggacaaggcatgtagcggtcgaaccggaagtagcgaacctcgacataatcgggcagcgcatagaaaacataaaacacgagcacaaaagcacatggcattacgacgaagacaacccctacaagacatgggcgtaccatggatcatacgaagtaaaaccaagtggatcggcttccagcatggtcaacggcgttgtcaaattgctaacaaagccatgggacgttataccaatggtaacgcaaatcgcaatgaccgacacaacacccttcgggcagcagcgtgtgtttaaagagaaggtagacaccagaacaccaaaagctaaacgaggcactgcccaaataatggaagttacagcaaaatggttgtgggggttcctttcaagaaataagaaaccgcgcatatgtacgcgagaagagttcacaagaaaggtcagatccaacgctgctatcggcgccgtgttcgtcgacgagaaccaatggaactcagccaaagaagccgtcgaagacgagagattctgggacctcgtgcaccgcgagcgagaactccacaagcagggcaagtgcgcaacttgcgtctataacatgatgggaaaacgggagaagaaactgggcgagttcgggaaggccaaaggaagtcgcgcgatctggtacatgtggctaggagcccgcttcctggaatttgaggccctcggcttcatgaacgaagatcactggttctcaagagagaacagccttagcggagtggagggggaagggctccataaactcggctacattctgagagacataagcaaaatcccaggaggtaatatgtacgcggacgacacagcggggtgggatacccgcataaccgaagacgacctgcagaacgaagcaaaaataacggatataatggaaccggaacacgcgctactagcgaaatcaatttttaaattaacgtatcaaaacaaggtagtcagggtacaacgcccagcaaagaatggtactgtcatggacgttatctcacgcagagaccagcgaggctccgggcaggtagggacctacgggctgaatacatttacgaatatggaagcgcagctcatcagacaaatggaatcagaaggtatattctcgccatccgaattggaaacgcctaacctggctggcagagtgctcgactggctggagaaacacggcgtggagcgtttaaagcgcatggcgatctcaggggatgactgcgtggttaaaccaattgacgatcgcttcgcgacagcactaacagcattaaacgatatgggaaaggtccgaaaagatattccgcaatgggaaccaagcaagggatggaatgactggcaacaagtccccttttgcagccaccatttccaccagctcataatgaaagacgggcgcgaaatcgtcgtgccctgcaggaaccaagacgagctcgtaggacgagcacgagtatcccaaggcgcgggatggtcactgcgcgagacagcttgcctgggcaagtcatacgcccaaatgtggcagctaatgtacttccatcgaagagacctccgactggccgccaacgccatctgtagcgcagtccctgtagactgggtgccaacaagcagaaccacatggtccatacacgctcaccaccagtggatgaccactgaagacatgctctctgtatggaatagggtgtggatcgaagagaacccatggatggaagacaagacccacatatcaagctggggagacgttccctatctaggcaaaagggaagatcagtggtgcggaagtctaatcggtctgaccgcgcgagcaacttgggccacaaacatacaggttgcaataaaccaagtgcgacgcctgctcggtaacgagaactacctcgactacatgacctcaatgaagcgatttaagaacgaatcagacccggaaggggcattgtggtag

SEQ ID NO: 24469 - RNA, 9879 nt, synthetic construct
  misc_feature 1..9879: note = derived and/or modified CDS sequence (opt11) from DENV-1__GU131758__SS-prME
  source 1..9879: mol_type = other RNA
agcgtgacaatgttgctcatgctgatgcccaccgcactggccttccacctcaccacccgaggcggggagccccacatgatcgtgtcaaagcaggagcggggcaaatcgctgctctttaagacaagcgcgggagtgaatatgtgtacgcttatcgccatggacctgggcgagttctgcgaggacacgatgacctacaagtgcccgcgcatcaccgaagctgagcctgacgacgtcgactgctggtgcaatgccaccgatacgtgggtcacttacggcacatgcagccaaaccggcgagcaccggcgtgacaagagaagcgtggccctagcaccccacgtgggcctagggctggagacccgcactgagacgtggatgagctccgagggcgcctggaagcagatccagagagttgagacttgggccctgcgccatccaggtttcacagtgatcgccctctttctggcgcacgccatcggtaccagcattacccaaaaggggatcatctttatcctgctcatgttggtgaccccgtccatggcaatgaggtgcgtcggcatcggctctcgagacttcgtagaggggctgagcggcgccacgtgggtggatgtcgtgctggaacacgggtcatgtgtgaccacaatggccaaggacaagcccaccctggacattgagctcctcaagacagaggttaccaaccccgcggtgcttcggaaactgtgcatagaggctaagattagcaacaccacaacggatagccgctgcccaacccaaggcgaggcaaccctcgtggaagagcaggacgccaatttcgtctgccggcgcaccttcgtggatcggggttggggcaacggatgcgggctgttcggaaaggggtccctgatcacgtgtgccaagtttaagtgcgtgaccaagctcgagggcaagaccgtccagtacgagaatctcaagtacagcgtgatcgtaaccgtgcacacgggcgaccaacaccaagtaggcaacgaatccaccgagcacggcactaccgcgaccatcactccccaggctcccagtaccgaaatacagctgaccgattacggcgccctaactcttgactgcagccccagaacaggcctggacttcaacgaaatggtccttttgaccatgaaggaaaagtcgtggctggtgcataagcagtggttcctcgacctacccttgccctggaccagcggggctagtacgagtcaggagacttggaatagaaaggacttactggtgacattcaagacagcccatgctaagaaacaggaggtcgtcgtactcggctcccaagagggcgccatgcacaccgcactcacgggggccactgagatccagacgagcggcaccacgaccatattcgccggccacctaaagtgccgcctaaaaatggacaagctgacgctgaagggcatgtcatacgtcatgtgcacagggagcttcaagctggaaaaggaggttgcggagacgcaacacggcactgtattagtgcagatcaagtacgagggcactgacgtgccctgcaaaatccccttttccacacaggacgaaaaaggggtcacacagaacggccggttgatcacggccaacccgattgtcaccgacaaggagaagcccgtgaacattgaggccgagccgcccttcggcgagtcctacatcgttataggcgcgggcgagaaggcgttgaagctctcatggttcaagaagggatcttccatcggcaagatgttcgaggcaacagcgcgtggggcccggagaatggccattctcggtgacacagcgtgggacttcgggtcaatcggaggcgtctttacgtcggtagggaagctggtgcaccagatctttgggactgcctatggggtgttgttctcgggcgtttcctggactatgaagatcggtatcggcgtgctcctgacctggctgggtctcaacagccggtccacttcactgtcgatgacctgtatcgccgtcgggctggttaccctgtacctgggcgtgatggtccaggccgatagcgggtgcgtcatcaactggaagggacgggagctgaagtgcgggagcggcatatttgtgactaatgaggtccacacctggaccgagcagtacaaattccaagcggactcaccgaagagactcagcgcggccatcggaaaagcctgggaagagggagtttgcggcatccgttcggccacccgactggagaacataatgtggaagcaaataagcaatgagctgaatcacattttgctagagaacgatatgaagttcaccgtggtcgtcggcgacgtcgccggcattctagctcaggggaaaaagatgatccggccccagccaatggagtataagtactcttggaagtcctggggcaaggccaagataatcggtgccgacgttcagaacacgaccttcataatcgacggcccgaacacaccggagtgccccgacgatcaaagagcctggaacatctgggaggtagaggattacggcttcgggatctttaccacgaacatctggctcaagctgagagacagctatactcaagtgtgcgatcaccgcctgatgagtgcggcgattaaggactcaaaagccgtccatgccgacatgggctactggatcgaaagcgaaaaaaacgaaacctggaaactcgcccgggcatccttcatcgaggtcaagacatgcatttggccgaagagccacacactgtggtccaatggagttctagaaagcgagatgatcatcccgaagatctatgggggcccgatctcccagcacaactatcgccccggttatttcactcagacggccggcccctggcatctcggcaagctggagctggacttcgacctatgcgaaggcacaacggtcgtcgtggacgagcactgcggcaatcgggggccctcgctgcgcacgacgacagtcacggggaagatcatccacgagtggtgctgtcgatcctgcacccttccgcctctgcgtttcaagggagaagacggctgttggtacggtatggaaatcaggcccgtcaaggagaaggaggagaatctggtcaagagtatggtcagcgcgggctccggcgaagttgactctttttccctggggctcttatgcattagcatcatgatagaggaggtgatgcgtagccggtggagtcgcaaaatgctgatgaccggcacgctggcggttttctttctgcttataatggggcaactcacgtggaatgacctcattcgtctatgcattatggtgggcgccaacgcgagtgaccgtatgggtatgggcaccacttatttggccctgatggctacctttaagatgcgcccgatgttcgccgtgggcttactgttccggcgcctaacgagccgggaggtcttgctcctgacgatcggtctgtcgctggtggcgagcgttgaactgccgaactccctggaggagctcggcgatggactcgcgatgggcatcatgattctgaagctcctcactgatttccagagtcatcagttatgggccaccctcttgagtttcacgttcatcaaaaccaccttcagccttcactacgcctggaagaccatggccatggtgctgagcattgtgtcgcttttcccactctgcctttccaccaccagccagaagaccacctggttgcccgtcctgctcggttccctcgggtgtaagccgctaacgatgttcctgatcgcggagaacaaagtgtggggccggaagtcgtggcctctcaatgaggggattatggcggtgggaatcgtttcgatcttgttgtcttcgttattaaagaatgacgttcccctcgccgggcctctaatcgcaggcggcatgttaatcgcttgctatgtgatctctggtagctccgcagacctctcgctggagaaagcggccgaggtcagttgggaggaggaggccgagcactctggcgcctcccacaacatcctggtggaggtacaggacgacgggaccatgaagataaaggacgaggagcgggatgacacccttactattctgctaaaggcgaccctcctcgccgtctctggcgtttacccgctgtccatcccagctaccctcttcgtatggtacttttggcagaagaagaagcagaggagcggggttctgtgggacaccccctcacctcccgaggtcgagcgggccgttctagacgatggcatctaccgcatcatgcagcggggactgctggggcgcagtcaagtcggcgtgggggtgttccaagagaacgtcttccacacgatgtggcacgtgacgcggggggcagtgctgatgtaccaggggaagaggctggagcccagttgggcgtctgtcaagaaggacctaatctcctatggtggcgggtggcggctgcagggctcctggaacacgggggaggaggtccaagtgattgccgtcgaacctggaaagaaccccaagaacgtacaaaccgcccccgggacgtttaagacctccgagggcgaggtgggcgcaatcgccctcgacttcaaacccgggacgagcggtagccccatcgtcaaccgcgaagggaaaatagtagggctctacggcaacggtgtggtcaccacctccggtacgtatgtcagcgcgatcgcgcaggccaaagcgtcccaggaggggcccctgccggaaatcgaggacgaggtttttaggaaacgaaacctgacgattatggacctccatcccggcagcgggaagacccggcgctacctcccagcgatcgtgcgggaggccataaagcgtaagctgcgtacgctcatcctggcgccgactagggtagtggcctcagagatggccgaggcgcttaagggcatgcccatacgctatcagacaaccgccgtgaagtcggagcacacgggtaaggagatcgtggacctcatgtgtcacgccaccttcacgatgcggctgctgagtccagtgcgcgttcccaattacaacatgatcatcatggacgaggcgcacttcaccgacccatcgagcatagccgctcgggggtacatctcgacccgggtgggcatgggtgaggccgcagcaattttcatgacagccacgccgcctggctccgtagaggcgttcccccagtcaaacgccgttattcaggacgaggagagggatattccagaacgctcatggaactccgggtacgaatggatcactgatttccccggtaagaccgtatggttcgtgccctccatcaaaagcggcaacgatatcgcaaactgcctccggaaaaatggaaaacgcgtaattcagctgtcccgcaagacattcgacacggagtaccaaaagactaagaacaatgactgggactacgtcgtgaccaccgatatctcagagatgggcgctaactttcgcgccgaccgggtcatcgacccacgccggtgcctaaagcctgtgatcctaaaagatgggcccgagcgcgtgatcctagcaggtcctatgcccgtgacggtggcctccgccgcgcagcggcgagggagaatcggacgcaaccacaacaaggagggcgaccagtacatttacatgggacaaccgctgaacaacgacgaggatcacgcgcactggacggaagccaagatgctcctggacaacattaataccccggaaggcatcattccagctttattcgagccggagcgggaaaagtccgccgctatcgacggtgaataccggctccggggcgaggcccgtaagaccttcgtcgaactgatgcgccgcggagacctgccggtctggttatcatacaaggtggcctccgagggattccagtacagcgaccgaaggtggtgctttgacggcgagcgcaataatcaagtgctggaggagaatatggatgtggaaatctggacgaaggagggggaacggaagaagctgcgcccgcgctggcttgacgcacgcacctactccgaccccctggctctgagagagttcaaggaattcgccgcgggccgcagaagcgtgtccggcgacttgatcctggagataggtaaactgccccagcacctcacccagagagcccaaaacgccctggacaatctggtcatgctccacaacagcgagcagggtggccgggcttaccgccacgcgatggaagagctaccggacacaatcgagacacttatgctcctggccctgattgccgtgctgaccggaggggtgaccctcttcttcctgtccggtcggggcctcggcaagaccagcataggactgctgtgtgtcatggccagctcagtgttgctgtggatggcctctgtcgagcctcactggatagccgcctccatcatcctagaattcttccttatggtactgttaatacccgagccggaccgccagcggaccccgcaggacaaccagttagcctacgtggtgatcggcctgctcttcatgattctcaccgtcgccgcaaatgagatgggcctgctggagactacgaaaaaggatctgggaatcggccacgcggccgtggagaaccatcaccatgccgctatgttagatgttgacttacacccggcttcagcgtggaccctctatgccgtcgccactaccatcatcacccctatgatgcgccacactatcgaaaacactaccgccaacatctctctgaccgcgatcgcgaaccaagcggccatcctgatggggcttgacaagggatggcccatcagcaagatggacatcggcgtacccctgctggccctcggttgctacagccaggtgaacccccttaccttgacggcggctgtcctcatgctggtcgcccactatgccattatcgggccaggactgcaggccaaagcgactagagaggcccagaagcgcacagccgccgggataatgaagaacccgaccgtggatgggatcgtcgctatcgatctcgatcccgtggtatacgacgcgaagttcgaaaagcagctaggccagatcatgctgctcatcctctgcacgagccagatactgctaatgcgcacaacctgggccctgtgcgagagcatcacactggccacaggaccgctaacaaccttatgggagggttcccccggcaaattctggaacaccacgatcgccgtaagcatggctaacatattccgtgggtcctacctggccggagccggtttggccttctcattaatgaaatccctcgggggcgggcgccgggggacgggtgctcagggagagaccttgggcgagaagtggaagcgccagctgaaccaattatccaagagcgaatttaatacctacaagcggtccggaataatggaggtggatcggtcggaggcgaaagaagggctcaagcgcggcgagacaaccaagcacgcggtgtctcggggcacagccaagctgcgatggttcgtagagcgcaacctggtaaagcccgaggggaaagtcattgacctcggctgcggtcgcggcgggtggagctactattgcgcagggctgaagaaagtcacggaggtgaaagggtacaccaaaggcgggcccggccacgaagagcccatcccaatggccacgtacgggtggaacctggtgaaattacattcaggcaaggacgtctttttcatcccgcccgaaaagtgcgataccctcctgtgcgacataggggagagctcccccaacccaactattgaggagggccgcactctgcgggtgctcaagatggtggagccatggctgcgggggaaccagttctgtataaagatcctgaacccctacatgcctagcgtagtagagaccttggagcagatgcagcggaaacacggtggcatgctcgtacggaaccccctatcccggaatagcacacatgagatgtactgggtctcctgcggcacaggcaacattgtgagcgctgtgaatatgacctctaggatgctcctaaacaggttcacgatggcccaccgtaagccaacctacgagcgcgacgtcgacctgggggcgggcacacggcatgtcgccgtggaacccgaggtcgccaacctggacattatcggccagcggatcgagaacatcaagcatgagcacaagagcacctggcactatgacgaggacaacccttacaaaacctgggcctatcacggttcctacgaggtaaagccctctggcagcgcctccagcatggtaaacggggtggtcaaactgctgacaaagccgtgggacgttatccccatggtaacccagatagccatgacagatacaactccctttggtcagcagcgggttttcaaggagaaggtcgacacccgcacccccaaggctaaacgcggaacggcccagattatggaggtgaccgcgaaatggctttggggcttcctgtcccgcaacaagaagccgcgaatctgtacccgcgaagagttcacccggaaggtgcgaagcaatgcagccataggcgccgtcttcgtggacgagaatcagtggaactccgcgaaagaagctgtggaggacgagcggttctgggacctggtgcaccgcgagcgtgagctgcacaagcaagggaaatgtgccacgtgcgtttataacatgatgggtaaacgtgaaaaaaagctgggggagttcggtaaggcaaagggtagccgagccatctggtacatgtggttgggggctaggttcttggagttcgaagccctgggcttcatgaacgaggaccactggttctctcgggaaaatagcctctccggcgtagagggcgaggggctccacaagctgggttacatcctgcgcgacatcagcaagatacccggcggcaacatgtatgccgacgacactgcgggctgggacaccaggatcaccgaggacgacctccagaacgaagccaagattacggatatcatggagcccgagcatgcactcctggcgaagtcaatatttaagctcacatatcagaacaaagtcgtccgtgttcagcggccggccaagaacggcaccgtcatggacgtgatcagccgccgcgaccaacggggctctggccaggtcgggacctatggtctaaacacctttacaaatatggaagctcaactgattcggcaaatggagagcgaggggatcttctccccctcggagctggagaccccaaacctggccggccgggtactcgactggctggaaaagcacggggtggagcggctaaaacggatggcgataagtggcgacgactgtgtggtcaagcccatcgacgaccgcttcgcaaccgccctgacggccctcaacgacatggggaaggtgcgtaaggacatcccgcaatgggagcccagcaagggatggaacgactggcagcaggtccccttctgctctcatcacttccaccagttaatcatgaaagatggccgggaaatcgtcgttccctgccgtaaccaggatgagctagtggggcgggcccgcgtgtcccagggcgcgggctggagcttgagagagacagcttgcctggggaagagctacgcccaaatgtggcagctgatgtacttccatcggcgcgacctacgcctggctgcgaatgctatctgcagcgccgtcccggtggactgggtaccgacctctcgcaccacgtggtcgatacatgcacaccaccagtggatgaccactgaggacatgctctcagtatggaatcgcgtgtggattgaggagaacccctggatggaggataaaacccacatctcctcctggggcgatgtcccctacctcggaaagcgcgaggatcaatggtgtggcagcttgatcggactaaccgcccgagcgacctgggctacgaacatacaagtggccatcaaccaggtacgaaggctcatagggaacgagaattatctggactacatgaccagcatgaaacggttcaagaacgagagcgacccggagggggccttatggtga

SEQ ID NO: 24470 - RNA, 9879 nt, synthetic construct
  misc_feature 1..9879: note = derived and/or modified CDS sequence (opt11) from DENV-1__GU131759__SS-prME
  source 1..9879: mol_type = other RNA
agcgtgacgatgctgctgatgttaatgcctacggccttagccttccacctcacgactcggggtggggagccgcacatgatcgtgagcaagcaggagaggggtaagtcgctactcttcaagacaagcgctggggtaaacatgtgtaccctcatcgccatggacctgggcgagttctgcgaggacaccatgacgtacaagtgtccccgcatcaccgaggccgagcccgacgacgtcgattgctggtgcaatgccacagacacttgggtgacctacgggacctgttcgcagacaggcgagcaccggcgggacaaacgctcggtagccctggcgccccacgtgggtctcggactcgagacgcgtaccgaaacctggatgagctcggagggcgcgtggaaacagatccagcgagtagaaacctgggctctccggcacccaggtttcacggtgatcgctctcttcctggcacacgctatcggcacctctatcacccagaagggtatcatcttcattctgcttatgctggtgaccccctccatggcaatgcggtgtgtaggcatcgggagcagggattttgtggaggggttgtccggggccacgtgggtggacgtcgtactagagcacggatcatgcgtgaccaccatggccaaggacaagccaaccctggacatcgagcttctcaagacggaagtcacaaaccccgcggtattacggaagctgtgcatcgaggccaagatctccaacaccaccacggacagccgctgcccgacgcaaggtgaggccaccctcgtggaggaacaggacgccaacttcgtttgccggaggaccttcgtggaccggggctggggaaacggctgcggtctgttcggcaagggttcactaatcacgtgcgctaagtttaagtgcgtgactaagctcgagggcaaaacagtccagtacgaaaatctgaagtacagcgtgatagtgaccgtccacacaggcgaccaacaccaggtcgggaacgagtccactgagcacggcacgaccgccaccataacgccccaggcccccagcaccgagatccagctgaccgactacggggcactcaccctggactgctcaccccggaccggcctggacttcaacgagatggtcctgctgacaatgaaggagaagtcctggctggtgcataagcagtggttcctcgacctgccgcttccctggaccagcggggcctcgacctcacaagaaacgtggaaccgtaaagacctcttggtgaccttcaagaccgcacacgcgaagaaacaggaggtcgtggtgttagggtcccaggaaggcgccatgcacaccgccctcacgggggccacagagatacagacgtcgggcacaacgaccatcttcgcaggacatctgaagtgccgcctgaagatggacaaactcaccttaaagggcatgtcctacgttatgtgcacgggcagcttcaagctagagaaagaggtggcggagacacagcatggaacggtgctcgtccagatcaagtacgagggaactgatgcgccctgcaagatccccttttctacacaggacgagaagggcgtgacgcagaacggccggcttattacggccaaccctatcgttaccgacaaggagaagcccgtcaacatcgaagccgagccacctttcggggagagctacatcgtcataggcgccggtgaaaaggcgctgaagttaagctggtttaagaaggggagctccatcggcaagatgttcgaagccaccgccagaggggctcgtcgtatggccatcctcggtgatactgcctgggacttcgggagcatcggcggcgtgttcacctccgttgggaaactcgttcaccagatcttcggaaccgcatacggggtgttgttctccggagtctcctggaccatgaagattggcattggagttctcttgacgtggctggggttgaacagccgctccaccagcctctccatgacttgcatcgcggtagggctggtcaccctctacctgggggtgatggtgcaggccgacagcgggtgtgtcattaactggaagggccgggagctgaagtgcggtagcggcatattcgtgacgaacgaggtgcacacctggacggagcagtacaagtttcaggcggacagcccgaagcgcctcagcgccgccataggcaaggcctgggaggagggcgtctgcggcattcggtccgccacccgcctcgagaacatcatgtggaagcagatcagcaacgaactgaaccacattttactggagaacgacatgaagttcaccgtggtggtcggggatgtagcgggcatactggcccaggggaagaagatgatccgaccccagcccatggaatacaagtactcctggaagtcctggggcaaggccaagatcatcggcgccgacgtgcagaacaccaccttcatcatcgatgggcccaacactccggagtgtcccgacgaccagcgcgcgtggaacatctgggaggtcgaggactacggcttcggcatctttaccacgaacatctggctcaagttgcgggactcctacacccaggtgtgcgaccaccgcctcatgagcgccgccattaaagactccaaggcggttcacgcggacatgggatactggatcgagtctgagaagaatgaaacctggaagctcgctcgggcctccttcatcgaggtcaagacctgcatctggcccaaatcgcataccctgtggagcaacggcgtgctggagagcgaaatgatcatccccaagatctacgggggtccgatctcccaacataattaccgccccgggtacttcacccagacagccggtccctggcacctcggcaagctagagctggacttcgacttatgcgagggcactacagtggtagtggacgaacactgcggcaatcgggggccctccctgcgcaccaccacggtgacgggcaagatcattcacgagtggtgctgtcggtcctgcaccctgccgccccttcgctttaagggggaggatggttgctggtacgggatggaaatacggccagtcaaggagaaggaggaaaatctggttaagagcatggtgagcgcgggctcgggcgaagttgatagcttctccctggggctactgtgcatcagcataatgatcgaggaggtcatgcgctcccggtggagcaggaagatgctgatgaccggcaccctcgccgtgttcttcctgctgatcatggggcagcttacgtggaacgacctgatccggctgtgcatcatggttggtgcgaacgcctccgatcgcatgggcatgggcactacctacctcgccctaatggccaccttcaagatgcgcccgatgttcgccgtgggcctcctgttccgtcgcctgacgagccgggaggtactgctcctgaccatcgggctgagcttggtcgcaagcgtagagctgcccaacagcctggaggagctgggcgatggactggccatgggcatcatgatcctgaagctgttaacagacttccagagccatcagctgtgggccaccctcctgtccttcacgttcatcaagaccaccttcagcctgcactacgcgtggaagaccatggcaatggtcctctccatcgtgtcacttttcccgttgtgcttatccacaacctctcagaagaccacctggcttcctgtgctgctcggcagcctggggtgcaagccactgacaatgttcctcatcgccgaaaacaaggtgtggggcagaaagagctggcccctgaacgaggggatcatggccgtgggcatcgtctctatcctgctctcaagcctgctgaagaacgatgtccccctcgccgggcccctaattgctggaggcatgctgatcgcgtgctacgtgatctctgggagctccgccgatctctctctggagaaggctgccgaggtgtcatgggaagaggaggccgagcacagcggggcgtcccacaacatcctggtagaggtacaggacgatgggaccatgaagattaaggatgaagaaagagacgatactctcaccatcttgctgaaggccaccctcttagccgtgtctggcgtctatcctctttccatcccggccaccctcttcgtgtggtacttttggcagaagaagaagcagcgcagtggtgtcctgtgggatacccccagcccgccggaggtcgagcgcgccgtgttagacgacggtatttaccgcatcatgcagcgggggctgctggggcgcagccaggtgggcgtcggtgtatttcaggagaatgtcttccataccatgtggcacgtcacacgtggcgcggtcttaatgtaccaggggaagcgcttggaaccctcctgggcgagcgtgaagaaggacctcatctcatacggcggaggatggcggctgcaggggagctggaacaccggcgaagaagttcaagtgatagccgtggaacctggcaagaaccccaagaacgtccagaccgcccccgggacgttcaaaacttccgagggcgaggtgggcgctatcgcactggactttaaacccggcacgagcggatcgcccatcgtgaaccgcgaggggaagatcgtgggtctctacggcaacggagtggtgaccacctctggtacttacgttagcgcgatcgcccaggccaaggcgtcccaggaggggcccctgccggaaatcgaggacgaagttttccggaagagaaacctgacgatcatggatctccacccagggagcggaaaaacccggcggtacctgccagccatcgttcgggaggcaatcaagcgtaagctgcggactttaatcttggcccccaccagggtggtggcctccgagatggcggaagcccttaagggaatgcccatccgctaccagacgactgccgtgaagtccgagcacaccggcaaggagatagtcgatctaatgtgtcacgccaccttcacgatgcggctgctttcccccgtgcgtgtacctaattacaacatgatcattatggacgaggcacatttcaccgatccgagctccatcgcggctcgggggtacatctctacccgcgtaggaatgggagaggcggccgccatcttcatgaccgcgaccccgcccgggtcagtggaagcctttccgcagagcaacgccgtgatccaagatgaggagcgggacatccccgagcgctcctggaatagcgggtacgagtggatcaccgacttccccggcaagaccgtctggtttgtgccgtccatcaaaagcggcaacgacatcgccaactgcctccggaagaacggcaagcgcgtgatccagctgtcccggaagacgttcgacacggagtaccagaagacgaagaacaacgactgggactacgtcgtgacgacggatatatcggagatgggcgctaatttcagagccgaccgggtgatcgacccccgacggtgcctgaagccggtcatcttaaaggacgggcccgagcgagtcatcctagccggccccatgcccgtcacagtggcctccgcagcgcaacgtcgcgggcggatcgggcgcaaccataacaaggagggggatcagtacatctacatgggtcagccactaaataacgatgaggaccacgcccattggaccgaggccaagatgctgctggacaacatcaacacccccgagggcatcatccccgccctgttcgagcccgagcgggagaagtcggccgccatcgacggggagtaccgcctccgcggcgaggctcggaagaccttcgtggagctcatgcggcgcggtgacctgccggtctggctcagccacaaggtggcttccgagggcttccagtactctgaccgccgctggtgcttcgatggcgagcgcaataaccaggtgctggaggagaacatggacgttgagatctggacgaaggagggggagcggaaaaagctgcgcccccggtggctcgacgcccgcacctactcggaccctctggccctgcgagagttcaaagagttcgcagccggccgccgttctgtgtccggggacctcatactggagataggcaagctgccccagcacttaacccaacgcgcgcaaaacgccctggacaacttggtgatgcttcacaacagcgaacagggcgggcgcgcctatcgccacgcaatggaggaactgccggacaccatcgaaacgctgatgcttctggcgctgattgccgtcctcaccggcggggtgacgctgttctttctgtccgggcgggggctcggtaagaccagcatcggcttactgtgcgtgatggcctcaagcgtcctcttatggatggcttccgtggagcctcactggatcgcagccagcatcatcctggagttcttcctgatggtgctgctgatccccgagcccgaccgccagcggaccccgcaggacaatcaactcgcctatgtcgtcatcgggctgctgttcatgatcctcacggtggccgcaaacgagatgggcctgttggagaccaccaaaaaggatctcgggataggccacgccgccgtcgagaaccaccaccatgccgcaatgttagacgtggacctgcaccccgcgtccgcctggaccctctacgccgtggccacgaccatcatcaccccgatgatgcgccacaccatcgagaacactaccgccaacatcagcctgacagcgatcgccaatcaagccgccatcctcatggggctcgataagggctggccgatctccaagatggacatcggcgtccccctgttagctcttggatgttacagccaggtgaaccccctgacactgacggccgccgttctcatgctcgtcgcccactatgccatcatcggccccgggctacaagcgaaggccacccgggaagcccagaagcgcaccgccgcgggcatcatgaagaacccgacggtcgacggtattgtcgcgatcgacttggaccccgtggtgtacgacgcgaaattcgagaagcagctgggccaaattatgctgctcatcctgtgcacgtcccagatcctgttaatgcgcaccacctgggccctgtgcgagagcatcacattagccacaggccccctcacgactctttgggagggttcccccggaaagttctggaacaccaccatcgctgttagcatggctaacatctttcggggctcatacttagccggagccggcctcgccttttcccttatgaaatccctcggaggcgggcgacgggggaccggcgcgcagggcgagaccctcggggagaagtggaagcgccagctaaaccagctgagcaagtcggagttcaacacctacaaacggtcagggatcatggaggtcgaccgcagcgaggccaaggagggtctcaagcgcggtgagacgaccaagcacgctgtgtcccgcggcaccgccaaactgcgttggttcgtagagcgaaacctggttaagccggaaggaaaggtgatcgacctcggctgtggccgcgggggatggtcctactactgcgccggactgaagaaggtgaccgaagtcaaaggttacaccaagggcgggcccggccacgaggagcccattcccatggcgacttacgggtggaacctggtgaagttacatagcggcaaggacgttttcttcatcccgcccgagaagtgtgacaccttgctgtgcgatatcggggagtcctcccccaaccctacgatcgaggagggacgcacactgcgggtactcaagatggtggagccctggcttcgcgggaaccagttctgcataaagatcctaaacccctacatgccctctgttgtcgagaccctcgagcagatgcagcggaagcacggtggcatgcttgtgaggaaccccctctctagaaattctacccacgaaatgtattgggtttcctgcgggactggcaacatcgttagcgcagtgaacatgacctcccgcatgctcctaaaccggttcacaatggcccaccgcaagccgacctacgagagagacgtggacttgggggccggcaccaggcacgtcgccgtggagccggaggtggcgaacctcgacataatcggccagcgcatcgagaacatcaagcacgagcacaagagtacgtggcattacgacgaagacaacccctacaagacatgggcctaccacgggagttacgaggtgaagccttcaggcagcgcctccagcatggtgaacggcgtcgtgaaactgttaaccaagccctgggacgtgatcccaatggtgacccagatcgccatgaccgacacgacccccttcggccaacagcgggtgttcaaggaaaaggtagacacccgcacccccaaagccaagcgggggacggcgcagatcatggaggtcaccgcgaagtggctctggggcttcctttcccgcaacaagaaaccgcggatctgcacccgcgaggagtttacccggaaggtgagatccaacgccgcgataggcgccgtgttcgtagacgaaaaccagtggaactcggccaaagaggccgtcgaagacgagcggttctgggacctggtgcaccgtgagcgtgagctccacaagcagggcaagtgcgccacgtgtgtctataacatgatgggcaagcgcgagaagaagctgggggagttcggcaaggccaaggggagccgggcgatatggtacatgtggttgggcgcccgcttcctggagtttgaggccctggggttcatgaatgaggaccactggttttctcgggagaacagcttgtccggtgtggagggcgagggattgcacaagttaggctacatcctgagggatatcagcaaaatcccaggagggaacatgtacgcggacgacaccgccggctgggacacccggataaccgaggacgatctgcagaacgaggcgaagatcacggatattatggagccggagcacgcacttctggccaagtccatctttaagctcacctaccagaacaaggtggtccgcgtccaacggccggcaaagaacgggaccgttatggacgttatcagcaggcgcgaccagcggggcagcggacaggtgggcacctacggcctgaacacgttcacgaacatggaggcccagctgatccgccagatggaatcagaggggatcttctccccttccgagctcgagaccccgaacctggcgggtcgggtgctggactggctcgagaagcacggcgtcgagcgcctaaagcggatggcgatctccggcgacgactgcgtggtcaagcccatcgatgatcgcttcgccaccgccctgacggcgctgaacgacatggggaaagtccgcaaggacatcccgcagtgggagcccagcaagggatggaacgactggcagcaagttcccttctgcagccaccacttccaccaactgataatgaaggacggtcgggagatcgtggtgccgtgccggaaccaggatgaactggtggggcgcgcgcgagtgtcacagggcgccgggtggtcgttgcgcgagaccgcctgccttgggaagtcctacgctcagatgtggcagctgatgtatttccaccgtcgcgacctccgtctggcggccaacgcgatctgcagcgcggtcccggtggactgggtgccaacctcccgcacgacgtggagcatccacgcccaccatcaatggatgaccaccgaggacatgctgtccgtctggaaccgagtttggatcgaagagaatccctggatggaggacaagacccacatcagctcatggggcgacgtgccgtacctcggaaaacgcgaagaccagtggtgcggcagcctgatcgggctgacggcgcgggccacatgggctaccaacatccaggtcgccataaaccaggtgcgccgcctaattggcaacgagaactaccttgactatatgacatccatgaagcggtttaagaacgagtcggacccggagggggccctgtggtga

SEQ ID NO: 24471 - RNA, 9879 nt, synthetic construct
  misc_feature 1..9879: note = derived and/or modified CDS sequence (opt11) from DENV-1__GU131761__SS-prME
  source 1..9879: mol_type = other RNA
agcgtgacgatgcttctaatgctaatgccgaccgcgctagcgttccacctaacaactagaggaggggaaccccacatgatcgtaagcaaacaagaacgggggaaaagtctcctgttcaaaacgtccgcaggggtaaacatgtgcactctcatagcaatggacctaggggaactgtgcgaagacaccatgacgtacaaatgtccgaggataaccgaaacagaacccgacgacgtcgactgctggtgtaatgccacagacacctgggtaacatacggaacatgctcacaaaccggggaacatcgaagagataaaaggagcgtagcccttgcaccacacgtcggactgggcctcgaaacacgaactgaaacatggatgtcgagcgaaggcgcttggaaacaaatccagcgagtagaaacctgggcgttacggcacccaggtttcactgtcatagccctcttcctagcccatgcgattggcacgtccattacccagaaaggcatcatcttcatcctactaatgctagtcacaccatccatggccatgcgatgcgtcggcatcggatcacgcgacttcgtcgaaggcctgtccggagcaacatgggttgatgtagtactcgagcacggtagctgtgtcacgacgatggctaaagacaaaccaacattagacatagagctactgaaaaccgaggttacgaaccccgcggtgctacggaagctctgtatcgaagcgaagatatccaacacaacgacggacagtaggtgcccaacacaaggagaagccaccctagtggaagaacaagacgccaactttgtatgccgtcggacatttgtggatcgtggatggggaaacgggtgcggactattcggtaagggcagcctgataacatgtgcaaaattcaaatgcgtaacaaagctcgagggcaagattgtgcaatacgaaaacctgaagtactcagtcatagtaaccgtccacaccggcgatcaacaccaggtgggcaatgagtccacagagcacggaacaacagcgaccatcacaccccaagcgccgacaacagaaatacaactcacggactacggagctctgaccctagactgtagtccacgtaccggactcgacttcaatgagatggtactactcacaatgaaggagaagagttggctcgtacacaaacaatggtttttggatctcccactgccgtggacaagtggggccagtacctcccaagaaacctggaaccgacaagacctactcgtcacttttaagacggcacacgcaaagaaacaagaagtcgtggtgctcggttcccaagaaggcgcgatgcacaccgcccttaccggagctacagaaattcagacgtcaggcacaactacgatcttcgccggacacctcaagtgccgcctaaaaatggacaaactgacactgaagggcatgtcatatgtcatgtgcacgggatccttcaaactcgaaaaagaactggccgagacccagcacgggacagtcctagtgcaaataaaatatgagggaacagacgcgccttgcaaaattccctttagcacacaagatgaaaaaggcgtaacacaaaatggtcgactgatcactgcaaaccccatagtcacggacaaggagaaaccagtcaatatagaagccgagccacccttcggcgaaagctatatagtgataggtgcaggcgaaaaagctctcaagctctcatggttcaagaaaggcagtagcatcggcaaaatgtttgaagcaacagcgcgtggcgcgcgacggatggcaatcctcggggataccgcctgggacttcgggagcatagggggagtcttcacctccgttggcaagttagttcaccaaatattcgggacggcgtacggcgtactattctcgggcgtgtcctggaccatgaaaataggtataggggtattgctaacctggctagggcttaattctcggagcacaagcctaagtatgacttgcatagcagtagggcttgtgacgctatacttgggtgtgatggtacaagcagacagcggatgcgtaataaactggaaagggagagaattgaaatgtggttcaggcatatttgtgacaaacgaagtacacacctggaccgaacaatacaagtttcaagcggattcgcccaaaagactcagcgcagctattggaaaagcatgggaagaaggcgtatgcggaataagaagtgcgacccgactagaaaatatcatgtggaaacagataagcaacgagttaaaccacatcctactggaaaacgacatgaaattcactgttgtagtgggcgacgtagccggaatcctggcacaagggaagaaaatgatccgccctcaaccgatggaatacaaatactcgtggaaaagttgggggaaagccaaaataataggcgcagacgtacaaaacaccacattcatcatcgacggtcctaataccccagagtgcccggacgaccagagagcatggaacatttgggaagtagaagattacggattcggaatcttcacaacgaacatatggctcaaactaagagacagctacacacaggtctgcgatcatcgactgatgagcgccgcaatcaaagattccaaagccgtacacgcagatatggggtattggatcgaaagcgaaaagaacgaaacctggaaactcgcgcgggcgagcttcattgaagtgaagacgtgcatctggcccaaaagccacaccctttggtctaacggcgtactcgaatccgagatgataatcccgaagatatacggaggcccaatctcacaacacaattatagacctggatacttcacacaaacggcagggccatggcacctaggtaaactagaactagacttcgacctctgcgaaggcaccactgtagtcgtggacgagcattgcgggaatcgtggtccttcactacggaccacaacagtgaccggaaaaataatccatgaatggtgttgccgatcatgcactctgcccccacttagatttcgcggagaggacggatgctggtacggcatggaaatacgtccggtcaaagagaaagaggaaaatttagtaaagagtatggtatcggcgggatccggcgaagtggacagcttctcactgggactgctctgcatctcgataatgatagaggaggtaatgcggagccgctggagcagaaagatgctcatgacgggcacgctggcagtctttttcctattaataatggggcagttgacgtggaacgacctgattagactgtgcattatggtcggggcgaacgcaagcgaccgaatggggatgggaacgacgtacctggcgctgatggcaacattcaagatgcggcctatgtttgcggttggacttctctttcgcaggctaactagccgcgaagtcttgcttctcaccataggcctaagtctagtggcaagcgtagaactaccaaattctctggaagaactcggagacggactcgcaatgggaataatgattttaaaactactgactgatttccagtcacaccaattatgggctaccttactctcactcaccttcataaaaaccacgttcagccttcactatgcttggaagactatggctatgatacttagcatagtctcactcttcccactctgcctgagcacgacgagccagaaaacaacgtggctccctgtgctcctgggtagcctcggttgcaaacccctcacgatgtttctcatcgcagagaataaaatatgggggcgaagatcctggccactaaacgaaggcataatggcagtaggcatcgttagtatcttgctgagttccctcctcaaaaatgacgtgcccctagccggccccttgatcgcgggtgggatgttaatagcgtgttacgtaatatcaggcagctcagcagacctctcactcgagaaagcggcagaagtctcgtgggaggaagaggccgaacacagcggtgccagccacaacatcctagtagaggtgcaagacgacgggacgatgaagatacaagacgaagaaagagacgacacactaaccatcctactaaaagccacactcctggccgttagcggagtatacccattgagtatcccagcgaccctcttcgtctggtacttttggcagaagaagaaacaacgaagcggggtactttgggacactcccagcccgccagaagtcgaaagggctgtactagacgacgggatctaccgcataatgcaacgtggactgctcggcaggagccaagtcggggtaggagtctttcaagaaaacgtcttccacacaatgtggcatgtgacgcgaggagcggtcctcatgtatcagggcaaacgactggagccctcatgggcgtccgtgaaaaaggacctcatctcatacggcggaggttggcgactacaaggaagttggaacaccggggaggaagttcaagtaattgcagtagagccagggaaaaatcccaagaacgtgcagaccgccccgggaacttttaagaccccggaaggcgaagtgggcgctatagcacttgacttcaaaccaggtacgtcggggtcccccatcgttaatagggaaggaaagatagttggactctatgggaacggggtagttacaacctcgggaacgtatgtgagcgcaatagcacaggcaaaagcaagccaggaaggaccgctgccggaaatcgaagacgaggtattcaggaagcgaaacctgacgatcatggacctacacccaggaagcggaaaaacccgacgttatctgcccgctatcgtgagagaggccatcaaacggaagctccggacactaatcctggcgccgacacgggttgtagcgtccgaaatggcagaggcccttaagggcatgccgatacgctaccaaaccaccgcagtaaaatcggaacacacgggtaaagaaatcgtagatcttatgtgccacgccacattcaccatgagactgttgagcccagtccgtgtaccaaactacaatatgataattatggatgaagcccacttcaccgatccgtcaagcatagcagcgaggggctacatctcgacgcgggttggtatgggagaagctgcggccatcttcatgacagcaacacccccgggcagcgtcgaagcattcccacaaagtaatgctgtaatccaagacgaagagagggacattccggagagaagctggaactcaggttacgaatggattacagatttccccggtaagaccgtgtggttcgttcccagtataaagtcggggaacgacatcgcaaactgcctcagaaagaatggaaaaagagtgatacagcttagccgaaaaacatttgacacggaataccagaaaacaaagaacaacgattgggattacgtcgtgaccacggacatcagcgaaatgggcgccaacttcagagcggaccgggtcatcgacccgcgacgatgcctaaaacccgtcattcttaaagacgggcctgagagagtaatattggcgggacccatgcctgtaacagttgctagcgcagcacagcgacgcggtcgcatcggtcggaaccataacaaagaaggagaccaatacatatacatgggacagcccctaaacaacgatgaagaccacgcacactggacggaagcaaaaatgttgttagacaacatcaatacgccagaaggcataatacctgcgcttttcgaaccagagcgcgagaagtccgccgcaatagatggagaatacaggctccggggagaagcgcggaaaacctttgttgaattgatgagacggggagacctgcctgtgtggttaagttacaaggtagcttccgaaggattccagtacagcgataggcggtggtgctttgacggcgagagaaacaaccaggtcctcgaggaaaacatggatgtggaaatatggacaaaagaaggggaacggaaaaagctcagacctcggtggctcgacgcgcgcacgtacagcgacccactcgccctgcgcgagtttaaagaatttgcggccgggaggaggagcgtatccggcgacctgatcttagaaatcggcaaattaccacaacacttaacgcaacgagctcagaacgctctggacaacctcgtaatgctccacaatagcgaacagggagggagagcatatcgacacgcaatggaagaattgcccgacacgattgaaacactaatgcttctagcgctcatagcagtactgactgggggcgtaacacttttctttctgtcgggccgaggcttaggaaagaccagtatcggactactatgcgtgatggcaagttcggtgctcctatggatggcatccgtagaaccacactggatcgccgcgtcaataatcctggagttcttcttgatggtgttattgatccccgaaccagaccgacagcggaccccacaagacaatcaactggcatacgtcgtgattggcctcctgttcatgatactaacagttgcagcgaacgagatggggctattagagacaaccaagaaagacctcgggatcggtcacgtcgcagtagaaaaccaccatcacgcagcaatgctggatgtcgacctacacccggcatcagcctggacactatacgctgtagcaacaaccataattacccccatgatgcgacacaccatagagaatacaacggcgaacatatccctaacagcgatcgcaaaccaagcagcgatattaatggggctcgacaagggctggccgataagcaaaatggacatcggcgtacctctgctagcattggggtgttacagtcaggtaaacccactaacactaacggcagcggtactcatgctcgtagcccactatgccattattgggccaggccttcaagcaaaggcgacacgggaagcccagaaacgaacagcggccggcataatgaagaacccaacagtagacggaatagtagcaatcgacctcgacccagtggtgtacgacgcaaaattcgaaaaacagcttgggcaaatcatgctcctgatactgtgcacaagccaaatactactgatgcgaaccacctgggcactatgcgagagcatcacccttgcaacaggcccgctcacgacactttgggagggaagcccagggaaattctggaacacgacgatcgcagtgagtatggcgaatatcttcagagggtcatatctagcaggcgcgggcctagccttcagtctcatgaaaagcctcggcggcggcagacggggaacaggggcacagggggaaactctgggcgagaaatggaaaagacaattaaaccagctctccaaatcggaatttaacacctataagcgcagcggcataatggaagtagacaggagcgaagcaaaagaggggctgaaacgaggtgagactactaaacatgcagtatccaggggcacagcgaagctacgctggttcgtcgagaggaatttagtgaaaccggagggtaaagtcattgaccttggatgcggccgcggaggatggtcttactactgtgcgggcctcaagaaagtaacagaggtcaaaggttatacaaaaggcgggcctggccacgaagaacccattccgatggctacgtatggatggaacctggtgaaactacacagtggaaaggacgtcttctttataccacccgagaaatgcgataccctgttgtgcgacatcggggaatcgagccccaaccccacaattgaggagggccgaacactccgggtcctcaagatggtagaaccgtggctgcgcgggaaccaattttgtataaaaatcctgaatccctacatgccgtctgtcgtggaaacactagaacagatgcaaaggaagcacgggggaatgctcgtccgaaatccactgtctagaaactcgacgcacgagatgtactgggtcagctgcggtacaggaaacatcgtgtcagcagtgaacatgacgagccgaatgctcctaaatcgcttcaccatggcccatcgcaagccaacgtacgagagagacgtcgacttaggcgctggaacgaggcacgtcgctgtagaacccgaagtagccaacctagacatcataggacagagaattgagaacatcaagcacgaacacaaaagcacatggcattacgatgaagacaacccctacaaaacgtgggcctaccacggcagctacgaggtaaaaccttcgggatcggcctcgtctatggtgaacggggtcgtaaaactcctaacaaaaccatgggacgtgatccccatggtaacacagattgcaatgaccgacacgacgccattcggacagcagagagtgttcaaagaaaaagtggacactcgaacccccaaagcaaaacggggaacggcccaaataatggaagtgacagctaagtggctctggggattcctatctcgtaataagaaaccgcgaatatgtacacgggaagagttcactaggaaagtccggagcaatgccgccataggagcggtcttcgtagacgagaaccaatggaactcggccaaagaagccgttgaagatgaacgattctgggacctagtccatcgagaacgcgagctacataaacagggaaagtgtgcaacatgcgtctacaacatgatgggtaagcgcgaaaagaaactgggtgagttcggcaaagcaaaaggcagcagagccatatggtacatgtggctaggcgctcgattcttggagttcgaagcactgggcttcatgaacgaggaccattggttctcaagggagaacagcctctccggcgtggaaggcgagggcttgcacaagttggggtacattctccgagacataagtaagataccagggggtaacatgtacgcagacgatacagcgggctgggatacacgaataacagaagacgatctgcaaaacgaagcacgaataacagacatcatggaacccgaacacgcgctcttggcaaagtccatcttcaaactcacgtaccaaaataaagtcgttagagtgcaacgcccggcgaaaaacggtacagtcatggatgtcataagccgacgtgaccaaagaggctcagggcaggtcgggacgtatggtctcaacaccttcacgaatatggaagcgcaactaatacgccaaatggagtctgaaggcatcttctcccctagcgaactagaaacgcctaacctcgcagaaagggtattagactggttggagaaatacggcgtcgaacgattgaagcgaatggcaatctcaggggacgactgcgttgtgaaaccaatcgacgacagatttgccactgccctaacagcgctaaacgacatgggcaaggtgcgtaaagatattccgcaatgggaaccctccaaagggtggaacgattggcaacaggttccattttgcagccaccacttccaccaattaataatgaaggatggtagggagatagttgtgccgtgcagaaaccaagacgaacttgtcgggcgagcgcgcgtcagccagggggcagggtggagcctaagggagacagcttgcctcggaaagagttacgcccagatgtggcaattgatgtactttcaccgaagagacctcagactggcagcaaacgccatttgtagcgcggtaccggtagactggataccgacatctcgcacaacgtggtctatacacgctcaccaccagtggatgaccacagaagacatgctatcagtatggaaccgcgtctggatagaagaaaacccatggatggaggataaaacccacatcagcagctggggagacgtcccatacctcggaaagcgcgaagaccagtggtgtggatcactaataggactcaccgcccgagcaacgtgggcaaccaacatccaagtcgccattaatcaagtacggcgattgatcgggaatgagaactacctggactatatgacatcaatgaagcgattcaaaaacgagtcagatccagagggggcactgtggtag

SEQ ID NO: 24472 - RNA, 9879 nt, synthetic construct
  misc_feature 1..9879: note = derived and/or modified CDS sequence (opt11) from DENV-1__GU131762__SS-prME
  source 1..9879: mol_type = other RNA
tcagtgaccatgctgttaatgctcatgcctactgccctggccttccatctcactaccagaggcggggagcctcatatgatcgtatcgaagcaagagcggggcaagtctctgctattcaagacatcagccggagttaacatgtgtacgctgattgcaatggacctgggcgagttctgtgaggacacgatgacctacaaatgcccgcgcatcaccgaggccgagcccgatgatgtggactgctggtgcaacgccactgacacctgggtgacgtatgggacatgcagccagaccggagagcaccggcgggacaagcggagcgtggccctagcgccgcacgtgggactcggactagaaacgcgcacggagacgtggatgtctagcgagggcgcctggaagcagattcaacgagtggaaacatgggccctgcgccacccggggttcaccgtgatcgccctcttcctggctcacgctatcggcacatctataacccagaagggaatcatctttatcctgctcatgcttgtgactccctccatggccatgcgctgtgtgggtatcggctcacgagacttcgtggagggtctttccggcgccacgtgggtggacgttgtgctagagcacgggagctgtgtgaccaccatggccaaggacaaacccaccttggacatcgaactgctcaagaccgaagttacaaaccccgcggtgctgagaaagctgtgcatcgaggccaaaatctcaaacaccaccacggacagccgctgtccgacccagggcgaagctaccctcgtggaggagcaggacgccaacttcgtgtgccggagaaccttcgtggacaggggctgggggaacggctgtgggctgttcggcaaaggctccctgatcacgtgcgcgaagttcaagtgcgtaaccaagctcgagggcaagatagtccaatacgaaaacctgaaatactcagtgatcgtaaccgtacacaccggtgatcagcatcaggtgggcaatgagagtaccgagcacggcacgacagcgactataacgccgcaagcgcccagtacggagatccagcttacagactacggagcactcaccctggactgtagccccaggaccgggctggacttcaatgaaatggtgctgttaacgatgaaggagaagtcttggctggtccacaagcaatggttcttggatctgcccttgccctggacctccggggcgtccacaagccaggaaacctggaatcggcaggacctcctggtgacattcaaaactgcccacgcaaaaaagcaagaggtagtggtgttaggcagtcaggagggcgcgatgcacacggccttaaccggggccactgagattcagacgtccgggacaaccacgatcttcgccgggcaccttaagtgccggctgaagatggataagctaactctgaagggcatgtcctacgtgatgtgcaccgggagcttcaagctggaaaaggaagtggccgagacccaacacggcactgtcctcgttcagattaagtatgagggcaccgatgccccctgcaagatccccttttccactcaggacgaaaaaggggtgacacagaatggccggctaatcacggcgaatccgatagttaccgacaaggagaagcccgtcaatatcgaggccgaaccgccattcggtgagagctacatcgtgatcggcgcaggcgagaaagccctgaagctcagttggttcaagaaggggagcagtatcggcaagatgttcgaggccaccgcgcgcggggcccggcgcatggccatcctcggcgacaccgcctgggatttcggaagcatcggaggagtgttcacatccgtcgggaagctggtccaccaaatcttcgggacagcctatggtgtgttattctcgggtgtttcctggacaatgaagattggtattggcgtgctcttaacttggctaggcctcaacagtcggtccatgtccctgagtatgacctgcatagccgtagggctggttaccttatacctgggggtgatggtgcaggcagacagcgggtgcgtcatcaactggaagggccgagagctgaagtgcggtagcgggatctttgttactaacgaagtgcacacgtggacggaacagtacaagttccaggcggattcccccaaacgcctctccgccgcaatcggaaaagcctgggaggaaggggtctgcggaatccggtcagcgaccagactggagaacattatgtggaagcagattagcaacgagctgaaccacattctcctggaaaatgacatgaagttcactgttgtggtcggggacgtggcgggtatcctggctcagggtaagaagatgatcagacctcagcccatggagtacaaatactcttggaagtcctggggcaaggccaaaattatcggtgcggacgttcaaaacactactttcattatagatgggcccaacacgccggagtgccccgacgatcagcgcgcatggaacatctgggaggtagaggactatggcttcggcatctttacaaccaacatctggctcaagctgcgcgactcttacacccaggtatgcgatcatcgcctgatgagcgccgcaatcaaggactccaaggccgtgcacgcagacatgggctactggatcgagagcgagaagaacgagacgtggaagttagcgagggcctcattcatcgaggtcaagacctgcatctggcccaagtcgcacacactgtggtcaaacggcgtcctggagagcgagatgattataccaaagatttacggaggtcccatctcgcaacataactaccgccctgggtactttacccagacggcgggcccctggcacctcgggaagttggagctggactttgacctctgcgagggtacgaccgtcgtcgtggacgagcattgcgggaaccgaggaccgagtctgcgcaccaccaccgtgaccggcaagatcatccacgagtggtgctgtaggtcctgcactctcccgcccctgcggttcaagggggaggacggttgctggtatggcatggaaatccggcccgtcaaggagaaggaggagaacctcgtcaagtccatggtgagtgccggctccggggaggtcgatagcttttccctggggctcctgtgcatcagcatcatgatcgaagaggtgatgaggtcccggtggagcagaaagatgctgatgacaggcaccctcgctgtatttttcctgttgattatggggcagctcacctggaacgacctgatccggctttgcatcatggtcggcgccaatgcctctgaccgcatggggatgggtaccacttaccttgccctcatggccaccttcaaaatgcgcccgatgttcgccgtgggcctcctgttccggcgcctgacgagtcgggaggtgctgctcctgaccatagggctaagcttggttgcgtcagtagaacttcctaactccctggaggagctcggcgacgggcttgctatgggaatcatgatcctgaagctcctgactgacttccagtcacaccagttatgggccacccttctgagccttacgttcatcaaaaccacgttctctctgcactatgcatggaagaccatggcaatggtcctatccatcgtgagcctgttccccttatgtctgtccaccaccagccagaagacgacctggctgcccgttctactaggctcgctggggtgcaagccgttaaccatgtttctgattgccgaaaataagatctggggacgcaagtcttggcccctcaacgagggtattatggccgtcggcatcgtgagcatactcctgtccagcctgctgaagaacgacgttcccttagctggccccctgatcgcaggcggcatgctcatcgcgtgctacgtcatctctggatcatccgctgatctgagcctggaaaaagccgccgaggtttcgtgggaggaagaagccgagcacagcggcgcgtctcataacatcctcgtggaggtccaagacgacgggaccatgaagatcaaggacgaagagcgagacgataccctcactatattactcaaagcgaccttgctggctgttagcggcgtatatccgctttccattcccgccacgctgttcctgtggtacttctggcagaaaaaaaagcagcgctcgggagtcctctgggacacccccagtcctcccgaggttgagcgggccgtactggacgacggcatctacagaatcatgcaaagaggcttactggggagaagccaagtcggagttggggtgttccaagaaaatgttttccatacaatgtggcacgtgacccgtggggcggtgctaatgtaccaggggaagagattagagccgtcctgggccagcgtgaagaaggatctcatatcctacggcggcgggtggagactccagggcagctggaatacgggggaagaagtccaggtgatcgctgtcgagcccggtaagaacccgaaaaacgtgcaaaccgcccccgggacatttaaaacctcggagggcgaggtaggcgcaatagctctggatttcaaacccgggaccagcggctcgcccatcgtcaaccgcgagggtaagatcgtgggcctatacggcaatggggttgtcacgacctcaggaacctacgtatccgccatcgcacaggccaaggcgtcccaggaggggcccctcccggagatagaagacgaggtattccggaagcgcaacttgacaatcatggacctgcatccgggctcgggtaagacccgtcggtacctacccgccatagtacgggaggccattaaacgcaaactgcggacgctgatcctcgccccgacccgcgtcgttgcgagcgaaatggctgaggccctgaagggcatgcccatccgctatcaaactaccgccgtcaagtcagagcacacggggaaggagatcgtggacctgatgtgccacgccacgtttaccatgagactgctgagtccggttcgggtccccaattacaacatgatcatcatggacgaggcccactttaccgatcccagttccatagcggcacggggttatatctccacgcgagtaggaatgggggaagcagcggccatcttcatgacagcaactccacctggctccgtggaagctttcccccagagcaatgcagttatccaggacgaggagcgggacataccggagcgctcctggaacagcggttacgaatggattaccgacttccccggcaaaacggtgtggttcgtgccctccatcaagtcgggtaacgacatcgctaactgtctaagaaagaacggtaagcgagtcatccagctatcccggaaaaccttcgataccgagtaccagaaaaccaagaataacgactgggattatgtggttacgaccgacatcagcgagatgggcgctaacttcagagccgaccgggtcatagatcctcgccggtgcctgaagcctgtgatcctaaaagacggccccgagcgtgtcatcctcgctggccccatgcccgtaaccgttgcctccgcagcccagcggcgcggccggataggaaggaaccacaataaggaaggcgaccagtacatttacatgggtcagccactgaacaacgacgaggaccatgcgcactggaccgaggccaagatgctattggacaacatcaacactcccgaggggatcatcccagccttgttcgaacccgaacgagaaaagtccgccgcaatcgacggggagtaccgtctcaggggcgaggcccgaaagacattcgtagagcttatgcgccgcggtgacttaccggtgtggctgtcttacaaggtggcatcggagggctttcagtacagcgaccgcagatggtgcttcgacggcgagcgcaataatcaggttctcgaggagaacatggacgtggagatctggaccaaggaaggcgaacggaaaaaattgcgccctcggtggctggacgcgcgcgtttactccgaccccctcgccctacgggagttcaaggagttcgcggccggccggcggtccgtctcgggagatctgatcctagagatcggaaaactgccccagcacttaactcaacgcgctcagaatgccctcgacaacttggtgatgctgcacaactctgagcagggcgggcgtgcgtatcggcacgctatggaggaattaccggacactattgagacgctgatgctgctcgccctaatcgccgtgctgaccggaggggttaccttgttcttcctgtccggccgggggttgggcaagacgtctataggactcctgtgcgtgatggcctccagcgtgttgttgtggatggctagtgtcgagccccactggatcgccgcgtcgataatcctggagttcttcctgatggtgctcctgatccccgaacccgatcggcagcggacaccgcaggacaaccaactggcctacgtcgtcatcggcctcctgttcatgatcctgaccgttgcagcgaatgagatggggctcctggagaccaccaaaaaggacctggggatcggccacgtggccgtcgagaaccatcatcacgccgccatgctcgacgtggatctgcaccccgcctccgcttggacgttgtacgccgtcgcgacgaccatcatcacccctatgatgcgccatacgatcgaaaacaccacagcaaacatctcactcacggccatcgccaaccaggcggccattctcatgggcctggataagggctggccgatctccaagatggatatcggagttcccttgctagcattgggttgctactctcaggttaacccgctcacgctgaccgcggccgtgttaatgttagtagcccactacgctattatcggcccaggactgcaggctaaggcaacccgggaggcccagaagcgcaccgccgccggaatcatgaagaacccgacggttgatgggatcgtagccatcgacctggaccccgtcgtatacgacgcgaagttcgaaaaacagcttggccagatcatgctgctgattctctgcactagtcagatactactgatgagaaccacctgggccttgtgtgaaagcatcacgttggcaaccggtcctctgaccaccctttgggagggatcccctggcaagttctggaatacgaccattgcggtgagtatggccaacatcttccggggaagctacctggcgggtgccggactggccttttccctcatgaagtcactcggcggagggcgtcgggggaccggggctcagggggagaccctgggtgagaagtggaaacgccagctcaatcagttgtccaagagcgagttcaacacgtacaaacggtcgggaataatggaggtcgaccgcagcgaggcgaaagaaggcttgaagaggggggagaccaccaagcacgccgtgagccgcggcacggccaagttacgttggttcgtggagcggaacctggtgaaaccggagggaaaagtgattgacctaggttgcggccgcggcggctggagctactactgcgccggattaaagaaggtcacagaggtcaaggggtacacgaagggggggccaggccacgaggagcccatccccatggctacctatgggtggaacctagtgaagcttcattccggcaaggacgtgttcttcatcccgccagagaagtgcgatactctgctgtgcgacatcggggagagctcgcccaaccccacgatcgaggaaggacgcaccttacgggtcctgaagatggtggagccatggctacgcggtaaccagttctgtatcaagatcttaaacccctacatgccctcagtggttgagactctggagcagatgcagcggaagcacggcggcatgttagtccgcaatcccctctccagaaactcgacacatgagatgtactgggtttcctgcggcacaggcaatatcgtctcggctgtaaacatgacctcacgtatgctgctcaacaggttcaccatggcacaccgaaagccaacctacgagcgagacgtggacttgggggcgggtacccggcacgtcgccgtcgagcccgaagtagccaatctggacatcattggccagcgcatcgagaacattaagcatgagcacaagagcacgtggcactacgacgaagacaacccctacaagacttgggcgtaccacggctcatacgaggtcaagccctcggggtccgcctccagcatggtgaatggagtcgttaagttgctcaccaagccgtgggatgtgatccccatggtcacccagatcgccatgacggataccacacccttcggacagcagagagtgttcaaagagaaggtagacacaagaacgcctaaggccaagcggggtacagctcagatcatggaggttaccgcgaaatggctctgggggttcctttccagaaataaaaagccgcggatatgtacacgcgaggagttcacgagaaaagttcgcagcaacgccgcgataggcgcagtatttgtagacgagaaccagtggaattccgctaaggaagccgtggaggacgagcggttttgggatctcgttcaccgcgagcgtgagctgcacaagcaaggcaaatgcgcgacctgcgtctacaatatgatgggaaagagagagaagaagcttggggaatttggcaaggccaagggaagccgggcgatttggtacatgtggctgggtgcacgcttcctggaattcgaggctctcggcttcatgaatgaagatcactggttcagtcgtgaaaacagcctgtccggggtcgagggcgaggggctacacaagctaggctacatcctccgggacatctccaagatccccggaggtaacatgtacgccgacgacacagccggatgggacaccaggattacggaggacgacttgcagaacgaagccaagatcactgatatcatggagcccgagcacgcgctcctggctaagtccatttttaaattaacctaccagaataaagtggtccgcgtacaaagaccggccaaaaacggaaccgtgatggacgtcatcagccgtcgcgaccagcgtggcagtgggcaggttggcacctacggactcaacaccttcaccaatatggaggcacagctgatcaggcagatggagagcgagggcatcttctcccccagcgagctggagaccccaaacctcgcgggccgggtcctggactggctggagaaacatggtgtcgagcgcctcaaacgaatggccatatccggggatgactgcgtggttaagcccatcgacgaccgcttcgctacggcgctgaccgcactgaacgatatggggaaggttcggaaggacataccgcagtgggaaccctcaaagggctggaatgattggcagcaggtccctttctgctcccaccacttccaccagctcatcatgaaggacggccgtgagatcgtggtcccctgccgaaaccaggacgagctggtgggtagggcacgggtatcccaaggcgccggctggagcctgcgcgagaccgcctgtctcggcaaatcgtacgctcagatgtggcaactgatgtactttcaccggagagacctgagacttgccgcgaacgccatctgctccgcggtccctgtggactgggtgcccacctccagaacgacctggtcaatccatgcccaccaccagtggatgactaccgaggacatgctgtccgtttggaaccgggtgtggattgaggaaaacccctggatggaggacaagacgcatataagctcctggggcgatgtgccctacctgggtaagagggaggaccagtggtgcggcagtctaatcgggttgaccgcccgggcgacttgggctaccaacatccaggtagccatcaaccaggtgcgtcgcctgattggcaacgagaactacttagactacatgacctctatgaagcgcttcaaaaacgagtcagacccggagggtgctctgtggtga

SEQ ID NO: 24473 - RNA, 9879 nt, synthetic construct
  misc_feature 1..9879: note = derived and/or modified CDS sequence (opt11) from DENV-1__GU131763__SS-prME
  source 1..9879: mol_type = other RNA
agcgtcaccatgttactcatgctgatgcccacggccttggccttccatctgacgacccgcggcggggagccccacatgatcgtgaccaagcaggagcggggtaaatccctgctgttcaagaccagcgctggcgtaaacatgtgcaccttaatcgccatggacttaggtgagctctgcgaggacaccatgacttacaagtgccctcggatcaccgaggccgagcctgacgatgttgactgttggtgcaacgccacagacacctgggtcacctacgggacctgttcgcaaaccggcgaacaccggcgcgacaagcggagcgtggccctcgcgccccacgtgggccttgggctggagacccgcaccgagacctggatgtccagcgagggagcctggaaacagattcagcgggtcgaaacgtgggccctccgccaccccggctttacggtgatcgccctgttccttgcgcacgccatcggcacctctataacccagaaggggatcatcttcatactgctgatgctggtgacgccaagcatggcaatgaggtgtgtaggcatcggctcccgcgacttcgtagaagggctcagcggcgcaacctgggtggatgtcgtacttgagcacgggtcctgcgtgacgaccatggccaaagacaaacctacgcttgacatcgagctactgaagacagaggttaccaaccccgcggtgctgcggaaactctgcatcgaggccaagatcagcaacaccacgacagactcacgctgccccacccaaggcgaggccaccctgatggaggagcaggatgccaatttcgtgtgccggcgtacgttcgtggaccggggctggggcaacggctgcggattattcggtaagggatcgctcatcacgtgcgcgaagttcaagtgcgtgaccaagctggagggaaagattgtgcaatacgagaaccttaagtactcagtcatcgtcactgtacacacaggtgaccaacatcaggtcgggaacgagagcaccgagcacggcaccacggccacgatcacgccacaggcccccacctccgaaatacagttgaccgactacggggccctaaccctcgactgcagcccccgcacgggcttagattttaatgagatggtgctgcttactatgaaggagaagagctggctcgtccacaagcagtggttcttggacctccctctgccctggaccagcggggcaagcacctcccaagaaacttggaaccggcaggatctgctggttaccttcaaaaccgcacacgcgaagaagcaggaggttgtcgtactcggcagccaagagggcgccatgcacaccgccttaacaggggccaccgaaatccagacctcaggcaccacgacgatatttgccgggcacctaaagtgccggttgaagatggacaagctgacccttaagggcatgtcatacgtgatgtgcaccgggtccttcaagctcgagaaggaagtcgcggagacccagcacggtaccgtgctggtgcagatcaagtacgagggaaccgacgccccctgcaagatacccttcagcacccaggatgagaagggggttacgcaaaatggccgactaatcactgcgaacccgatcgtgaccgataaggaaaagccggtgaacatcgaggccgagccgcccttcggggaatcctacatcgtaatcggcgcgggcgagaaggccttaaagctcagctggttcaagaaggggtcgagcattggcaagatgttcgaggccaccgcccgaggagccagacgcatggcgatattaggcgacacggcctgggacttcggatccattggtggcgtgttcacctctgtgggtaagctggtccaccagattttcggcaccgcttatggagtgctgttctccggcgtgagctggaccatgaagatagggatcggtgtcctgctgacgtggctcggcctgaactcccgcagcactagtctatctatgacctgcatcgccgttgggctcgtgaccctgtacctgggcgtaatggtgcaggctgactccgggtgcgtgatcaactggaagggacgggagctcaagtgcgggtctggcatcttcgtcacgaatgaggtccacacctggacagaacagtacaaatttcaggcggacagcccgaagcgcctgagtgccgccatcggcaaggcctgggaggagggcgtatgcgggatccgatccgccacacgcctggagaacattatgtggaagcagatctccaacgagctcaaccacatcctgctggaaaatgatatgaaatttactgtcgttgtgggggacgtcgtgggcatcctcgcgcaagggaagaagatgatacggccccaacccatggagcacaagtacagctggaaatcatggggcaaggccaagatcatcggcgcggacgtgcagaacactacctttatcatagacgggcccaacaccccggagtgtcccgacgatcagcgggcctggaatatctgggaggtcgaggactacggcttcgggatctttaccacgaacatctggctgaagctgcgggattcttacacccaggtctgtgaccatcgcctcatgtctgctgcgataaaggactcgaaagctgtgcatgccgacatgggctattggattgaatccgagaagaacgagacctggaaactggcccgcgcgagcttcatcgaagtcaaaacgtgcatatggcccaagtcccacactctgtggagcaacggagtgctcgaatcagagatgattatccccaagatctacgggggaccgatcagtcagcacaattatcgccccgggtattttacccagaccgccgggccgtggcacctggggaagctggagctcgacttcgatttgtgcgagggcactacagtggtcgtggatgagcactgcggcaaccgggggcccagcctgcgcaccacgacagtgacgggtaagatcattcacgagtggtgctgcagatcatgcaccttgccgccactccgcttcaagggggaagacggctgttggtacggcatggagattagacccgtcaaggagaaggaggagaacctggtgaagtccatggtgagcgccggtctcggcgaggtcgacagcttcagcctgggtctgctctgcattagcataatgattgaagaggtgatgagatcaagatggagccgtaagatgctgatggccggcaccctagcagtgtttttgctgctgatcatgggccaactcacctggaacgacctgatccggttatgcattatggtgggagccaacgctagcgatcggatggggatgggcacgacctacttggcgctgatggcaacgtttaagatgcgtcccatgttcgccgtgggcctcctgttccggcggctgacaagccgggaggtgctgctcctgacgatcgggttatcgctcgtcgcgagcgtcgagcttcccaactccttggaggagctcggcgatgggctggcgatgggcatcatgattttaaaactcctgaccgacttccagagccaccaactgtgggccaccctcttatccctgacctttatcaaaacgaccctcagcttacactacgcctggaaaaccatggcgatggtcctgtccatcgttagcctcttccctctatgcctgtccaccacgtcgcagaagaccacctggctcccggtgctgttggggtcacttgggtgcaagccgctgaccatgttcctgatcgcggagaacaagatatggggccgtaagtcttggcccttaaacgaggggatcatggcagtcggcgttgtgtccatcttgctgagcagcctactgaagaacgatgtccccctggccgggcccctcatcgccggcgggatgctgatcgcatgctacgtgatatccggatcgtccgcggacctgagcctcgagaaggccgcagaggtctcctgggaggaagaagctgaacacagcggcgcctcccacaacatcctggtcgaggtgcaggacgatgggacgatgaagatcaaggatgaggagcgagacgacaccctgaccatcctcctgaaggccaccctgctcgccataagcggcgtgtatccgctgtctatccccgccacgctgttcgtctggtacttctggcaaaagaagaagcagcgctccggggttctatgggacacgcccagcccacccgaggtggagcgggcggtcctcgacgacggcatctaccgcatcatgcagcggggcctcctggggcgcagccaggtgggcgtgggggtcttccaggagaacgtgttccacaccatgtggcacgtgactcggggcgcggtcctcatgtatcaggggaagcgcctggaaccttcctgggccagcgtgaagaaggacctcatttcctacgggggcggatggcggctccagggctcgtggaacaccggggaagaggtgcaggtcatagccgttgagcccggcaagaaccccaagaacgttcaaacggcacccggaacctttaagacgcccgagggagaggtcggcgccatcgcgctggatttcaagcccgggacgtccgggagccccatcgtgaaccgcgaaggcaagatcgtgggtttgtacggcaacggggtggtgacgaccagcgggacctacgtgtccgccatcgcccaggctaaggcgagtcaagagggtccactccccgagattgaggatgaggtcttccggaagcggaacctgactataatggacctgcaccccggctccgggaagacacgccgttacttaccagccatcgttcgggaggccatcaagaggaagctccggactctgatcctcgcccccacccgagtggtcgcaagcgagatggcggaggccctgaaaggcatgcctatacgctatcagactaccgccgtgaaatccgaacacaccggcaaggagatagtggacttgatgtgtcacgccaccttcacgatgcgactcctgagccctgtacgcgtgccgaactacaacatgatcatcatggacgaggcccacttcactgaccccagttctattgcggcgcgggggtacatctccacccgcgtggggatgggggaggctgccgccatcttcatgaccgcgacgccgcccggcagcgtcgaggccttcccgcagtccaacgccgtaatccaagatgaggaacgggacatcccagagcgcagctggaactccgggtacgagtggattacggactttcccggcaagaccgtttggttcgtccccagcatcaagtccggcaacgatatcgcaaactgcctgcggaagaacggcaagcgcgtgatccagctatcgcggaagaccttcgacaccgagtaccagaagacgaagaacaacgactgggactacgtggtcaccaccgatatctccgagatgggcgccaacttcagggccgaccgtgtgatagacccgcgccggtgcctgaagcctgtgattctgaaggacggtcccgagcgcgtaatactcgccggcccaatgcctgtgaccgtagccagcgcggcgcagcggcgcgggcggatcgggcggaaccacaacaaggagggcgaccagtacatctacatggggcagcccctgaacaacgacgaggaccatgcccactggacggaggcgaagatgctgctcgataacatcaacacgccggagggcataatccccgccctcttcgagccggaacgcgaaaagtccgctgcgatcgatggggagtaccgcctgcgcggcgaagcccggaaaaccttcgtcgagctcatgcgccgcggggacctgcccgtctggctgagctacaaggtagcctccgagggtttccagtacagtgaccgccggtggtgcttcgacggggagaggaacaatcaggtgctcgaggagaacatggacgtggagatctggactaaggaaggtgagcggaagaagttgcgcccccggtggctggacgcccggacatacagcgatcccttggcccttcgggagttcaaggagttcgcggccggccgccgttccgtaagcggcgatctgatcttggagatcggcaagctgccgcagcacctgacccaacgcgcgcagaacgccctagacaatctggtgatgctccacaactccgagcagggcgggcgggcgtaccgccacgccatggaagaacttcccgacaccatcgagaccctgatgttactggcccttatcgccgtgctgacgggtggggtcaccctcttcttcctgagcggccgggggctgggcaagacatccatcggcctcctgtgcgtcatggccagctcggtgctgctctggatggcgagcgtcgagccccattggatcgccgccagcatcattctggagtttttcctgatggttctcctgatcccagagccggacaggcagcggaccccccaggataatcagctagcctacgtggtcatcgggctcctatttatgatattaaccgttgccgcgaacgagatgggcctcctagagacgaccaagaaggacctggggatcgggcacgtggccgtcgagaaccaccaccatgctacgatgctcgacgtggacctgcaccccgccagcgcctggaccctgtacgcggtggcaacgaccatcatcacgccgatgatgcgccataccatcgagaacacgactgccaacatctccttgacagccattgcgaaccaagcggccatactgatgggtctggacaagggatggccaatcagcaaaatggacataggggtgcccctcctggccctcgggtgctacagtcaggtaaaccccttgacgttgactgccgcggtgctgatgctcgtcgcccactacgccatcatcgggccggggcttcaggccaaagccacccgggaggcccagaagcgcaccgccgccggaatcatgaagaaccctaccgtggacgggatcgtagccatcgacctggaccccgtggtgtacgacgctaagttcgagaagcagctcggccagatcatgctgctgatcctctgtaccagccagatcctgctgatgcgcacaacctgggcgctctgcgaatctatcaccctcgccactgggcccctgacgaccctctgggagggtagcccaggcaagttttggaacaccacgatcgccgtgagcatggccaatatcttccgggggagctacctggccggcgcgggcctggccttctccctcatgaagtccttggggggtgggagacgtgggaccggggcccagggcgagaccctaggcgagaagtggaagcgccagctcaaccagcttagcaagtccgagttcaatatctacaaacggagcgggattatggaggttgaccgttccgaggccaaggagggcctgaagcgcggggagacaacgcgccacgccgtctcacgcggcacggccaaactgcgctggttcgtggaacggaaccttgtcaagcccgaaggtaaggtcatcgacctgggctgcggacgcgggggctggtcctactactgcgccggactaaaaaaggtgactgaggtcaaaggctacactaaaggcgggcccggtcatgaggagcccatccccatggccacttacgggtggaaccttgtgaagctacactccggaaaggacgtattcttcacgccgccagaacgttgtgacacccttctctgcgacatcggggagtccagccccaatccgaccattgaggaaggccgcacgctccgggtactgaagatggtagagccctggctcagaggaaaccagttctgcatcaagatcctgaacccgtacatgccttccgttgtcgagaccctggaacagatgcaacggaagcacggcggcatgttagtgcgcaacccgcttagccggaactccacccacgagatgtactgggtgagctgcgggaccggaaacattgtcagtgccgtgaatatgaccagcagaatgctgcttaaccgcttcacgatggcgcaccggaagccgacgtacgagcgtgacgttgacctcggggccggcactcgtcacgtcgccgttgaacccgaggtcgccaacctggacatcataggacagaggatcgaaaacattaagcacgagcacaagtccacatggcactacgacgaggacaacccctacaagacgtgggcctaccacgggagctatgaagtcaagccgtcgggcagcgcgagttcaatggtgaacggcgtagttaagttgctgactaagccatgggacgtaatccccatggtcacgcagatcgccatgaccgatactacccccttcggccaacagcgggtgtttaaagaaaaggtggacacccgcaccccgaaggctaaacgggggacggcgcagatcatggaagtcaccgcacgctggttatggggcttcttgagtcggaacaaaaagccccggatttgcactcgggaggaattcacccgtaaggtccggtcgaacgcggccatcggcgccgttttcgtcgatgagaaccaatggaactccgccaaggaggcggtagaggacgaacgcttctgggaccttgtacaaaaggagcgggaattacacaaacaggggaagtgcgccacgtgtgtttacaacatgatgggcaagcgcgagaagaagctcggggaatttggcaaggctaaggggtcgcgggccatctggtatatgtggctgggcgcccgattcctggagttcgaggccctcggcttcatgaatgaagaccactggttctcccgggagaattccctgtcgggggttgaaggcgaagggctgcacaaactcggctacatcctacgcgacatctccaagattcccggaggcaacatgtatgccgatgacaccgcaggttgggacacgcgaatcaccgaggacgacctgcagaacgaggccaagatcacggacatcatggagccggaacacgccttactggcgaccagcattttcaaacttacctaccagaataaggtagtccgcgttcaacgccccgccaagaacgggaccgtaatggacgtcatttcccggcgcgaccagcgcggcagcggacaggtgggcacatatgggctgaacaccttcaccaacatggaggcccaactgatccgccaaatggaatccgagggcattttcctgcccagcgagctcgagacccctaatctcgccgagcgggttctggactggctagagaagcacggcgtcgagcgcctcaaaaggatggccatcagtggggacgactgtgtggtgaaaccgatcgacgaccgtttcgctaccgccctgaccgccctcaacgatatgggtaaagtccggaaggacatcccccagtgggaacccagcaagggatggaacgactggcagcaggtccccttctgctcccaccatttccaccagctgatcatgaaggatggccgcgagatcgtggttccatgccggaaccaggacgaattggtgggtcgcgcccgggtaagccagggcgcagggtggtccctacgcgagacggcgtgcctaggcaagagctacgcccagatgtggcagctgatgtacttccacaggcgcgacctccggctggccgccaacgccatctgcagcgccgttcccgttgactgggtgcccacttcccgcaccacatggtctatccacgcccaccatcaatggatgaccacagaggatatgctatctgtctggaacaaggtgtggatcgaggagaacccctggatggaggacaagacgcacgtgagctcctggggagacgtaccgtacctcggtaagcgggaggaccagtggtgtggctccttaatcggtctaaccgcacgcgccacctgggcgagcaatatccaggtggccatcaaccaagtgcgccggctcatcgggaacgagaactaccttgactacatgacttccatgaagcgattcaagaacgagggcgaccccgagggggctctgtggtga

SEQ ID NO: 24474 - RNA, 9879 nt, synthetic construct
  misc_feature 1..9879: note = derived and/or modified CDS sequence (opt11) from DENV-1__GU131766__SS-prME
  source 1..9879: mol_type = other RNA
tctgtgaccatgctgctcatgttaatgcccaccgccctggccttccacctcaccacccggggcggggaaccccacatgattgttactaagcaggagcggggcaagagccttctgttcaagaccagcgccggagtgaatatgtgcacactcatcgccatggacctcggggaactgtgtgaggatactatgacctacaagtgcccccgtatcacggaggccgagcccgacgacgtcgattgctggtgtaatgccactgacacctgggtgacctacggcacttgctcgcagaccggcgagcatcggcgcgacaagcggagcgtggccctcgcgcctcacgtgggcctggggctggaaacccgcaccgagacctggatgtccagcgaaggcgcctggaagcagatccagagggtcgagacgtgggccctgcgtcaccccgggttcaccgtcatagccctattcctggcgcatgccatcggcacctctatcacccaaaaggggatcatcttcatcctcctaatgttggtgacgcccagcatggccatgcggtgtgtcggcatcggctcccgcgattttgtggaggggctcagcggcgccacgtgggtggacgtggtgctggaacatgggtcctgcgtgaccactatggccaaagacaagcccacgctggacatcgagttgctgaagacagaggtaacgaaccccgcggtgctgcgcaaactctgcatcgaggccaagataagcaacaccacgaccgactcccgctgtcccactcagggtgaggccaccctgatggaggagcaagacgccaacttcgtttgccgcagaactttcgtagaccgtggctgggggaacggctgtggcctgttcggcaagggaagcctcatcacatgcgcgaaattcaagtgcgtgacgaagctggaaggcaagatcgtacagtatgaaaatctgaagtactccgtcatcgtgacagtgcacactggagatcagcaccaggtcgggaacgagagcatcgagcacggcaccacagctaccataacgccccaggcgcccacttcggagatacagctcaccgattacggggccctgaccctggactgcagcccccgcaccggcctcgacttcaacgagatggtgctgctcacgatgaaagagaaatcctggctggtccataagcagtggttcctggacctgccacttccctggaccagtggagcaagcacttcccaagagacctggaatcggcaagacttactggtgacgttcaagaccgcccacgcgaaaaagcaggaagtggtcgtgttgggctcccaggagggcgccatgcacaccgccctgaccggtgccacggagattcagacctccggcaccacgacgatcttcgccgggcacctgaagtgcaggcttaagatggacaagctgaccctaaagggcatgagctacgtcatgtgcaccgggtccttcaagctcgagaaggaggtcgccgagacccagcatggcacggtgttagtgcagatcaagtacgagggcacagacgccccctgtaagatccccttcagcacccaggacgagaagggggtcacgcagaacggcagactgatcacggccaatccgattgtaatagacaaggaaaagcccgtgaacatagaggccgagccccccttcggcgaatcatacattgtcattggcgcgggcgagaaggccttgaagctctcttggttcaagaaggggtccagcatcggcaaaatgttcgaggccaccgcccgtggggcacgaagaatggcaatcctaggcgacaccgcctgggacttcgggagcatcggcggcgtctttacctctatcgggaagctagtgcaccagatattcggtactgcctacggggtgctcttttcaggcgtgagctggaccatgaagatcgggataggggtgctgctaacctggctcggactgaactcccgttcgacttcgctgtcaatgacgtgtatagccgtcggtctcgtgaccctgtacctgggcgtgatggttcaggccgactccgggtgcgtgatcaactggaaaggcagggaactgaagtgtgggtctggaatctttgtcaccaacgaagtccacacctggaccgagcagtacaaattccaggcggacagcccgaagcgcttgtcagccgccattggtaaagcctgggaggaaggagtatgcggcattcggagcgccacccgcctggagaacataatgtggaagcaaatatccaatgagctcaaccacatcctgctggagaatgacatgaagttcaccgtagtcgtgggagacgtggtcggaatcctcgctcagggcaagaagatgatccggccgcagcccatggagcacaagtacagctggaagtcctgggggaaggctaagatcatcggcgccgacgtgcagaacaccacattcatcatcgacgggcccaacacacctgaatgccccgacgaccagagagcctggaacatctgggaggtggaagactacggtttcgggatcttcaccaccaacatctggctgaaaatgcgggacagctacacgcaggtatgcgatcatcgcctgatgtcggcggccattaaggactctaaggccgttcacgccgacatgggatactggatcgagtccgagaaaaacgagacctggaagctcgcccgggcgagcttcatcgaggtgaaaacctgcatctggcccaagtcccatacgctgtggtcgaacggcgtcctggagtccgagatgataatcccaaaaatctatgggggccccattagccaacacaattaccgaccgggttacttcacgcagacggctggcccttggcacctcggaaagctagagctggactttgacctctgtgagggcaccacggtggtggtcgacgagcactgcggcaaccgggggcccagcctgaggaccactacggttacaggcaagatcatacacgagtggtgctgccgttcatgcaccctgccgcctttacgcttcaagggcgaagatggctgctggtatgggatggagatacggcccgtgaaggaaaaggaggagaacctggtcaagtccatggtgtctgccggcagcggcgaggttgactccttcagcctggggctcctctgcatcagcatcatgatcgaggaggttatgcggagccggtggtcccgcaagatgctgatgacgggcaccctcgccgtgttcttgcttctcatcatgggccaactgacgtggaacgacctgatccggttgtgcatcatggtcggtgccaacgcgtcggataggatggggatgggcaccacctacctggcgctgatggccaccttcaagatgcgcccgatgtttgccgtcgggttgctattccgaagattgacctcccgggaggtattgctgctgaccataggtctgagcttagtggccagcgtcgagttgcccaactctctcgaggagctgggcgacgggctcgcgatgggtataatgatcctaaaactgcttaccgacttccagtcccaccagctctgcgccacgctactaagcctcaccttcatcaagaccacgctctccttgcactacgcctggaagaccatggccatggtgctcagcatcgtcagcctgatccccctatgcttgagcacgacatcccagaagactacctggctccccgtgctgctcggaagcctggggtgcaaaccgcttactatgttcctcatcgcggaaaacaaaatatggggtcgcaagtcctggcccctgaacgaggggatcatggccgtgggcgtcgtgagcattctgttaagctccctactgaagaacgacgtacccctcgcggggccactgattgcaggcggaatgctgatagcttgttatgtgataagcggtagcagcgcggatctctccctggaaaaagccgcggaagtgtcctgggaggaggaggccgagcattccggcgcaagccacaacatcctggtggaggtccaggacgacgggaccatgaagatcaaggacgaggagcgggacgacacgctcacgatcctactgaaggcgaccttactggccgtgtccggcgtgtacccgctgagcatcccggcgaccctcttcgtttggtacttctggcagaaaaagaagcagagatccggtgtgctatgggacacccccagcccgccggaggtagagcgcgccgtcctagacgacggcatctaccgcataatgcagcggggcctgctaggacgctcccaggtgggcgttggggtgttccaggagaacgtattccacacgatgtggcacgtgactcgaggtgctgtcctgatgtaccaaggcaagcgccttgagcccagctgggcctcggtaaaaaaggacctcatctcttacggcggcgggtggcgtctgcagggctcttggaacaccggggaggaagtgcaggtcatcgctgtagaacccggcaaaaacccgaaaaacgtgcagactgcccccgggacgttcaagaccccggagggcgaggtcggagcgatcgccctcgacttcaaaccaggaactagcggctcccccatagttaaccgcgaggggaagatcgtgggattatatggcaacggggtcgtgacgacaagtggcacctacgtcagcgcgatcgcacaggccaaggcctcccaggaggggccgctgcctgagattgaggacgaagtatttcgtaagcgcaacctgaccatcatggatcttcaccccggaagcggtaagacccggcgctacctgccggcgatcgtgcgggaggcaatcaagcgaaagctgcggacgttaattctggctcctacccgggtggtggcctccgagatggccgaggctttaaagggcatgccaatccgctaccagaccaccgccgtcaagagcgagcatacgggcaaggaaatcgtggacctcatgtgccatgcgaccttcaccatgcggctgctgtcccccgtccgcgtgcctaattacaacatgataatcatggacgaggcccacttcaccgacccgagctccatcgcagcgcgggggtacataagcacccgcgtgggcatgggggaagccgccgccatcttcatgaccgccaccccgcccgggtccgtcgaggcgttcccgcagagcaacgccgtgatccaggacgaggagcgggacatccccgagcgctcctggaacagcgggtacgagtggatcactgatttccccggaaagacggtgtggttcgtcccctccatcaaaagcggaaacgacatcgcaaattgcctccgcaagaacggaaagagggtgatccagttatcccggaagaccttcgacaccgaataccagaagacaaagaacaatgactgggattacgtggtcacgacggacatcagcgagatgggcgccaacttcagggcggaccgggtgatagacccgcggcggtgcctgaagccggtgatcctgaaagacggacccgagcgcgtgatcctggccggccccatgccggtgaccgtagcgtccgccgcacagcggcgcgggcggatcggtaggaaccacaacaaggagggcgaccagtacatctacatggggcaacccctgaacaatgacgaagaccatgcacactggactgaagccaaaatgctcctggacaacatcaacacgcctgaaggcatcatccccgcgctgttcgagcccgaacgggaaaagtccgccgccatagacggggagtaccgcctacgcggcgaggcgcggaagacatttgtcgaactgatgcgccgaggggatctgccagtttggctctcctacaaagtcgccagcgagggcttccagtacagcgaccgccggtggtgcttcgacggcgagcgcaacaaccaggtgctggaggagaacatggacgtggagatatggaccaaggagggggagcggaagaagttgcgcccccggtggttggacgccagaacctattcggaccccctggccctgcgggagtttaaggagttcgccgcgggtcgccggtcagtgtcaggcgacctcatcttggagataggcaagctgccgcagcacctcacgcagcgcgcccaaaacgccctggacaacctggtgatgctgcataacagcgagcaaggcgggcgggcctaccgccacgctatggaggagcttccggacaccatcgagacgttaatgctgctggccctgatagccgtgctcaccggcggggtcacgctgttctttctgtccggtcgggggcttggcaagaccagcataggccttctgtgcgtaatggcctcatctgtgctgttgtggatggcctccgtagaaccacactggatcgcggccagcataatcctcgagttctttctaatggtgctgctgatccccgagccggaccgccagcggacgccccaagacaaccagttagcgtacgtagtcatcgggttacttttcatgatactcaccgttgcggccaacgagatgggtttactggagaccacgaagaaagacctcggtatcggtcacgtcgcggttgagaaccaccaccacgctaccatgctggacgtggatctgcaccccgcctccgcctggaccctctatgccgtggcgaccactatcataacaccgatgatgcgccacacaatcgagaataccacggcaaatatcagcctaaccgccatcgcaaaccaggccgccatcctgatggggctcgacaagggctggccgatctccaaaatggacattggcgtcccgttgctggccctcggatgctacagccaggtgaaccccctgaccctgaccgccgccgtgctaatgctggtcgcgcattacgccatcatcgggccgggtctgcaggccaaggccacgcgggaagcccagaagcgcaccgcggcgggtatcatgaaaaaccccaccgtggacgggattgtggccatcgacctcgaccccgtcgtttacgacgccaagttcgagaagcagctgggccagattatgctgctaatcctgtgcacctcccagattctgctcatgaggacgacctgggcgctgtgtgagagcatcaccctggcgaccggccccctcacgaccctgtgggaggggtccccgggcaagttctggaacaccaccatcgccgttagcatggcaaacattttccgggggtcctacctcgccggagccggcctggcgttcagcttaatgaagtccctcggaggcgggcgccgtgggacgggggcccagggcgaaaccctgggtgagaagtggaagcgccaactgaaccagctgtccaagtcagagtttaacatttacaagagatccgggatcatggaggtcgaccgttcggaggccaaggaaggactgaagcgcggggagaccacgcgccacgccgtctcgcggggcacggcgaagctgcgctggtttgtggagcggaacctggtcaagcccgagggcaaggttattgatctgggctgcggcagagggggatggagctattactgtgccggtctcaagaaggtgaccgaggtgaagggctacaccaagggtgggcccggccacgaggagcctatcccgatggccacctacgggtggaatctcgttaagctgcactccggcaaggacgtattcttcactccgcccgaaaagtgcgacacgctcctttgcgacatcggggaatcctctccgaacccgaccatcgaagagggccgcacacttcgcgtcctcaagatggtagagccttggctgcggggtaaccagttctgtatcaagatcctgaacccttacatgcccagcgtagtcgagacgctagagcagatgcaacgcaagcacggcggcatgctggtacgtaatcccctgtccaggaacagcacacatgagatgtactgggtttcctgtgggaccggcaacatcgtcagcgccgtcaacatgacctcccgtatgttactgaaccgctttaccatggcccaccgcaagcccacgtacgagaaggatgtggacctgggagcgggcacccggcacgtcgccgtggagcccgaggtggccaacctagacatcatcggccagcgaattgaaaacatcaagcacgaacacaagagcacttggcactacgacgaggacaacccatacaagacgtgggcttaccatggtagttacgaggtcaaaccgtctggatccgccagctctatggtgaacggagtcgtaaaactcttaaccaagccatgggatgtgatccccatggtaacccagattgcgatgaccgacacaacgcccttcggccaacagcgagtgtttaaggagaaagtggacacccgcacccccaaggccaagcggggcaccgtccagatcatggaagtgacggccagatggctgtggggatttctgtccaggaacaagaagccccgcatttgcactagggaggagttcactcgtaaggtacgatccaacgccgcgatcggcgcggttttcgtggacgagaaccaatggaactccgccaaggaggccgtggaggacgagcgtttctgggacctggtcaagaaggagcgggaactccacaaacaggggaagtgcgcgacctgcgtgtataacatgatgggcaaacgcgagaagaagctgggggagtttggcaaggccaaggggagcagggccatctggtacatgtggctaggcgcccgattcctcgagttcgaggcccttggcttcatgaacgaggaccactggttctcccgggagaactcactttccggagtggaaggcgaggggctccacaagttaggctatatcctgcgcgacatcagcaagatacccgggggcaacatgtacgccgacgatacggcgggctgggacacccggattaccgaggacgacctccaaaatgaggccaagattaccgacatcatggagccggagcacgccctgttggccacgtcaatcttcaaattgacctaccagaacaaggtcgtgcgcgtgcagcggcccgctaagaacgggaccgtcatggacgtgatcagccgccgggaccagagaggctccggtcaggtgggcacctacggcctgaatacgttcaccaatatggaggcacagctgatccgacagatggagtccgaagggatcttcctcccctccgagctggagacccccaacctcgccgagagggtcttggactggttagagaagtacggcgtggagcgcctgaagcgcatggccatcagcggtgacgactgcgttgtcaagccgatcgacgacaggtttgccaccgccctcacggcgttaaacgacatgggcaaggtgcggaaggacatcccccaatgggagccctcaaaggggtggaacgactggcagcaagtccccttctgcagccaccatttccaccagttaataatgaaggacggcagggaaatcgttgtgccatgccggaaccaggacgagttagtgggccgcgcccgggtctcccagggggccggctggagcctaagagagaccgcctgcctgggcaagtcttacgctcagatgtggcagctgatgtacttccaccggcgcgacctgcggctcgcggcgaacgctatctgctccgctgtacccgtcgactgggtgcccaccagccgcaccacgtggagtatccacgcgcaccaccagtggatgaccaccgaggacatgctcagcgtgtggaatcgggtgtggatcgaagaaaacccctggatggaggacaagacccacgtgtcttcatggggagacgtgccgtacctcgggaagcgtgaggaccagtggtgcggctccctgatcggactcacggcccgggctacctgggcgagcaacatccaggtggcgataaaccaagtccgtaggctgattggaaacgagaactacctggactacatgacatccatgaagcgattcaagaacgagggcgatccagagggagcgctctggtga

SEQ ID NO: 24475 - RNA, 9879 nt, synthetic construct
  misc_feature 1..9879: note = derived and/or modified CDS sequence (opt11) from DENV-1__GU131767__SS-prME
  source 1..9879: mol_type = other RNA
agcgtgaccatgcttctgatgctgatgcccactgccctggccttccatctcacaacgcggggcggggaaccccacatgatcgtaagcaagcaggagcggggcaagagcttgctgttcaaaacgtctgtgggcgtgaacatgtgcaccctcatcgccatggatctgggcgagttttgtgaggacaccatgacgtacaagtgcccacgcatcacggaagccgaacccgatgatgtggactgctggtgcaatgccactgacacgtgggtaacatacgggacctgtagccagactggcgagcaccggcgcgacaagcggtccgtggcgctggcgcctcacgttggcctcgggctggaaacgcggaccgagacctggatgtcatccgagggcgcctggaagcagatccaacgggtggagacctgggcactgcgccacccggggttcactgtgatagccctcttcctggcacacgctatcggcacatcgatcacccagaaagggataattttcatcttattgatgcttgttaccccatccatggccatgaggtgcgtaggcatcggcagccgcgatttcgtggaaggactttcaggagccacgtgggtcgatgttgtattagaacacgggagctgcgtgaccaccatggccaaggacaaacccacactggatatcgagctgctcaaaacggaggtgaccaacccagccgttctacgaaagctgtgcatagaagcgaagatatccaacaccacgacggattcacgctgcccgacccagggcgaggccaccttagtcgaagagcaggacgccaacttcgtgtgtcggagaacttttgtggaccggggctgggggaacgggtgcggcctgttcgggaaggggtccttaataacgtgtgccaagttcaagtgcgtcaccaagcttgagggaaaaatcgtgcaatacgagaatctgaagtacagcgtgatagtaaccgtgcacacgggcgaccagcaccaggtagggaacgaatccacggagcacggcaccacggccacaatcaccccccaagcgcctagcacggagatccagctgaccgactacggggccctgaccctggactgcagccccagaacgggcctggatttcaacgagatggtgctcctgacgatgaaggagaagtcctggctggtgcacaagcaatggttcctcgatcttccactgccctggacttcgggggcctccaccagccaggagacctggaaccgtcaggacctcttagtcacgttcaagaccgcacatgccaaaaagcaggaggtcgtggtactgggcagtcaggagggagcgatgcacacggcgttgaccggggccacagagatccagaccagcggcaccactactatcttcgccgggcacctgaaatgccgcctgaaaatggacaagctcaccttgaagggaatgagctacgtgatgtgcaccgggagcttcaagctggagaaggaggtggccgaaacccagcatgggaccgttctagtgcagattaagtacgaagggaccgacgcgccttgcaagatccccttctcaacccaagacgaaaagggggtgacccagaacggccggttaatcacggccaacccgatcgtcacagacaaggagaagccggtaaacatcgaggccgagccgccctttggggagagctatatcgtgatcggggccggtgagaaggcgctgaagctgtcctggttcaagaaggggagctcgataggcaagatgttcgaggccactgcccgtggtgctcggcgaatggctattttaggtgatacagcatgggactttgggtctatcggcggcgtattcacctccgtggggaaactggtgcatcagatctttggcaccgcctacggggtcctgttcagcggcgtgagttggacaatgaagatcgggatcggcgtgctcctgacctggctgggattgaacagccgcagcacgagcctgtccatgacctgtatagccgtcggtctggtgaccctctatctgggcgtgatggtacgggccgacagcggttgcgtgataaactggaagggccgcgagctaaagtgcggatcgggcatcttcgttaccaatgaggtgcacacatggaccgaacagtacaaatttcaggccgactccccgaagcggttgagcgcggccatcggcaaagcatgggaggagggggtgtgtggtatccgcagcgccacccggctcgagaatatcatgtggaagcagatcagcaacgagctgaatcacatcctcctggaaaatgacatgaagctaactgtggtcgtcggggacgtggccggcatcttagcgcaggggaagaaaatgatccgcccccagcccatggagtacaagtacagctggaagtcctggggcaaagccaagatcataggcgccgacgttcagaacaccaccttcatcattgacgggcccaacaccccggagtgccccgacgaccagcgggcctggaacatttgggaagtcgaggactacgggttcgggatcttcaccaccaacatctggctgaagctaagagactcgtacacccaggtatgtgaccaccgcttgatgagcgctgccatcaaggacagtaaggcggtacatgccgatatgggctactggattgagagcgagaaaaacgagacctggaagctggcccgcgcttccttcatcgaggtgaaaacctgcatctggcctaagagccacaccctgtggtccaatggcgtgctcgagagcgagatgatcattcccaaaatctacgggggccctatctcacagcacaactacagacccgggtatttcacgcagaccgccggaccctggcacctggggaagcttgagttggacttcgatctgtgcgaaggcaccactgtcgttgtggacgagcactgcggcaaccgagggccgagcctgcgaacgaccaccgtcaccggcaaaatcattcacgagtggtgctgcagatcctgcactctgccgccgctccggttcaagggggaggatggctgctggtatgggatggagatccgccccgtgaaggaaaaggaggagaacctcgtcaagagcatggtctcggccggctcgggcgaagtagactcgttctccctcgggttgctgtgcatcagcataatgatcgaggaggtgatgagatcccggtggtcaaggaagatgcttatgaccggcaccttagccgtcttttttctgctcatcatggggcaactgacatggaacgacctgatcaggctctgcatcatggtaggcgccaacgcttccgaccgcatgggtatgggcacgacttacctggccttaatggcaaccttcaagatgaggccgatgttcgctgtcggactcctgtttaggaggctgaccagccgcgaggtcctactgctgacaatagggctctcgctggtggccagtgtggaactgcccaactccctcgaggagctgggcgacgggttggcgatgggaatcatgattctcaagctcctgaccgacttccagagtcaccagctctgggcaacactgctctccctcacctttatccggacgacctttagcttgcactacgcctggaagacaatggctatggtgcttagcatcgtaagcctcttccccctgtgcttatccacaacgagccagaagaccacctggctccccgtcctgctgggatccctcggatgcaaaccactgacgatgttcttgatcgccgagaacaagatctggggccgcaaatcctggccccttaacgaagggatcatggccgtgggcatagtgagcatccttctgtccagcttactgaaaaacgacgttcctcttgccggtccgctcatagccggcggtatgctgatcgcttgctatgtcatctcaggcagctccgccgatctgagcctcgaaaaggcggccgtggtctcctgggaggaggaggccgaacactcaggcgcctcccacaacatcctggtcgaggtgcaggatgacggaacgatgaagatcaaggacgaggagcgagacgacaccctaactatcttgttgaaagcaacgctgctcgctgtaagcggcgtgtacccgctgtccattccagccaccctctttgtttggtacttctggcagaagaaaaagcagcgatccggggtcctatgggacacgcccagcccgcccgaggtagagcgggccgtcctcgatgacgggatctaccgcataatgcagcggggactgctgggtcgctcgcaggtcggggtaggggtttttcaggagaacgtttttcacaccatgtggcacgttacccggggcgccgtgttaatgtaccaggggaaacgcctggagccctcctgggcgagcgttaagaaggatctcatttcctatggcggcggatggcgccttcaagggtcttggaatactggggaggaggtccaggtgatagccgtcgaaccgggcaagaatcccaagaatgtgcagacggcccccgggacttttaaaacgtccgaaggcgaggtcggcgccatcgcgctggacttcaagcccggtacctctggtagccccattgtaaaccgggagggcaaaattgtggggctgtatggcaacggcgtagtcacaacttccggtacctatgtatcggcgatcgcccaggcaaaggccagccaggaggggcccctcccggagatcgaggacgaggtgtttcgcaagcgcaacctgaccatcatggatctacacccgggctcggggaagactcggcgctacctccccgcgatcgttcgggaggccataaagagaaagctgcgcaccctgatattagcaccaacccgggttgtggccagcgagatggcagaggcgctgaaaggcatgcccatccgctaccagaccacagccgtcaagagcgagcacaccggcaaggagatcgtggacctcatgtgccatgccaccttcaccatgagattgctgagccccgtgcgcgtccctaattacaatatgatcataatggatgaggcccacttcacggacccgagttccatcgccgcgagaggctatataagcacccgcgttggaatgggggaggccgccgccatcttcatgactgccacgccccccggatccgtagaggcgttcccccagagcaacgccgtcatccaggacgaggagcgggacatcccggagcgcagctggaacagcgggtatgaatggattaccgacttccccgggaagaccgtgtggttcgtgcccagcatcaagagcggcaacgacatagccaactgtctgcggaagaacgggaaacgtgtcatccagctttccaggaagaccttcgacaccgagtaccaaaagacaaagaacaacgactgggattacgtggtgaccaccgacatctcggagatgggtgccaacttccgtgccgatcgggtcatagatccccgacgctgtttgaagcctgtgatcctgaaggacggacccgagagagtcatcctggcgggccccatgcccgtcaccgtggcatccgccgcccaacggcgcgggcggatcggccgcaaccacaacaaggagggtgaccagtacatctacatggggcagccgcttaataatgacgaggaccacgctcactggacggaagccaagatgctgctcgacaatataaacacacccgaagggatcatacccgcgctgttcgagcccgaacgggagaagtccgccgccatcgacggggagtaccggttgcgtggagaggcgcggaaaaccttcgtcgaactgatgagacgaggggacttgccggtgtggctgtcatacaaggtggcctcggagggcttccagtacagcgaccgccggtggtgcttcgacggcgagcgcaacaaccaggtcctagaggaaaacatggacgttgagatctggaccaaggaaggggagcggaagaagctccggccccgctggctggacgctcgcacgtacagtgaccccctcgccttgcgggagttcaaggagtttgcagccggtcgccggagcgtatccggcgatctgattctcgaaatcggcaagctgccccaacacctgacccagcgcgcccagaacgccctcgacaatttggtaatgctgcacaacagcgagcagggcgggcgggcctacagacacgcgatggaagagctcccggacaccatcgagaccctgatgctgctcgcgttaatagctgtgctgacgggtggcgtgaccttatttttcctgtccggccgcgggctcggcaaaacctccattggcctcctgtgcgtcatggcctccagcgttttgttgtggatggcgtccgtggagccccattggatagcggccagcatcatcctggagttttttctgatggtcttgctgatccccgagcccgatcgtcagcggaccccgcaagacaaccagctggcctacgtggtgatcgggcttctgttcatgattctgaccgtcgcagccaacgagatgggcctcctggagacaaccaagaaggacctggggatcggccacgtcgcggtggagaaccatcatcatgccgccatgttagacgtcgacctgcaccccgcctccgcgtggacactgtacgcggtggccacaactattatcacacccatgatgaggcacacaatagagaacacaacggctaatatcagcctcacggcaatagccaaccaggcagccatactaatgggactggataaaggttggcccatttctaagatggatatcggcgtgccgctactggccctcgggtgttacagccaggtcaaccccctcaccttaaccgccgcggtactgatgctggtagcccattacgccataatcggcccggggctgcaagcgaaggccacgcgcgaggcccagaagaggaccgccgctggcatcatgaagaacccgaccgttgacggcatcgtggcaattgacctggacccggtagtctatgacgccaagtttgagaaacagctcggccagatcatgttgctcatcctctgcaccagccagatcctgctcatgcggaccacctgggcgctttgcgagagcatcacactcgccaccggaccactgacgaccctatgggaggggtccccgggcaagttctggaataccaccatcgccgtgagcatggcaaacatattccgggggagctacctagccggcgcaggccttgcgttctccctcatgaagtccttagggggagggcgcagaggcaccggggcccagggcgaaaccctgggcgagaagtggaagcgccagctaaaccaactttccaagagtgaattcaacacttacaagaggtccgggatcatggaggttgaccggagcgaagccaaagagggcctgaaacgcggggagaccacgaaacacgcggtctcccgcggcacggccaaactccgctggtttgtggagagaaacctagtcaagcctgagggcaaggtgatcgaccttggctgcggacgcggcggatggagctattattgtgccgggttaaagaaagtgaccgaagtgaagggttataccaagggcggccccggccacgaggagcctatccccatggcaacgtacgggtggaacctcgtcaagctgcactctggcaaggacgtgttcttcattccgcccgaaaaatgcgacacgctgctctgcgacattggggaatcttcccccaaccccaccatcgaggagggacgcactctgcgggtcctgaagatggtcgagccgtggctccgggggaatcaattttgcatcaagatactgaatccctacatgcccagcgtggtggagacgctggagcagatgcaacggaaacacggcggtatgttagtccgcaaccccctgtccaggaacagcactcacgagatgtattgggtatcttgtgggacgggcaatattgtgagcgcggtcaacatgacctcgcgcatgctgctcaaccgctttaccatggcgcaccggaagcccacgtacgaacgcgatgtggatctgggggccggcacccggcacgtggccgtcgagcccgaggtggccaacctggacatcatcggccaacgcatcgaaaatatcaagcacgagcataagagcacctggcactacgacgaggacaacccctacaagacctgggcctaccacgggtcctatgaggtaaaaccctccggtagcgcgtcatctatggtcaacggggtggtcaaattactaactaaaccgtgggacgtcatacctatggttacccagatcgcgatgacagacacgacacccttcggccagcagcgggtgttcaaagaaaaagtcgacacccggacccccaaagcgaaacgcgggaccgcccaaatcatggaggttaccgccaagtggctgtggggcttcctatcccgcaacaagaagcctcggatctgcacccgtgaggaattcacgcggaaggtccgcagcaatgcagctattggcgcagtgttcgtggacgagaaccaatggaactccgccaaggaagcggtagaagacgagcggttctgggatctagtgcatcgagagcgagagctccataagcagggtaaatgcgctacctgcgtgtataacatgatgggcaagcgcgagaagaagctaggcgaattcggcaaggccaaggggagccgagccatttggtacatgtggttgggcgccagattcctagagttcgaggctctcgggtttatgaacgaggaccactggttctcgcgggaaaacagcctctccggcgtcgagggtgaagggctgcacaagcttggctacatccttcgcgatatctccaagatccccggcggcaacatgtacgcagacgacactgccggttgggatacccggatcaccgaggacgatctgcagaacgaagccaagattaccgacatcatggagcccgagcacgccctcctagcgaagtccatcttcaagctaacgtaccaaaacaaggtggtgagagttcagcgcccggccaagaacgggaccgttatggacgtcataagccggcgcgatcagcggggctctgggcaggtcggcacctacggcctcaacacctttacgaacatggaggcccagctgatacgacagatggagagcgaagggatattctccccaagcgagcttgaaacccccaacctcgccggacgggtgctggactggctggagaagcacggggtggaacgcctaaagagaatggccatatccggcgatgactgcgtggtgaaacccatcgacgaccggttcgcgaccgcattaaccgccctgaacgatatggggaaggtacggaaggacataccgcagtgggaaccgagcaagggctggaacgactggcagcaggtccccttctgctctcaccattttcatcagctaatcatgaaggatggccgagagattgtggtgccctgccggaatcaggacgagctggtcggccgcgcccgggtcagtcagggcgccgggtggagtctacgcgaaacggcatgcctgggcaagtcctatgcccagatgtggcagctgatgtatttccataggcgcgaccttcgcctcgccgccaacgcgatatgttctgccgtgccggtcgactgggtgcctacttcccgcaccacgtggagcatacatgcccatcaccagtggatgaccaccgaggacatgctgtcggtgtggaaccgggtctggatcgaggagaatccctggatggaggacaagacccacatctcttcatggggcgacgtgccttacctggggaagcgtgaagatcagtggtgtggctccctcatcgggcttaccgcccgcgcaacatgggcgaccaacatacaggtggctatcaatcaagtccggaggctgctgggcaacgagaactacttagactatatgacttccatgaagcgattcaagaacgaaagcgacccggagggcgccctgtggtga

SEQ ID NO: 24476 - RNA, 9879 nt, synthetic construct
  misc_feature 1..9879: note = derived and/or modified CDS sequence (opt11) from DENV-1__HM181967__SS-prME
  source 1..9879: mol_type = other RNA
agtgtgaccatgctactaatgttaatgcccaccgccctggcgttccaccttaccacccggggcggtgagccacacatgatcgtgagcaagcaggagcggggcaagagcctgctgttcaagacctcggccggagtgaacatgtgcaccctcatcgccatggatctgggcgagttatgcgaggacaccatgacctacaagtgtccccgcattaccgagaccgagcccgacgacgtggactgctggtgtaacgccacggacacctgggttacttacggtacctgcagtcagacgggcgagcaccggcgcgataagagaagtgtagcgctcgcgccccacgtgggtctggggctggagacccggaccgagacttggatgagctccgagggcgcgtggaagcagatccagcgcgtcgagacttgggccctccggcaccccgggttcaccgtgattgccctgtttctggcacatgcgatcggcacctcgatcacccagaagggtatcatcttcattttactgatgctggtgacgccatccatggccatgcggtgcgtcggcataggctcacgcgatttcgtagaggggctctccggggccacctgggtggacgtcgtattggagcacgggagctgcgtaacgaccatggccaaagacaaacccaccttggacatcgagctactgaagaccgaggtcaccaatcccgccgtcctgcggaagctctgtatcgaggcgaagatttccaacaccaccacggacagccgctgcccgacacagggcgaggccaccctagtggaagagcaggacgccaacttcgtttgtaggcgcactttcgtggaccgcggctgggggaacggttgcgggctgttcggcaaagggagcctcatcacgtgcgccaagttcaaatgtgtgaccaaactagagggaaagatcgtccagtatgagaacctgaagtacagcgtgatcgtaaccgtccacacgggcgaccaacaccaggtggggaacgagtcaaccgaacacggcaccacggccaccatcacgccccaagcccccaccaccgagattcagctcactgactacggcgctctgacgctggattgctcgccgcgcacaggcctcgacttcaacgagatggtcttattaaccatgaaagagaaaagctggctcgtgcacaagcagtggttcctggacctaccgttgccctggaccagtggggctagcacgtcccaggaaacctggaatcgccaggaccttctggttacgttcaagactgcccacgccaagaaacaggaggtcgtagtgctcggcagccaagagggagctatgcacacggccctgaccggtgccaccgagatccagaccagcggcacgaccaccattttcgccggtcaccttaagtgccggctcaaaatggataagctgacccttaagggcatgagctacgtcatgtgtacggggtcgttcaagttggagaaggaagtggctgagacccagcacggcaccgtgcttgtccagataaagtacgagggaaccgacgcgccctgcaagataccattcagtacgcaagacgagaagggggtaacgcagaacggccggctgataaccgctaaccctatcgtgaccgacaaggagaagcccgtgaatatagaggccgagccacccttcggggagagctacatcgtgatcggcgccggggagaaggccctgaagttgagctggttcaaaaaggggtcgtctatcggcaagatgttcgaggcgaccgcccgcggggcccgtcggatggccatcctgggcgataccgcgtgggacttcgggtccataggcggcgttttcaccagcgtgggcaaactggtccaccagatcttcggtaccgcttacggggtactgttctccggcgtctcttggacgatgaagatcgggatcggcgtgctgctgacctggttggggctaaattcccgcagcacctccctgagcatgacctgcatcgccgtggggctcgtgacgctgtacctaggcgtgatggtacaggcggattccggctgcgtaatcaactggaaaggccgggagctcaagtgtgggagcggcatcttcgtaacgaacgaggtgcatacctggaccgagcagtacaagttccaagcagactcgccgaagcgcctatccgccgctatcggaaaggcctgggaggagggtgtctgcggcatccggagcgccacccgcctggagaacatcatgtggaagcagatttccaacgagctcaaccacatccttttagaaaatgacatgaagttcacggtggtcgtcggggacgtggccggcatcctcgcccaagggaagaagatgatccggccccagcccatggagtataaatacagctggaagtcctgggggaaggcgaagatcatcggcgccgacgtccaaaacaccacctttatcatcgacgggcccaacaccccggagtgtcccgacgaccagcgcgcctggaacatctgggaggtcgaagactatggattcgggatattcacgaccaacatctggctgaagctgcgtgacagctacacccaagtgtgcgaccaccgcctaatgtcagcggcaataaaggacagtaaggccgtacacgctgacatgggctactggatcgagagcgagaagaacgagacctggaaactggctcgggcgagctttatcgaagttaagacgtgcatctggcccaagtcccacaccctgtggtcaaacggcgtgctcgagtccgagatgatcatcccgaagatatacggagggccgatcagtcagcacaactaccgtccgggctacttcacccaggcggccgggccatggcacctgggaaaactggaactggacttcgacctgtgcgagggcaccacggttgtcgtggacgagcactgcggcaaccgggggccgtccttgcgcaccaccaccgtgacgggcaagatcattcacgagtggtgctgccggagctgtaccctgccgcccttgcgcttccgcggggaggatggctgctggtatggcatggagattcgccccgtcaaggagaaggaggagaacctggtaaagtccatggttagcgcgggcagcggcgaggtagactccttctcactcgggttactgtgtatctccatcatgatagaggaagtgatgcggagccgctggtcccggcgcatgctcatgaccggaacattagccgtgtttttcctgttgatcatgggtcaactgacgtggaacgacctcatccgcctctgtatcatggtcggcgcgaacgccagcgaccggatggggatgggcacgacctacctggctctgatggctaccttcaaaatgcgcccgatgtttgccgtgggcctcctttttcggcgcctcacgtcccgggaggtgctactgctgactattgggctcagcctggttgcgtccgtggagctgcccaactctctcgaagagctgggcgacgggcttgccatgggcatcatgatcctcaagttgctgaccgacttccagtcccaccagctctgggccacccttctgagcctcacgttcatcaagaccaccttctccctccactatgcgtggaagaccatggcgatggtcctgtcaattgtgtccttgttcccgctctgcctgagcaccacctcacagaagacaacttggctcccagtgctgctgggcagcctcggctgcaagccgctgacgatgttcttgatcgctgaaaacaagatctggggccgccggtcctggcctctcaacgaggggataatggccgtcgggatcgtgagcatcctgttgagctctctcctgaagaatgatgtgcctctggccggccccctaatcgccggcggcatgctgatcgcttgctacgtcataagcggctcgagcgccgacttgtctctcgaaaaggccgccgaggtgagctgggaggaggaggccgaacactccggcgctagccacaacatcctggttgaggtccaggacgacgggaccatgaagatcaaggacgaagagcgagacgacaccctaacgattctcctgaaggccaccctgctcgctgtgtccggtgtgtatcctcttagcattcccgccacgcttttcgtctggtatttttggcagaagaaaaagcagagatccggggtgctctgggacacccccagcccgcccgaggtggagagggccgtcctggatgacggcatctacaggatcatgcagcgcggtctgttagggcggtcacaagtgggcgtgggggtcttccaggagaacgtgtttcacaccatgtggcacgtcacccgcggcgcggttttaatgtaccaggggaaacgactagagccctcgtgggcctccgtgaagaaggacctgattagctacggtggcgggtggcgcttacagggcagctggaatacgggagaggaggtgcaggtcatcgccgtggagcccgggaagaacccgaagaacgtgcagaccgccccaggtaccttcaagacccccgaaggcgaggtgggcgccatcgcgctggacttcaaacccgggacgagtggctcacccatcgtgaaccgggaggggaagatcgtgggcctgtacggcaacggtgtcgttaccaccagcggcacttacgtgtctgccatagcccaggcaaaggcgtcccaggaagggccgttacccgagattgaggacgaggtcttccgcaagcggaacctgacgatcatggacctgcaccccggaagcggcaagacccggcggtatctaccggccatcgtccgagaggccataaagcgcaagctgcggaccttgatactcgcccccacccgcgtcgtagcttccgagatggctgaggccctgaaaggcatgcccatccgttaccaaacgactgcggtcaagagcgaacacaccggcaaggagatcgttgacttaatgtgccacgcaacattcacgatgcgcctgctgtcgcccgtccgggtgcccaactacaacatgatcatcatggatgaagcgcacttcaccgaccccagctccatcgccgcgcgtgggtatatctctacccgggtgggcatgggggaggcggcagcgatctttatgaccgcgacgccgcccggctccgtcgaggctttcccccagagcaatgctgtgatccaggacgaagagcgcgatatccctgagagatcctggaacagcgggtacgaatggataaccgatttcccggggaagacggtgtggttcgtcccaagtatcaagtcaggcaacgacatagccaactgcctgcgcaagaacgggaagcgagtgatccaactctcccgcaaaacctttgacacggagtaccagaaaaccaagaacaacgattgggactacgtagtcaccactgacatcagcgagatgggcgcgaacttccgggcggacagggtcatcgacccacggcgctgcctgaagcctgtaatcctgaaggacgggcccgaacgggtcattctcgccggtcctatgccggtcacggtcgcttccgctgcgcagcgcaggggacgcatcggaaggaaccacaacaaggaaggagaccaatacatctacatgggccagcccctgaataatgacgaggaccacgcacactggaccgaagccaaaatgcttctcgacaacatcaacacccccgagggtatcattcccgccctgtttgagccggagcgggagaagtcggccgcgatcgatggcgagtatcgcttgcggggcgaggcccgcaagaccttcgtggagctcatgaggcgcggggacctgcccgtgtggctgtcatacaaggtcgcgtctgagggtttccagtacagcgaccggagatggtgtttcgacggggagcggaacaatcaggtgttagaggagaacatggacgtggagatctggacgaaggagggggagcgcaagaagctacggcccaggtggctggacgcccggacttactccgaccccttagcactccgcgagtttaaggagtttgccgccggccgtcgcagcgtctccggagaccttatcctcgagatcggaaaattgccgcagcaccttacccagagggcccagaacgccctcgacaatctggtcatgctgcacaacagcgagcagggcgggcgggcgtaccggcatgccatggaggagttgccggacaccatcgagacgctgatgttgctcgcccttatcgccgtcctgaccggcggggtcaccctgttcttcttgagtggccgcgggttgggtaagacctccatcggcctcctgtgcgtgatggcctccagcgtgttactctggatggcgagtgtagagccccattggatcgcagcgtctatcatcttagaattcttcctgatggtgctcctcatacccgaaccggaccggcagcgtacgccccaggataaccagttagcgtacgtagtaattggcctactgttcatgatcctgaccgtggccgcgaacgagatgggtttactggagaccaccaagaaggacctggggatcggccacatggccgttgaaaaccaccaccacgccgctatgctcgacgtggacttacatcccgcctccgcgtggaccctctacgccgtggcaacgaccatcatcaccccgatgatgcgccataccatcgagaacaccaccgccaacatttcccttacagccatcgcgaaccaggccgccatccttatggggctggacaaaggctggcccatctccaaaatggatatcggcgtgcccctcctggccctgggttgctacagccaggtcaaccccctgaccctgacagcggccgtcctgatgctcgtagcccactacgcaatcatcggcccggggctgcaggccaaggccacccgggaggctcagaagcggacagccgccggcatcatgaagaaccccacagtcgacgggatcgtagccattgacctggatcccgttgtctacgacgcgaagttcgagaagcagctcggccaaatcatgctactgatactctgtacgagtcagatactattaatgcggaccacctgggccctctgcgagagcataaccctagccacgggccccctgaccaccctctgggaaggttccccgggtaaattctggaacaccacaatcgccgtgagcatggcgaacatcttccgtgggtcctacttggctggggccggcttggccttctcgctcatgaagtccctcgggggcggtcggcgaggtaccggggcccagggcgaaaccctaggggaaaagtggaagaggcagctaaaccagctgtccaagagcgagttcaacacctacaagcgctcagggattatggaggtggaccggtctgaagcgaaggagggcctgaagcggggggaaacgacgaaacatgcggtctcccggggcaccgcaaagctacggtggttcgtggaaaggaacctagtgaagccagaggggaaggtcatcgacctgggctgcggccgaggaggctggtcatactattgcgccgggctaaaaaaggtgaccgaggtcaagggctacaccaagggtggccctggccacgaagagcccatccctatggccacctacgggtggaacctcgtcaagctgcactccggcaaggacgtgttcttcattccgcctgagaagtgcgacaccctgctatgcgacattggagagagctcccccaatccaaccattgaggagggccggacgctccgagtactgaagatggtcgagccttggctccgggggaaccagttctgcatcaagatacttaacccctacatgcccagcgtggtggagaccctggaacagatgcagcgcaaacacggcggaatgttggtccggaacccgctgtctagaaacagcacccacgagatgtactgggtgtcttgcgggaccggcaacatcgtgagcgcggtcaacatgacctccagaatgctgctcaaccgatttacgatggctcaccgtaagcctacctacgaacgggatgtggacctcggtgccggtactcgccacgtggccgtcgagccggaggtggccaacctagatatcatcggccaaaggatagagaacatcaagcacgaacacaaatcaacctggcattacgacgaggacaacccatacaagacttgggcgtaccacgggagttacgaggtaaaaccgagcggctccgcgagcagtatggtcaatggggttgtcaagctcctgaccaagccctgggacgtcatcccaatggtgacccagatcgccatgaccgacacgaccccgttcggacagcagagagtcttcaaggagaaggtggacaccagaaccccgaaggcgaaaagagggacggcccagatcatggaggtgaccgctaagtggctgtggggcttcctatccaggaacaaaaagcctaggatctgcacccgtgaagagtttacccgcaaggtgcgtagcaacgccgccatcggggccgtgttcgtggacgagaatcaatggaactccgccaaagaggccgtcgaggacgagcggttttgggacctggtgcaccgggagcgcgagcttcataagcaggggaagtgcgccacgtgcgtgtacaacatgatgggtaagcgggagaagaagcttggtgagttcggcaaggcaaaagggagccgcgccatctggtatatgtggttgggggcgcggttcctagagttcgaggctctcggcttcatgaatgaggaccactggttctcccgcgagaacagcctgagcggagtagagggggaggggctgcacaagctcggatacatcctgcgggacatcagcaagatccccggcggcaacatgtacgctgatgatactgccggttgggatacccgcatcaccgaggacgacctgcagaacgaggcccgtatcacggacatcatggagccggagcacgcgctcttagccaagtccattttcaagctgacctaccagaacaaggtggtgcgggtccaacgccccgccaaaaacgggactgtgatggacgtgattagccggcgcgaccagcggggctctgggcaggtcggcacctacgggctcaacacgttcaccaacatggaggcccagctgatccgacaaatggagagcgaggggatcttcagtcccagcgagctggagacccccaatctcgcagagagggtgctggactggctggagaaatatggcgtggagcgacttaagcggatggctatctccggggacgactgcgtcgtgaagcctatagacgatcgcttcgccaccgccctgactgccctgaacgatatgggcaaggtgcggaaggacatccctcaatgggagcccagtaaggggtggaacgactggcagcaggtcccgttctgctcgcaccactttcatcagctcattatgaaagatggccgtgagatcgtggtgccgtgtcggaaccaggacgagctggtcggccgagcacgcgtgtcacaaggagcgggctggagcctgcgtgaaaccgcctgcctcgggaagagctacgctcagatgtggcagctgatgtacttccaccggcgcgacctgcggctcgccgctaacgccatctgcagcgccgtgccagttgactggatccccacttcccgaaccacctggagcatccacgcccatcaccagtggatgaccaccgaggatatgctgtccgtctggaaccgcgtgtggatcgaggaaaacccctggatggaggacaagacccacatcagctcctggggcgacgttccgtatctggggaagcgagaggaccagtggtgcgggtcactcatcggccttacggcacgcgcgacctgggccaccaatatccaagtggccatcaaccaggtgcggcgactgatcgggaacgagaactacctcgactacatgacatccatgaagcggttcaagaacgagagcgaccccgagggcgccctgtggtga

SEQ ID NO: 24477 - RNA, 9879 nt, synthetic construct
  misc_feature 1..9879: note = derived and/or modified CDS sequence (opt11) from DENV-1__GU131768__SS-prME
  source 1..9879: mol_type = other RNA
agcgtaacgatgctcctcatgctgatgccaaccgcactcgcgttccacttgaccactaggggtggggaaccccatatgattgtgacaaaacaagaacgagggaaatcgctcctgtttaaaacgtccgcaggagtcaacatgtgcaccctaatagcaatggacctgggggaactgtgcgaagacacgatgacgtacaagtgcccaaggattaccgaagcggagccggatgacgtggactgctggtgcaatgcgacggatacatgggtcacgtacggaacctgcagccaaaccggcgaacataggcgagacaagcgcagcgtcgccctagcaccccatgtggggctaggcttagaaacgcggactgagacctggatgagctcggaaggcgcctggaaacaaatccaaagggtggagacctgggcgctgcgccacccaggctttacagtgatagccctgttcctcgcccatgccatcggcaccagcattacccaaaagggaatcatctttatcctcctcatgctagttacgccatctatggccatgcgatgtgttgggatcggctcaagagacttcgtggaggggcttagcggggcgacctgggtagacgtcgtccttgagcacggctcatgcgtaacaaccatggccaaggataagccaacgctggacatagaactcctcaaaactgaagtcactaaccccgcagttctacggaagctctgcatcgaagcaaaaataagcaacacgacaactgactcacggtgccccacccaaggagaagccacgttaatggaggagcaagacgcgaacttcgtatgcagacgcacgttcgtagacagaggctgggggaacggttgcggactctttgggaaaggctcactaataacgtgcgctaaattcaaatgtgtaaccaaactggaaggcaagatcgtgcaatacgagaatcttaagtattccgtgatcgtgacagtccacacgggagaccaacatcaagtgggaaatgaatcgacggaacacggcacaaccgcaacaataacgccacaagcccccaccagcgagattcaattaaccgactacggagcgttaactcttgactgcagccctaggacaggcctagattttaacgaaatggtcttgttgacgatgaaagagaaatcctggctcgtacacaaacaatggttcctagacctaccgctgccgtggaccagcggagccagcacctctcaagagacgtggaaccgccaagatctcctcgtaacctttaaaacagcacacgccaagaagcaagaagtcgtagtactaggatcacaagagggcgcgatgcacacggcgctgacaggggctactgagatacaaacaagcggtacaacgaccatatttgctggccacctgaaatgtagacttaagatggataaactcacactcaaggggatgtcgtatgtaatgtgcacaggttcattcaagctagaaaaggaagtcgcagagacgcaacacggtacagtactggtacaaatcaagtatgaagggacagatgctccctgtaagatcccattttcaacacaagacgaaaaaggggtgacacaaaatggcagactgatcaccgccaaccccatcgtaaccgacaaagaaaaacctgtgaacatcgaagccgaacccccgtttggggaaagctatatcgtgataggcgcaggggaaaaagccctcaagctatcgtggttcaagaaaggctcatccatcggcaagatgttcgaggcaactgcacggggagccaggcgaatggccatactcggggacactgcctgggacttcgggtctgtaggaggcgttttcacttcagtggggaagctagtccaccagatcttcgggaccgcgtacggcgtcttattttctggagtgagttggacgatgaagattggaatcggtgtgctcctgacatggctgggcttaaactcgcgcagcacttccttgagcatgacctgtatagcggtcggattagtcacgctatacctgggggtcatggtacaagccgacagtggctgcgtcattaattggaaaggaagggaactaaagtgtggctcgggcattttcgtgactaatgaagtgcacacatggacagaacaatacaagttccaggccgacagcccgaaaaggctctcagccgccatcggaaaggcctgggaggagggggtctgcggaatacgaagcgctacaaggctagaaaacatcatgtggaaacagatatccaatgagctaaaccatatattgttagaaaatgacatgaaattcactgtcgtagtcggagacgtcgttggaatactcgcccagggcaagaagatgataagaccacagcccatggaacacaaatatagctggaaatcatggggaaaggctaaaatcataggagccgacgtccagaacacaacattcataatagacgggccaaacaccccggaatgccctgatgaccaacgcgcgtggaacatctgggaagtcgaagactacggattcggtatttttacaaccaatatttggcttaagttacgagacagttacacgcaagtttgtgaccaccgcctcatgagcgccgcgataaaagacagcaaggcagtacatgcggacatgggctactggatcgaaagcgagaaaaacgaaacgtggaaactagcccgcgccagcttcatcgaggttaaaacatgcaactggccgaaaagccacaccctgtggagtaacggcgtactcgagtcggaaatgatcataccaaaaatctatggaggcccgatctcacagcacaactacaggccgggatactttacacagacagcgggcccctggcacctcggaaaactggaactagatttcgacctctgtgaaggcaccacagtcgtcgtggacgagcactgcggaaatcgagggccctcactaaggacaacaacagttaccgggaaaataattcacgaatggtgctgcaggtcctgcacactaccaccactacgcttcaaaggcgaagacggatgctggtacggcatggaaataagacccgtaaaggagaaggaagagaatctggtaaagtcgatggtgagcgcaggaagcggagaagtagacagcttctcgttagggttattatgtatcagcataatgatcgaagaagtcatgagaagccggtggagccgaaaaatgctaatgacgggcaccctagcagtattcctattactaattatgggccagctcacctggaatgacctaatccgactatgcataatggtaggagctaacgcatctgacaggatgggaatggggaccacatacctagcgctaatggctacatttaagatgcgaccaatgttcgccgtcgggctcctgttccgcaggcttacgtcccgagaagtattactacttactatcggccttagcctcgtcgcctcagtcgaactgccaaattctctggaagaacttggcgatggtctagcaatgggtattatgattctgaaactcctaactgatttccagtctcaccaactctgggccacgctgctgtcgcttacatttataaaaacgacactaagcctgcactatgcctggaaaaccatggccatggtgctctccattgtatccctatttccactgtgtctttccacaacctcccagaaaacaacctggctaccagtgttgctggggtcgctgggctgcaagcccctcaccatgttcctcatcacagaaaacaaaatctggggacggaaatcatggccccttaatgaaggtattatggccgtgggcgtagtgtcgatcctcttaagcagcctactgaaaaacgatgttcccttagcgggaccactgatcgccggcggcatgctgatcgcgtgttatgtcatatcgggtagcagtgctgacctctcattggaaaaagccgcagaagtaagctgggaggaagaggcagagcacagtggggcctcgcataacatcctggtagaggtgcaagacgacggaacgatgaagatcaaagacgaggaacgagacgatacgctaacaatactcctcaaagcgaccctattggccgtatcgggcgtgtacccactatcgatacctgcaacactcttcgtatggtacttctggcagaaaaagaaacagagatcaggcgtcctatgggacaccccatcccctccagaggtcgaacgggcggtcctagacgacgggatctaccgtattatgcaacgtggcctcctgggacggagtcaggtgggtgtcggtgtgttccaagagaacgtgttccacacaatgtggcatgtaacaagaggggcagtcctcatgtaccaaggaaaacgccttgagccgtcctgggccagcgtgaagaaagatctaattagctacggcgggggatggcgactgcaaggaagctggaacaccggagaagaagttcaagtcatcgcggttgaaccagggaagaacccgaaaaacgttcaaacagcccccggcacattcaaaactccggagggcgaggtaggcgccatcgcgctcgatttcaaacccggaacgagcggatcgccgatcgtgaaccgcgaaggcaaaatagtggggctgtacggcaatggagttgtaactacgtccggaacttatgtatccgcgatagcccaggctaaagccagtcaggaaggaccacttcccgaaatagaagacgaggtcttcagaaaacgaaatctcacaataatggatctccacccaggcagcggaaaaacacgtcggtatctaccggccatagttcgggaggccatcaaacgcaaactcaggaccttaatcctggctccaacccgtgtcgtggccagcgaaatggccgaggccctaaagggaatgccgatacgctaccaaacgaccgcggtaaaatcagaacacaccggaaaagaaatagtagacttaatgtgtcacgccacattcacaatgagactgctcagccccgtacgggtgcctaactataatatgatcatcatggacgaagcacacttcacagacccaagctcaatagctgcaaggggttatatcagcacgcgagtcgggatgggcgaggctgcagcaatcttcatgacagcgacaccacccgggagtgtcgaagcgttcccccaaagtaatgctgttattcaggacgaagaacgagacatccccgaacgaagctggaacagcggctatgaatggataacagacttcccaggaaagacagtttggttcgtgccgagtattaagtcgggcaatgatatagcgaactgtttgcgtaaaaacggtaaaagagtaatccaattaagtcgtaaaacgttcgatacggaataccagaaaaccaaaaataacgattgggactatgttgtaacaactgacatatcagagatgggagccaattttcgagcagaccgagtaatcgacccacgaagatgtctgaagccagtaatcctgaaggacggccccgagagggttatcttagcaggtccaatgccagttacggtggccagcgcagcccagcgacggggacgtataggccgaaaccacaacaaggaaggagaccaatatatatacatgggtcaaccgctaaacaacgacgaggaccatgcgcattggaccgaagcgaagatgctcttagacaacataaacaccccagaaggaataatacccgccctgttcgaaccagaaagagagaaatcagccgctatcgacggggagtatcgactccggggcgaagcccggaaaacattcgtcgagctaatgaggagaggggacctaccagtatggctaagttacaaggtagcgtcggagggctttcagtactccgacagaagatggtgtttcgacggcgaacgcaacaaccaggtactcgaggagaatatggacgtagagatttggaccaaagaaggcgagcgcaagaaactgcggcccaggtggctagacgcacggacctacagcgatccgctagccctcagggagttcaaagaatttgccgcgggacgaaggagcgtatcgggcgacctcatcctagagattggtaaactcccacaacatctaacccaacgggcgcagaacgcactggacaacctggtaatgctacacaacagcgagcaagggggccgggcttatagacacgccatggaagaactaccggacaccatcgagactcttatgctattagcgctgatcgcagtcctaaccggtggggtcacactattcttcctatcaggccgcggactcgggaagacgagcataggcctcttatgcgtcatggcgagtagcgtgctcctgtggatggcaagtgtggaaccccattggatcgctgcatcaataatattggagttcttcctcatggtcttactcataccagaacctgacagacagagaaccccgcaagacaatcaactcgcatatgtagtaatcgggttattgtttatgatactcaccgtcgccgccaacgagatggggctccttgagaccacaaagaaagacctagggatagggcacgtcgcggtggagaatcaccaccacgcaacgatgcttgacgtggacttacacccagcctccgcttggacactatatgcagtagcgacaacgataataacgccaatgatgcggcacacaatagaaaacacaaccgcgaatatatcactcactgccattgccaaccaggcggcaatactcatgggtcttgacaaaggctggcccatatcgaaaatggacataggcgttccgctgctcgcgctaggctgctattcacaagtaaacccactcacactgacagcggccgtactaatgctagtggcccattacgcaatcataggcccagggctccaggcaaaggcaacccgagaggctcagaaaaggacggctgcgggcatcatgaagaacccaaccgtagacgggatcgtcgcgatagatctcgacccggtagtgtacgatgcaaaattcgagaaacaactcggtcaaatcatgctgctcatactatgcacgtcgcaaatactgctcatgcgaacgacctgggcattgtgcgaatcgataaccctagcaacgggcccgctaacgacactatgggaaggatctcccggcaagttctggaacacgaccatagccgtgagtatggcgaacatcttccgtgggtcatacctagcaggggctgggctcgcgttttccctcatgaaatccctaggaggagggcggagagggacaggggcacaaggcgaaacgctaggggagaaatggaagcgacaactgaaccagctctctaagagcgagtttaacatctacaaaaggagcggaatcatggaagttgacaggagcgaagcaaaagaggggctgaaaaggggagaaaccacccggcacgcggtctcgcgtggaacagccaaattgcgctggttcgtggaacgcaatctggtgaagcccgaaggaaaagtcatagaccttggatgtggacgaggaggctggagctactattgcgctggactaaagaaagtaaccgaagtaaagggctatacgaaaggcggaccaggtcatgaggagccaatccccatggcgacatacggttggaacctggtcaagctccactcaggcaaagacgtatttttcacgccacccgagaaatgcgataccctactatgcgatataggagaatcgtccccaaacccaacaatagaagaaggaagaaccctaagagttctaaaaatggtggaaccatggctgcggggaaaccagttctgcataaaaatactcaacccctacatgcccagcgtagtcgaaacactggaacaaatgcagaggaaacatggaggtatgctagttcgcaacccgctgtcgagaaattcgacccatgagatgtactgggtaagttgtgggaccgggaacatagtatcggcagttaatatgacatcaaggatgttactcaatagattcacgatggcacatcgcaaaccgacgtacgaaagagacgtggacctgggagcaggaacaagacatgtcgccgttgagccagaggtcgcaaacctggacatcatcggccagaggatagagaatattaaacatgaacacaaatcaacatggcactacgatgaggataacccatacaagacctgggcgtatcatggctcctacgaggtcaaaccgtccggcagcgcatcctccatggtcaatggcgttgtcaaactactaaccaagccgtgggatgtcataccaatggttacccaaatcgcgatgacagacacgacgccattcggacaacaaagggtcttcaaagagaaagtagataccaggaccccgaaagcaaagcgaggaacagcacagatcatggaggtcaccgcgcgatggctgtggggatttttgtcgcgaaacaagaaaccgaggatatgcacgcgcgaggagttcacccgcaaagtacgcagcaacgccgcaattggcgccgttttcgtggacgaaaaccagtggaacagcgcaaaagaagcagtcgaagacgaaagattctgggacctcgttaagaaagagcgagagttacacaagcagggcaaatgcgcaacatgcgtgtacaacatgatggggaaacgagagaagaaactcggagagttcggcaaggccaagggaagccgagcgatttggtacatgtggctgggtgctcgcttcttggagttcgaagcactgggcttcatgaacgaggaccattggttttcccgcgaaaattcactcagtggtgttgaaggcgaaggactacataagttggggtacatcctaagagacataagcaagataccaggaggtaacatgtacgcagacgacactgctgggtgggacacccgcatcaccgcggacgaccttcaaaacgaagcgaagatcacggatattatggaacccgagcacgcactacttgcaacttctatcttcaagctcacctaccagaacaaggtagtccgagttcaacgtcctgccaagaacggtaccgtaatggacgtgatttcacgaagagaccaacgagggagtggacaagtcggaacatatggactcaacacgttcactaacatggaggcccaactaatcagacagatggagtccgaaggcatattcctaccatctgaactggagacacccaacctggcggaacgagtcttagattggttagaaaaatacggggttgagagactgaaacgcatggctatatcaggagacgattgtgtggtcaagccaatagacgatcggtttgcgacggcactaacggctctcaacgacatgggaaaagtccgtaaggacattccgcaatgggaaccaagcaaaggatggaacgattggcaacaggtacccttctgtagtcaccacttccaccaacttattatgaaagatggtagggaaatagtagtaccctgccgaaaccaagacgagctcgtgggacgcgccagagtcagccaaggcgcggggtggtcactaagggagactgcctgcctagggaaaagctacgcacagatgtggcaactcatgtactttcaccgacgagatctccgactagcagcaaacgcaatctgtagcgcggtcccagtggactgggtaccgacttctcgaactacctggagcatacacgcacatcaccaatggatgaccacagaagacatgttaagcgtatggaaccgtgtttggatcgaggagaatccttggatggaagacaagacccacgtaagctcgtggggagacgtcccatacctgggtaaaagggaagaccagtggtgtggcagtctaattggcctcaccgcgagagccacctgggccagcaacatccaagtagcgataaaccaggtacgtcggctcataggtaatgaaaactacctcgactatatgacatccatgaaacggttcaaaaacgaaggagacccggaaggggctctgtggtag

SEQ ID NO: 24478 - RNA, 9879 nt, synthetic construct
  misc_feature 1..9879: note = derived and/or modified CDS sequence (opt11) from DENV-1__GU131770__SS-prME
  source 1..9879: mol_type = other RNA
tcggtgaccatgctgctcatgctgatgcctacggccctggccttccacttaaccacccggggaggagaaccccacatgattgtgagcaagcaggaacggggcaagagcctgcttttcaaaacgagcgccggggtcaacatgtgcaccctcatcgctatggatctcggcgagctgtgcgaggacactatgacctacaaatgcccccggataaccgagaccgagccagacgacgtagactgctggtgcaacgccacggacacctgggtgacctacgggacgtgtagccagactggcgagcaccgtagagacaagcggtccgtggccctcgcgcctcacgttggcctggggctggagacccggaccgagacctggatgagctccgagggcgcctggaagcagatccaaagagtcgagacgtgggcactccgccatcccgggtttaccgtcatcgccctgttcctggcacacgcgatcggcacctcaatcacccagaaggggatcatcttcatactactgatgctggtgacaccgtctatggccatgagatgtgtgggcatcggcagccgagacttcgtggaagggctctcgggcgccacctgggtggacgtcgtactggagcacgggagctgcgtgaccactatggccaaggacaagccaacgctggacattgagcttctaaaaaccgaggtcaccaaccccgctgtgctgcggaaactctgcatcgaagcgaagatctcgaacacgacgaccgacagccgctgcccgacccagggcgaggcgaccctggtggaggagcaggacgccaactttgtctgccgccggacctttgtggatcggggctgggggaacggttgcgggctgttcgggaaggggtccctcatcacgtgcgccaagttcaagtgcgttaccaaactggagggcaagatcgtccagtacgagaacctgaagtatagcgtgatcgtaaccgtccacactggcgaccagcaccaggtagggaacgagtccaccgagcacggcacaacagctacgatcacgccacaagcgcccaccactgagatccagctcaccgactacggggccctgacgcttgactgcagcccgaggaccggcctggacttcaatgagatggtcctgctgactatgaaggagaagtcttggctcgtgcacaagcagtggttcctggacctacccttaccatggaccagcggggccagtacgtcccaggagacctggaatcggcaggacttattagttacattcaagacagcccacgccaaaaagcaggaggtggtggtgcttgggtcgcaagaaggcgctatgcacacggcactgaccggggccaccgaaatccagacctccggtaccaccaccatcttcgccgggcacctgaagtgtcgcctcaaaatggacaagctgaccctgcggggcatgagctacgtcatgtgcacgggttccttcaaattggagaaggaggttgccgagacccagcacggcaccgtgctggtccagatcaagtacgagggcaccgacgcgccatgtaagatccccttctcaacgcaggatgaaaagggggtgacccagaacggccgtctgatcactgccaacccgatcgtgacggacaaggagaagcccgtgaacatcgaagcagaaccgcccttcggggagtcttatatagtgatcggtgccggagagaaggcgctgaagctaagttggttcaagaaagggtcatcgatcggcaagatgttcgaggccacggcccgcggggcccgacgcatggccatcctcggcgacaccgcctgggacttcggatccatcggcggcgtgttcactagcgtcggtaagctagtgcatcagatcttcggcacggcctacggggtgctattctcaggcgtcagctggacgatgaagatcggtatcggcgtgctactaacctggctcggcctgaactccagatctacctcccttagcatgacctgcatcgccgtgggcctcgtcacgctgtatctgggcgtgatggttcaggcggattctgggtgcgtcataaactggaagggccgcgagttaaaatgtggtagtggcatcttcgtgacaaacgaagtacatacctggactgaacaatacaagtttcaggccgacagcccgaagcggttgtccgctgccataggcaaggcttgggaggagggggtctgcggaatccgcagcgctacccggctcgagaatattatgtggaagcagatttctaacgagctcaatcacatcttgctggaaaacgatatgaagttcaccgtggtggtgggggacgtggccggcatcctcgcccaagggaagaagatgatccgcccacagcccatggagtacaagtacagttggaagtcctggggcaaggccaagatcatcggcgccgacgtgcaaaacacaacgtttatcattgacggaccaaacaccccggaatgcccagacgaccagcgggcctggaacatctgggaggtcgaagactacgggttcggaatctttacgaccaacatctggcttaagctgcgcgacagctacacccaggtgtgcgaccaccgcttgatgtccgcggccatcaaggattcgaaggcagtgcacgcggacatgggctactggatcgagtcagagaagaacgagacttggaaactggcccgcgcgagtttcatcgaggtcaaaacgtgcatctggcccaagtctcacaccctgtggagcaacggcgtgctcgagtccgagatgatcatcccaaagatttacggcggcccgatcagccaacataactacagacccgggtacttcacccagactgccggcccatggcacctgggtaagctggagctcgacttcgatttatgcgaggggaccacagtggtcgtggacgaacattgcggaaaccgcgggccgtcccttcggaccacgacggtgactggaaagataatccatgagtggtgctgccgcagctgcactctgccacccctccggtttcgcggggaggacggctgctggtacggtatggaaatacggcctgtcaaggagaaggaagagaacctggtgaagtccatggtgagcgcgggcagcggggaggttgactccttcagcctcgggctgctgtgcatctccataatgatcgaagaggtgatgaggagccggtggtcccgtaagatgctcatgaccgggacgctggccgtgttcttcctgctcatcatggggcagctgacctggaacgacttgatcagattatgcatcatggtcggcgcaaatgcgagcgaccggatggggatgggaactacctacctggcactgatggctacgttcaagatccgcccgatgttcgccgtcggcttactgttccgacgcctgacctcccgggaggtgctcctgcttaccataggtctcagcctcgtggcctccgtggagctgccgaacagcctcgaggaactgggcgacgggctggcgatgggcattatgatcttgaagctcctcaccgacttccagtcccaccagctctgggccacgctgctatcacttacatttataaagacaaccttctccctgcactgcgcctggaagactatggcaatggtcctcagcattgtgagcctcttcccgctatgccttagcactacctcccagaagacaacgtggctccccgtcctactgggctctttgggttgcaagccgctgaccatgttcctgatcgctgagaacaagatctggggtagacgatcttggccgctcaatgagggaatcatggccgtcgggatcgtgagcatccttctgagctccctcctgaagaatgatgtgcccctggccggcccccttatcgccggcggaatgctgatcgcgtgctacgtcatcagcgggtcctcggctgacttgtccttagagaaggccgcggaagtgagctgggaggaagaggcggagcactcgggcgccagtcacaacatcctggtggaggtccaggatgacgggaccatgaaaataaaggacgaggagcgcgacgacaccctgacaatcctcctcaaggctacgttactcgcagtgtcgggcgtctacccactgagtatccccgccactctgttcgtctggtacttctggcagaagaagaagcaacggtccggagtgttatgggacacccccagcccgccagaggttgagcgagccgtactggacgacgggatctacaggatcatgcagcgcggcctgcttgggcggtcccaggtcggcgtaggggtgttccaagagaacgtgttccacaccatgtggcatgtcacgcgcggcgctgtcttaatgtaccaggggaagcggcttgagcccagctgggcgtccgtcaagaaagacctgatcagctacggcggcggatggcgcctccagggttcctggaacaccggggaggaggtccaggtcatcgccgtggagcccgggaaaaatcccaagaacgtgcagaccgcgcccggaaccttcaagacgccggagggcgaggtcggcgccatcgccctggacttcaagcccgggaccagcggcagtcccatagtgaaccgggaagggaagattgtgggcctgtacgggaacggggtcgtgaccaccagcggcacgtacgtgagcgcgatcgcgcaggccaaggcttcccaggaggggccgctccccgaaatcgaggatgaggtctttcgcaagcggaacctcaccatcatggatttgcaccccggcagcgggaagacccgcagatacctgccggcgatcgtgcgcgaggccatcaagcgtaagttgcgcacactgatactcgcccccacgcgcgtggtcgcctccgaaatggcggaggcgctgaaggggatgccgatacgataccaaacgaccgcggtaaagagcgagcacaccggcaaggagatcgtggacctgatgtgccacgccacgttcaccatgcgtctcctctccccagtccgggtgccaaactacaacatgataatcatggacgaggcccacttcaccgacccctcttcgatcgccgcgcgcgggtatatcagtacccgggtgggcatgggagaggcggccgccatcttcatgacggccacgccgcccggctccgtcgaggcattcccgcaaagcaacgccgtgattcaggacgaggagcgtgacatcccagagagatcgtggaactcaggatacgagtggatcaccgacttccccggcaagaccgtgtggttcgtcccctccataaagtcagggaacgacatcgccaactgcctgcggaagaacgggaagcgggttatccagctctcacgcaagacgttcgacaccgagtaccagaagaccaagaacaatgattgggactacgtagtaacaacggacatcagcgagatgggagccaacttccgggcggaccgcgtgatagacccacgacgctgcctgaagcccgtcatcctgaaggacgggccggagcgggtcatcctcgccggccccatgccagtgaccgtcgcatccgccgcacagcgccgggggagaatcgggcgcaaccacaataaagagggtgaccagtacatctacatggggcagcccctgaacaacgacgaagaccacgcgcattggactgaagccaagatgctgctcgacaacataaacacccccgagggcataatacccgccctgtttgagccggagcgggagaagtccgccgccatagacggggagtaccgcctgcgaggcgaggcgcgtaagacgttcgtagaattaatgcggcgcggggacctgcccgtgtggctgtcctacaaagtcgccagtgagggcttccaatattccgaccggcgctggtgcttcgatggcgagcggaataaccaggtgttagaagagaatatggatgtggagatctggaccaaggagggagagcggaagaaactgcggccccggtggctggacgcccggacgtactccgaccccctcgccttgcgcgagttcaaagagttcgccgccggtcgccgctccgtctccggggacctgatcctggagatcggcaagctgccgcagcacctgacccagcgggcccagaacgccctcgacaacctggtgatgttacacaacagcgagcagggcgggcgcgcctatcggcacgctatggaggagctccccgacacgatcgagaccttaatgctgctcgcgcttatcgccgtcctgacgggcggggtcaccctcttcttcctatccggccgcgggctaggaaagaccagcattggtttactgtgcgtgatggcctctagcgtgctgctctggatggcctccgtagagccccactggatcgccgcgagcatcatcctggagttcttcctaatggttctcctgatccccgagccggacaagcagcggacaccccaggacaatcaactggcctacgttgtaatcgggctcctgttcatgatcttgacggtggccgccaacgagatggggctcctggagaccaccaagaaggacttaggcataggccacgttgctgtggagaaccaccaccacgccgccatgctcgatgtggacctgcaccccgcctccgcatggacgctctacgcggtcgccaccaccatcataacccctatgatgcgccacacgatcgagaacaccaccgcgaacatctccttgacagcgatcgccaaccaggcagccatactgatggggctagacaaaggctggcccatctccaagatggacattggcgtccccctcttggctctggggtgctacagccaggtgaatcccctcacactaaccgccgcagtgctgatgctcgttgcccactacgcaatcatcggacccgggctgcaggccaaggcgacccgcgaagcgcagaagcggaccgccgccgggatcatgaagaaccccacggtggacgggatcgtagccatcgacctggaccccgtcgtgtacgacgctaagtttgagaagcaactcggccagatcatgctgcttatcctctgcacctcgcagatcctgctcatgcgtacaacctgggctctctgcgagagtatcacactggccaccggccccctgaccaccttatgggaggggtccccgggcaagttctggaacacgactattgcggtgagtatggcgaacatcttccgggggtcctacctggccggagccgggctggccttcagcctcatgaagtccctcgggggcggtcggcgggggactggggcccaaggggagaccttaggcgagaagtggaagcggcaactaaaccagctgtccaagagcgagtttaatacttataagcggtccgggatcatggaggtcgaccggtccgaggccaaggagggcctgaagagaggggaaaccaccaagcacgcggtgtcacgcggcaccgcgaagctccggtggttcgtggaacgcaatctggtcaagcccgaggggaaggtgatcgacctggggtgcggtcgcggaggatggagttactactgcgccgggttaaagaaagtgacggaggtcaaggggtacactaaaggagggcccggtcatgaggaacccatcccgatggcgacctacgggtggaacctcgtgaagctgcattccgggaaggacgtgttcttcatcccgcccgagaaatgtgacaccctgctctgcgatattggggagagctcccccaacccgacgatcgaggagggcagaaccctgcgggtgctgaagatggtggagccttggctccgcgggaaccagttctgcatcaagattctgaacccctacatgccttcggtggtcgagacgctggagcagatgcagcggaagcatggcggcatgctcgtgaggaacccgctgtcgcggaatagcacgcacgagatgtattgggtgtcctgcgggaccgggaatatcgtcagcgccgtgaacatgacaagtcgtatgttgctcaacaggttcaccatggcgcaccggaagcctacctatgagcgcgacgtggacctcggggccggtacccgacacgtcgccgtggaacccgaggtggccaacctcgatatcatcggccagcgcatcgagaacatcaagcacgagcacaagtctacgtggcactacgacgaggacaacccctacaaaacctgggcataccacgggtcctatgaggtaaagccgtctggtagtgctagcagtatggtgaacggggtcgtgaaattgctgaccaagccctgggatgtaatccccatggtcacccaaatcgcgatgaccgacaccaccccttttggccagcagcgagtgtttaaggaaaaggtcgacaccaggacgccaaaagccaagcgggggaccgcccagatcatggaggtcaccgccaagtggctgtggggcttcctttcccgcaacaagaagccccggatctgcacccgcgaggagttcacgcggaaggttcgcagcaacgcggccatcggcgccgtgttcgttgatgagaatcagtggaactccgccaaggaggcggtggaggacgagcggttttgggacctggtgcacagggaacgagagctccacaaacagggcaagtgcgcgacctgcgtttacaacatgatgggcaagcgcgagaagaaattgggtgagttcggaaaggccaaaggcagccgggccatctggtatatgtggctgggcgcccgttttctggagttcgaggcgctcggcttcatgaacgaggaccactggttttcccgtgagaacagcctgtcgggagtagagggcgaggggctgcacaaactcggctacatcctgcgcgacataagcaagatccctgggggcaacatgtacgctgacgacaccgcaggttgggatacccggatcactgaggatgatcttcagaacgaggcccgcatcaccgacatcatggagccggagcacgccctgctggctaagtccatcttcaagctgacctatcagaacaaggtggtccgggtgcaacggcccgccaagaacgggactgtgatggacgtgatcagcagacgggaccagcgcggttccggccaggttggcacgtatggcctcaacacattcactaatatggaggcccagctaattcggcaaatggagagcgagggcatcttctccccgagtgagctggaaactccgaacctggccgaacgcgtcctggactggttagagaagtacggcgtcgagcggctaaagaggatggccatatccggggacgactgcgtggttaagccgatcgacgaccggttcgcgacggcccttaccgccctgaatgacatgggcaaggtccgcaaggacataccacaatgggagccctcaaaggggtggaacgactggcaacaagtccccttctgctcccaccacttccaccaactcataatgaaggacggccgtgagatcgtggtcccgtgcagaaaccaggacgagctggtgggacgggcccgagtgagccagggggccggctggtcactccgggagaccgcgtgcctggggaaaagctacgctcagatgtggcagctgatgtatttccaccgccgggatctgcgtctcgccgccaatgcgatctgcagcgcggtcccagtggactggatcccaacctcccggacaacctggagcatccacgcccaccaccagtggatgacgaccgaagacatgctgtccgtgtggaaccgcgtctggatagaggaaaacccctggatggaggacaagacgcatatcagctcttggggcgacgtgccgtacctgggaaaacgcgaagatcagtggtgcggcagtttgatcggattaactgcccgggccacctgggcgaccaacatccaggtggccatcaaccaggtccgccggcttatcgggaacgagaactacctagactacatgacctccatgaaacgcttcaagaacgaaagcgatccagagggggccttgtggtag

SEQ ID NO: 24479 - RNA, 9879 nt, synthetic construct
  misc_feature 1..9879: note = derived and/or modified CDS sequence (opt11) from DENV-1__GU131773__SS-prME
  source 1..9879: mol_type = other RNA
agcgtgaccatgctgttgatgctgatgcccacagccctggctttccacctcacgacccggggtggcgagccccatatgattgtgagcaagcaggagaggggcaaaagcctgctgttcaagacttccgccggggtaaacatgtgcaccctcatcgcgatggacctaggcgagctctgcgaggacaccatgacctacaagtgcccccgaatcaccgaggccgagcccgacgacgtggactgctggtgcaacgccaccgacacgtgggtgacctacgggacatgcagccagaccggcgagcatagaagggagaaaaggtctgtggctctcgctcctcacgtgggcctggggctggagacgcggacggagacttggatgtcatccgaaggcgcctggaaacagatccagcgcgtggagacctgggcactccgtcaccccgggttcacggtgatcgccctgtttctggctcacgccatcggaacctctatcacccagaaggggatcatcttcatcctcctgatgctggtaactcccagcatggccatgcggtgcgtcggcatcggcagtcgggacttcgtggaggggctatccggcgccacgtgggttgacgtcgtgctggagcacgggagctgcgtaaccaccatggctaaggacaagcccaccctggacatcgagctcctgaagacagaggtcaccaaccccgcagtgctgcgtaagctctgcatcgaggccaagatctccaacaccaccacggatagcaggtgcccgacacagggcgaggccaccctggtggaggagcaggacgccaatttcgtctgtcggcgcaccttcgtggaccggggctggggcaacggctgcgggctgttcggcaagggttctctcctgacgtgcgccaagttcaaatgtatgaccaagctggagggaaagatcgtgcagtacgagaatctcaagtatagcgtcatcgtgacagtgcacaccggcgaccagcaccaggtcggtaacgaatccaccgaacacggcaccaccgcgacgattactcctcaggcccccaccacggaaatccagctgaccgactatggggccctgaccttagactgcagccccaggaccggtctggacttcaatgagatggtgttgctcaccatgaaggagaagtcctggctggttcacaagcagtggttcctggatctacccctgccctggaccagcggggccagcacctcccaggagacctggaaccggcaggacctgctcgtgaccttcaagaccgcccacgcgaagaaacaggaggtggtcgtgctgggaagccaggagggcgccatgcacacggcactgacgggggctaccgagatccagacctcgggtaccacaacaattttcgccggtcacctgaagtgccgtctgaagatggacaagctgacccttaagggcatgagctacgttatgtgcacagggtcctttaagctagagaaagaggtcgcggagacgcagcacggtaccgtgctggtgcagatcaagtacgagggcactgacgcgccctgcaagatccccttcagcactcaggacgaaaagggggtaacgcagaatggccggctgatcaccgccaacccgatcgtgacagacaaggaaaagcccgtgaacatcgaggccgagccgcccttcggggagtcttacatcgtcatcggggctggggagaaggccctcaagctgagctggttcaagaaggggagctcaatcggcaagatgttcgaggccaccgcccgcggggcgcggcgcatggcgatcctcggcgacacggcctgggacttcgggtccatcggcggcgtgttcaccagcgtcgggaagctcgttcaccagatcttcggcaccgcttacggggtcctattcagtggcgtgagctggacaatgaaaatcgggatcggggtcctgctcacgtggttgggcctgaattcccgctcaacgtccttatcgatgacctgcattgccgtggggctcgtgaccctgtacttaggcgtcatggtgcaagcggactccgggtgcgttattaactggaagggcagggagctgaagtgcgggagcggcatcttcgtcacgaatgaggtacacacctggacggaacagtacaagttccaagccgacagcccgaagcgactatccgcggccataggcaaggcctgggaggagggggtgtgtggcatccggagcgccacccgcctcgagaacatcatgtggaagcagatatccaacgagctgaaccacatcctgcttgagaacgatatgaagttcaccgtcgtggtgggggacgtcgcgggcatcctggtgcagggaaagaagatgatccgaccccagccgatggagtacaagtacagttggaagtcctggggcaaggccaagatcatcggcgctgacgttcagaacagcacgttcatcatcgacgggccgaacaccccggagtgtcccgacgaccagcgcgcctggaacatctgggaggtcgaggactacggcttcgggatcttcaccaccaacatctggctgaagctccgggactcctacacccaggtgtgcgaccaccgcctcatgagcgcggctatcaaggactccaaggccgtgcacgccgacatgggctactggatcgagagcgaaaagaacgagacatggaagctggcccgggcgtctttcatcgaggtcaagacgtgcatctggcctaaaagccataccctctggtccaacggagtgctggagtcggaaatgatcattcccaagatccatggcggcccgatctcccagcacaactaccgccccgggtacttcacgcagacagcgggcccatggcacctgggtaaactcgagctggacttcgacctgtgcgagggcaccaccgtggtcgtggacgagcactgcggcaaccgggggccgagcctcagaaccaccaccgtcaccggaaagatcatccacgagtggtgttgtcggtcctgcactttgccgcccctgaggtttcgcggggaggacggctgctggtacgggatggagattcgccccgtgaaggagaaggaggagaacctggtcaagagcatggtgagcgccggaagcggcgaggtggacagcttcctgttggggctcctttgcatctcgatcatgatcgaggaagttatgagaagccgatggtcccggaaaatgctgatgaccggcaccctcgccgtgttttttctgctgatcatgggacagctcacctggaatgacctgatccgcctgtgcatcatggtcggcgcaaatgcgagcgaccgcatgggaatgggcacgacctacctcgccctgatggccaccttcaagatgcggccgatgttcgccgtgggcctgctgtttcgccggctgacttcccgtgaggtcttactcctgacgatcgggctgagcctcgtcgcaagcgtggagctgcccaatagcctggaggagctaggagatggtctggctatgggcatcatgatcttgaagcttcttaccgacttccagtcctaccagctgtgggcgaccctcctgtcactgaccttcatcaagacgacgttctctctccactacgcctggaaaacaatggccatggtcctgagcatcgtgtcgctgttccctctctgcctgagcaccacatcccaaaagaccacgtggctgccggtgctcctgggctctttagggtgcaaaccgctcaccatgttcctgattgcggagaataagatctggggccggaagtcctggccccttaacgaggggatcatggccgttgggatcgtgagcattttactgagctccctgttaaagaacgacgtgcccctggccgggcctctgatcgccggcggcatgctcatcgcctgctacgtcatcagcggttccagcgcggacttatcactggaaaaggctgccgaggtcagctgggaggaagaggccgaacactccggagccagccacaacatcctcgtggaagtccaggacgacgggacaatgaaaataaaggacgaggagagggacgacaccctgaccatcttactcaaggccaccttattggccgtgtccggcgtatacccgctcagcatcccagccaccctcttcgtctggcacttttggcagaagaagaagcagcggagtggggtgttatgggacacgcctagcccgcccgaggtggagcgcgccgtcctggacgatggcatctaccggatcatgcagcgcggcctcctgggccggagtcaagtgggggtaggggtcttccaggagaacgtattccacaccatgtggcacgtgactcgcggcgccgtcctgatgtaccaggggaagcgcctcgaaccctcctgggcgagtgtgaagaaggacctgatcagctacggcggcgggtggcgcttccagggttcctggaacaccggcgaagaggtgcaggtcatcgcggtggagcccggcaagaacccaaagaacgtgcagacggcccccggcacctttaagacccccgagggcgaggtgggtgccatcgcgctagacttcaagccaggtacgagcggatctcccatagttaaccgggaggggaagattgtgggcctctacgggaacggcgtcgtgaccacaagtggcacctacgtgtcagcgatcgcacaagcgaaggcctcccaggaggggccgctgcccgagatcgaggacgaggtcttccgcaagcggaacctgacgatcatggacctccaccccggcagcgggaagacgcgccggtacctgcctgcgatcgtacgcgaagcaattaaacggaagctgcgcacgttgatcctggcacccacccgagtggtcgcctccgagatggccgaagcgctgaagggcatgccgatccggtaccagaccaccgccgtcaagagcgagcacaccggtaaggaaatcgttgatctcatgtgccatgcaaccttcaccatgaggctactgtcccccgtccgggtgccgaactacaacatgatcatcatggacgaggcccacttcacggatcccagctccatcgccgcgcgcggttacatcagcacccgggtgggcatgggtgaggccgctgccatcttcatgaccgccaccccgccaggttccatggaggcgttcccgcagagcaacgccgtcatacaagacgaggagcgcgacatccccgagcggtcgtggaacagcggatacgagtggatcacggacttccccggcaagaccgtgtggttcgtgccttccatcaaggccgggaacgacatcgcaaactgcctccgcaagaacgggaagcgggtcatccagctaagccgaaagaccttcgacaccgagtaccagaagacgaagaacaacgactgggactacgtggtgaccaccgacatcagcgagatgggggcgaacttccgggccgaccgcgtcatcgacccgcggcgctgcctgaagcccgtgattctcaaggacgggcccgagcgggtgatattagcgggccccatgcctgttaccgtggccagcgccgcgcagcgtagggggcgcataggccgtaaccacaacaaggagggcgaccagtacatctatatggggcaacccctgaacaacgacgaagaccacgcccactggacggaggccaaaatgctgttggacaacatcaatacccccgagggcatcatcccagcgctgttcgaaccggagcgcgagaagtccgccgcgatcgacggggagtaccgcctccggggcgaggctcgcaagacctttgtcgaactgatgcggcgcggggacctacccgtatggctcagctacaaggtggcctcagagggcttccagtacagcgaccggcgctggtgcttcgacggggagcggaataaccaggtcctggaggagaacatggacgtcgagatctggaccaaagagggggagcgcaagaagctgcggcccagatggttggatgcccggacgtacagtgaccccctggccctgcgcgagttcaaggagttcgcggcgggccggcgctctgtgagcggggacttaatcttagagatcggtaagctgccgcagcacctcacccagcgggcccagaacgccctggacaacctcgtcatgctccacaactccgaacagggcgggcgcgcgtaccggcacgccatggaagagctgcccgataccatcgagaccctgatgttgcttgcactgatcgccgtgctcacgggcggggttaccctattcttcctgtcggggaaaggactcggcaagacctccatcggcctgctctgcgtcatggccagctccgtgctgttgtggatggcaagcgtcgagccccactggatcgccgcctccatcatcttagagttcttcctcatggtcttgctcataccagagccggaccgccagaggacgccgcaggacaaccagctcgcgtacgtggtcatcgggctgctattcatgattttgaccgtcgcagccaacgagatgggcctgctggaaacgaccaagaaggacctcgggataggccacgtggcagtggagaaccaccaccacgccgccatgcttgacgtcgacctgcatcctgcctccgcatggaccctctacgccgtggccaccacgataattaccccgatgatgcgccataccatcgagaataccacggctaacatcagcttaaccgccatcgcaaaccaggccgccatcctaatgggactggataagggctggcccatcagcaagatggacatcggggtgcccctgctggccctcgggtgctacagccaggttaaccccctgaccctgaccgcggccgtgctcatgcttgtggcccactatgccatcattggcccggggctgcaagccaaggcaacccgggaggcccagaagcgcaccgccgccggcattatgaagaaccccaccatcgacgggatcgtcgccatcgatctcgaccccgtcgtgtacgacgcgaagttcgagaagcagctgggccagatcatgctgctcatcctgtgtaccagccagatcctgctcatgcgcacgacatgggccctgtgcgaatccattaccctggcgaccggccccttgacaacgctatgggaggggagcccgggaaagttctggaacaccaccatcgcggtctccatggccaacatcttccggggaagttacctagccggagcgggcctcgcgttctccttgatgaagtccctcgggggcggccgccgggggacaggggcccaaggcgagacactcggagagaagtggaagcgccagttaaaccagctgtctaagtctgagttcaacacctacaagcggagcggaatcatggaggtggaccgctccgaggccaaggagggcttaaagcgtggggagaccacaaagcacgccgtgtcccgcggcaccgccaaactgcgttggtttgtcgagcgcaacctggtgaagcccgaggggaaggtgatcgaccttggctgcggccgcggtggctggtcctactattgtgcagggctcaaaaaggtcacagaggtgaagggctataccaaaggcgggcccgggcacgaggaacccatcccgatggccacgtacgggtggaacctggtgaaactacacagcggcaaggacgtcttcttcatcccacccgagaagtgcgacacactcctgtgcgatatcggggagtccagcccaaacccaacaatcgaggaaggccgtaccttacgggtgctcaagatggtggagccatggctgagagggaatcagttttgcatcaaaattctgaacccctacatgccctccgtcgtggagaccctcgaacagatgcagcgcaagcatggcggcatgctggtacggaaccccctcagccggaattccacgcacgagatgtactgggtcagctgcgggaccggaaatatcgtttccgccgtcaacatgaccagccgcatgctcctgaaccggttcaccatggcgcaccgcaaacccacgtacgagcgcgacgtggacctgggtgccggcacccgtcacgtggccgtggaacccgaggtcgcaaacctcgatatcataggccagcgcatcgaaaacatcaagcacgagcacaagtcgacctggcactacgatgaggacaacccctataagacttgggcataccacgggtcgtacgaagtgaagccgtccggaagcgcctccagcatggtgaatggggtcgttaagctgctgacgaagccctgggacgtgatccccatggtgacccagatagccatgaccgacaccacgcccttcggccagcaacgggtgttcaaggagaaggtggacacccgcactccgaaggccaaacgggggacggctcaaattatggaggtgacggcgcggtggctctgggggttcctgagccgaaacaagaagccccgcatctgtacccgggaggagttcacccgcaaggtgcgtagtaacgctgcgatcggcgccgtcttcgtggatgagaaccagtggaactctgcgaaggaagccgtagaggacgatagattttgggacctggttcatagagagcgcgaactccacaaacaggggaagtgtgcgacctgcgtgtacaatatgatgggcaagcgggagaagaagctgggggaattcggcaaagccaaggggtcccgggccatatggtatatgtggctgggggcacggttcctcgagttcgaagcgctgggcttcatgaacgaggaccattggttcagccgtgagaattccttaagcggggtggagggtgaggggttacacaagctgggctacatcctgcgcgacatcagcaagattcctggaggcaacatgtacgcggacgacacagccggctgggatacgagaataaccgaggatgacctccagaacgaggccaagatcaccgacattatggaaccggagcacgcgctgctcgcaaaaagcatcttcaagctcacgtaccagaacaaggtcgtgcgggtgcagcgccccgccaagaacggcactgtcatggacgtgatctcccgccgggaccaacgcggcagcgggcaggtgggtacctacgggctgaacaccttcaccaacatggaggcccagctgatccgccaaatggagtcggaggggatcttcttacccaatgagctggagacccccaacctggccggccgcgtcctcgactggctggagaagtacggtgtcgagagattaaagcgcatggcgatctcaggggacgactgcgtggtcaaacccatcgacgaccggttcgccaccgccctcaccgccttgaacgatatggggaaggtgcgcaaggacatcccccagtgggaaccctcaaagggttggaacgattggcaacaggtccccttctgctcgcaccacttccaccaactgatcatgaaggacggccgtgagatcgtagtgccatgtcgcaaccaggacgaactcgtggggcgcgcccgcgtgagccagggtgcggggtggagcctgagagagacggcctgcctgggcaagagctacgctcagatgtggcagttaatgtacttccaccgccgggacctacgtctggccgcaaatgccatctgctctgcagtgcccgtggactgggtccccaccagccgaaccacctggtccatccacgcccaccaccagtggatgacgactgaggatatgctcagcgtgtggaaccgcgtgtggatcgaggagaacccctggatggaggacaagacccgaatctccagctgggaggatgtcccgtatctggggaagcgcgaggaccagtggtgtggatccctgatcggccttacggcccgcgcgacgtgggcaacgaacatccaggtcgccatcaaccaggtgagacgcctgatcgggaacgagaactatagcgactacatgacctccatgaagcggtttaagaacgaaagcgagcccgagggcgccctgtggtga

SEQ ID NO: 24480 - RNA, 9879 nt, synthetic construct
  misc_feature 1..9879: note = derived and/or modified CDS sequence (opt11) from DENV-1__GU131775__SS-prME
  source 1..9879: mol_type = other RNA
tcagtcaccatgctgctgatgctcatgccgacagcactggccttccacttgaccactcgcggaggggaaccgcacatgattgttaccaaacaagaacgcggaaaaagcctcctgtttaagacgagcgcaggcgtgaacatgtgtactttaatagcgatggaccttggagaactctgcgaagacaccatgacatacaaatgccccaggatcaccgaagccgaacctgacgatgtggactgctggtgcaacgccacggatacctgggtaacttacggcacatgcagtcagacgggagagcatagaagagacaaacgcagcgttgcactagccccacacgtcggactcggcctagaaactcggactgagacgtggatgtcatccgagggcgcatggaaacaaatacagcgcgtagagacgtgggcactaagacacccaggattcacagtcatagccctctttctcgctcacgccattggaacctcgataacacagaaggggatcatctttatccttctcatgctcgtaactcccagtatggcgatgaggtgcgtcggaatcggcagccgggacttcgtagaagggctatcaggagcgacctgggtggacgtcgtactcgaacacggatcgtgcgtcactaccatggcaaaagataaacctacccttgacatcgaactcttaaaaacagaagtcacgaatccagcagtactccggaaattgtgcatcgaggccaagatcagcaacactacaacggattctagatgcccaacccagggagaagccacgctgatggaggagcaagacgcaaactttgtctgtcgtcggacgttcgtggaccgcggctgggggaacgggtgcggcctcttcgggaaaggctcactcatcacatgcgccaagttcaagtgtgttacaaaactagaaggcaaaatcgtccagtacgagaaccttaagtacagcgtggtcgtgaccgtacacaccggggatcaacatcaggtcggaaacgagagcacagaacacggcacgactgcaacaataaccccacaagcacccacatcggaaatacaactaacggactatggcgccctcacgcttgattgcagccccagaaccggcctagacttcaacgagatggtactactaacgatgaaggagaagtcctggctagtacacaaacagtggttcctagatctgcctttaccgtggacaagcggagcaagtacgtcacaagaaacatggaacaggcaggacctcttagtcacgtttaaaacggcacatgccaagaaacaagaggttgtggtcctaggtagccaagaaggggccatgcacacggccctgacaggggcgacagagatacagacatcaggcaccacaacaatttttgccgggcacctgaagtgccggttaaaaatggataagctaacactcaagggaatgagctacgtcatgtgcaccggcagcttcaaactcgaaaaagaagttgcagagacccaacacggaacagtcctagtacaaattaagtatgaagggacggacgcaccctgcaaaatcccattcagtacacaagacgagaagggcgtgactcaaaacgggcgccttataactgctaacccaatcgtcacggacaaagaaaaacccgttaatatcgaggcggagcccccgttcggcgaaagttatatcgtcatcggagcaggcgggaaggccctcaaactttcatggttcaagaaaggaagcagcattggcaaaatgttcgaagcaactgctcggggcgcgcggcgaatggctatcctcggcgacacggcatgggactttgggagtgtcggtggagtattcacgagcgtcggtaaactggtacatcaaatctttggcacggcgtatggtgtcctcttttcaggagtctcatggacaatgaaaattgggataggagtcctactcacgtggttaggtcttaattcgcgcagcacttccctctccatgacctgcattgccgtgggcttggtgaccctttacctgggggtaatggtgcaagcagactcgggatgcgtcattaactggaagggacgagaactgaagtgcgggtctggcattttcgttaccaacgaggtccatacatggacagaacaatacaaatttcaggcggattcgcccaaacgactatcagctgcgatcggcaaagcctgggaagagggggtctgtggaataaggtccgcgaccaggctcgaaaacatcatgtggaagcaaataagcaacgaacttaaccacatactcctagaaaacgatatgaaattcacagtcgtagtgggcgacgtcgttggaatattggcacaaggaaagaaaatgataaggccgcaacccatggaacacaaatattcatggaaatcctgggggaaagcaaagataatcggagcagatgtgcagaacacgaccttcattatagatggcccgaacaccccagaatgtccagacgatcaaagggcgtggaacatctgggaagtagaagactacggattcggcatattcaccacgaacatctggctcaagctccgcgactcatacacccaagtctgtgatcataggctgatgagtgccgcgataaaggattcaaaagcagttcacgcggacatgggctactggatagaaagcgaaaagaatgaaacttggaagctagcacgcgccagcttcatagaagtaaagacgtgcatatggcccaagtcgcatactctctggtccaacggcgtgctggaaagcgagatgatcataccaaaaatctacggcggacccattagtcaacacaactacagaccaggttacttcacccagacagctggtccctggcacctgggtaagctcgaactagacttcgacctgtgtgagggtactacagtcgtggtggacgaacattgcggaaaccggggcccgtcactccgaacgacaacagtaaccgggaaaataatccatgagtggtgctgtaggagctgcacactgcccccacttcgtttcaaaggggaagacggttgttggtacggcatggaaatccgacccgtaaaagaaaaagaggagaatctggtcaaatccatggtatctgcaggcagtggggaagtggacagcttcagcctagggctcttgtgtatctcaataatgattgaagaagtaatgcggtcaagatggtcaagaaaaatgctcatgaccggaacattagccgtatttctactgctaataatgggccaattaacatggaacgacctgatccgactgtgcataatggtgggcgcgaacgcttcggaccgaatgggaatgggcacgacgtatctagccctaatggccacattcaagatgcggccaatgttcgcagtgggccttctcttccgacgtctgacatcccgggaagtgctgctactaaccatcggactatccctagtagctagcgtcgaactcccgaactccctagaagaacttggcgacggcttagctatggggatcatgatactaaaactcctgacagacttccagtcacatcaactctgggccactctcttatcactaacgttcatcaaaaccacattgtccctacactacgcgtggaaaactatggcgatggtactatctatagtgtcactatttccactgtgcctgagcacgacttcccagaaaacaacttggttacctgtactcctcgggtccctcggatgcaaaccgctaacaatgtttctcatcacagaaaacaagatctggggacgaaagagctggccgcttaacgaaggaataatggcagtgggcgtcgtatctatactgctcagttccctgctaaagaatgacgtgcccctcgcaggaccgctcattgccggcggcatgctcatagcatgctacgtaatttccggatccagcgctgacttatccctagaaaaagccgcggaagtgtcctgggaagaggaggcagaacattcaggagcgtcacacaacatcctcgtcgaagtacaagacgatggtacaatgaagataaaagacgaggagcgcgacgacaccctaaccatccttctgaaagcgaccctattagcggtgagtggcgtctaccccctgtcaatacccgcgacattgttcgtctggtacttctggcagaagaagaaacaaaggagcggagtcctctgggacacgcccagcccaccagaagtagagagagccgtcctagatgacgggatctaccgcattatgcaaagagggctgctggggagaagccaagtaggagttggtgtattccaagaaaatgtcttccacacaatgtggcacgtaacacgtggagcggtcctcatgtatcaggggaaacgtttggaaccatcctgggcgtcggtaaagaaagacctcatcagctacgggggagggtggcgcctgcaggggtcctggaacacaggggaagaagtacaggtcatagctgtggaaccgggcaaaaacccgaagaacgtccagacggcgccagggacgttcaaaacaccggagggagaagtcggtgccatagcattggacttcaagccaggaacgagcgggagcccaatcgtgaacagagaggggaagatagtgggactatatggaaacggtgtggtaaccactagcgggacctacgtctctgcaatagcccaagcaaaagcgtcacaggaagggcccctgccggaaatagaagatgaggtgttccgtaagagaaaccttacgataatggacctccacccaggcagtggaaagactcgacgatacctgccagcgatagtacgggaggcgatcaaacgcaagctcaggactctcatcctagccccaacgagagtagtcgcaagtgaaatggcggaagcgctaaagggaatgccaatccgctaccaaacaacagcagtgaaaagcgagcacacaggaaaagaaatcgtggacctcatgtgccatgcgacattcacgatgagactgctctcaccggtgcgcgttccgaactacaacatgattataatggacgaagcccattttacagatccgtcatccattgccgcgagaggttatatttccacccgagtaggaatgggcgaagctgccgcaattttcatgacagcaacaccgcctggaagtgtagaagcgttcccgcagtccaacgcggtgattcaggacgaggaaagagacatacccgaaagatcctggaatagtggatatgaatggattactgacttcccgggcaaaacggtttggttcgtcccatccattaagagcggcaacgacatcgcaaactgtcttcggaagaacggaaaacgggtcatacaactcagcagaaaaacctttgacacagagtaccagaaaactaaaaacaacgactgggattacgtagtaacgacggacataagcgagatgggcgcaaacttcagggccgatagagtcatcgatccaaggcgatgcctaaaacctgtcatactcaaagatggacccgaaagagtcatactcgcgggccccatgccagtgacggttgcaagcgcggcacagcggagaggtcggataggtaggaaccacaacaaagaaggagatcaatatatctacatgggacaacccctcaacaatgacgaagatcatgcccactggactgaggccaaaatgttattggacaacatcaacacccccgaaggcatcattccggccctgttcgaaccggaaagggaaaaatcggctgcaatagacggagagtaccgtctccgtggagaggcgaggaagacgttcgtagaattgatgaggcgaggcgatcttccagtttggctatcatataaagtagccagcgaaggattccagtactcagatcgccgctggtgcttcgacggggaaagaaataatcaggtactagaagaaaatatggacgtagaaatctggacgaaagaaggcgaacgtaagaagctaaggccgcgttggctggacgccagaacatacagtgatcctctcgccctaagagaatttaaagagtttgcggcaggacgccgatcagtatcgggagacctaatactagaaatagggaaactaccccaacacctaacacagcgagcacaaaacgcattggacaatttggtcatgctccataacagtgaacaaggcggacgagcataccgacacgcgatggaagaacttccggacacgatagaaacattgatgctactcgcactaatagcagtattaaccggtggggttaccctcttctttctgtctgggagaggtctcggaaagacatcaattggtctgttgtgcgtgatggcttctagtgtcctactgtggatggcgtcagtagaaccccactggatagcggcatcaataatactagagttcttcctaatggtactattgataccggagcccgacagacaacgcacaccacaagacaatcaactagcctacgtcgtcatagggctactcttcatgatcctaacagtggccgcgaatgaaatgggcctgcttgagaccaccaagaaagacttgggtataggacacgttgccgtagagaaccaccaccacgcaacaatgctagacgtagacttacacccagcaagcgcctggacattatatgcagtagctactaccataataactccgatgatgcgccataccatagaaaacaccacggcaaacatctcccttacagcaatcgcaaatcaagcagcaatcctgatgggactggacaagggatggcccataagcaaaatggacataggcgtaccgcttctcgctctcgggtgctactcgcaagtgaaccctttaacacttaccgcagcagtactcatgctggtcgctcactatgcgataattggtccgggcctccaagcaaaggcaacacgggaagcgcagaaaagaaccgccgcagggataatgaaaaacccgacagtcgatggtatcgtcgctatcgatctcgacccggtagtgtacgacgcgaaattcgaaaaacaactcggacaaattatgctgctaatcctatgcacatcacaaatactactaatgcgaacaacttgggctctgtgcgaaagtatcacactagcaactggaccacttaccacgctatgggagggaagcccgggcaaattttggaacaccacgatcgccgtgagtatggccaacatatttaggggatcatatctagcaggggccggacttgcgttttccttgatgaagtcactaggcgggggaagacggggcactggcgcacagggggaaaccctcggggaaaaatggaagagacaacttaaccaactcagcaagtcggagttcaatatctacaaacgtagcggtataatggaggtcgaccgcagcgaagccaaagagggtctaaaaagaggggagactacgcgtcatgcggtcagtcgcggaacagcaaaattacgatggttcgtagagcggaacctcgtcaagccagaaggcaaagtgattgatcttggatgcggtcgcggcggttggtcctactactgtgccggcctgaagaaggtgacagaggtgaaaggatacacgaaaggcgggccaggacatgaggagccaatacccatggcgacatatggctggaacctagtcaagctacactcaggtaaagacgtctttttcacaccacccgaaaagtgcgacacactgctatgtgacattggggaaagttcgccgaacccaacgatcgaggaaggcagaaccctacgcgtgttaaaaatggtcgagccctggctgagggggaaccagttctgtattaaaatcctcaatccatacatgccgagtgtcgtcgaaaccctggagcaaatgcaacgaaaacacggtggtatgcttgtcagaaacccgctgagccgaaacagtacccacgaaatgtactgggttagttgcggcacgggtaacatagtaagtgcggtaaatatgacatccaggatgttactgaaccggttcacgatggcccaccgcaagcctacgtacgaacgagacgtagaccttggcgcaggcactcgacatgtagcagtagaacctgaagtagcgaatcttgacatcatagggcagcgcatcgagaacatcaaacacgaacacaaatcaacgtggcactatgatgaagacaacccttataagacatgggcataccacggcagttatgaggtgaagccgagcggatccgcatcgtcaatggtaaatggtgttgtaaaacttcttaccaaaccatgggacgtaatacctatggtcacccaaatagcgatgactgacaccacaccattcggccagcaacgcgtcttcaaagaaaaggtggacacaaggacccccaaggcaaaacgaggaacagcacagataatggaggtcacggcgcggtggctatggggctttctgtcccggaacaagaaaccgcgaatctgcacacgcgaagagttcacacgaaaggtaagaagcaatgcggccattggtgccgtatttgtcgacgagaaccaatggaactccgccaaggaggccgtagaagatgagcgattctgggacctcgtacagaaagaacgagagctacataagcagggaaaatgtgccacttgcgtctacaacatgatgggcaaaagagaaaagaaacttggcgagttcggtaaggccaagggctcgcgcgccatatggtacatgtggctcggcgcgcgttttcttgagttcgaggcgttggggttcatgaacgaagaccattggttttcgcgggagaactccctaagcggagtcgaaggagaaggactacataaacttgggtacatactacgcgacatctccaaaatcccaggaggcaatatgtacgctgacgacaccgcgggctgggatactagaattacagaagacgatctacaaaacgaggctaagataacagacataatggaacctgagcacgccctcctagcaacatcaatcttcaagctaacataccagaacaaagtggtccgggtccagaggccggctaaaaatggcacagtcatggacgtgatctcccggcgcgatcaaagggggtctgggcaggtaggaacgtacggcctgaatactttcacgaacatggaagcccaactaatcagacagatggaaagcgaaggtatcttcctaccatcggaactggaaactcccaacctggctgaaagagtactcgactggctagaaaagtacggtgtagaaagattaaaacgaatggccatatccggtgatgactgcgtggtaaaaccgatagatgataggttcgcaactgcactcacagctttgaacgacatggggaaggtccgtaaagatatacctcaatgggaacccagcaagggctggaacgactggcaacaagtgccgttttgctctcaccactttcaccaacttattatgaaggacggcagagagatagttgtcccatgtaggaaccaagacgagcttgtaggcagagcaagggtaagccaaggggccggatggtccctgcgagaaacagcctgcctcgggaaaagttatgcacaaatgtggcaacttatgtattttcaccgaagagacctacggttggcggcgaacgcaatttgcagcgcagtaccagtggactgggtgccaaccagtcggaccacatggagcatccacgctcaccaccagtggatgacaaccgaagacatgttaagcgtctggaacagggtgtggattgaagagaacccatggatggaagacaaaacacatgtgagtagctggggcgacgtgccatacctgggcaaaagggaagatcaatggtgcgggagcctaatcgggttaaccgcacgcgcaacatgggcaagcaacatacaggtggccataaaccaggtccgcagattaattggaaacgagaactatctcgattatatgaccagcatgaaaagatttaaaaacgaaggtgacccagaaggagccctttggtaa

SEQ ID NO: 24481 - RNA, 9879 nt, synthetic construct
  misc_feature 1..9879: note = derived and/or modified CDS sequence (opt11) from DENV-1__GU131777__SS-prME
  source 1..9879: mol_type = other RNA
agcgtcaccatgctgctcatgctgatgcccaccgccctggcgtttcacctgaccacccgtggcggggagccccacatgatcgtgagcaagcaggagcgggggaagagcctgttattcaaaacaagcgccggggtgaacatgtgtaccctcatcgcgatggaccttggcgaactgtgtgaggacaccatgacctacaagtgtcccaggattacagagaccgagcccgacgacgtggattgttggtgcaacgctaccgatacatgggtgacctatgggacctgcagccagacgggagagcaccggagggataaacggtccgtggccctagcgccacacgtgggcctgggtctggagacacgcaccgagacctggatgagcagtgaaggagcgtggaaacagatccaacgggtcgagacgtgggctttgagacatcccgggttcactgttatcgcgttgttcctggcccacgcaatcggcaccagcattacccaaaaagggatcattttcatactcctgatgctggtgacgccctccatggccatgcgttgcgtcggcatcggcagcagagactttgtggaagggctctccggcgccacctgggtggacgtcgttttagaacatgggagctgtgtgaccaccatggctaaggacaagcccacgctagatatcgagctcctgaagaccgaggtcaccaaccccgccatcttacgaaagctctgcatagaggcaaagatttccaatactacgaccgactcgaggtgcccgacacagggagaagcgacattggttgaggagcaggatgccaactttgtgtgtcggcgcacgttcgtagaccggggctgggggaacggatgtgggctctttggcaaagggagtctcattacgtgcgccaagttcaaatgtgtgaccaagctagagggcaagatcgtgcaatacgagaacctgaaatactccgtcatcgtgaccgtgcacacgggagatcaacaccaagtcggaaacgagtccaccgagcacggcactaccgccaccatcacgccgcaggcgcccacaaccgagatccagctgactgactacggggccctgacactggactgcagcccccgcaccggcctcgacttcaatgagatggtgctgctgaccatgaaggaaaaatcctggctcgtccataagcaatggttcctggacttacccttgccgtggaccagcggagctagtacttcccaggagacctggaaccggcaggacctgctggtgaccttcaaaaccgcccacgctaagaagcaagaggtagttgtgctcggctcacaggaaggcgcgatgcacacggcgctgaccggggccaccgaaatccagacctccggcacgaccaccatcttcgccgggcatcttaagtgccgtctcaagatggacaagctcacccttaagggaatgagctacgtgatgtgtacggggagcttcaagctcgagaaggaagtcgcggagacccagcacggcaccgtgctggtgcagatcaagtacgagggcaccgatgcaccctgtaagatcccctttagcactcaggacgaaaagggggtgacacagaatggccggctgattaccgccaacccgatcgtgaccgacaaggagaaacccgtgaacattgaagctgagccgcccttcggggagtcctacatcgtcatcggcgccggcgagaaggcgcttaagttgtcatggttcaagaagggctcctcaatcgggaagatgttcgaggccacagcccgaggggctcggcgcatggcaatcctgggcgacaccgcatgggatttcgggtccataggcggcgtattcaccagcgtggggaagctagtccaccagatcttcgggaccgcctacggggtcctcttttccggagtgagttggacgatgaagatcgggatcggcgtgcttttgacatggctcgggctgaactcgcggagcacctccctgagcatgacctgcatagccgttgggctcgtcacgctgtacctaggcgtcatggtgcaggccgattcggggtgcgtgatcaactggaagggccgggagctcaaatgcgggtcaggcatcttcgtaaccaacgaggtgcatacctggaccgagcagtataagttccaggccgacagcccgaagcgcttatccgctgccattggcaaggcgtgggaggaaggggtgtgtggcatacggagcgccacccgcttggagaacatcatgtggaagcagatctcgaacgagctcaatcacatattgctggagaacgacatgaagttcacggtcgtggtcggggacgtggccggtatcctcgcccaggggaagaaaatgatccgaccccagcccatggagtacaagtatagctggaaatcctggggcaaggccaagattatcggcgccgacgtgcagaacacaaccttcatcatcgacgggcccaacaccccggagtgtcccgacgatcagagggcctggaacatatgggaggtagaggattacggcttcgggatatttacgaccaacatttggctaaagctccgggactcgtacacccaagtgtgcgaccaccgcctcatgtccgcggccatcaaagatagcaaggccgtgcatgccgacatgggctactggattgaatcagagaagaacgagacttggaaactggcgcgggcttctttcatagaggtgaaaacttgcatctggccaaagtcccacactctgtggagcaacggcgtcctcgaatccgagatgatcatacctaagatctacgggggtcctataagccaacacaactataggcccggctatttcacgcagaccgccggcccatggcacctgggaaagctcgagctcgacttcgacctgtgcgagggcacgaccgtggtagtagatgagcactgtggcaacagggggccgagcttacgcaccaccacagtgactggcaagataatccatgagtggtgttgccggagctgcacactgccgcccctccgtttccgcggggaggacgggtgctggtacggcatggagatccgccccgtcaaggagaaggaggagaacctggtgaaatccatggtgagtgccggctcgggagaagtggactctttcagcctcggcctgctttgcatctctatcatgatcgaggaggtaatgcgaagccggtggtccagaaagatgcttatgacaggcactctggctgtgtttctgctcctgattatgggtcagctgacctggaacgatttgatccgcctttgtataatggttggcgccaacgcgagcgacagaatggggatgggcacaacctacctggccttaatggcaacgttcaagatgcggccgatgttcgccgtcgggctgctgttccgccggctcacttcccgcgaggtgctactgctcacgatcgggctgagcttggtggcttccgttgaactccctaacagcttagaagagcttggggacggcctcgcaatgggcatcatgatcctaaagctgctcaccgacttccagtcccaccagctatgggccacgctgttgagtctaaccttcatcaagacaaccttctccctgcactacgcctggaagactatggccatggtgctcagtatagtctccctgttccccctctgcctcagcaccacgtcccagaagaccacttggttacccgtgctgctgggatcgttagggtgtaaaccgttgactatgttcttgatcgctgagaacaaaatctggggccggcgctcatggcccctgaatgaggggatcatggctgtgggcatcgtctctatattgctcagctccttgctgaagaacgacgtgccgctagctgggccgctgatcgcaggtggcatgctcatcgcctgctacgtcatcagcgggtccagcgcggacctctccctggagaaggccgccgaggtctcttgggaggaagaggcggagcacagcggcgctagccacaatatcctggtggaggtccaggacgatggtaccatgaagatcaaagatgaggagcgggatgataccttaaccatcctgctcaaagcgacgctcctggcgattagtggcgtctacccgctgagcatccccgcaaccctttttgtatggtatttctggcaaaagaagaaacagcgctcgggggtactgtgggacacccccagccctccagaggtggaacgggccgtgttagacgacggcatatacaggatcatgcagaggggcttactcggtcgctcccaagtgggcgtcggcgtgtttcaggagaatgtgtttcacacaatgtggcacgtcacgcggggtgctgtgctcatgtaccagggtaagcgcctggagcccagctgggcttcggtcaagaaggacctcataagctacggcggggggtggcggctacagggctcctggaacaccggcgaagaagtccaggtgatcgcggtggagcccgggaagaaccctaagaacgttcagaccaccccaggaacttttaaaaccccggagggcgaagtgggggcgatagccctggacttcaagcccggcaccagcggctcccccatcgtgaaccgtgaggggaagatcgtcggcctctacggcaacggtgtggtgaccacgtcgggcacctacgtaagcgccattgcccaggccaaagctagccaggaggggccgctgcctgagatcgaggacgaggtgttcaggaaacgcaatctgaccatcatggatttacaccccggcagcgggaagacccggcgctaccttccagccattgtgcgggaagcgattaaacgaaaactccgtacgcttatcctggctcccacgcgggtcgtggcctccgaaatggccgaggccctgaagggcatgccaatccgctaccagaccaccgcagtaaagagcgagcatacgggtaaggaaatagtcgacctcatgtgtcacgccacattcacaatgcggctgctaagccccgtgagagtaccaaattacaacatgattatcatggatgaggcccactttaccgatcccagcagtattgccgcccgagggtacatcagcactcgcgtaggcatgggggaagccgccgccattttcatgactgcgacaccgcctggctccgtagaagcattcccgcagagcaacgcagtcatacaggacgaggagcgggatatccccgaacgcagctggaactcggggtacgaatggatcaccgacttcccgggcaagacggtctggttcgtgccctccatcaaatcaggtaacgatatagccaactgtcttcggaagaatgggaagcgcgtgatccagctgtcccggaagacgtttgacactgaataccagaagaccaagaacaatgactgggactacgtggtgacgaccgacatcagcgagatgggcgccaacttccgcgccgaccgggtgattgacccgcgccggtgcctgaagcccgtgatccttaaggacgggcccgagcgcgtgatactggcgggccccatgcccgtaactgtcgcctccgccgcccagcgacgcgggcggatcgggcgcaaccataacaaggagggcgaccagtacatctacatgggccagcccctgaacaacgacgaagaccacgcccactggaccgaagcgaagatgctcctggacaacattaacacgcccgagggcataataccagctctgttcgagccggagcgcgagaaatccgccgcgatcgacggggagtaccgactccgcggcgaggcccggaagacgtttgtagagctgatgcgccgcggggacctgcctgtttggctctcctacaaggtagcgagcgagggtttccagtacagcgatagaagatggtgcttcgacggcgagcgcaataaccaggtgctggaggagaatatggatgtcgagatttggaccaaggaaggggaacgaaagaagctgcgcccccggtggctggacgcccgcacctactcggacccactggcgcttcgggagttcaaggagttcgccgcgggccggcggtccgtgtccggggacctcatcctggagatcggcaaactgccccagcacttgacgcagcgcgcgcaaaacgccttggacaacttggtaatgctccacaacagcgagcaaggcgggcgggcatacaggcacgccatggaggagttgcccgacaccattgagaccctgatgctgctggcgctcatagccgtcctgaccgggggggtgacccttttcttcctgtccggccgcgggctcggcaaaactagcatcggcctgttgtgtgtgatggcctccagcgtcttactgtggatggccagcgtcgagccgcattggatcgccgcgagcatcatactggagttcttcctgatggtgctgcttatacccgagccagaccgccagcggaccccccaggacaatcaattggcctacgtcgtaattgggctgctgtttatgatactgaccgtggccgccaacgagatgggcctgcttgagaccacgaagaaagacctcgggatcgggcacgtcgccgtcgggaatcatcaccacgcggctatgctggacgtggatttgcaccccgcatcggcgtggactctctacgcggttgcgaccaccatcatcaccccgatgatgcgccatacgatcgagaacacgaccgccaacatcagcttaacagctatcgctaatcaggccgcgatcctgatgggcctagataaaggatggccaatctctaagatggacatcggggtgccactgcttgccctcggctgctacagccaagtgaacccgctcactctcaccgcagccgtcttaatgctggttgctcactacgccatcatcggacccggcctgcaagccaaggccacccgcgaggcccagaaacggaccgcggccgggataatgaagaatcccacagtcgatggcatcgtcgcgatcgacctcgacccggtggtgtacgacgccaagttcgagaagcagcttggtcagatcatgctgctaatcctgtgtacctcccagatcctgctcatgcggacgacgtgggccctgtgcgagagcatcaccctggcgaccggccccctcacaacactgtgggagggttccccggggaagttctggaacaccaccatagccgtcagcatggccaacatctttcggggctcatacctggccggagcagggctcgcattcagcctgatgaagtcactgggggggggccgccgcggtaccggcgcccagggcgagacccttggcgagaagtggaagcgccaactgaaccagctgagcaagagcgagttcaacacttataaaagatccggcatcatggaggttgatcgctcagaggccaaagaggggttgaagcggggcgaaaccacaaagcacgccgtgtcccgcgggacggcgaagctgagatggttcgtcgagcgcaaccttgttaagcccgagggcaaggtgatcgacctggggtgcggccggggaggctggagctattactgcgccggtctcaaaaaggtaaccgaggtaaaaggttacaccaagggcggtcccgggcacgaggagcccatcccgatggcgacgtacggctggaacctggtgaagctgcacagtgggaaggatgttttcttcatcccccccgagaagtgtgacacgctcctgtgcgacatcggcgagagttcacccaacccgaccatagaggagggccgcaccctgcgggtgctcaagatggttgagccctggctgagaggtaaccagttctgtattaaaatcttaaacccctacatgcccagcgtcgtggaaaccctcgagcagatgcagcggaagcatggcggcatgctggtgcgcaacccactgtcccggaatagcacccacgagatgtactgggtctcctgcggcacagggaatatagttagcgcggtgaacatgacctcccgcatgctactgaacagattcaccatggcccatcggaagcctacctacgagcgcgacgtcgacctgggagcgggaacgcgtcatgtcgccgtcgaacccgaagttgccaaccttgacatcatcgggcaacgcatcgagaacatcaagcacgagcacaaaagcacgtggcattacgatgaggacaacccctacaagacgtgggcatatcacggctcctacgaggtgaagccgagcgggagtgccagcagcatggtgaacggcgtagtgaagctgctgaccaagccatgggacgtaatccccatggtgacgcaaatagcgatgacagacaccacccccttcgggcagcagcgggtgttcaaggaaaaggtcgacacccggaccccaaaggcaaagcgtggcactgcccaaatcatggaggtgacggcaaagtggctctggggcttcctatcccgcaacaaaaagcctcggatctgcacccgcgaggagttcacccggaaggtgagatcgaacgctgccataggggctgttttcgttgacgaaaaccagtggaacagtgctaaggaggcggtagaagacgagcggttctgggacctggtccaccgcgagcgggagttgcacaagcagggtaaatgtgcgacttgtgtgtataacatgatggggaagcgggagaagaagctcggcgaatttggaaaggccaaagggtcacgggccatatggtacatgtggctgggcgccagatttcttgaattcgaggccttggggttcatgaatgaggaccactggttctccagggagaacagcttatcgggcgtagagggggaaggcttgcacaagctggggtacatcctgcgcgacatctcaaagatccccggcggcaacatgtatgcggacgataccgctgggtgggacacgcggatcaccgaggatgacctccagaacgaggcacgcatcaccgacattatggagccggagcacgccctgctagccaagtccattttcaagctgacctaccagaacaaggtcgtgcgggtgcagcggcccgccaagaacggcacggtcatggacgtgataagccgccgcgatcagcgcggctcgggacaggtgggcacttacgggctgaacacattcaccaacatggaggcccagctgatacggcagatggaaagcgagggcatcttttcccccagcgaactcgaaacgccaaacctggcggaacgtgtcctagactggttagaaaagtacggggtcgagcggctgaagcgcatggccatctccggcgacgactgtgtggtcaagcctatagacgaccggtttgccaccgcgctgacagctctcaacgacatggggaaggtaagaaaggacatcccccagtgggagcccagcaagggctggaacgactggcaacaagtcccgttctgctcccaccacttccaccagcttatcatgaaggacggccgggagatcgtcgtgccttgccgcaaccaggacgagttggtaggtagggcccgtgtcagtcagggagccggctggtcgctccgggagaccgcctgtctcggaaagtcctacgcgcagatgtggcagctgatgtacttccaccgccgggatttaaggctggccgccaacgccatttgtagcgcagtgcccgttgattggatccccacgtcaagaaccacctggagcatccacgcccatcaccagtggatgaccacggaagacatgctgtccgtctggaaccgtgtctggattgaggaaaatccctggatggaggataagactcacatcagttcatggggcgacgtgccgtacctgggcaagagagaggatcagtggtgtggctcactgattgggcttaccgcgcgggcaacctgggctaccaatatccaagtcgcaattaaccaagtacgtcggctaatcggcaacgaaaactaccttgactatatgacgtccatgaagcgcttcaagaacgagtcagacccggagggggcactgtggtaa

SEQ ID NO: 24482 - RNA, 9879 nt, synthetic construct
  misc_feature 1..9879: note = derived and/or modified CDS sequence (opt11) from DENV-1__GU131778__SS-prME
  source 1..9879: mol_type = other RNA
agcgtgaccatgctcctcatgctgatgccaaccgccttggccttccacctcacaacccgggggggggaaccccatatgatcgtcagcaagcaagaacggggcaagagcctgctgttcaagacctctgccggggtgaatatgtgcaccctgatagctatggacctgggagagttctgtgaggacacaatgacgtacaagtgtccgcgcatcactgaggccgaacctgatgacgtggactgctggtgcaatgccacagatacatgggtgacctacgggacctgcagccagaccggcgagcaccggcgagacaagcggtctgttgccctggccccccacgtggggctagggctggagacgcgcacggagacttggatgagctccgagggcgcctggaaacagatccagcgggtggagacctgggccctgagacaccccggtttcacggtgatcgccctcttcttggcgcacgcaatcggcaccagcatcacccagaaagggatcatcttcatcttactcatgctagtgaccccctctatggcaatgcgttgcgtcggcatcggcagcagagacttcgtggaggggctgtccggagcgacatgggtggacgtcgtccttgaacacgggagctgcgtgaccaccatggctaaagacaagcccacgctggacatcgagctgctcaagactgaggtgacaaaccccgctgtattacggaagctgtgcatcgaggcgaaaatctccaataccaccacggacagccgctgcccgacacagggtgaggcgaccttagtagaggagcaagatgcaaacttcgtgtgccggcgcaccttcgtggaccggggctggggcaacggttgcgggctgtttggcaaggggtccctgattacgtgcgccaaattcaaatgcgtgaccaagctcgagggcaagaccgtacagtatgagaacctgaaatactcggtgatcgtgaccgtccacacgggagaccagcaccaggtggggaacgagtccactgaacacggcaccaccgcgacaatcacaccccaagccccatctaccgagatacagctcaccgactacggagcactgacactggattgcagcccccgaacagggctggacttcaacgagatggtcctcctgaccatgaaggagaagtcctggttagttcacaagcagtggttcctcgatctcccgctgccctggacctccggggcctccacctcgcaggagacgtggaaccggaaagatcttctggtgacctttaagaccgcgcatgcgaagaaacaagaggtcgtagtgctggggtctcaggagggcgccatgcacaccgccctcacgggggcgaccgagatccagacctctggcaccactaccatattcgccggacatctgaagtgccgcctgaaaatggacaagctgaccttaaagggcatgagttacgtcatgtgcacagggagcttcaagttggagaaggaggtagcggagacgcaacatggcaccgtgctcgtccagataaagtacgaagggaccgatgctccctgcaagatccccttctccacccaggacgagaagggagtaacccaaaacggtcggctgatcacggccaacccgatcgtgacggacaaggagaagcccgtcaacatcgaggccgagccccccttcggggagagctacatcgttatcggcgcgggcgagaaagccctgaagctctcctggttcaagaaagggtcatccatcggcaagatgttcgaggccaccgcccggggggcccggcgaatggcgatcctcggcgacactgcctgggacttcggtagcatcggcggcgtgttcacctccgtcggaaagttagtccaccagatcttcggcaccgcttacggcgtactgttctcaggcgtctcctggaccatgaagatcgggatcggcgtgctactgacgtggctgggcctaaactcacgctccacgtcactttccatgacctgcatcgcagtggggctcgtcaccctttacctgggcgtgatggtccaggcggacagcgggtgcgtcatcaactggaaaggccgggagcttaagtgcggttccggcatcttcgtgacgaatgaggtgcacacttggaccgaacagtataaattccaagcggactccccgaagcgcttaagcgccgccatcggaaaggcctgggaggagggggtctgcggcatacgttccgccacccgccttgagaacatcatgtggaagcaaatcagcaacgagctgaaccatattctccttgagaacgacatgaaatttaccgtagtggtcggggacgtggcaggcatcctggcccaaggcaagaagatgatccggccccagcctatggagtataagtattcctggaagtcctggggcaaggccaagattatcggcgctgatgtgcagaacacgacattcatcatagacggtcccaacacgcctgagtgccccgatgaccagcgcgcctggaacatctgggaggtcgaggactacggtttcgggatcttcaccacgaatatctggctcaagctgcgcgactcctacacccaagtgtgcgaccaccgcctgatgagcgccgccatcaaggactccaaggccgtccacgcagacatgggctactggattgaaagcgagaagaacgagacctggaagctcgcacgtgccagtttcatcgaggtcaagacctgcatctggcccaggagccacacactatggtccaatggggtcctagagagcgagatgattatacccaagatctacgggggcccaatatcccagcacaactaccggcccgggtacttcacccagaccgccgggccctggcaccttgggaagctcgaactggacttcgacttatgcgaggggaccacggtggtagtggacgagcattgcggcaaccgagggccgtcgcttagaaccaccactgtgacgggaaagatcattcacgaatggtgctgccgctcatgcaccctgccgccgctgcggttcaagggcgaggacggctgctggtacggtatggagatccgccccgtcaaggagaaagaagagaacctagtcaagagcatggtgtctgccggctccggcgaggtcgatagcttttccttagggttactatgcataagtatcatgatcgaggaggtgatgcggtcccgctggtctcggaagatgctcatgacaggtaccctcgctgtgttcttcctgctgatcatggggcaactaacgtggaacgacctcatccgcctgtgcatcatggtcggcgcgaacgcatccgaccgcatggggatgggcactacctacctcgccctcatggccaccttcaagatgcggccgatgttcgccgtgggactcctgttccgccggctgacctcgcgggaagtcctgctcctaaccatcgggctgagtctagtcgctagcgtggaactgcccaacagtctcgaggagttaggcgacggactggcgatgggcatcatgatcctgaagctcctcaccgacttccagagccaccagctgtgggccaccctcctctctctgacatttataaagaccacgttcagcttgcactacgcctggaaaaccatggcgatggtcctgtccattgtgagcctgtttcccctctgcttatccacgaccagccagaaaaccacttggctgcccgtgctcctgggctcgctggggtgtaagccactcacgatgttcctcatcgccgagaacaagatttggggccgcaagtcgtggcccctgaacgaggggatcatggccgtcggcatcgtcagcatcttactatccagcctcctcaagaacgacgtgcccctggccgggccattaatcgccggcggcatgcttatcgcgtgctacgtcatatccgggagttccgccgacctgagcctggagaaggccgccgaggtgtcctgggaggaggaggccgagcactccggcgcgtctcataacatcctagtggaggtccaggacgacgggaccatgaagattaaggacgaggagcgggatgacaccctgacaatcctgctcaaagccaccctgctggctgtgagcggcgtttacccgctgtccatacccgccacgctgttcgtatggtacttctggcaaaagaagaagcagcggagcggggtgctttgggatatcccaagcccgcccgaggtggagcgcgccgtcttagacgacggcatctatcggatcatgcagcgaggcctgttggggagaagccaggtgggtgtgggggtcttccaggagaacgtgttccacactatgtggcacgtgacccgcggcgcggtcctcatgtaccaagggaagcggcttgagccctcctgggccagcgtgaagaaggacctgatctcctacggcggggggtggagactgcagggctcttggaacaccggagaggaagtgcaggtcatcgccgtggaacccggcaaaaaccctaagaacgtccagactgccccggggacctttaagacgtctgaaggcgaggtcggtgccatagcgctcgatttcaagcccgggaccagcggcagccccatcgtgaaccgggaaggtaagatagtgggcctgtacggcaacggggtcgttacgacctccggaacctacgtgagcgccatcgcacaggctaaggcgtcccaggaggggcccctaccggagatcgaggacgaggtcttccgcaagcggaacttaaccatcatggacctgcacccaggcagcggcaagacgagacggtatttgccggccatcgtgagggaagccatcaagcgaaagctccgcaccctcatactcgcaccgacccgcgtggtcgcctcagaaatggcggaggccctcaaaggaatgcctatccggtaccaaaccacggccgtcaaaagcgagcacaccggcaaagagattgtcgacctcatgtgccacgccaccttcaccatgcgccttctctcgccagtccgggtgcccaactacaatatgatcatcatggacgaggcccacttcacggatccttcctccatcgccgcccgcgggtatattagcacccgggtaggcatgggggaagccgcggctatcttcatgaccgcgacccccccgggttccgtggaggccttcccccagagcaacgccgttatccaggacgaagagcgcgacattccggagcggagttggaacagcgggtacgaatggatcacagatttccccggaaagaccgtgtggttcgtcccctccatcaagagcgggaatgacatcgctaactgcctacgcaagaacgggaagagagtaatccagctgtcccgcaagacattcgacactgagtaccagaagacgaaaaacaatgactgggactatgtggtcaccaccgacatcagcgagatgggcgctaacttccgtgcagatcgcgttattgatccccggcgctgcttaaaaccggtgattctgaaagatgggcccgaacgtgtcatcctggccggccccatgcccgttaccgtcgccagcgccgcgcagcgccgggggcgcatcgggagaaaccacaacaaggaaggcgaccagtacatctatatgggacagccgcttaacaacgatgaagaccacgcgcactggacagaagccaagatgctgctggacaacataaacacccccgagggcatcatacctgctctctttgagccagagcgcgagaaatccgccgcaatcgacggggagtaccggctgcggggcgaggcccgcaagaccttcgtggaactgatgagacgcggggacttgccggtgtggctgagctacaaggtagcctccgaaggtttccagtatagcgaccggcgctggtgcttcgacggcgagcgaaacaaccaggtcttagaggagaacatggacgtcgaaatctggaccaaggagggagagcgcaagaagctccggccccgctggctggacgcccggacgtacagcgatcccctggccttacgagagttcaaggagttcgcggccggccggcgctcggtatccggagatcttatcctggaaatcggcaagctcccccagcacctgacccagcgcgcccagaatgccttagacaacctcgtgatgctgcacaacagcgagcagggcggacgcgcgtaccgtcacgccatggaggaactcccggacaccatcgagaccctcatgcttctggccctcatcgcagtgctgacgggcggggtaactctgttcttcctctccggccgtgggttaggcaaaacctctatcggcctgctctgcgttatggcctccagtgtgctgctatggatggcttccgtcgagccccactggatcgccgccagcataatcctggagtttttcctgatggtgctgttaattcccgagcccgaccgtcagcgtaccccgcaggacaatcagctggcatacgtggtaataggcttgctcttcatgattctgacggtggcagccaacgagatgggcttactcgagacgaccaagaaagatctggggatcggccatgtcgccgtcgagaaccaccaccacgccgccatgctggacgtggacctccaccccgcctccgcgtggacgctgtacgcggtggcgaccacgatcatcacgcccatgatgcgacacaccatcgagaacaccacggctaacatctccctgaccgccatcgccaatcaggccgccattctcatgggtctagacaaaggttggcccatctccaagatggacatcggggtgccccttttggccctggggtgctactcccaggtgaacccgctgacactcaccgcggccgtgctgatgctggtcgcccactacgcgatcatcgggcccgggctgcaggccaaggcgacacgcgaggcgcagaaacgcaccgccgctggcatcatgaaaaaccctacggtcgatggtatcgtggccattgacctcgaccccgtggtgtacgacgcgaagttcgagaagcaattgggccagatcatgctcctgatcctgtgcacttctcagatcctcctgatgcggacgacctgggcgctttgcgagagcatcacccttgccacaggtcccctgactaccctgtgggaagggtcgcccggcaagttctggaacacaaccattgcggtgagcatggcgaacatcttccgcgggagctatttagcgggagcgggacttgcctttagtctgatgaagtcactcgggggcggtcggcgcggcacgggggcgcagggcgagaccctgggtgaaaagtggaaacggcagttgaatcagctctccaaaagcgagttcaacacctacaagcgatcagggattatggaggtcgaccggtccgaggcgaaggagggcctcaagaggggggagaccacgaagcacgcggtaagtcggggcaccgcaaagttaaggtggttcgtcgagcgcaatctcgtcaagccggagggtaaggtgatcgatctgggttgcggtcgcgggggctggagttactattgtgccgggctgaaaaaggtgaccgaggtcaagggctataccaagggggggcccggtcatgaggaacctattcccatggccacgtacgggtggaaccttgtgaagttacacagcggcaaggacgtgttcttcatcccgcccgagaagtgtgatacccttctatgcgacatcggtgagagcagtcccaaccccacaatcgaggagggccggaccctccgggttctgaagatggtggagccgtggctgcgcgggaaccagttctgtatcaagatcttgaatccttacatgcccagcgtggtcgagacgctggagcagatgcagcgcaagcacggaggcatgctcgtccggaacccactctctcgcaacagcacgcacgagatgtattgggtgtcctgcgggaccggcaatatcgtcagtgcggtgaatatgaccagtcggatgttactgaaccgcttcacgatggcccaccgcaagccgacctacgaaagagatgtggacctcggggcaggtacccgacatgtggccgtggagcccgaggtggccaaccttgacatcatcggtcagcggatcgagaatatcaagcacgaacacaagagcacctggcattacgatgaggataacccctacaagacctgggcgtaccacgggtcctacgaggtcaagcccagtggttcagcttcctctatggtgaacggagttgtcaagctgcttactaaaccgtgggacgtgatcccgatggtcacccagatcgcaatgaccgacaccacgcccttcggccagcagcgcgtgttcaaagagaaggtggacacccggacacctaaggccaagcgcgggaccgcacagatcatggaagtgacagcaaagtggttgtggggattcctgtcccgcaacaagaagccgcgaatctgcacccgggaggagttcacccgcaaggtgcgctcgaatgctgccatcggcgccgtgttcgtcgatgagaaccaatggaactccgcgaaagaggccgtagaggacgagcggttctgggacctcgtccaccgagagcgcgagctgcacaagcagggaaagtgcgcgacctgcgtctacaacatgatgggcaagcgggagaagaagcttggcgagttcggcaaagccaaggggagccgcgccatttggtacatgtggctcggtgcgcggttcctggagttcgaggccctgggctttatgaacgaagatcactggttctcccgcgagaatagcctctccggggtagaaggtgaggggttgcacaagctgggctacatcctcagagacatatcacgcatccccgggggcaacatgtacgccgatgacaccgccggctgggacacccggataacagaggacgacctgcagaacgaagccaagataaccgacatcatggagccggaacacgcgctactcgccaaatccatctttaagctgacctaccagaacaaggtggtccgcgtgcagcgcccggctaagaacgggaccgtgatggacgtgatcagccggcgggaccagcggggatcgggacaggtgggcacctacggcctgaacaccttcacgaacatggaggcccaactcatacgccagatggagtccgaaggcattttctccccgagcgaactagagacccccaatctggccggccgggtgctcgactggcttgagaagcatggcgtagaacgcctaaagcggatggcgatctccggcgatgactgcgtggtgaagcccatcgacgaccgcttcgccaccgcgctcaccgccctgaacgacatggggaaggtccggaaggacatcccgcagtgggagcccagcaagggctggaacgactggcagcaggtccccttctgctcacaccacttccaccagcttatcatgaaggacggccgggagatcgtagtcccctgccggaatcaggacgagcttgtggggcgcgctcgtgtgtcccagggcgcgggttggagcttgcgcgaaacggcgtgcctgggcaaatcctacgcccagatgtggcagctcatgtacttccaccgacgcgacctgcggctggcagctaatgccatctgctcagccgtccctgtagactgggtgcccacttcccgcacgacctggagcatccacgcccaccaccagtggatgaccaccgaggacatgctgtccgtctggaacagagtatggatcgaggagaacccctggatggaggacaagacccacatcagctcctggggagacgtgccctatttgggcaagcgcgaggaccagtggtgcggctcgcttattgggttaacggccagagcgacgtgggccaccaacatccaagttgccataaaccaggttcggcgactaatcggcaacgagaactacttggattacatgacctcgatgaaacggttcaaaaacgagtccgacccggaaggggccctctggtga

SEQ ID NO: 24483 - RNA, 9879 nt, synthetic construct
  misc_feature 1..9879: note = derived and/or modified CDS sequence (opt11) from DENV-1__GU131779__SS-prME
  source 1..9879: mol_type = other RNA
agcgtgaccatgctgctcatgctgatgcccaccgccctggccttccacctcaccaccaggggcggggaaccccatatgatcgtttcgaagcaggagcggggaaagagcctgctgttcaaaaccagcgccggggtgaatatgtgcaccctcatcgccatggacctgggcgagctttgcgaagacaccatgacctacaagtgcccccggatcaccgaaaccgagcccgatgacgtggactgctggtgcaacgcgacagacacctgggtgacttacgggacctgcagccagacgggagagcaccgacgtgacaagcgctccgtggccctcgcaccccatgtgggcctggggctggagacccgcaccgagacctggatgtcttccgagggtgcctggaagcagatccagcgggtggagacgtgggccctccgccaccccgggttcaccgtaatcgccctcttcctggcccacgcgatcgggaccagcatcacccagaaggggataatctttatcctcctgatgctggtgacaccctccatggccatgcggtgcgtgggcatcggcagccgtgacttcgtggaggggctctccggcgccacctgggtggacgtcgtgctggagcacgggagctgtgtgactacaatggccaaagacaagcccacgcttgacatcgagttgttaaagaccgaggtcaccaaccccgctatcctgaggaaattgtgcatagaggcgaagatctcaaataccacgaccgacagccgctgcccgacccaaggcgaggccaccctggtggaggagcaggacgccaactttgtgtgccggcgcacgttcgtcgaccggggctgggggaacggctgcgggttgttcggcaaagggtccctcatcacgtgcgccaagtttaaatgcgtgaccaagttagagggcaagatcgtgcagtacgagaacctcaagtacagcgtaatcgtgaccgtgcacacgggcgaccagcatcaggtcgggaacgagtccaccgagcacggcaccaccgctaccatcacgccccaggcaccgaccaccgagatccagcttacagactatggcgccctgactctggactgcagcccccgcacgggactcgacttcaacgagatggtcctgctgaccatgaaggagaagtcctggctggtccacaagcagtggttcctggacttgcccctcccctggaccagcggggcctctacgtcacaggagacctggaaccggcaggacctgctggtgaccttcaagaccgcccacgctaagaagcaggaggtggtcgtccttggcagccaggaaggcgcgatgcacacggccctgaccggcgccaccgagatccaaacctccggtacaactaccatcttcgcggggcacctgaagtgcaggctcaagatggacaagctgaccctgaagggcatgagctacgttatgtgcacggggtccttcaagttagagaaggaagtcgccgagacacagcacggaacagtgctggtgcagatcaagtatgagggcaccgacgcgccctgcaagatcccctttagcacgcaggacgagaagggggtcacccagaacggccggctgatcaccgctaatcccatcgtgaccgacaaagagaagcccgtaaacatcgaggccgagccgcccttcggggagtcctacatcgtcattggtgccggcgagaaggcgctgaaactcagctggttcaagaaaggctccagcattggcaagatgttcgaggccacggcccgcggggcccgtcgcatggccattctgggcgacaccgcgtgggacttcgggtccatcggcggggtgttcaccagcgtgggtaagctggtccaccagatcttcggcacagcctacggggtcctcttctccggcgtgagctggacgatgaagatcgggataggcgttctgctgacctggctggggctgaactcccgcagcacctccctgagcatgacctgcatcgccgtggggctcgtgactctgtatttaggcgtcatggtgcaagcggactccgggtgcgtgatcaactggaagggacgggagctcaagtgcgggagcggcatattcgtcaccaacgaggtccacacctggacagagcagtacaagttccaggccgacagcccgaagcgcctgtccgccgccatcggcaaggcctgggaggaaggggtgtgcggcatccggagcgccacccgactggagaacatcatgtggaagcagatcagcaacgagctcaatcacatcttactagagaacgacatgaagttcacggtggtggtaggggacgtcgccggcatactcgcgcaggggaagaagatgatcaggccccagcccatggagtacaagtacagctggaagtcctggggcaaggccaagatcatcggcgccgacgtgcaaaacaccaccttcatcatcgatggtccgaacacccccgagtgccccgacgaccagcgggcctggaacatctgggaggtggaggactacggcttcgggatcttcacgaccaacatctggctgaagctgcgggacagctatacccaggtctgcgaccacagactcatgtccgcggccatcaaggatagcaaggccgtgcacgctgacatgggctactggatcgagtccgagaagaacgagacctggaagctggctcgggcgagcttcatcgaggtgaagacgtgcatctggcccaagtcccacaccctgtggagcaatggcgtcctcgagtccgagatgataatcccgaagatctacgggggcccgatctctcagcataactaccgccccggatacttcacccaaaccgccggaccctggcacctggggaagctggagctcgacttcgacctgtgtgaggggacgactgtggtagtcgacgagcactgcgggaaccgggggccgagcttgcgaactactacggtgacgggcaagatcatccacgagtggtgttgccggagctgcacgctgccgcccctcagattccgcggggaggacggctgctggtacgggatggagatacgtcccgtgaaggagaaggaggagaacctggtcaagtcgatggtgagcgcggggagcggcgaggtagactccttcagcctagggctgctttgtatctccatcatgatcgaggaggtcatgcggtcgcgttggtccaggaagatgctcatgaccggtacgctagcagtgttcctgctcctaatcatggggcagctgacctggaacgacttaatccgcctgtgcataatggtgggagccaatgctagcgaccgtatgggaatgggcaccacctacctcgccctcatggccactttcaagatgcggccgatgttcgccgtcggactgctgttccgcagacttacctcgcgcgaggtgctgctgctcaccatcgggttaagcctggtggtctccgtggagctgcccaatagcctggaggagttgggggacgggctcgccatgggcataatgatcctgaagctgcttaccgactttcagtcccatcagctgtgggctacgttattgagcctgaccttcatcaagaccactttctccctgcactacgcctggaagacgatggcgatggtcctcagcatcgtgtccctgttccccctgtgcctctccaccacctcccagaagaccacctggcttcccgtgctcctcggaagcctggggtgcaagccgctgaccatgttcctcatcgcagagaacaagatatggggcagaaggtcctggcccttgaacgaggggatcatggcggtcggcatcgtgagcattctgctaagctccctgctgaagaacgatgtcccactagccgggcccctgatcgccggtggcatgctgatcgcctgctacgtcatcagcgggtccagcgccgacctctccctggagaaggcggccgaggtaagctgggaggaagaggccgaacactccggcgcgagccacaacatcctggtcgaggtccaggacgacgggaccatgaagatcaaggacgaggagcgggacgacaccctcaccatcctgctgaaggccactctcttggcagtctccggcgtatacccgctaagcatcccggccaccctcttcgtctggtacttctggcagaagaagaagcagcgctccggggtgctgtgggacacccccagtccacccgaggtggagcgggccgtcctggacgacggcatctaccgcatcatgcagcggggactgctcgggcgctcccaagtgggcgtgggcgtcttccaggagaacgtgttccatactatgtggcacgtgacacggggcgccgtactgatgtaccaggggaagcgcctggagcccagctgggcctccgtgaagaaggacctcatcagctacggcggcgggtggcggctgcagggctcctggaataccggggaggaggttcaggtcatcgccgtggagcccggaaagaaccccaagaacgtgcagaccacccccggaacgttcaagaccccagagggtgaggtcggcgccatcgctctggacttcaaacccgggaccagcggctcccccatcgtgaacagggaggggaagatcgtcggcctctatggcaacggggtcgttaccactagcgggacttatgtgagcgccatcgcccaggcgaaggcctcccaggaggggccgctgcccgagatcgaggacgaggtattccggaaacgaaacctgaccattatggacctccaccccggcagcgggaagacccggcgctacctgccggccatcgtgcgggaggccatcaagcgcaaactgcgcaccctcatcctggcgccgacgcgggtggtcgcatccgaaatggccgaggccctgaagggcatgcccatcagataccagaccaccgcggtcaaaagcgagcacacggggaaagagatcgtggacttaatgtgccacgcgaccttcaccatgcggctgctgtcccccgtccgcgtgccgaactacaacatgatcatcatggatgaggcacatttcaccgacccttcatccatagccgcccgggggtacatttcgacccgcgtgggtatgggggaggccgcggccatctttatgaccgctacgccacccggctccgtcgaggccttcccgcagagcaacgccgtgatccaagatgaggaacgggacatcccagagcgctcctggaatagcgggtacgagtggatcaccgacttccccggcaagacggtgtggttcgtcccctccatcaagagcggcaacgacatcgcgaactgtctccggaagaacgggaaacgcgtgatccagctgtccaggaagactttcgacactgagtaccagaagaccaagaataacgactgggactatgtggtcacgacagacatcagcgagatgggcgcaaacttccgggcagaccgagtgatcgacccgcgccggtgcctgaagcccgtgatcttgaaggacggtcccgagcgcgtcatcctggccggcccgatgccggtgaccgtcgcgtccgccgcccagcggcgcgggcgtatcggccgtaaccacaacaaggagggagatcagtacatctacatggggcagccccttaacaacgacgaggaccacgctcactggaccgaggccaagatgctccttgacaacatcaacacgcccgaaggcataatccccgcgctgttcgagccggagcgcgagaagtccgccgccatcgacggggagtaccggctccgcggcgaagcgcggaagaccttcgtcgagctcatgcgccgcggggacctgccagtgtggttgtcgtacaaggtcgccagcgagggcttccagtactctgaccgccggtggtgcttcgacggagagagaaacaaccaggtgctggaggagaacatggacgtggagatctggacgaaggagggggagcggaagaagctgcgccctcggtggctcgacgcgcgcacctactccgacccgctggccctgcgggagttcaaggaatttgccgccggccgccggtcggtatccggggacctcatcctggagatcggtaaactgccgcagcacctcacgcagcgcgcccagaacgccttggacaacctggtgatgctccacaacagcgagcagggagggcgggcataccgccacgccatggaggagctgcctgataccatcgaaaccctgatgttactggccctgatcgcggtgctcaccggcggggtcaccctattcttcctgtccggccgggggctcggcaagacgagcatcggcctgctgtgcgtgatggcctccagcgtcctcctgtggatggcctccgtcgagccccactggatcgccgcgtcaatcatcctggagttctttctcatggtactgctgatacccgaacctgaccgccagcggacgccccaggacaatcagctcgcgtacgtggtaatcgggttactgttcatgatcctcaccgtggcagccaacgagatgggcctcctggagaccacgaagaaggatctcgggatcggccacgtggccgtcgggaaccatcaccatgccgcgatgctggacgtagacctgcaccccgcctctgcctggaccctctacgccgtagccaccactatcatcacgcctatgatgcgccacaccatcgagaacacgaccgcgaacatcagcctaacggcaatagccaaccaggcggccatcctgatgggcctcgacaagggctggcccatttccaagatggacatcggggtccccctcctggcgttaggctgctacagtcaggtgaaccccctgaccctgactgccgccgtgctcatgttggtagcacactacgcgatcatcgggccgggcttacaggccaaagccacccgtgaggcccagaagcggactgctgcggggatcatgaaaaaccccaccgtggacggcatcgtggccatcgacctcgaccccgtcgtgtacgacgccaagttcgagaagcagctgggacaaataatgctgctcatcctgtgcaccagtcagatcctgctcatgcgcaccacgtgggccttgtgcgagagcatcaccctggccactggccccctcaccactctgtgggagggctccccggggaagttctggaacacgaccatcgcggtgtctatggccaacatcttccggggctcctacctggccggcgccggactcgcattcagcctgatgaagtccttaggcggaggccgccgggggaccggcgcgcagggcgagacgctcggggagaagtggaagcggcagctaaaccaactgtccaagtctgagttcaacacatacaagcggtccggcatcatggaggtcgaccgcagcgaagccaaggaggggctcaagcggggcgaaaccaccaaacacgccgtatcccgcggcacggccaagctgcgctggttcgtagagcgcaacctggtgaaacccgagggcaaggtgatcgatctcggctgcgggcgcggcgggtggagctactactgcgcgggcctcaagaaggtaaccgaggtcaaagggtataccaagggcggccccggccacgaggagcccatcccgatggcgacctacggctggaacctggtgaaactgcattccgggaaggacgtgttctttatcccgcccgagaagtgcgacacgttattgtgcgacatcggggagagctcccccaaccccaccatcgaagaaggtcgcaccctgcgggtcctcaagatggtggagccctggctgcgcggcaaccagttctgcatcaagatcctgaacccatacatgccgagcgtagtggagaccctcgagcagatgcagaggaagcacggcgggatgctagtgcgcaatcctctgtcccgaaactcgacccatgagatgtactgggtgtcctgcggcacggggaacatcgtcagcgcagtgaacatgacctcccgcatgctcctgaaccgcttcaccatggcccacagaaagcccacctacgagcgcgacgtggacctgggtgctggcacgcggcacgtcgcggtggagcccgaggtggccaacctcgacatcatcgggcagcgcatagagaacatcaagcacgagcacaagtccacctggcactacgacgaggacaacccctacaagacctgggcctaccacggctcctatgaggtcaagccgagcgggtcggctagcagcatggtcaacggcgtggtgaagctgctgaccaagccctgggacgttatccccatggtcacgcaaatagctatgaccgacaccacgcccttcgggcagcaacgggtgttcaaggaaaaggtggacacgagaaccccgaaggcgaagcggggcaccgcccagattatggaggtcaccgccaagtggctatggggattcctgtcccgcaacaagaaaccccggatctgtactcgcgaggagtttacccgcaaggtgcgcagcaacgcagccatcggggcggtgttcgtagacgagaaccagtggaactccgccaaggaggccgtggaggacgaacggttctgggacctggtgcaccgcgagcgggaactccacaagcaaggcaagtgcgctacctgcgtatataacatgatgggcaagcgggagaagaagttgggcgagttcgggaaagcgaagggcagccgggccatctggtacatgtggctgggcgcccgcttcctggagttcgaagccctggggttcatgaacgaggaccactggttctcacgggagaatagcctgtccggcgtggagggggaaggactccacaagctgggctacatcctgcgagacataagcaagatccccggcggcaacatgtacgccgacgacaccgcgggctgggacacgcggattaccgaggacgatctacagaacgaggcccggatcaccgacatcatggagccggagcacgccctgctggccaagtccatcttcaaactcacctaccaaaacaaggtggtccgcgtgcagcggcccgcgaagaacggcacggtgatggacgtcatcagccgccgggaccagcgcgggagtggccaagtgggcacctacgggctgaacactttcaccaacatggaggcgcagctgatccggcagatggagagcgagggcattttctctcccagcgagctcgagacgcccaacctggcagagcgcgtgctggactggctcgagaaatatggggtcgagcggctgaagagaatggctatctcgggtgacgactgcgtggtcaaaccaatcgacgaccggttcgccacggccctgaccgcgctgaacgacatggggaaggtccgcaaggacatcccccagtgggagcccagcaagggctggaacgactggcagcaggtccccttctgctcccaccacttccaccagctcatcatgaaggacggccgggagatcgtagtcccgtgccgcaaccaggatgaactggtggggcgggcccgagtgagccagggcgccgggtggagcctccgggagaccgcctgcctgggcaagtcctacgcccagatgtggcagctgatgtactttcaccgccgtgacctccgcctggcggcgaacgcgatctgcagcgccgtccccgtagactggattcccacgtcccgaaccacctggagcatccacgcgcaccaccagtggatgaccacggaggacatgctgtccgtgtggaacagggtatggatcgaggagaatccctggatggaagacaagacccacattagctcctggggcgacgtgccgtacctcgggaaacgcgaagaccaatggtgcggcagtctgatcgggctgaccgcccgggccacgtgggccaccaatatccaggtggccataaaccaggtccgccggctcatcggcaacgaaaactacttggactacatgacgtccatgaagcgtttcaagaacgagagcgaccccgagggtgcgctgtggtga

SEQ ID NO: 24484 - RNA, 9879 nt, synthetic construct
  misc_feature 1..9879: note = derived and/or modified CDS sequence (opt11) from DENV-1__GU131780__SS-prME
  source 1..9879: mol_type = other RNA
agcgtaaccatgctactcatgctcatgcccactgccctggcctttcacctcacgaccagagggggggagccgcacatgatcgtaagcaaacaggagcgtggtaagagcctgctgttcaaaacctccgccggggtgaacatgtgcacactcatcgccatggacctgggagagttttgcgaggacaccatgacgtacaagtgcccccgtataactgaagctgagccagacgacgtggactgctggtgcaacgcgaccgacacgtgggtgacgtacgggacgtgcagtcaaactggcgagcatagacgggacaagcggtccgtggccctggcgccccacgtcggactcgggctcgaaacgaggaccgagacctggatgtcatccgagggagcctggaagcaaatccaacgggtcgagacctgggctttaagacatcccgggttcaccgttatcgcccttttccttgcgcacgccatcggcaccagcatcacccagaagggtataatcttcatcttgctcatgctagtgactccttccatggccatgcggtgcgtcggtattggcagccgggactttgtagaggggttatcaggtgccacctgggtggatgtcgtattagagcacgggagctgcgtgacgacaatggcaaaagacaagccgaccctggacatcgagctactgaagacggaggttacgaaccccgcggtgctgcgcaagctatgtatcgaggccaagatatccaacaccactacagatagccgctgcccgacccagggagaggccacattggtggaggagcaggatgccaacttcgtctgccggcgcaccttcgtggaccggggctgggggaacggctgtggtctgttcggcaagggctcattaataacgtgcgcaaagttcaagtgcgtgaccaagctcgaaggaaagacggtccaatacgaaaatcttaagtatagcgtgatagttacagtccatacaggggaccagcaccaagtggggaatgaatcaactgagcacggcaccactgccacgatcacgccccaggcccctagcaccgagattcagctgaccgactacggggcgttaacccttgactgtagcccccgtaccggcttagacttcaacgaaatggtcctcctgacgatgaaggaaaagtcctggctcgtccacaaacagtggttccttgacttaccgctgccctggactagcggggcttccaccagccaggaaacctggaaccgtaaggacctcctggtgacctttaagaccgcccacgccaagaagcaggaagtcgtggtgttgggcagccaggagggtgccatgcacaccgccctcacgggtgcaaccgagatccagacctcgggcaccacgacgatattctccgggcacctgaagtgcagactgaagatggacaagctcacgctgaaggggatgtcctacgtcatgtgcacagggtcctttaagcttgagaaagaggtggccgagacgcagcacgggaccgtgctcgtccagatcaagtacgagggcacagatgcgccctgtaagatccccttctccacccaagacgagaagggtgtaacgcagaacggccggctgatcactgcaaaccctatcgtgaccgacaaggagaagcctgtgaacatcgaggccgaaccgcccttcggggaatcctacatcgtgataggagccggcgagaaggctctaaagctaagctggttcaaaaaagggtccagcatcggtaagatgttcgaggccaccgccaggggggcccggagaatggccatcctaggagacacggcgtgggacttcggctctataggcggcgtttttaccagcgtcgggaagctggtacaccagatatttggcaccgcttacggtgtgttgttctccggggtgtcctggaccatgaagatcggaatcggcgtgctcttgacgtggctgggtctcaattcccggtcgacctcccttagcatgacctgcatcgctgtggggttagtcaccctctacctaggcgtgatggtgcaagccgattcaggctgcgtcatcaactggaagggccgcgagcttaagtgtgggtcgggcatcttcgtgactaatgaggtgcacacctggaccgaacaatacaagtttcaggccgacagcccgaagcggttgtccgctgccatcggtaaggcctgggaagagggggtctgtggcatccggagcgcgactcgcctcgagaatatcatgtggaagcagatctccaacgagctgaaccacatactgctggagaacgatatgaagtttaccgtggtggtcggggacgtggcaggcatcttagcccagggtaagaagatgatacggccccagcccatggagtacaaatacagctggaagtcttggggcaaagccaagatcatcggcgcagacgtccagaacacgacatttatcatcgacggaccgaacacaccggaatgccccgacgaccaacgcgcctggaacatttgggaagtcgaggactacggctttggcattttcaccactaacatctggcttaaattgcgggacagctatacccaggtatgcgatcatcgcctgatgagtgcggccatcaaggacagcaaagccgtgcacgccgacatgggctactggatcgagagcgagaagaacgagacctggaaactcgcaagagcaagcttcattgaagtcaagacctgcatatggcccaagtctcacacgttatggagcaacggcgtactggagtccgagatgatcatccccaagatttacgggggcccgatctctcaacacaactaccgccccggttatttcacacagacagctggcccctggcacctcggtaagctggagttggacttcgacctctgcgaaggaaccacggtggtagtggacgagcactgcggcaaccgcgggccgtcactgcgcaccacgaccgtgacgggcaagatcatccacgagtggtgctgccggtcatgcacactgccgccactgcgcttcaagggggaggacggctgctggtacggaatggaaatccggcctgtcaaggagaaggaggagaacctggtcaagagcatggtgtcagctgggtccggtgaggtcgactccttcagcctggggttactgtgtatctcaatcatgatcgaagaggttatgcgcagccggtggtcccgcaagatgttgatgactggcactttagcagtgttcttcctgttaatcatgggtcagctcacttggaacgacttgatacggctgtgcattatggtgggcgcaaacgctagcgaccgcatggggatgggcaccacctatctcgcgctgatggccacttttaagatgcgcccgatgttcgccgtgggactcttattccgacgcctcacgtcgcgggaggtactgctcctgacaattggtctgtcgctagtggcatctgtggagttaccgaacagtctggaggaactcggggatgggctggcgatgggcatcatgatccttaagctcctgacagactttcagtcccatcagctgtgggcaaccctactgtccctaaccttcatcaagacgacgttctcgctgcactatgcctggaagaccatggccatggtattaagcatagtgtctctgtttcctttatgcctgagcactacatcccagaagaccacgtggctgcccgtgctcctgggttctctgggatgcaagccgttgacgatgttcctgatcgcggagaataagatctggggccggaaaagctggccactaaacgaaggtatcatggccgtcggcatagtctccatcctcttaagcagcctgctcaagaacgacgtgccgctggccgggccccttatcgccgggggcatgctcatcgcctgttacgtcattagcggaagttctgcggacctgtccttggagaaggcggccgaggtcagctgggaggaggaggcggaacacagtggcgccagccacaacatcctcgtggaggtgcaagatgacgggaccatgaagatcaaggacgaagaacgggacgataccctgaccatcttgctcaaggcaaccctgctgacggtgtcgggcgtgtatcctctcagcatccccgcgaccctgttcgtgtggtacttctggcaaaagaagaaacaacgctccggtgtcctgtgggacacacccagcccgcccaaggtggagcgggccgtcctcgacgacggaatttatcgcatcatgcagcgtggcctgctggggagatcgcaggtaggcgttggtgtcttccaggagaacgtattccacacaatgtggcatgtaacgcgtggcgccgttctaatgtaccaaggaaagcgcctcgaaccaagctgggcctctgtcaagaaggatctgatcagctatggcggcgggtggcggttgcagggctcctggaacaccggtgaagaggtgcaggtaatcgcggtagagcccggtaaaaacccgaagaatgtgcagaccgcccccgggacatttaagacttcagaaggcgaggtcggcgccatagccttggacttcaagcccggcaccagcggctccccgattgtgaaccgcgagggaaagatcgtggggctgtacggcaacggggtcgtgacaaccagcggcacgtatgtatccgccatcgcgcaggccaaagccagccaggaggggccattgcccgaaatcgaggacgaggtctttcggaagcgtaacctgactataatggacctgcaccccggaagcgggaagacccggagatatctgccggccatcgtgagagaggcgatcaagcgcaagctccgtaccctgatcttggcccctacgagagtggtcgcctcagagatggccgaagcattaaaggggatgcccatacgctaccagaccacagcggttaaatccgagcacaccggcaaggaaattgtggatctgatgtgccatgcaacgttcaccatgcggttgctctcccctgtccgcgtgccgaactacaacatgattatcatggatgaagcccacttcaccgaccctagcagtattgccgcccgtggatatatcagcacccgggtcggcatgggggaggcggccgcaatcttcatgaccgccacgccgcccggctcagtcgaggctttccctcagtccaacgcggtgattcaagacgaggagcgcgatatcccggagcgcagctggaactccgggtatgagtggattaccgacttccccggcaagacagtgtggttcgtccctagcataaagagtggaaatgatatagcgaactgcttacggaagaacggcaaaagggtgatccagctgagccggaagacgtttgacaccgagtaccagaaaactaagaacaatgattgggactatgtggtaaccacggatatttcggaaatgggcgccaattttagggccgacagggtgatcgatccccggcggtgcctgaagccggtgatcctgaaggacgggccagagcgcgtcatcttagcagggccgatgcccgttactgtcgccagcgccgcccagagacgcggtcggataggcagaaatcacaataaggagggcgaccagtatatttatatggggcagccactcaacaacgacgaagatcatgcccactggacggaggcgaaaatgttactggataacattaacacccctgagggaatcatccccgccttgttcgagcctgagcgtgaaaagtccgcggccatcgacggcgagtaccggcttcggggcgaggcacgaaagacttttgtggaactaatgaggaggggggatctcccggtgtggctgtcatacaaggtcgcgtcggagggttttcaatactcggatcgccggtggtgctttgacggagagcggaacaaccaggtgctagaggaaaacatggacgtggagatctggaccaaggagggtgagcggaagaagttacgcccacggtggttggacgcccggacatacagcgatcccttagcactccgtgagttcaaagagttcgctgctggccgccgatccgtctccggggacctgatcctggagatcggtaagttgccccagcacctgacacagcgcgctcagaatgcactggacaacctggttatgctgcacaattccgagcagggcgggagagcgtaccgccacgccatggaggagctaccggacactattgagacaatgatgctcttggcgctcatagccgtactcactggcggagtcaccctgttcttcctcagcggacgagggctcggcaaaacctccatagggctgctgtgcgttatggctagttccgtccttctgtggatggccagcgtggagccccactggatcgccgcatccataatcctggagttctttctcatggttttgctgatacccgagcccgaccgtcagcggacaccacaggacaaccagttagcctacgtggtcatcggcctgctgttcatgatccttacggtagcggccaatgagatgggcctgctggagaccaccaagaaggacctggggatcggccacgttgctgtcgaaaatcaccaccatgcggccatgctggacgtcgacctgcaccccgcctcagcatggacgttgtacgctgttgctaccaccatcatcacccccatgatgcgccataccatcgagaacaccactgcgaacatctccctgaccgccatcgcgaaccaggccgcaatcttgatggggttggacaagggctggccgattagcaagatggacatcggtgtccccctgttggccctcgggtgctacagtcaggtgaaccctctgacgctgaccgccgccgtgctcatgctggttgcgcactacgccatcatcggccctgggttacaggccaaggctacccgcgaggcacaaaaacgtacggcggcaggcatcatgaaaaaccctaccgtggacgggatagtggccatcgacctcgaccccgtcgtttatgacgctaaattcgagaaacagctgggccagattatgctgttgatcctgtgcaccagccagatactactcatgagaaccacctgggccctctgcgagagtatcacgctggcgaccggacctctaactaccctgtgggaggggtcccccggcaaattctggaacacgaccatagcggtaagcatggctaacatcttccggggatcgtacctagccggtgccgggctggcgttctcgctgatgaagtccctcgggggcgggcgaaggggtacgggggctcaaggcgagaccctcggcgagaagtggaagcgccagctcaatcagctctccaagtccgaattcaacacgtataagcggtcagggatcatggaagtcgaccgaagtgaagcgaaggagggcttgaaacgaggtgagaccaccaagcatgccgtgagccgcggcaccgctaagctgaggtggttcgtggaacgcaatttagtcaagccggaaggtaaggtgatcgacctcggctgcggccgcggcgggtggtcctactactgtgcaggcctgaaaaaggtgacggaagtaaaggggtacaccaaaggcggtcccgggcacgaggagcccatacccatggctacgtacggttggaacttggtgaagctgcactccggcaaggatgtgttcttcatcccgcccgagaaatgcgatacattgctctgcgacatcggggagtcctcacccaaccccaccatcgaagaaggccgaaccctgcgtgtactaaagatggtggagccctggctacgagggaaccagttctgcataaagatccttaacccctacatgcccagcgtggtcgagaccctcgagcagatgcaacggaagcacggtggcatgctggtgcgcaaccccctgtcgcggaactctacccacgagatgtactgggtgtcctgcgggacaggcaacatcgtctccgcagtcaacatgacgtccagaatgcttctgaaccgcttcaccatggcccaccgcaagccgacctacgagagggacgttgacctgggagcgggcacccggcacgttgccgtggagcccgaggttgccaacctcgacatcatcggccagaggatcgagaacataaagcacgaacacaagtctacctggcactacgacgaagacaacccatacaagacctgggcttaccacgggtcctacgaggtcaagcccagcgggtccgctagcagtatggttaacggcgtcgtgaagctgctcactaagccgtgggacgtgatccccatggtcacacagattgctatgaccgacaccaccccgttcggccagcagcgggtgtttaaagagaaggtggacacccggacgcccaaggccaagcggggcaccgcccagataatggaggtcaccgctaaatggctctggggcttccttagccgcaacaagaagccacgcatttgtaccagggaagagttcacgcggaaggtgcgctcaaacgccgcgataggcgctgtgttcgtcgatgagaatcagtggaactcagccaaggaggccgtggaggacgagaggttctgggacctagttcaccgcgaacgggagctccataagcagggcaagtgcgctacctgcgtgtacaacatgatgggcaaaagggaaaaaaagctgggtgagtttggcaaagccaaggggtcaagggccatatggtacatgtggctgggagcccgcttcctagagttcgaggccctcgggtttatgaacgaggaccactggttcagccgggaaaactcgctctctggggtggagggagagggactccacaagctcggctatatcttgcgcgacatctccaagatccccggcggcaacatgtacgcagatgacaccgccggttgggacacacggatcacggaagacgacctacagaacgaggccaaaattaccgatatcatggagccagagcacgcactgctggccaagagcatcttcaaactcacctaccaaaacaaagtggtacgtgtgcagcgaccggccaagaacggaaccgtgatggacgttatttcacgtagggaccagcggggctccggccaggtgggcacgtacggcttgaacacattcaccaacatggaggcccagctgatccgccagatggagtccgaagggatattcagtccctccgagctcgagacaccaaacctggccaggcgcgtgctggactggctcgagaagcatggcgtcgagcggctgaaacgcatggccatcagcggcgacgactgtgtcgttaagccaatagacgaccggttcgctaccgccttgaccgccttgaatgacatgggcaaagtgcggaaggacatccctcagtgggagccgagcaaaggctggaatgactggcagcaagtccccttctgctcgcaccactttcaccagctgatcatgaaggacggtagagagattgtggtcccctgtaggaaccaggatgagctcgtcggccgtgcgcgcgtgagccagggcgccggctggtccctccgggagaccgcgtgcctgggaaaaagctatgcgcagatgtggcaactaatgtacttccatcgccgggatctccgacttgcagccaacgccatctgctccgcggtaccagtggactgggtaccgacctccaggactacgtggtccatacacgcccatcaccagtggatgaccaccgaagacatgctatcagtctggaatagagtgtggatcgaggagaatccctggatggaagacaagacgcacatctcttcatggggtgacgtcccttacctggggaagcgggaggaccagtggtgcggctccctgatcggcctaacagcgcgcgcaacctgggccaccaatatccaggtcgctatcaaccaggtgcgaagactcatcgggaacgaaaattatctggattacatgacatcaatgaagcgctttaagaacgagtccgacccagaaggggccctgtggtga

SEQ ID NO: 24485 - RNA, 9879 nt, synthetic construct
  misc_feature 1..9879: note = derived and/or modified CDS sequence (opt11) from DENV-1__GU131781__SS-prME
  source 1..9879: mol_type = other RNA
tccgtcaccatgctgctaatgttaatgcctaccgccttggccttccacctcacgacccggggcggggagcctcacatgatcgtgtctaagcaggaacgtggcaagagcttactgtttaaaaccagcgccggggtaaacatgtgcaccctcatcgcgatggacctgggcgaattctgtgaggacactatgacatacaagtgcccacgaatcactgaggccgagcccgacgacgtggactgctggtgtaacgccaccgacacgtgggtgacttacgggacctgcagccagaccggcgagcaccggcgggacaagcggtccgtggcactggcgccacatgtgggcctaggtctggagacgcgcacggagacctggatgagcagtgagggcgcctggaagcagatccagcgtgtcgagacctgggctttgcgacaccccgggtttacggtaatagccctcttcctggcccacgccatcggcacatctattactcaaaagggtatcatcttcatccttctgatgctggtgacaccctcaatggccatgcggtgcgtcggcatcgggagccgggacttcgtcgaggggctgtccggcgccacgtgggtggacgtcgtccttgagcacggcagctgcgtgaccaccatggcaaaagacaagcccactctggacattgagctgctcaagaccgaggtcactaaccccgcggtcctgcggaagctctgcatagaagccaagatctccaacaccaccacggacagccggtgccccacccagggagaagcaaccttagtagaagagcaggacgctaacttcgtctgccggcgtacctttgttgaccggggctgggggaacgggtgcgggcttttcggtaaggggtccttgatcacatgtgccaagtttaagtgcgttaccaagctcgaaggcaaaatagtacagtacgagaacctgaagtacagcgtaatcgtgacggtccacaccggggatcagcatcaagtggggaacgagtcgacagaacacggcaccaccgcgaccatcacgccccaagccccctcaacggagatccagctgactgactacggggcattaactctggactgcagtcccagaactggcctggacttcaatgaaatggtcctcctcacgatgaaggaaaagtcctggctggtacacaagcaatggttcctcgatctgcccctaccctggacgtctggcgcctccacaagtcaagagacgtggaaccggcaagacctcctcgtcacgttcaagaccgcccacgcgaaaaaacaggaggtcgtcgtcttgggatcccaggagggcgcaatgcacaccgccctaaccggggcgacggagatccagacctccggcaccaccactatattcgctgggcacctgaagtgtcgcctgaagatggataagctcacccttaagggcatgtcctatgtcatgtgcactgggtccttcaagctggagaaggaggttgccgagacacagcacggtacggtgctcgtccagattaaatacgaaggcaccgacgccccctgcaagatcccgttctccacccaggacgagaagggggttacccagaatggccggctgatcacggctaaccctatcgtgaccgacaaggacaagcccgtcaacatcgaggctgagccgcctttcggggaaagctatatcgtgatcggcgcgggggagaaggccctgaagctgtcctggttcaaaaagggttccagtatcggcaagatgttcgaggccaccgcgcgcggtgcccggcggatggccatcttgggcgataccgcctgggacttcgggagcatcggcggcgtttttacttccgtcgggaagctggttcaccaaatcttcgggaccgcatacggcgtcctgttcagcggcgtctcctggaccatgaagatcgggattggcgtgttactaacctggctgggcctcaactcacgctccacatctttatccatgacctgcatagccgtagggctggtcactttgtacctgggcgtgatggtgcaggccgacagcggctgtgtcgtgaactggaagggcagagaactgaagtgcgggagcggcatattcgtgaccaatgaggtccacacgtggactgagcagtacaaattccaggcggactccccgaaacgcctaagcgcagccatcggcaaggcctgggaggagggggtctgtggcatccggtcggccacccggctggagaatatcatgtggaagcagatcagcaacgagctgaaccatatcctgctagagaacgacatgaaattcaccgtggtggttggggacgtcgcaggcatcctggcccaagggaaaaaaatgatccggccccagcccatggagtataagtattcctggaaatcctggggcaaggccaagattatcggcgcagatgtccagaacacaacgttcataatcgacgggccaaacacgcccgagtgccctgacgaccagcgcgcgtggaacatctgggaggtagaggactacggattcgggatcttcaccaccaatatatggctcaaactgcgggattcctacacgcaagtgtgcgaccaccggctgatgagcgcagccatcaaagactccaaagcagtccacgccgacatgggctactggatcgagagcgagaagaacgagacctggaaactcgcgcgtgcctccttcatcgaggtgaagacgtgtatttggcccaagagccacaccctgtggtccaacggtgtgctggaaagcgagatgataattccaaagatttacgggggcccgatctcacaacataactaccgacccgggtacttcacccagactgccggcccatggcacctcggtaaactagaactggactttgacctctgcgagggcacaaccgtcgtggtggacgagcattgcggcaaccggggcccaagcctgcgcaccacgaccgtcaccggaaagattatacacgagtggtgttgcaggtcgtgcactttgccgcctctgcggttcaagggggaggacggctgttggtacgggatggaaattcgcccggtgaaggagaaggaggagaacctggtcaagtcaatggtaagcgccggctctggcgaggttgacagcttctctttagggttgctgtgcataagtataatgattgaggaggtgatgaggtcccgatggagccgcaagatgttgatgaccggcaccctcgccgttttcttcctgctgatcatggggcagctcacctggaacgacctgataaggctgtgcatcatggtgggcgcgaacgcctccgaccgcatggggatgggcaccacctatttagccctgatggccacgttcaagatgcgcccgatgtttgcggtgggcctgctgttccggcgcttgacaagccgggaggtcttactcctgaccataggcctgtccctcgtggcaagcgtcgagctgccgaattccctggaggagttgggcgacgggctggctatgggcatcatgatcctgaagctcctaaccgatttccagtcccaccagctgtgggccaccctcctgtccctgaccttcatcaagacgaccttctcactccactacgcgtggaagaccatggctatggtcttatccatcgtgtctctgttccccctgtgtatgtccaccacatcgcaaaagaccacctggttacctgtcctgctcggctccctggggtgcaagccgctgaccatgttcctcatcgccgagaacaagatctggggccgcaagtcttggcccctaaacgaggggatcatggcagtgggcattgttagcatcctcctctccagcctgctgaagaacgacgttccccttgccgggcccctgatcgccggtggcatgctaatcgcgtgctacgtgatctccggtagctccgccgacctgtcgcttgagaaggccgccgaggtgtcgtgggaagaagaggcggagcactcaggcgcatctcacaacatcctggtcgaggtgcaggacgacggcaccatgaagatcaaggatgaggagcgtgacgacaccctcaccatcctgctgaaggccaccctactcgccgttagcggagtctatccactatccatccctgctaccctcttcgtttggtacttctggcagaagaagaaacagcgcagcggcgtgctgtgggacacaccgagcccacccgaagtcgagagagccgtactggacgacggcatctaccgcatcatgcagcgaggcttactgggacgcagccaggtgggagtcggggtctttcaggagaacgtgttccacactatgtggcacgtgacaagaggcgcggtgctgatgtaccagggcaagcgcctcgagccttcctgggcctctgtgaagaaagatctcatctcctatggcggcgggtggcgactgcagggcagctggaacacgggggaggaggtccaggtgattgccgttgagcccggcaagaaccccaagaatgtccagactgcgcccgggaccttcaaaacctcggagggcgaggtgggtgctatcgcgctggacttcaagcccggtactagcggtagccccatagtgaaccgcgaaggcaagatcgtcggcctttacggcaatggggtggtgacaacttccggcacctacgtcagcgccatcgcccaggccaaggcctcccaagaggggcccctgccggagatcgaggatgaggtctttcggaagcgcaatctgaccatcatggatctccatcccggcagcggtaagacgcggcgctatttgcccgccatcgtgcgtgaggccatcaagcgcaaactccgcacccttatcctggcccctacaagagtcgtcgcctccgagatggcggaggccctgaaaggcatgccaatccgttaccagaccacggccgtcaagtctgagcacaccggtaaagagatcgtagacctcatgtgccatgcgaccttcaccatgagactgctttctcccgtgcgcgtacccaactacaacatgattatcatggacgaggcccatttcacggacccgagctccatcgcggcccgcgggtacatctcaacccgcgtcggcatgggggaggccgccgccatcttcatgacggccacgccgcccggctccgtggaggccttccctcagagcaatgccgtgattcaagatgaggagcgggacataccggaacgctcatggaatagcggttacgagtggatcaccgacttccccggcaagaccgtctggttcgtgccttccataaaaagcggaaacgacatcgccaactgcctccgtaagaatggtaagcgcgtgatccaactgtcccggaagaccttcgacaccgagtaccagaagacgaagaacaacgactgggactatgtcgtgaccaccgacatctcagaaatgggcgccaacttccgcgctgaccgggtgatcgacccgcgccggtgcttgaagcccgtcatcctcaaggacgggcccgagcgcgtgatcctcgctggccccatgcccgtcaccgtggcctctgccgcgcagcggcgcggccggatcggacgcaaccacaacaaggaaggcgaccagtacgtgtacatgggtcagccactgaacaacgacgaagaccacgcgcactggacggaggcgaagatgcttctcgacaacataaacacccccgagggcatcatccccgccctgtttgagcccgagcgggagaagtccgccgcgattgacggggagtaccgcctccgaggcgaggcccggaagaccttcgtcgaactgatgcgcaggggggacctgccggtgtggctatcgtataaggtggccagcgagggtttccagtacagcgaccgtagatggtgcttcgacggcgagcgcaacaaccaggtgcttgaggagaatatggatgtcgagatatggaccaaggaaggggagcggaagaagttacgtccgcgttggcttgacgccaggacgtactccgatccactggcactgcgagagttcaaggagttcgcggccggtcgccggagcgtgtccggagatctcattctggagatcggcaaactccctcaacacctcacccagcgcgcccaaaacgccctggacaacctggtcatgctacataatagcgagcagggtgggcgggcataccgccatgccatggaggagctgccggacaccatcgagaccctgatgttgctggccctaatcgccgtgcttacgggcggggtgaccctgttctttctgtccggacgagggctcggtaagactagcatcggccttctgtgcgtgatggccagcagcgtgcttctgtggatggcgtcggtggagccccactggatcgccgcaagcatcatcctggagttctttctcatggtcctgttaatcccagaacccgaccgccagcggaccccgcaggacaatcagctcgcctacgttgtgattggtctgctgttcatgatcctcaccgtcgccgcgaacgaaatgggcctgctggaaacgaccaagaaagatctcgggatcggccacgtggccgtggaaaaccaccatcacgcagccatgctcgacgtcgacctgcaccccgcctccgcgtggaccctgtacgccgtggcaaccacaattattacccctatgatgcgccatacgattgagaacaccacggcgaacatcagcctcactgccattgcgaaccaggcagccatactgatggggctggataaagggtggcccatatccaagatggatatcggcgtgcccttactggcactcgggtgttactcacaggtaaaccccttaaccctgacagcggcagtactcatgctggttgcgcactacgccatcattgggcccgggctgcaagcgaaggcaacgcgagaggcccaaaagcggactgctgccggcataatgaagaacccgaccgtcgacgggatagtggccatcgatctcgacccagtggtctacgatgcgaagttcgagaaacagttgggccaaatcatgctgctcatcctgtgcacctcccaaatcctgctcatgcgcacaacctgggccctgtgcgagagcatcacgctggcgaccggccccctaactaccctgtgggagggatcccccggcaagttctggaacaccacgatcgccgtgagcatggccaacatcttccgggggagctacctggcgggcgccggtctcgctttctccctgatgaagtccctcgggggcggccggcgggggacgggggcccagggcgagaccctcggcgagaagtggaaacgccagctgaaccagctgtccaagagcgagttcaacacttacaagcggtccggtatcatggaggtggaccgcagcgaagcgaaggaaggcctcaagcgaggggagaccacgaagcacgccgtctcacggggcaccgccaagctgcggtggttcgtagagcgcaaccttgtgaagccggaagggaaggtcattgatctgggctgcggccgcggcgggtggagctattattgcgccgggcttaagaaagtgacagaggtgaagggatacaccaagggcgggccgggccacgaagagcccatcccaatggcaacgtacggttggaacttggtcaagctccatagcggaaaggacgtgtttttcattccacccgaaaagtgcgataccctcctgtgtgatatcggagagtcctccccaaaccccaccatcgaggagggccgcaccctgcgggtgctcaagatggtcgagccatggctgcgagggaaccagttctgcataaagatcctaaacccatacatgcctagcgtggtggagacgctcgagcagatgcagcggaagcatgggggcatgctggtccgtaaccccctatcccggaacagcactcacgagatgtattgggtttcctgcggaaccggtaacatcgtgagcgcggtcaacatgacctccaggatgctcctgaaccgcttcaccatggcccaccgtaaaccgacgtacgagagggacgttgatttgggggcaggcacccggcacgtggcggtcgagcccgaagtcgccaatctagacatcatcgggcagcgcatagagaacatcaagcacgagcataaaagcacctggcattacgacgaggacaacccctacaagacctgggcgtaccacgggtcctatgaggtcaagccaagcggctcagcctccagcatggtgaacggggtggtcaagctgctcacgaagccgtgggacgtcatcccgatggtgacccagattgccatgaccgacaccacgcccttcggccagcaaagagtcttcaaagagaaggtagacacccgcactcccaaagccaagcgtggtaccgcccagatcatggaagtgacggcgaagtggctctggggcttcctgtcccgcaacaagaaaccgcggatctgcacccgcgaggaattcacccgcaaggtccgcagcaacgccgccatcggggctgttttcgtggacgagaaccagtggaactccgcgaaggaggccgtcgaggacgagcggttctgggatctagtgcatcgcgagcgcgaactgcataaacaggggaagtgcgcgacctgcgtgtacaacatgatgggtaagcgggagaagaaactgggggagtttggtaaggccaaagggtcgcgggcaatctggtatatgtggctgggcgcgagatttctggaattcgaggcattgggcttcatgaacgaagaccactggttctcccgggagaacagcctgtccggggtcgagggagaggggctccacaagctgggctatatcctgcgcgacatcagcaagatccccgggggcaacatgtatgccgacgacacggcaggctgggacacccgtattaccgaggacgacctccaaaatgaggctaagatcaccgacatcatggagcccgagcacgcgctgctggccagaagtatcttcaagctgacctaccagaacaaggtggtgcgggtccagcggccagccaagaacggtaccgtaatggacgtgattagcagacgggaccaacgcggctccggacaggtcggcacatacggcctgaacaccttcacgaacatggaggcacagctgattcggcagatggagagcgaaggcatattttccccctcagagctcgagacccctaatttagccggccgagtgctggactggctggagaaacacggtgtggagcgcctgaagcgcatggcaatctccggcgacgactgcgtcgtgaagcctatagacgaccggttcgccaccgccctgacagccttgaacgatatggggaaggtgcgcaaggacatcccacaatgggagccgagcaagggctggaacgattggcaacaagtccccttctgcagccatcacttccaccaactgatcatgaaggacggccgggaaatcgttgtgccctgccgcaaccaggacgaactggttgggcgggcccgggtctcccagggcgcggggtggagccttcgggagacagcctgtctcggcaagtcctatgcccagatgtggcaactgatgtatttccaccgccgggacctccgcttggccgcgaacgccatctgcagcgccgtgccggtcgattgggtgcctacctcgcggaccacatggagcatccacgcccaccatcaatggatgacaaccgaggacatgctatcggtgtggaaccgcgtctggatcgaggagaacccctggatggaggacaaaacccatatcagctcatggggagacgtgccctacctgggcaagcgggaggaccaatggtgcggctctctgatcgggttaaccgcccgcgcgacgtgggccacaaacatccaggtcgccatcaaccaggtcaggcgcttaatcggcaatgagaactatctggactacatgacctcgatgaagaggttcaaaaacgagtctgacccagaaggtgccctgtggtga

SEQ ID NO: 24486 - RNA, 9879 nt, synthetic construct
  misc_feature 1..9879: note = derived and/or modified CDS sequence (opt11) from DENV-1__GU131782__SS-prME
  source 1..9879: mol_type = other RNA
tccgtgaccatgctgctgatgctgatgcccacagccctagcattccacctcaccacccgggggggggaaccccacatgatcgtaactaagcaagagcggggcaagagccttctgtttaagacctctgcgggggtgaacatgtgcaccctcatcgccatggacctgggcgagctgtgcgaggacaccatgacctataagtgcccgcgcatcaccgaggccgaacctgacgacgtagactgttggtgcaatgccactgacacatgggtgacttacgggacctgttcacagaccggcgagcacagaagggataagcgcagcgtggctctggcgccccacgtggggctgggactagagaccaggactgaaacatggatgagttctgaaggggcctggaaacaaattcagcgtgtcgagacttgggccctcaggcacccggggttcacagtgatcgccctcttcctggcccacgccattggcacctccatcacccagaaggggatcatattcattctcctgatgctagtaacgcccagcatggcaatgcggtgcgtagggatcggcagtcgcgacttcgtcgagggtctcagcggcgccacatgggttgatgtcgtgctggagcatgggagctgcgtgaccaccatggcgaaggacaagcccaccttagatatcgaactcctgaagacagaagtcaccaatccggcagtgctgcggaagctatgtatcgaggcgaagatctcgaacaccactaccgattcacgctgcccgacccagggcgaggcaacgctgatggaagagcaagacgccaacttcgtatgccggcgcacgtttgtggatagaggctggggaaacggctgcgggctcttcggaaagggatcacttataacatgtgcgaaatttaagtgtgttaccaagctggaaggcaaaatcgtgcagtatgagaacttaaaatactccgtcatcgtaaccgtgcacacgggcgaccagcaccaggtcgggaacgagtctaccgaacacggcactaccgcgacgatcacgccccaggcccccacaagtgagatccagcttaccgattacggggcgttgacgctggactgttccccgcgcacgggcttagactttaatgagatggtgcttctgacgatgaaggagaagtcctggctcgtccataagcaatggttcttagaccttcctctcccttggaccagcggggcaagcacctctcaggagacgtggaaccggcaggacctgctggtgacctttaagaccgcgcacgcgaagaagcaagaggtagtcgttctcgggtcacaggagggtgcaatgcacacagcgctaacgggggccaccgagatacagaccagcggcaccacgaccatttttgctggtcaccttaagtgtcgcctgaagatggacaagctgactctgaagggtatgagctacgttatgtgcaccggttccttcaagctcgagaaggaggtagcagagacgcagcatggcaccgtactcgtgcagattaagtacgaaggcacagatgcaccgtgtaaaatccccttcagcacccaggacgagaagggggtaacacaaaacggccgtttaattactgcgaacccgatcgtgaccgacaaggagaagcccgtgaatatcgaagccgagccgcccttcggggagtcctacattgtcattggcgcgggcgagaaggccctcaagctcagctggttcaagaagggtagcagtatcggcaagatgttcgaagcgacggcaagaggcgcccggcgcatggcaatcttgggagacacggcgtgggactttgggtcgatcggcggcgtgttcacatcagtaggtaagctggttcaccaaatcttcggcaccgcctacggtgtgctgttctccggcgtttcatggaccatgaagattggaattggcgtgcttctgacttggttgggcttgaactcccgctctacctccctgagcatgacctgcatcgccgtcgggttagtcaccctgtacctgggcgtcatggtccaagccgactcagggtgtgtgatcaactggaaggggcgggagctaaaatgcggaagcggcatcttcgttaccaacgaggtgcacacctggaccgaacaatacaagtttcaggcggactcaccgaagcgtttgtcggccgcgatcgggaaggcctgggaggagggagtttgcgggattagatcggcaaccagactggagaacatcatgtggaagcagatctcaaacgagttgaaccacatcctgctggagaatgacatgaagttcaccgtcgtcgtcggggacgtcgtgggcattctcgcacaggggaagaagatgatccggccgcagcctatggagcacaagtacagctggaagtcctggggaaaagccaagatcattggtgccgacgtgcagaacactacgttcatcatcgacgggcccaatacaccggagtgccccgacgaccagcgcgcctggaatatatgggaggtggaggattacggatttgggatcttcaccacgaacatctggctgaagttacgcgacagctacacgcaagtatgcgaccaccggttgatgtccgcggcgataaaggacagcaaggctgtgcacgctgacatgggttactggatcgagagcgagaagaacgagacatggaagctggccagggcgagcttcattgaggtcaagacctgtatttggccaaagtcccacaccttgtggtccaacggggtactcgagagtgaaatgatcatccccaagatctacggaggaccgataagccagcataattaccgccccggttatttcactcagactgcaggtccttggcatctggggaagctggaactcgactttgacttatgcgaaggcaccacggtggtcgtggacgaacactgcgggaaccgggggccgtccctgcggacgacaaccgtaacgggcaagattatccacgagtggtgctgcaggagctgtaccctgccgcccctccgcttcaagggcgaggacggctgctggtacggcatggagatcaggcctgtcaaggagaaggaggagaaccttgtcaaatccatggtgagcgccggcctaggggaggtggactccttctcacttggactcctctgcatcagcataatgattgaagaggtaatgcgctcccgctggtctcgcaagatgttgatggccggcaccctggccgtgttcctgctgttaatcatggggcagctgacctggaatgatctgatacggttatgcatcatggttggggcaaatgcctccgaccgcatgggtatgggaaccacttaccttgctctgatggccacattcaagatgcgcccgatgttcgcggtgggcctcctgttccggcgactgactagccgggaagtgttgctgctgacgatcgggctgtcccttgtcgccagcgtggagctgcccaactccctggaggagctcggcgacggactcgcgatgggaatcatgatcctcaagctacttactgatttccagccacaccagctgtgggccaccctactttcgttaacgttcatcaaaacgacactctccctgcactacgcctggaagaccatggcgatggttctatccatcgtgagtctctttcctctctgtctgtcaaccacttcgcagaaaaccacatggctcccagttctgttgggatccctcggttgcaagccactgaccatgttccttatcgctgaaaacaagatctggggccgcaaatcttggcccctcaacgaggggatcatggcagtcggggtggtatcaatcctgttatcctcactcctcaagaatgacgtccccctggctgggccactgatcgcgggcggcatgctgatcgcgtgctacgtaatcagcggctcaagcgccgatctgtcgctcgaaaaggctgcggaggtgagctgggaagaagaggccgagcactctggcgcttcccataacatcctggtcgaggtgcaggatgacgggacgatgaagataaaggatgaggagcgggatgacaccctaacgatcctccttaaggccactttgctcgctatttccggagtgtaccccttgtctattccagcaactctgttcgtctggtacttttggcagaagaagaagcagcgcagtggggtgctgtgggacacccccagcccgccagaagtagagcgggcggtccttgacgacggcatctacagaatcatgcaacggggcctgctgggtagatcccaggtgggcgtgggagtcttccaggagaatgtgttccacacaatgtggcacgtgacacggggcgccgttttgatgtaccaggggaaaagactggaaccctcatgggcctccgtgaaaaaggatctcattagctacgggggtgggtggcggttgcaggggtcctggaacaccggggaagaggtgcaagtcattgccgtggagccgggcaaaaacccgaagaatgtgcaaacggcccccggcacttttaagacccccgagggcgaggtcggcgccatcgcgctggacttcaagccggggaccagtggctccccgatcgtgaaccgcgaggggaaaatcgtgggtttatacggcaacggggtggttacgacaagcggaacctacgtatccgctatagcccaggcgaaggcgtctcaggaggggcccctgcccgagatcgaggacgaggtcttcaggaaacgcaacctcacaataatggacttacacccaggcagcgggaagactcgtcgctacctccctgccattgtgagagaagcgatcaagcggaaacttcgtacccttatcctagccccaacgcgggtggtcgccagtgaaatggcggaggcccttaagggtatgcccatccgatatcagacaacggctgtcaagagcgaacataccggcaaggagatcgtagacctcatgtgtcacgccaccttcaccatgaggctcctatctccggtccgcgtgcctaactacaatatgatcattatggacgaagcgcactttactgaccccagttccatcgctgcccgcggctacatctccacacgcgttggcatgggggaggctgccgccatcttcatgacagcgaccccacccggttccgtggaggccttcccacagagcaacgcggtgatccaggacgaggaacgtgacatcccagagcgctcgtggaattcggggtacgaatggatcacggacttccccggcaagaccgtctggtttgtccccagtatcaagagtggcaacgacatcgccaactgcttgcggaaaaacgggaagcgcgtaatccagctctcccggaaaactttcgacacggagtaccagaagaccaagaacaacgactgggactacgtggttactaccgatatcagcgagatgggcgcgaacttccgcgccgaccgtgtgatcgaccccagacggtgcctgaagcccgtgatcctcaaagatggccccgaacgcgtcatcttagctggcccgatgcccgtgaccgtcgcttccgcagcgcaacggcgcggaagaatcggccgcaatcacaacaaggagggagaccagtacatttacatggggcaacccctgaacaatgatgaagaccacgcacactggacggaggccaagatgctattagacaatattaacacccccgaaggcatcattcccgccctgttcgagcccgaacgggaaaagtcagccgcgattgatggggagtaccgattgcgcggggaagcccgtaagacctttgttgagttgatgcgccgcggagacctacccgtatggctgagttacaaggtagcctcggagggattccagtattccgaccgcaggtggtgttttgacggtgagcggaacaatcaagtgctcgaggagaacatggatgtcgagatctggaccaaggaaggtgagcggaaaaagctgcgccctcggtggctggatgccagaacgtacagcgatcctcttgccctgcgggagttcaaggagttcgcggccgggcgccggtcagtatcgggggacctaatattggagatcggtaaactcccccagcatcttacccagcgcgcccaaaatgccctcgacaatctggtgatgcttcacaacagtgaacaaggaggccgggcgtaccgccacgcaatggaggagctacccgacaccattgaaactctcatgttgctcgccctgatagccgtgctaacgggcggggtcaccctcttctttctgtctgggagaggtctgggaaagacaagcatcggccttctgtgcgtaatggcttcttcggtgcttttatggatggcgtcagtcgagcctcattggatcgccgcctcaatcattctggagttcttccttatggttctcctaatccctgagcccgatcgccagcggactccgcaagacaaccagctggcatatgtggtcatagggcttctgttcatgatattaaccgttgccgcaaatgagatgggactcttagagaccaccaagaaggacctggggattggccacgtggcagtcgagaaccaccaccacgctacaatgttagacgtcgatttgcaccctgcctccgcatggacgctatacgcggtggcaacgactatcatcacgcccatgatgcggcataccatcgagaatacgaccgcgaacattagcctcacagctatagccaaccaggcagcaattcttatggggctggacaaaggttggcccatctctaaaatggacatcggcgtccccctcctggcgttgggctgctacagccaggtgaatccgctcaccctgacggccgcagtgcttatgctcgtcgcccactacgccatcatcggacctgggctccaagcgaaggccactcgggaggcgcagaagcgcaccgccgccgggattatgaagaaccccaccgtagacggcattgttgccatagacctcgaccccgtagtgtacgacgctaagttcgagaagcagctcggccagattatgctcctgattttatgtacgtcccagatccttctgatgcggaccacctgggctctatgcgagtcgatcaccctggcaacgggcccattaacaaccttatgggaggggtctcctggcaagttttggaacaccacgatagcagtgagcatggctaacatatttcgagggagttacttagccggcgcgggcttagcgtttagcctaatgaagtccctcgggggcgggaggcgggggaccggagctcagggcgaaaccctgggcgagaaatggaagcgccagctcaaccagctcagcaaaagcgagttcaacatctacaagcggtccggaatcatggaggtcgaccggtcagaggctaaggagggtcttaaacgcggtgagaccacgcgccacgcggtgtctcgaggcactgctaagctgcgatggtttgtcgagcggaatctagtcaaacccgagggtaaagtcatcgacttaggttgcggccgcggcggctggagctactactgcgctggtctcaaaaaagttaccgaagtcaagggatacacaaagggtggacccggacacgaagagcctatcccgatggccacatacgggtggaatctggtgaaactgcactccggcaaagatgtgtttttcacgcctccggaacgatgcgacactctgctctgtgacatcggtgagagttcccctaacccgacgatcgaggagggccgcacccttcgggtgctgaaaatggttgagccgtggctccgaggtaaccagttttgcattaagatattgaacccttacatgccaagcgtggtcgaaactctggaacagatgcagcggaagcacggcggaatgctcgtgcgaaatcccttatcccgaaatagcacccacgagatgtactgggtctcgtgcgggacagggaacatcgtaagcgccgtaaatatgacctccagaatgctgctaaaccgctttacgatggcgcaccgtaagcccacctacgaacgcgatgtggacctgggagccgggactcggcacgtggcagtggagccggaggtcgcgaacctggatatcatcggccaacgtatcgaaaatattaagcacgagcacaagagtacctggcactacgacgaggacaacccgtacaagacttgggcgtaccacgggtcatacgaagttaaaccaagcggctccgcaagcagtatggttaacggggtggtaaagctccttaccaagccctgggacgtcatcccaatggtcacccagatcgccatgacggacacgacgcctttcggccagcaacgggtgtttaaagagaaagtggacacccggacccctaaagccaagcggggtacggcgcaaatcatggaggtgaccgccagatggctgtggggcttcctcagccggaacaagaagcctcgtatctgcacgcgggaggaattcacccgcaaagtgcgctctaatgcggccatcggcgccgtcttcgtagacgagaaccagtggaacagcgccaaggaggcggttgaggatgagcgcttctgggacctggtacagaaggagcgggagctccataagcaaggaaagtgcgccacgtgtgtctacaacatgatgggcaagcgcgaaaaaaaacttggagagtttggtaaggcgaagggttcccgggccatctggtatatgtggcttggagcccgcttcctggagttcgaggcgctcgggtttatgaacgaggatcactggttttcacgggagaatagcctgagcggggtcgagggcgaggggctgcataagctgggctacatcttacgcgatatcagcaagatccccgggggcaatatgtacgccgatgacactgccgggtgggacacccggataacagaagacgacctgcagaacgaagccaagataaccgatatcatggagcccgaacatgcactcttggcgaccagcatttttaagctgacctaccaaaacaaggtggtacgcgttcagcgccctgccaaaaacgggactgttatggacgttatttcccggcgcgaccagcgggggtccggccaggtgggcacgtacggcctcaacaccttcactaacatggaggctcagctgattcgccagatggagagcgaggggatcttccttccctcagagctcgaaacaccgaacttagctgagcgggtactggattggttggagaagcacggcgttgagcgattaaagaggatggccattagcggagacgactgcgtggtcaagcctatcgacgaccgctttgcgaccgccttgactgccctcaacgatatggggaaagtccgtaaggatatcccccaatgggaacccagtaaggggtggaatgactggcagcaagtcccgttttgctcgcaccacttccatcagctgataatgaaggatggtcgcgagatcgtggtgccgtgtcggaaccaggacgaattggtgggacgcgccagagtgtcccagggtgccggctggagcctccgagagaccgcttgcctagggaaatcctacgcccagatgtggcagctcatgtactttcaccggcgggaccttcgtctggccgcaaatgcgatttgctcggccgtccccgtagattgggtacctacctcgcgcacaacctggtctatccatgcccatcaccagtggatgaccaccgaggatatgctgagtgtctggaatagagtgtggatcgaggaaaacccctggatggaagacaaaacgcacgtgtcttcctggggggacgtaccctaccttggtaagcgcgaggaccaatggtgcggctctctgatcggcctaaccgccagagccacctgggcgagtaatatccaagtggcaatcaaccaggtgcggaggctgatcgggaacgagaactatctggactacatgacttccatgaagcggtttaaaaacgagggcgacccagagggagccctgtggtaa

SEQ ID NO: 24487 - RNA, 9879 nt, synthetic construct
  misc_feature 1..9879: note = derived and/or modified CDS sequence (opt11) from DENV-1__GU131784__SS-prME
  source 1..9879: mol_type = other RNA
tcagttaccatgctacttatgctgatgccaacggcgctagcgttccacctaacgacaagaggtggggaaccgcacatgatcgtaagcaaacaggaacgcgggaaaagccttttattcaaaacatcggctggggtaaacatgtgcacgctaatcgccatggacctgggagaattttgtgaagacaccatgacgtacaaatgcccacggatcactgaagcggaacccgatgatgtggattgctggtgtaacgccacggacacatgggtaacctacggaacctgctctcaaacgggggagcacaggagagacaaacggtctgtagcgctggcaccccacgtcgggctgggactagagacaaggacggaaacctggatgagttccgaaggcgcgtggaaacaaatccaaagagtcgaaacatgggcccttagacaccctggattcaccgtgatcgcgctgttcctggcccatgcaataggaacatcaatcacgcaaaaggggataatcttcatactccttatgctcgtgactccgtcaatggcaatgagatgcgtggggataggttccagagacttcgtagaaggtctcagcggtgcgacgtgggtggacgtagtcttagagcacggcagctgtgtaacaacaatggcaaaggacaagcccaccctagacattgagttactgaaaacagaagtaacgaaccctgccgtactccgaaaactatgcatcgaggcaaaaataagtaacacaacgacggactcccgttgcccgacacagggggaagcgacactcgtagaagaacaagatgcgaacttcgtctgccgacgaacgttcgtagacagaggctgggggaacgggtgcggactgtttggcaaagggtcactgatcacatgcgcgaaatttaagtgtgtaactaaactcgagggcaaaacagtacaatacgaaaatctcaaatacagcgtaatcgtaaccgtacacacaggcgaccaacaccaggtcgggaatgaatcgacggagcatggaactaccgcaacaatcacgccgcaagcaccatcgacagagatccaactcacggattacggggcccttaccctagactgctcacccaggacaggcctggacttcaatgaaatggttttgctcaccatgaaagagaaaagttggctagtacacaaacagtggttcctcgacctaccactaccgtggacctctggagctagcacaagtcaagaaacatggaataggaaagacctactcgtcacatttaagaccgcccacgctaagaagcaggaggttgtcgtgctagggtcacaggaaggggcaatgcacacagccctcaccggtgccacggagatccagaccagtggcaccaccacaatcttcgccggccacctgaaatgtagacttaaaatggataagctcactctgaaagggatgagctatgtgatgtgtacgggatctttcaaactagaaaaggaggtcgccgaaacacaacacggcacagtcctggtccagatcaaatacgagggcacggacgccccgtgcaaaatccctttcagtacccaggacgaaaaaggagtgacccaaaacggccgactaatcaccgccaacccgatagtgacagacaaggagaaaccagttaatatagaggcggaaccacccttcggtgaaagctacatcgtaataggagcgggggaaaaagctctgaagctaagctggtttaagaaaggctccagtatcggcaaaatgttcgaagcaactgcccgaggcgcgcgcagaatggcaatactcggcgacacggcctgggacttcggttccatcggaggggtctttacgtcggtaggtaagctagtacatcagatattcggcaccgcttacggcgtgctattcagcggcgtctcgtggacgatgaaaataggaatcggagttctgctgacctggctaggacttaacagccgcagcacgagcttaagcatgacttgtatagcagtcggcctggtgactttgtacctcggtgtaatggtgcaggcggatagcggctgcgtgataaactggaaaggcagagaactcaagtgtgggagcgggatcttcgtcacgaacgaagtccacacatggacggaacagtataaattccaagcggactcaccaaagaggttatccgctgcaataggaaaggcttgggaggagggagtctgcggcatcagaagtgcaacacgcctggagaacataatgtggaagcaaataagtaacgaactaaaccacatcctactggaaaacgacatgaagttcacagtcgtcgttggggacgttgctgggatattagctcaaggcaagaaaatgatccgtcctcaaccgatggagtacaaatactcctggaaatcctggggcaaggccaagataataggcgcggatgtgcaaaacaccacattcatcatagacggaccaaacactccggaatgcccggatgaccaacgcgcctggaatatctgggaggtcgaagactatggattcggcatatttaccaccaacatttggctaaaactcagagactcttacacccaagtgtgcgaccaccggctgatgtccgctgcaattaaagacagcaaggcagtacacgcggacatgggatattggattgagtcggagaaaaacgaaacctggaaactggcgagggcttcgttcattgaggtcaagacatgcatctggcccaagagccacacattgtggagcaatggggtcctcgagagcgaaatgataataccaaaaatatacggcggaccaatcagccagcacaactaccgcccaggttacttcactcaaacggcagggccgtggcacctaggcaaactggaacttgacttcgatttgtgtgaaggcacaacggtagtagtagacgaacattgcggcaacagggggccgagtctccgaacaacgactgtcacagggaagattattcacgaatggtgttgccgaagctgcacactgccgccgctgcgcttcaaaggagaagacggatgctggtacggcatggaaatacgcccggtgaaggagaaagaagaaaatctcgtcaaatcaatggtttcggcaggaagcggggaagtcgactccttttcattgggcctgctctgcataagcatcatgatcgaggaggtaatgaggagtagatggagtcggaagatgcttatgaccggcacactcgcagtattcttcttattgataatgggacaactgacctggaacgacttgatccgtttgtgcatcatggttggagccaatgcatctgaccgcatggggatgggaacgacataccttgccctgatggcgacatttaagatgcgacccatgttcgccgtcggcctgttatttcgacgactcacgtccagagaggttctgctactaacaataggcttatccctggtggccagcgttgaattgcccaattcgctcgaagaattgggtgatggactagcaatggggataatgatcttgaagctcctaacggacttccaatcccaccagctatgggcaaccttactctctctgacattcatcaaaacaacgttctcgctacaccacgcttggaaaaccatggcaatggtactaagtatcgtctccctattcccgctatgcctgtctacaacctcgcagaaaactacatggcttccggtactactagggtcactcgggtgcaagcccctgacgatgttcctcatagcagagaacaaaatctggggcagaaagtcatggcctttgaacgagggtataatggcagtcgggatcgtgagcattctcctaagctcactgttaaagaacgacgtccctctagcaggcccgctaatagccggcggaatgctaatagcgtgctacgtaatatcaggctcgagcgcggacttgtcgctcgagaaagcagccgaagtctcatgggaggaagaagccgaacactcaggtgccagtcataacatattagtcgaagtgcaagacgacgggaccatgaaaataaaggacgaggagcgtgacgacaccctaacaatattactaaaagccaccctacttgcggtctccggagtatacccactatcaataccggcgaccctcttcgtatggtacttctggcagaagaagaagcaacgatccggcgtcctgtgggacacgccaagcccacccgaagtcgaacgagccgtcctggacgacggaatctatagaatcatgcaaagagggctcttgggcaggagccaggtcggagtgggagtattccaagaaaacgtgttccacaccatgtggcacgtcacgcggggagcagtcctcatgtaccaggggaaaaggctagaaccatcctgggcaagtgtcaagaaagatctgatcagctatggcggagggtggcgactgcaaggatcatggaatacgggagaggaagtgcaggtaatagcggtcgaaccgggcaaaaatcccaaaaacgtgcaaaccgcccccggaactttcaagacctctgaaggcgaggttggagccattgcactagatttcaaacccggcacctccggcagccccatcgttaaccgtgaaggaaagatagtgggcttatacggcaatggagtcgtcacaacaagcggaacctatgtaagcgcaattgcacaggcgaaagcatcccaagaaggacccctcccagagatagaggacgaagttttccgaaagcgaaacctaaccattatggacctacacccgggtagtggcaagacacgccgctacctgcccgctatcgtcagggaggcaatcaaaagaaagctaagaacactcatccttgcgccaacccgagtcgtagcaagcgaaatggctgaagccctaaaaggaatgccaatccgctatcaaaccacggccgtcaaaagcgaacacacaggaaaagagatcgtagacctaatgtgccatgctaccttcacaatgagactgctctcccccgtgcgcgtaccaaactacaacatgatcatcatggacgaggcccacttcacagaccctagttcgatcgcagccagagggtacatcagcacccgagtggggatgggggaagcagcggccatcttcatgacagcgacgccgcccggatctgttgaggcattcccacagagcaacgctgttattcaggacgaggaacgagacatcccggaacgatcatggaactcgggatacgaatggatcacggacttccccggaaaaacagtatggttcgtgccgtcaatcaagtccggcaatgacatcgccaactgcttgaggaaaaacgggaagagagtgatacagctatcgcgtaagacgttcgacaccgagtaccagaaaactaagaacaacgactgggattacgtcgtaaccacagacatatcagaaatgggagcaaactttagagcagatagggtgatagacccaagacggtgtctcaaaccagtcatccttaaggacggacctgaaagagtcattttggcagggccaatgcccgtaacagtagcctcagccgcccagaggagggggcgcatagggcgcaaccacaacaaggagggcgaccaatacatatacatgggccaacccctgaacaatgacgaagatcatgcgcactggactgaagcgaagatgctgcttgataacatcaacacaccggaggggatcatacccgcgttgttcgaacccgaaagagagaaaagtgcagctatcgacggcgaatacagacttagaggtgaagcccggaagaccttcgtcgaactgatgaggagaggcgatctacccgtctggctctcgtacaaggtcgccagtgagggatttcaatatagcgatagacgatggtgtttcgatggggagcggaacaatcaagtgctagaggaaaatatggacgtcgaaatctggacaaaggaaggagagagaaagaaactgcgccctagatggctcgacgcccggacgtacagcgacccactagccctccgcgaatttaaagagtttgcagctggacgccggagcgtgtcaggcgatctgatactagaaatcggcaaactaccacagcacctcacccaacgggcccaaaatgcgctcgacaacctagtaatgctacacaacagcgagcagggaggccgcgcatatcgccacgctatggaggagctacccgacacgatagaaacccttatgctgctggcactaattgcagtacttacaggaggggtgaccctattctttctgagcggccggggcttagggaaaacgagcatagggttattgtgcgtaatggcatccagcgtcctactgtggatggcgagtgtagagccgcactggatagcggccagcatcatactcgagttcttcctaatggtactattgattccagaacctgaccgtcaacggacaccacaagacaaccaactagcgtatgttgtgatcggtctactatttatgatactcacagtcgccgcgaatgaaatgggccttctcgaaacgaccaaaaaggacctaggaataggacatgcggcggtggagaaccaccaccacgcggccatgctagacgtggacctccaccccgcttcagcatggacgttgtacgcagtagccacaacaatcataacaccgatgatgcggcatacaatagaaaatacaacggcaaacatctcgctaacggccatagcgaaccaagcggcgattcttatgggactagacaaaggatggccgatcagcaagatggatataggagttccgctcctggcattaggctgttacagccaagtcaatccactcacattaaccgcggctgtgctaatgctcgttgcacattacgcgataataggcccgggactgcaggccaaagcaacaagagaagcgcagaagaggactgccgcaggtatcatgaaaaaccccacagtcgacggaatagtcgcaatcgatttggaccccgtggtgtacgatgccaaattcgaaaaacaacttgggcaaataatgctcctaatattgtgcacctcacagatactcctgatgaggacgacttgggccctctgcgaaagcataactttagccacaggaccgctgacaactttatgggaagggtcaccggggaagttttggaacacgacaatcgcagtatcaatggcgaacatctttcgcgggtcatacctcgccggcgcaggtctcgcattttcgttgatgaagagtctagggggtgggagaaggggaacaggggcacaaggagagacactaggggaaaaatggaagcgacagttgaaccaactatcgaaaagcgaatttaacacatataaacgatccggcataatggaggtcgaccggtccgaagcaaaagaaggcctaaagcgaggagaaacgaccaagcacgcggtcagcagagggacagccaagctaagatggttcgtggaacgcaatttggtgaagcctgaaggaaaagtaatagaccttggctgtgggcgcgggggctggtcatactactgcgcggggctcaagaaagtaacggaggtaaagggctacactaagggaggacccggacacgaagaacccatcccaatggcaacctatggctggaatctcgtgaaacttcactcaggaaaagacgtattctttatccctcccgaaaagtgcgacaccctgctctgcgacattggcgagtccagtccaaatcccactattgaggaaggcagaaccctacgcgtactaaagatggtagaaccatggctgcgcggaaaccagttctgcataaagattctaaacccgtatatgccctccgtggtcgagacactagagcaaatgcagaggaaacacggaggaatgttagtaagaaacccactatcaagaaatagcacacacgagatgtattgggtatcatgcggaacaggcaacatagtaagtgcggtgaacatgacgtcccgtatgttattaaaccggtttactatggcacacaggaaaccaacgtatgaaagggacgtagacctcggcgcgggaacccgacacgtggccgtagaacccgaagttgcgaacctcgatataatcgggcaaagaatagagaatataaaacacgagcacaagagcacatggcactacgacgaagataacccatacaaaacatgggcctaccacggctcttacgaggtaaaaccgagcggcagcgcgagttcgatggtgaatggggtcgtaaaactcctcacgaagccatgggacgttataccgatggtgacgcagatcgctatgactgatacaacaccattcggacaacaacgggtgttcaaggaaaaggtagacacccgaactcctaaagcgaaaagaggaacggcacagatcatggaggtcacagccaagtggctctggggcttcctctcaaggaacaaaaagccccgaatatgcacgagggaggagttcaccaggaaggtccggtccaacgcggccataggcgcagtatttgtcgacgaaaaccaatggaactcagccaaagaagccgttgaagacgaacgcttctgggacttggtacaccgggaacgagaactacacaagcaagggaagtgcgcaacctgcgtatacaatatgatgggaaagcgagagaaaaagctgggggagttcgggaaggccaaaggaagtcgtgcaatctggtacatgtggctcggagcacgtttcctagagttcgaggctctcggattcatgaacgaagaccattggttctctagagaaaactcattgagtggagtagaaggggaagggctgcacaagctcgggtacatattgcgagatatatcaaagatcccaggcggcaatatgtatgcagacgacacagcaggctgggacacccggataactgaggacgacctgcagaatgaggcaaaaatcactgatatcatggagccggaacacgcactattggctaaatcgatctttaaactgacataccagaataaagtagtcagagtacaacgtcccgccaagaatggcacggtcatggacgtcatctcccgacgagaccagagggggtccggccaagtaggcacctacggcctgaacaccttcacaaacatggaggctcaactaatccggcaaatggagtccgaaggaatcttttccccgagcgaactagaaacaccgaacttagcacgtagagtcctagactggctagagaagcacggagtagaacgccttaaaagaatggccatttcgggagacgactgcgtagtgaagccgatagacgaccggtttgcaactgcacttaccgcgctgaatgacatgggaaaagtacgaaaagacataccccagtgggaaccctccaaagggtggaatgactggcaacaggtcccattttgcagccatcatttccaccagctcatcatgaaagacggtcgcgagatagtggtaccctgcagaaaccaggacgaactggtggggagagcacgcgtttcgcagggggccggctggagcttgagagaaacagcctgtctaggtaaaagctatgcgcagatgtggcagctaatgtacttccaccggcgggatttgcgactagcggccaacgccatatgttcggccgttcccgtcgattgggtgccgacgtcccgcactacctggtcaattcacgcgcaccatcaatggatgacaaccgaggacatgctctcggtctggaatcgggtatggatagaggaaaatccatggatggaagataaaacgcacatatcgagttggggagacgtgccctacctgggcaagcgtgaggatcagtggtgcggttcactcataggcctaaccgcaagagcaacctgggcaacaaacatacaagtcgccatcaaccaggtgaggagacttatcgggaacgagaattatttggattacatgacaagtatgaagcggttcaaaaacgaatcggacccggaaggagcactctggtga

SEQ ID NO: 24488 - RNA, 9879 nt, synthetic construct
  misc_feature 1..9879: note = derived and/or modified CDS sequence (opt11) from DENV-1__JF937612__SS-prME
  source 1..9879: mol_type = other RNA
agcgtgaccatgttgctcatgttaatgcctactgctctggccttccacctcaccacccgcggcggggagccacatatgatcgtatcaaagcaagagcggggcaagagcttgctgttcaagaccagcgccggggtgaacatgtgcaccctcatcgccatggacctgggtgagctgtgtgaggacactatgacctataagtgtccccggatcactgagacggagcctgacgacgtggattgctggtgcaacgcaacggacacctgggtcacctacgggacttgctcacagactggcgagcaccggcgtgacaagcgctccgttgccttagcccctcacgtgggcctgggtctggaaacccggaccgaaacatggatgagctcagagggtgcttggaagcaaatccagcgggtcgagacgtgggccctcagacatcccggatttacagtgatagctctgttcctggctcatgctatcggaaccagcattacacagaaagggatcattttcatcctcctaatgcttgtgacgccgtccatggccatgaggtgcgtcggaattgggtcgcgcgacttcgtggaggggctatccggggccacctgggtcgacgtagtgcttgaacacggaagctgtgtgaccaccatggccaaggataagcccactctggacatcgagctcttaaaaaccgaggtgaccaacccggccgtgctgcggaagctttgcatcgaagcgaagatctccaacacgacaaccgactcacgctgcccaacccaaggtgaggccactcttgtggaggagcaggacgccaacttcgtatgccggcgcacattcgtagacaggggttgggggaatggctgtgggctattcgggaaggggtccctcatcacctgcgccaagttcaagtgcgtaaccaagttagaaggcaaaatcgtacagtacgagaacctgaaatactcagttatcgtgactgtgcacacgggcgaccaacaccaggtagggaacgagtccaccgaacatggaaccaccgccactataaccccacaggcgccgaccactgagattcaattaaccgactacggggccctaactctggactgcagcccacgcacggggctggacttcaacgaaatggttctactgacgatgaaggagaaatcctggttagtgcataaacaatggttcctagacctccccctcccctggacctcaggggcctcgacgtctcaagagacgtggaaccgccaggaccttctcgtaacctttaagaccgctcatgccaagaaacaggaagtagtcgtgctgggtagtcaagaaggggctatgcacaccgcacttaccggggccacagagatccagacctccggaacgacaaccatattcgccggccatctaaagtgtcgcctaaagatggacaaactaaccctgaagggaatgtcgtacgtaatgtgtacgggctccttcaaattagagaaagaggtagccgagacccaacacggcaccgtgctggtacagattaagtacgagggaaccgacgcaccatgcaaaatccccttcagcacacaggacgagaagggcgtgacccagaacggccgtctgatcaccgctaacccgatcgtgaccgacaaggaaaagcccgtgaacatagaagccgaacctcccttcggcgaatcatacatcgtgatcggggcaggggagaaagccttgaagctgagctggttcaagaaaggcagtagcatcgggaagatgttcgaggcgacggcccgcggggctcggcgaatggcgatactgggagacacggcatgggacttcggtagtataggcggcgtgttcacttctgtcgggaaattagtgcaccaaatctttggcaccgcttatggcgttctcttctcgggcgtctcttggacgatgaagattggtatcggggtgctactgacctggctcggcctgaactcccgctccacctccctgtcgatgacctgtattgccgtcggtctcgtcacgctgtacctgggcgtgatggttcaagcggactcaggttgcgtcattaattggaaaggccgtgaattgaagtgcggtagtggtatcttcgtgaccaacgaggtgcacacatggacagaacagtacaagttccaggccgattctcccaagcgcctatccgctgccatcggcaaggcctgggaggaaggggtgtgcgggatcaggagcgccacacgcctggaaaacatcatgtggaagcagatatccaacgagctcaatcacattctcctggagaacgacatgaagttcacggtagttgtcggggacgtggcaggcattttagcgcagggaaaaaagatgatacgacctcagccgatggagtacaagtacagctggaagtcctggggcaaagccaaaatcataggcgccgacgtgcagaatgccacgttcataatcgacgggcccaacaccccggaatgccccgacgaccagcgtgcttggaacatctgggaggtcgaggactacggttttgggatctttaccacaaatatctggctgaagctgcgggacagttatactcaagtgtgtgaccaccgcctcatgtccgcagccatccgggatagcaaggccgtgcacgccgacatggggtactggattgagagcgagaagaacgagacctggaaactggcacgggcgagctttatcgaggtgaagacctgtatatggcccaaatcccacacgctgtggagcaatggggtattggagtccgaaatgattattcccaagatctacggcggacctatcagccagcacaattatcggcccggatattttactcaggccgccggcccctggcacctggggaaattagaattggatttcgatttatgcgagggtacgaccgtcgtcgtggacgagcactgcgggaatcggggtccatccctccggactacgaccgtgaccggcaaaatcatccacgagtggtgctgtcgtagctgcacgctaccgccgctccgctttcgcggagaagacgggtgctggtacgggatggaaatccggcccgttaaagaaaaagaagagaacctcgtgaaatccatggtgagcgccggcagtggggaggtagactccttcagcctcgggctgttatgcatctccataatgatcgaggaggtgatgaggtcacggtggagccgccgtatgttaatgaccggcacactagctgtgttcttcctgcttatcatggggcagctgacatggaacgacctaataagactctgcatcatggtgggagccaacgccagcgaccgcatggggatgggcacgacctacctggccttgatggctaccttcaagatgcgtcctatgtttgcggtgggtttgctgtttagacgtctgacaagccgcgaggttttgctgctgacaatcggtcttagtcttgtcgcctccgtggaactcccgaattctttagaggagctaggggatgggctggcgatgggcataatgatcctaaaactactgaccgattttcaaagtcaccagctctgggctaccctgctttctctcaccttcataaaaacgaccttcagtctgcattacgcgtggaagacgatggcaatggtcttgtcaatcgtgtccctcttccccttatgcttaagcaccacttcccagaaaacgacttggctcccggtcctgttaggatcacttggttgcaagccgctgactatgttcctcatcgcggagaacaagatctgggggcgtcggtcctggcctctaaacgaagggataatggccgtcggtatcgtcagcatactcctgtcctccctcctgaagaacgacgtgcccctggccggaccactaattgcgggtggcatgctgattgcctgctatgtaattagcgggtcctcagccgacttgtccttagagaaggcagccgaggtgagctgggaggaggaggcggaacactccggagcgagccacaacatactcgtggaggtccaggacgacgggacgatgaagattaaagatgaggagcgggatgatacactcactatcctccttaaggccaccctgctcgctgtgagtggcgtgtacccccttagtatccccgccaccttattcgtttggtacttctggcagaaaaaaaagcagcgatccggtgtgctctgggacacgcccagcccgccggaagtggagcgtgcggtcctggacgacggaatctaccgcataatgcaacggggcctgttagggcgcagtcaggtaggggttggggtatttcaggagaacgttttccatacaatgtggcacgttaccaggggcgctgtcctcatgtaccaagggaagcgtctggagcccagttgggcgtccgtgaagaaagacctgatctcatacggcggaggctggcggctccaaggttcctggaatacaggtgaggaagtgcaggtcatagccgtagagcctggcaagaacccgaagaatgtgcagacggcccccgggacttttaagaccccggaaggtgaggtaggcgcgatcgccctggactttaagccagggaccagtggctcacccatagtgaaccgcgaaggcaagatcgtgggtctgtacggcaacggagtggttaccacctcgggtacgtatgtctccgcgatcgcccaagcaaaggcatcacaggaggggcctctcccagagatcgaggatgaggttttcagaaagaggaatttgacaatcatggacctgcaccccggcagtgggaagacgcggcgctacttaccggccattgtgcgcgaggcaataaaaaggaagttgaggacccttatcctagcccctacccgggttgtcgcctcagagatggccgaggcactgaaggggatgccgatccgctaccagactaccgccgtaaagtcagagcacactgggaaggagatagtggacctaatgtgccacgccaccttcaccatgcggctcctgtcccccgtccgagtcccgaactacaacatgatcatcatggacgaggcacacttcacggaccccagttccatagctgcccgtgggtacatctcaacccgcgtgggaatgggggaggcggccgctatcttcatgacagcaaccccgcccggctccgtcgaggccttcccgcagtccaatgcggtgatccaggacgaggagcgggacatacccgagcgctcctggaacagcgggtacgagtggatcacagatttccccggtaagaccgtttggttcgtcccgagcatcaagagcggcaatgacatcgcgaattgcctgcggaaaaacgggaagagggtaattcagttgtcccggaaaacattcgacaccgagtaccaaaagaccaagaataacgactgggactatgtagttacaactgacattagtgagatgggcgccaactttcgggcggaccgggttatcgacccacgccggtgcctgaagccagtgatcctgaaagacggacccgagcgcgtgatcctcgccggtcccatgccggtcaccgtcgcctctgcggcccagcgccgggggcggataggacggaatcacaataaggaaggcgatcagtacatctacatggggcagccactgaacaatgacgaggaccacgcccactggaccgaggccaaaatgttgcttgataatatcaatacccccgaaggaatcatccccgccctgttcgagcctgagcgggagaagagtgcggccatcgacggcgaataccggctccgcggcgaggccagaaagaccttcgtagaactaatgcgacgaggcgatctccccgtttggctgtcttacaaagtagcttctgaggggtttcaatactctgatcgccggtggtgctttgatggcgagagaaacaaccaggtgctcgaagaaaacatggacgtggaaatatggaccaaggagggggagcggaagaagttacgcccacggtggctcgacgcgcgcacctattccgaccccttagccctgcgggaatttaaagaatttgcggcaggacgaagaagcgtctctggtgacttaatacttgagattgggaaactaccccagcacctcacgcagcgcgcgcagaacgcactcgacaatctggtgatgctgcataactcggagcagggtggtagggcttataggcacgctatggaggagctcccagacacaatcgagaccttgatgttgctcgctctaatcgccgtgctgaccgggggcgtaaccctctttttcctgtcaggccgggggttaggcaagaccagcattggacttctatgtgtgatggcctcctcggttctgctctggatggcctccgttgagccgcattggatcgccgcctcgatcatcctggagttcttcctgatggtcctcctcatccctgagcctgaccgccagcgcacgccccaggacaaccaacttgcatatgtcgtaattgggctcctcttcatgattctgaccgttgcggctaacgagatgggactactggagacgacaaagaaggatctggggatcggtcacgttgcggtcgagaaccaccaccatgccgccatgcttgacgtagacttacacccagcgtccgcctggactttatatgccgttgccactactataattactcctatgatgcggcacaccattgagaacaccacggcaaacatctcgctcacggccatagccaaccaggctgcgatcttgatggggttagacaagggttggcccatctccaaaatggatatcggcgtgcccctcctggctttaggctgctattcacaggtgaaccccctcaccctaacagcagctgttctgatgttggtcgcccactacgcaatcataggcccgggtctgcaggcgaaggcgacccgggaagcccagaagcggacggctgccggcattatgaagaacccaaccgtcgacgggatcgtggcgatcgacctcgatcctgtcgtatatgacgccaagttcgaaaagcaactcggccagatcatgctgttgatcctctgcacctcccagatcttactgatgcgtacgacgtgggcgttgtgcgagagtattaccctagccacgggcccgctaacgacgctttgggagggatcccctggaaagttctggaacaccaccatagccgttagcatggccaacattttccgcggctcctatctagcgggcgccggccttgccttctcgctaatgaagtccctcgggggcggacgtcgggggacgggggcgcagggcgagaccctaggcgagaagtggaaaaggcagctaaaccagcttagtaagagcgagttcaacacgtacaagcgctccgggatcatggaggtcgaccgctcggaggccaaagaggggctgaagcgcggcgagaccactaaacacgccgtctcacgtggcaccgcaaagctccggtggtttgtcgagcgcaacctcgtcaagccggaggggaaggtaatcgatctgggctgcggccgaggcgggtggagctattactgcgccggccttaagaaggtaaccgaggtcaaaggctacacgaagggcggccccggccacgaggagcccatcccgatggctacatacgggtggaacctcgtgaagctacactccgggaaagacgtattctttattccccccgagaagtgcgacaccctcctatgcgacatcggcgagagctcgccgaatcccactattgaggaaggccggacactgcgcgtcctgaagatggtggagccctggttacgagggaaccagttctgcatcaaaatccttaacccgtacatgccgagcgtggtcgagacgttagaacagatgcagcggaaacacggcggcatgctcgttcgcaacccgttgagtcgcaactcgacccacgagatgtactgggtttcgtgtgggaccgggaatattgtgagcgccgtcaatatgaccagtagaatgttgttgaaccgctttacgatggcccaccggaaaccaacgtacgaacgcgacgtggatctgggggccgggacccggcacgtggctgtggaacccgaggtggccaacctggacattataggccagcgcatcgagaacatcaagcatgagcacaagagcacatggcattacgatgaagataacccttacaagacctgggcgtatcacggatcttacgaggtcaagccgtcagggtcagccagctccatggtgaacggggtcgtgaagctcctcactaagccttgggatgtgatccccatggtgacccaaatagccatgaccgataccacgcccttcgggcaacaacgggttttcaaggagaaggtagacacccgaacgccgaaggcaaagcgaggcactgctcagataatggaggtaactgccaaatggctatggggcttcctctccagaaataaaaaaccgagaatttgcaccagggaggagttcacacgcaaggtgcgcagcaacgccgcgatcggcgctgtgttcgtagacgaaaatcagtggaacagcgccaaggaggccgttgaggacgaacggttctgggatctggtacatcgcgaaagagagttacacaagcaagggaaatgcgctacctgcgtctataacatgatgggcaaacgagaaaaaaagctgggcgagtttggcaaggccaaagggtcccgagctatctggtacatgtggctgggcgcccgcttcctggaattcgaggcactcgggttcatgaacgaagaccactggttttcgcgcgagaatagcttatctggcgtcgagggtgaggggctgcacaagcttggctacatactaagagatatttcaaaaatccccggcggcaacatgtacgccgatgatacggccggctgggatacccgcatcaccgaagacgacttgcagaacgaagcgcggatcaccgacatcatggagcccgagcacgccctactggccaaaagtatcttcaagctcacgtaccagaacaaggtagtgcgtgtccagcggccggctaaaaatgggacggtgatggacgtcataagcagacgggaccagcgcggatccggccaggtgggcacatatggcctaaatacctttacgaacatggaggcccagctcatccggcaaatggaatcggaaggaatattcagtcccagcgagctggagaccccgaaccttgcggaacgcgtgctagactggctagagaagtacggcgtggagcggctcaagcggatggccatcagtggggatgactgtgtagtaaaacctattgacgaccggtttgcaactgcccttaccgcactgaacgacatgggcaaggtccgcaaagatatcccccagtgggagccctccaagggatggaatgactggcagcaggttcccttctgtagtcaccacttccaccagctcatcatgaaggacggaagggagattgttgttccgtgccgcaatcaggatgagctagtgggcagggcgcgcgtgtcacagggagccggctggagtctccgggaaactgcttgtcttgggaaatcgtatgctcagatgtggcagctcatgtacttccacagaagggacttaagactcgcggccaacgcaatctgttcagcggtcccggtggattggatccccacgtcccgaaccacgtggtcgatacatgcccaccaccaatggatgacgaccgaggatatgctatccgtgtggaaccgggtttggatcgaagaaaacccttggatggaggacaagacgcacatcagcagctggggcgacgttccgtacctaggcaagcgggaagaccagtggtgcggcagtctcatcggccttacagcgcgcgcaacctgggccacaaacatccaggtggcgattaaccaggtccgccgccttatcgggaatgagaactacctggactacatgacctccatgaagcgcttcaaaaacgagagcgaccccgagggcgccctttggtaa

SEQ ID NO: 24489 - RNA, 9879 nt, synthetic construct
  misc_feature 1..9879: note = derived and/or modified CDS sequence (opt11) from DENV-1__GU131786__SS-prME
  source 1..9879: mol_type = other RNA
agcgtgaccatgctgctcatgctgatgcctaccgccctggccttccatcttaccactaggggcggggaaccgcacatgatagtgtcaaagcaggaacggggcaagagcctgctgttcaagacgtctgcgggggttaacatgtgcaccctaatcgccatggatctaggcgagttctgcgaagataccatgacctacaagtgcccccgcatcaccgaggccgagcccgacgacgtcgactgctggtgcaacgccaccgacacctgggtgacctacgggacctgctcccagaccggcgagcaccggcgggacaaacggtccgtggccttagcgccccacgtgggcctcggtctggagacgcgcaccgagacctggatgagctccgagggggcctggaagcagattcagcgggtggagacctgggccctgcggcaccctgggtttacggtgatagccctcttcctggcacacgccattggcacctccatcactcagaagggaatcatcttcatcctactcatgctggtgaccccctccatggcgatgcgatgcgtcggcatcggaagccgcgacttcgtggagggtctgtccggcgccacgtgggtggacgtcgttctcgagcacgggagctgtgtgaccaccatggccaaggacaagcccaccttagacatcgaactgctgaagacggaggtcactaaccccgccgtgcttcggaagctgtgcatcgaggccaagatttccaataccaccacggacagccgctgtccaacccagggggaggcaaccctcgtagaggaacaggacgccaacttcgtctgccggaggacattcgtggatcggggttgggggaacggatgcggactcttcggcaaggggtccttgatcacgtgcgccaagttcaagtgcgtgaccaagctcgagggcaaaatcgtccaatacgaaaacctgaagtacagtgtgatcgtgacggtccataccggcgaccagcaccaggttggtaacgagtccacggagcacggcaccaccgcgaccatcacaccccaggcccccagcacggagatccagttaacagactacggggctcttaccctggactgcagtcctcggaccggcctggacttcaacgagatggtcctcctgactatgaaggagaagtcctggctggtgcacaagcagtggttcctcgacctgcccctgccctggaccagcggggccagcacttcacaggaaacctggaatcggcaagacctcctggtaacatttaagaccgcccatgcgaaaaagcaggaggtcgtggtgctgggctcccaggagggcgcaatgcacactgccctcactggggcgacggagatccagaccagtggcaccaccacgatcttcgcagggcacctgaaatgccgcctgaagatggacaagctcacgctgaagggcatgtcctacgtaatgtgcaccgggagcttcaagttagagaaggaagtggcggagacacagcacggcacggtgctcgtccaaatcaaatacgagggcaccgacgccccctgcaagattcccttctccacccaggatgagaagggggtgacccagaacggccggctgatcacggccaacccgatagtgaccgacaaggagaaacccgtcaacatcgaggccgagccgcccttcggggaaagctacatcgtgatcggcgcgggcgagaaggcccttaaactgagttggttcaagaaggggagctctataggcaagatgttcgaggccccggcccgcggggcccggcgcatggcgatcctcggcgctaccgcctgggacttcgggtccataggcggagttttcccctctgtcgggaagttagtgcaccagatcttcggcacggcgtacggggtgttattctcgggcgtctcctggacgatgaagatcgggattggcgtcctcctgacgtggctgggcctcaattcacgctccacaagcctgtcaatgacctgcatcgccgtgggacttgtcacgctctacctgggcgtgatggtgcgggctgacagcgggtgcgtcatcaactggaagggccgcgagctgaagtgtgggtccggcatcttcgtgaccaacgaagtgcacacctggaccgagcagtacaagttccaggctgactccccgaagcggctcagcgccgccatcggcaaggcctgggaggagggggtttgcggtattcgctccgcgactagactggaaaatattatgtggaagcaaatcagcaatgaactgaaccatattctcctggagaatgacatgaagttaaccgtggtggtcggggacgtggccggcatcctcgcccaggggaagaagatgatccgcccccagccgatggagtacaagtattcctggaaatcctggggcaaggccaagataatcggcgcggacgtgcagaacacaaccttcatcatcgacgggcccaacacccccgagtgccccgacgatcagcgggcctggaacatctgggaggtcgaggattacggcttcgggatctttactactaacatctggctgaagctacgcgacagctacacccaggtgtgtgaccacagactcatgagcgccgcgattaaggactctaaggcagtacatgcggacatgggctattggatcgagtccgagaagaacgagacctggaagctggcccgcgccagcttcatcgaggtcaagacgtgtatctggccgaagtcacacaccctgtggtccaacggcgtgttagagagcgagatgatcatccccaagatctacgggggaccaatcagtcagcacaactaccggccggggtacttcacccagaccgcgggcccctggcacctggggaagctggagctcgacttcgacttgtgcgagggcacgaccgtcgtagttgacgagcattgcggcaaccgcgggccgagcttacggaccaccacggtgaccggcaagataattcacgaatggtgctgccgtagttgtaccctgccacccctccggtttaagggggaggatggctgctggtacgggatggaaatccgccccgtcaaggagaaggaggagaatcttgtaaagagcatggtaagcgccggctccggcgaggtcgacagcttctccttggggcttctgtgtatcagcatcatgattgaggaagtgatgcggtcccgctggagccggaagatgttgatgacaggcacgctggcggtgttcttcctgctgatcatggggcagctgacctggaacgatctgatccgcctctgcatcatggtcggggccaacgcatccgaccgcatggggatgggaaccacctacctggccctgatggccaccttcaagatgcggcccatgttcgcggtgggtctgctgttccgacgcctgaccagcagggaggtgctcctactgaccataggtctctccctggtcgccagcgtggagctgccaaattccctagaggagctgggcgacgggctggccatgggcattatgatcctcaagctgctgacagactttcagagccaccaactctgggccacactgctgagcttaaccttcatcagaaccaccttctctctccactacgcctggaagacgatggccatggtcctgtccatcgtgagcctgttcccgctgtgtctctccaccaccagccagaagaccacatggctccccgttctgctaggctccttagggtgcaagccgctcaccatgttcctgatagcggagaacaagatatggggtcgcaagagctggccattaaatgaggggatcatggccgtcggcatcgtaagcatcctgctgtcctcgctcctgaagaacgacgtgcccctggccgggccactcatcgctggcggcatgctgatagcctgctacgtaatctctgggtcttccgccgacctgtctctcgagaaggccgccgtggtgagctgggaggaagaggcggagcacagcggcgcgtcccataacatcctcgtcgaggtgcaagacgacgggaccatgaagatcaaggatgaagaacgggatgacaccctgaccatcctcctgaaggctaccttactggcagtgagcggcgtctaccccctgtccatccccgccaccctgttcgtttggtacttctggcagaagaagaagcagcggtctggagtgctctgggacaccccatccccaccggaggtcgagcgggcggtactggacgacggcatttaccgcataatgcagcggggcctacttggcaggagccaggtgggcgtaggggtattccaagagaatgtgttccacactatgtggcatgtcacgcgcggcgcagtgctcatgtaccagggcaagcgcctagagccctcctgggcctcagtgaagaaggacctcatctcctacggcggcggttggcgactccagggttcgtggaacaccggggaggaggtccaggtgattgctgtggagccaggcaagaacccaaagaacgtccagacggcccccgggaccttcaagacgtccgagggagaggtgggtgcgatcgccctggacttcaagcccggaaccagcggcagcccgatagtgaaccgcgaggggaagatagttggcctgtacggcaacggggtggtgaccacctccggcacgtacgtcagcgccatcgcccaggcgaaggcctcccaggaagggcccctccccgaaatcgaggacgaggttttccgaaagcggaatctgaccataatggacctgcacccgggcagcgggaagaccagacgctacctccccgccatcgtgagggaagccatcaagcgcaagctgcgcaccctgatattggcccccactcgagtcgtagcgtccgagatggccgaagccctgaagggcatgcccatccgctaccagaccaccgccgtcaaatccgagcacacgggcaaagagatagtcgacctgatgtgtcatgcgacgtttaccatgcggctcttgtccccggtccgcgtgcccaactacaacatgatcataatggacgaggcgcacttcacagaccccagctccatcgctgcccgggggtacatttcaacccgcgtcggcatgggtgaggccgccgcgatctttatgacagccacgccaccgggatccgtggaggctttcccccagtcgaacgccgtgatccaagatgaggagcgggacatacctgagcgcagttggaacagcggatacgagtggatcaccgatttccctggtaagaccgtctggttcgtgccgtctatcaagtctggcaacgacatcgcgaactgcttgcggaagaacgggaagcgcgtgatccagctctcccggaagacgttcgacacagagtaccagaagacaaagaacaacgactgggactacgtcgtgaccacggacatcagcgagatgggcgccaacttccgcgccgaccgggtgatcgatcctagacggtgcctgaagcccgtcatcctgaaagacggtcccgagcgcgttatattggccggcccgatgcccgtcaccgtggccagtgcggcccagcggcgcgggcgcataggccgcaaccacaataaagagggggaccagtacatctatatgggccaacccttgaataacgacgaggaccacgcccactggaccgaggccaagatgctactcgacaacatcaatactcccgagggcataatccctgccctgttcgagcccgaaagggaaaagagcgcagccatagacggggagtatagactgcgcggcgaggcccggaagacgtttgtggagctcatgcgtcgcggggacctgcccgtctggctgagttataaggtggcttcagagggcttccagtacagcgaccgccggtggtgcttcgacggcgaaaggaacaaccaggtcttagaagagaacatggacgttgaaatctggaccaaggagggtgaacggaagaagctgcgcccacggtggttagatgcccgcacctactccgacccactcgcgctgcgcgagttcaaagagttcgccgccggccgccggagcgtgtccggagacttaatcctcgagatcggcaagctgccacagcacctgacccagcgcgcacaaaacgcgctcgacaacctggtgatgttgcataactccgagcagggcggccgggcataccggcacgccatggaggagctcccagacacgatcgagaccctgatgctcctcgcactgattgccgtcctgaccggcggggtgaccctcttcttcttatccggccggggtctgggcaagacgtcaattggcctactgtgtgtgatggcgtccagcgtcctgttgtggatggcctccgtggaaccccactggatcgccgccagcatcatcctggagttcttcttaatggtgctgctgattccagagcccgaccgtcagagaacgccccaggacaaccagctagcttacgtcgtcatcgggctcctgttcatgatcctaaccgtcgcggccaatgaaatgggcttgctggagacaaccaagaaggacctggggatcggccacgtcgccgtggagaaccaccaccatgccgcgatgctcgacgtagacctgcatccggcgagtgcctggacgctatatgcggtagccaccaccatcatcacccccatgatgcgccacacgatcgagaacactaccgccaacatcagcctcaccgcgatagccaaccaggctgccatcctgatggggctggacaagggctggcccatctccaagatggacatcggcgtgcccctcctggcgctgggatgttatagccaggtgaacccgttaacgcttaccgcagctgtcctgatgctcgtagcccactatgcgatcatcggccccgggttacaggcgaaggccacccgcgaggcccagaagagaaccgctgccggcatcatgaagaaccccacggtagacgggatcgttgcgatagatctggacccagtagtgtacgatgccaagttcgagaagcagctcggccaaatcatgttactgatcctctgcacgtcccagatcctgctcatgaggaccacctgggccctctgcgagagcataactttggccacgggcccgctaaccaccctctgggaggggtccccaggcaagttttggaatacaaccatcgccgtcagcatggcgaacatcttccgggggagctacctggcaggcgccgggctggccttctccctcatgaagtccctcgggggcgggcgacgggggaccggtgcgcagggcgaaaccctcggcgagaaatggaagcgccagctcaatcagttatccaagagcgagttcaacacgtacaagcggtccgggatcatggaggtggaccgcagcgaggccaaggagggccttaagcgcggggagaccaccaagcacgccgtaagtcgaggcaccgccaagctcaggtggttcgtcgagcgcaatctggttaagcccgagggtaaggtgatcgacctaggatgcggcagaggcgggtggagctactactgcgccggtttgaagaaggtcactgaggtgaagggttacaccaagggcgggcctggccacgaggagccgatcccaatggcgacctacggctggaacctcgtgaagctgcactccggcaaggacgtcttctttatccctcccgagaagtgcgacaccctgctatgcgacatcggggagtcctccccgaaccccacgatagaggagggtcgcaccctgcgagtgctgaaaatggtggagccctggctccgcggtaatcagttctgcataaagatcctaaacccgtacatgccgagcgtcgtggagactctggagcagatgcagcgtaagcacgggggaatgttagtgcgaaaccccctgtccaggaacagcacccatgagatgtactgggtctcctgcgggacgggcaacatcgtgagcgcagtgaacatgacttcccgcatgctgctcaaccgcttcaccatggcacaccgaaagcccacctacgagcgcgacgtggacctgggggccggcacccggcacgtggccgtcgagccagaggtcgcgaaccttgacatcattgggcagcgcattgagaacatcaagcacgagcacaagagcacgtggcactacgatgaagacaacccctacaagacctgggcataccacgggtcctacgaggttaagcccagcggaagcgcctccagcatggtcaacggggtggtgaagctcctgaccaaaccgtgggacgtcatacccatggtgacccagatcgccatgacggatacgaccccgttcggccagcaaagggtgtttaaggagaaggtcgacacacgcacgcccaaggccaagcgggggaccgcgcaaataatggaggtgaccgcaaagtggctgtggggcttcctctcccggaacaagaagcccaggatctgcacccgcgaggagttcacgaggaaggtgcgaagcaacgccgccatcggcgcggttttcgtggacgagaaccagtggaactccgctaaggaggccgtagaggacgagcgcttctgggacctcgtccaccgcgagcgggagctgcacaagcagggcaagtgcgctacctgcgtttataacatgatgggcaagcgtgagaagaagctcggggagttcggcaaggccaaggggtcgcgggcgatttggtacatgtggctgggcgcccgcttcctggagttcgaggccctcggcttcatgaacgaagatcattggttctcacgggagaacagcctgtccggcgtagagggcgaggggttacacaaactcggctacatcctgcgcgacattagcaagattcccgggggcaacatgtacgccgatgacaccgcgggctgggatacaagaatcacggaggatgacttacagaacgaggcgaagatcaccgatatcatggagcccgagcacgccctcctggctaagtccattttcaagctgacctaccagaacaaggtcgttcgcgtgcagcgcccggccaagaacggtaccgtcatggatgtcataagccgccgcgaccagcggggctccggacaggtaggcacatacggcctcaacacctttacaaacatggaggcccagctgatccggcaaatggagagcgaggggatattctcccccagcgagttggagacccccaacctcgcgggccgggtgttagactggttagagaagcacggagtggagcgcctcaagcggatggctatctccggcgacgactgcgtggtaaaacccatcgacgaccgcttcgccacggccctgaccgccctgaacgacatggggaaggtgcggaaggatatcccccagtgggaaccgagcaagggatggaacgactggcagcaggtcccgttctgcagccatcacttccaccagctaattatgaaggatggccgcgagatcgtcgtgccctgccggaaccaggacgagctggtcggccgcgcgcgggtcagccagggggccggatggagcctgcgcgagaccgcctgcctcggcaagtcctatgcccagatgtggcagctgatgtacttccaccggcgtgacctgcggctggcggcgaacgccatttgcagcgccgtacccgtggactgggtacccacctcccgtacgacatggagcattcacgcccaccaccagtggatgaccaccgaggatatgctgtcggtatggaaccgcgtgtggatagaagagaacccgtggatggaggataagacgcatatcagctcttggggcgatgttccctacctgggcaagcgcgaagaccaatggtgcggcagcctcatcgggctgaccgcgcgcgccacgtgggctaccaacatccaggtggccatcaaccaggtgcggcgccttcttggcaacgagaactacctggactacatgacgtccatgaagcggtttaagaacgaaagcgaccccgaaggggccctgtggtag

SEQ ID NO: 24490 - RNA, 9879 nt, synthetic construct
  misc_feature 1..9879: note = derived and/or modified CDS sequence (opt11) from DENV-1__GU131787__SS-prME
  source 1..9879: mol_type = other RNA
tccgtaaccatgctgctcatgctgatgcccaccgccttagcctttcacctcaccacccggggcggggagccccacatgatcgtgagcaagcaggagcgggggaagtcattgttattcaaaacaagcgctggggtgaacatgtgcaccctcatcgccatggatttaggcgagctttgcgaagacaccatgacctacaagtgcccgcgtatcaccgaaaccgaacccgacgatgtggattgctggtgcaacgccaccgatacctgggtaacctatgggacctgcagccaaacgggcgagcaccggcgcgacaagcgatcagtggccctggcccctcacgtggggcttggactggaaacgcgcaccgaaacctggatgagctccgagggcgcctggaagcaaatccagagggtggagacgtgggcactccgccacccggggtttaccgtcatcgccctgttcctggctcacgctatcggaaccagcatcacgcagaaggggatcatattcatcctcctgatgcttgtgacacccagcatggccatgcgttgcgtcggcatcggcagccgtgacttcgtggaggggctctcaggcgccacctgggtcgacgtcgtattagagcacgggagctgcgtgaccaccatggccaaggacaagccgacgctggacatcgagctcttaaaaaccgaggtcaccaaccccgccgttctgcggaagctctgcatcgaggcgaagatctccaacaccacgacggactcccggtgtcccactcagggagaggccaccttagtggaggagcaggacgccaattttgtctgccggcgcacgttcgtggaccgaggctgggggaatggctgcggtctgttcggcaaaggtagcctcataacctgcgcgaagttcaaatgcgtaaccaaacttgaaggcaagatcgtgcagtatgaaaacctgaagtacagcgtgatagtgaccgtccacacgggcgaccagcaccaggtggggaacgagtccaccgagcacggcaccaccgccaccataacgccccaagcgccaaccaccgagatccagttgaccgactacggggccctgacgttagactgcagcccccgcacgggcctcgacttcaacgagatggtcctgctgaccatgaaagaaaaatcctggctcgtgcacaagcagtggttcctggacctgcctctcccttggacctcaggggcctctacctcccaggagacatggaaccggcaagacttactggtgaccttcaagaccgcccacgctaagaagcaagaagtcgtggtgctagggtcacaggaaggcgcgatgcacacggcgctgacaggggccacagagatccagacgtcgggcacgacaacaatctttgccgggcacctgaaatgcagactaaagatggataagctgaccctgaagggtatgtcgtacgtcatgtgcacggggtcctttaagctcgagaaggaggtggcagagacccagcacggcacagtgctggtccaaatcaagtacgagggcaccgacgcgccatgtaagatacccttctccacgcaggacgagaagggagtgacccagaacggccggctgatcaccgcgaacccgatcgtgaccgacaaggagaagcccgtcaacattgaggccgagccgccctttggggagtcctacatcgtgatcggcgcgggcgagaaagcgctgaaactcagctggttcaagaagggctcgagcatcggcaagatgttcgaggccacggcccgcggggccagacgtatggccatcctgggcgataccgcctgggacttcggctctatcggcggcgttttcacctccgtcgggaaattagtacatcagattttcggcacagcctacggggtcctcttcagtggcgtctcttggacgatgaagatcgggatcggcgtgctgctgacgtggctaggtctaaattcgcgcagcacatccctgtccatgacctgcatcgccgtggggttagtcacgttatacctgggcgtaatggtgcaggctgactccgggtgcgtcatcaactggaagggccgggagctcaagtgcgggagtggcatcttcgtgaccaacgaggtgcacacctggacagagcagtataagttccaggccgactccccgaagcgtctgagtgcggctatcggcaaggcctgggaggaaggggtctgcggcatccggagcgccacccgcctcgagaacataatgtggaaacagatctcaaacgagctcaaccacatcctcctggagaacgggatgaagttcacggttgtggtgggcgatgtggccggcatcctagcacaggggaagaagatgatacggccccagcccatggagtacaaatacagctggaagtcatggggaaaggccaagataatcggggcagacgtgcagaataccaccttcattatcgacggtcctaatacccccgagtgccccgatgaccagcgcgcctggaacatttgggaggttgaagactacgggttcggcatcttcacgacgaacatctggctgaaactgcgggacagctacacccaagtctgtgaccaccgcctcatgtccgcggccattaaggactccaaggccgttcacgccgacatgggatattggatcgagagtgagaagaacgagacctggaaactggcccgggcgagcttcatcgaggtgaagacgtgcatctggcccaagtcccacaccctgtggtcgaacggtgtgctcgagtccgagatgataatccccaagatctacggcgggccgatcagccagcacaactaccgccctggctatttcacacagaccgccgggccctggcacctgggcaaattagagctcgacttcgacctgtgcgagggcacgaccgtcgtcgtcgacgagcactgcggcaaccggggcccgtcccttaggaccaccacagtcacggggaagatcatccatgagtggtgctgccggagctgtaccttgccgcccctccgctttcggggcgaggatgggtgttggtatggcatggagatcaggcccgtaaaggagaaggaagagaatctggtgaagtccatggtgagcgccggcagcggtgaggtggattcgttcagcctcgggctactgtgcatatcaatcatgatcgaggaggtgatgcggagccgctggtcgcggaagatgctcatgaccgggaccctggcagtgttcttcctgctcatcatgggtcagctgacctggaacgatctgatccgcctctgcatcatggtcggggccaatgcctccgacaggatgggcatgggcaccacctaccttgccctgatggccacgttcaaaatgcgccctatgttcgcagtggggctactgttccgccggctgacttcccgcgaagtgctcctgctcaccatcggactcagccttgtcgcttccgtggagctgccgaacagcttggaggagctgggtgacggcctggcgatgggaatcatgatcctcaagctgctgaccgacttccagagtcaccagctctgggcgacgctgctgtctttaaccttcatcaagaccaccttcagccttcattacgcctggaagacgatggccatggtcctgagcatcgtgtccctctttcccctgtgcttaagcaccaccagccagaagaccacgtggctccctgtactgctggggtctttgggctgtaagccgctgaccatgttcctcattgccgagaacaagatctgggggcggcgctcctggccgcttaatgagggcataatggctgtcgggatcgtgtccatcttactgagctccctcctcaaaaacgacgtgcccttggctggccctcttatcgccggcgggatgctgatcgcctgctacgtcattagcggatccagcgccgacctgtccctcgagaaggccgcggaggtgagctgggaagaggaggccgagcattccggtgcaagccacaacatcctggtggaggttcaggatgacggcaccatgaagattaaggacgaggagcgagatgataccctcaccattctactgaaggcgacgttgctcgccgtgtccggggtgtatcctctttcaattcccgcgaccctgtttgtctggtacttttggcagaagaaaaagcagcgctcgggcgtgctgtgggacacccccagtccacccgaagtcgaacgtgcggtcctggacgacggcatctaccgcatcatgcagcgggggttgcttggccgatcccaggtgggggtgggggtcttccaggagaacgtgttccatacgatgtggcacgtcaccagaggggccgtactcatgtaccaaggcaaacgcctggagcccagctgggcgtcagtgaagaaggatctgattagttacggagggggatggcgcctccaggggagttggaacaccggagaggaggttcaggtcatcgcggtggagcccgggaagaatcccaaaaacgtccagaccgcccctggcaccttcaagactcccgagggtgaggtcggggccatcgccctggacttcaagcccgggactagcggttcccccatcgtgaatcgcgagggaaaaattgtgggcctgtacggtaacggcgtcgtgacgacatcagggacgtacgtgtcagcgattgcccaggccaaggcctcccaggagggcccgctgcccgagatcgaggacgaggtcttccggaagcgcaacctgaccatcatggacctgcaccccgggagcggtaagacccggcgctacctccctgcgatcgtgcgcgaggccatcaaacgcaagctgcgaaccctgattcttgccccaactcgggtagtcgcctccgaaatggcagaggcgctgaagggcatgccgattcgctaccagaccacggccgtcaagagcgagcacaccgggaaggagatcgtcgacttaatgtgccacgcaacattcacaatgagactcctctcccccgtccgcgtgcctaactataatatgatcataatggacgaggcgcactttaccgaccccagctccatcgccgcgcggggatacatcagcacccgcgtcggtatgggcgaggccgccgccatcttcatgactgccacgccgcccgggtccgtcgaggcattcccccagagcaacgccgtgattcaggatgaggagcgggacattcccgagcgctcctggaactcaggctacgagtggatcacagatttcccgggcaagacggtctggttcgtcccctccatcaagagcgggaacgacatagcaaactgcctgcggaaaaacggcaagagagtgatacagctctcccggaagacgttcgataccgagtaccagaagaccaagaacaacgattgggactacgttgtcaccactgacatatcagaaatgggggccaactttcgagcggaccgggtgatagacccgagacggtgcctgaaacccgtcattctgaaagacggccccgagcgcgtcatcctcgccggtcccatgccagttaccgtcgcctcggccgcccagcggcgcggccggataggacggaaccacaacaaggagggggaccagtatatctacatgggccaaccactgaacaacgacgaggaccacgcgcactggaccgaggccaagatgctgctcgataacatcaatactccagaggggatcatcccggccttgttcgagccggagcgcgaaaagtcagccgccattgacggcgagtatcggctgcgtggtgaggcacggaagacgttcgtggagctgatgcgccggggcgacctgccagtgtggctgagttacaaggtagccagcgaaggcttccagtatagcgaccgccggtggtgcttcgacggggagcgcaacaaccaggtgctcgaggagaatatggacgtggagatctggaccaaggagggcgaacggaagaagctgcgcccccggtggctcgatgcgcgcacatattcggaccccctcgcattacgggagttcaaggagttcgcggcggggcgccggtcagtcagcggcgacctaatcctcgaaatcggcaagttaccgcagcacttgacccagcgcgctcagaacgcgctcgataatctggtgatgttgcataactccgagcagggaggacgtgcttatcgccacgctatggaggagctcccggacacgatcgagacgctgatgctactcgccctaatcgctgttctgacagggggcgtcacactgttctttctgtcgggccggggcctgggtaagaccagcatcggcctcctgtgcgtgatggcatccagcgtgctgctctggatggccagtgttgaaccccactggatcgcagcctccatcatccttgagttcttcctgatggtactcctgatccctgagccggaccgccagcgtacgccgcaagataaccagctggcctacgtagtcatcggcctcctgttcatgatcctaaccgttgccgccaacgagatggggctcctggagaccaccaaaaaggatcttggaatcgggcacgtagcggtcgagaaccaccaccatgccgccatgttggacgtggacttgcaccccgcgtccgcctggacgctgtacgcggtggccactaccattatcaccccgatgatgcgccacacgatcgagaacaccactgcgaacatcagcctcaccgccatcgccaaccaagctgccatactgatgggcctcgataagggctggcccatctccaagatggacatcggagtcccgttactggccctgggctgctacagccaggttaatccgcttacactgaccgccgcagtgctgatgctcgtggcccactacgccatcatagggccgggcctgcaggccaaggccacgcgcgaggcgcagaagcgaaccgccgccgggatcatgaagaaccccactgttgacggaatcgtggccatcgatctggaccctgtcgtatacgacgccaagttcgaaaaacagctcggacagatcatgttactgattctgtgcacctcccaaatactgttgatgcgcaccacctgggcgctctgcgaatctatcacactggccaccgggcccctgaccaccctctgggagggctccccggggaagttctggaacacaacaattgccgtgagtatggccaacatattccggggctcctacctggcaggcgccggactggccttttcactcatgaagtcgctgggcgggggcagacgagggaccggggcccagggcgagaccctgggggaaaagtggaagagacagctcaaccagctgtccaagtccgagtttaacacgtataagcgttccggaatcatggaagtcgaccggagcgaggccaaggaagggctgaagcggggcgagaccaccaagcacgcggtatcacgcggaaccgccaaacttcggtggttcgtggagcgcaacctggtcaagcccgagggcaaagtgattgacctgggatgtgggcggggtggttggagctactactgcgctgggttaaagaaggtgacggaggtcaaggggtacaccaagggcggccctgggcatgaggagcccatcccgatggcaacctacggttggaacctcgtgaaactgcactccggtaaagacgtgttcttcatcccgcccgagaagtgcgacacactgttatgcgacatcggtgaatcatcccctaacccaactatcgaagaggggaggaccctgcgtgtactgaagatggtcgagccctggctaagggggaatcaattctgcatcaaaatcctgaacccctacatgccatctgtggtagagacactggagcagatgcagcggaagcatggcgggatgttggtgcgcaacccgctgagtcggaacagcacccacgagatgtactgggtgtcctgcggcacagggaacatcgtctcggccgttaacatgacatcacgaatgctgctcaatcgcttcaccatggctcaccggaagccgacctacgagcgcgacgtggacctgggcgctggcacccggcacgtcgcggtggagccggaagtggccaatctggatattatagggcagcgcatcgagaacatcaagcacgagcacaagagcacctggcactacgacgaagacaacccctacaagacctgggcctaccatggctcctatgaggtcaagccgagtggctccgcgtctagcatggtgaacggagttgttaagctgctgaccaagccctgggacgtgatccccatggtgactcaaattgccatgacggataccacgccattcgggcagcagcgggtgtttaaggagaaagtggacacccgcacgcccaaggccaagcggggcaccgcacagatcatggaggtaaccgccaagtggctttggggcttcctctcccggaacaagaagccccgaatctgcacccgcgaggagttcacgaggaaggtacgcagcaacgcggccatcggtgcagtgttcgtcgatgagaaccaatggaactccgccaaggaagctgtggaggacgagcggttctgggacctggtgcaccgcgagcgggagctgcacaagcaggggaagtgcgcgacatgcgtctataacatgatgggaaagcgggagaaaaagctaggagagttcgggaaggccaagggcagccgagccatctggtacatgtggctcggagcgaggttcctggagttcgaggccctcggtttcatgaacgaagaccactggttttcccgggagaacagcctgtctggtgtggagggggagggcctgcacaagttggggtatattctgcgcgacatctccaagatccccgggggcaacatgtacgccgacgacacggccggatgggacacccggatcacggaagacgacctgcaaaacgaggcgcgcattaccgatatcatggagccggagcatgcgcttctggcgcggagtatcttcaaacttacctaccagaacaaggttgtccgggtccagcgcccagccaagaatggcaccgttatggacgtaatcagccggcgcgaccagcgggggtccggacaggtggggacgtacgggctcaacacgttcaccaacatggaggcgcagctgatccgccagatggagagtgagggtatcttttcacccagcgaactggagacgcccaacctcgcagagcgggtgttagactggctggagaagtatggggtggagcgccttaaacggatggccatctctggcgacgactgcgtggtaaagccgatagacgaccgcttcgcgacggcccttacagccttaaacgacatggggaaagtccgaaaggacataccccagtgggagcccagcaagggttggaacgattggcagcaggtccccttctgttcccaccacttccaccaactcatcatgaaggacggtcgcgaaatcgtcgtcccttgccggaatcaagatgagctggtggggagggcacgggtgtcacagggcgccggctggagcctgcgagagaccgcgtgcttgggcaagtcttacgcccagatgtggcagctgatgtacttccaccggcgagacctgcgtctcgccgccaacgcgatttgctcagctgtccccgtcgattggatccccacttcccgcacgacatggagcatccacgcccaccaccaatggatgaccactgaggacatgctgtccgtgtggaaccgcgtctggattgaggagaacccctggatggaggataagacgcacatcagttcatggggcgacgtgccgtacctgggcaaacgggaagaccagtggtgtggtagcctcatcgggctgacagcccgcgccacctgggcgaccaacatccaggtggccatcaaccaggtccgtaggctaattggcaatgaaaactacctcgattacatgacctccatgaaacggttcaagaacgagagcgaccccgagggggcgctgtggtga

SEQ ID NO: 24491 - RNA, 9879 nt, synthetic construct
  misc_feature 1..9879: note = derived and/or modified CDS sequence (opt11) from DENV-1__HM181968__SS-prME
  source 1..9879: mol_type = other RNA
agcgtgaccatgctactcatgctgatgcctaccgccctggccttccacctcaccacccggggaggcgagccccacatgatcgtgaccaagcaagagcggggcaaaagcctgctgttcaaaactagcgcgggggtgaatatgtgcaccctcatcgccatggatctaggggagctatgcgaggacaccatgacgtacaagtgcccccggatcaccgaggcagagcccgatgacgtggactgctggtgtaatgctactgacacctgggtgacctacggaacctgctcgcagacaggggagcaccggcgcgacaagcggagcgtggccctcgcgccccacgtgggcctggggctggaaacacgaaccgagacatggatgtccagcgaaggtgcctggaagcagatccagcgggtggaaacgtgggccttacgccaccccgggttcacggtgatcgccctgttcctggcacatgccataggcacttccatcacccagaaaggcatcatcttcatactcctcatgcttgtgacgcccagcatggccatgcggtgcgtaggcattgggtcccgcgatttcgtggaggggctcagcggcgctacctgggtagacgtagtgttagagcacgggtcgtgcgtgaccaccatggccaaggacaagcccactctggacatcgagctgctgaagaccgaggtcacgaatcccgctgtactgcggaagctctgcatcgaggccaaaatcagcaacaccacgacggactcccgatgtcccacccagggcgaggccactttgatggaggagcaggacgccaacttcgtttgccgtcgaacgttcgtcgaccggggttgggggaatggctgcggtttatttggcaaggggtcactgatcacatgtgccaagttcaagtgcgtgaccaagctggagggcaagatcgtgcagtacgagaatctgaagtacagcgtcatcgtaacggtgcacacgggcgaccaacaccaggtcgggaacgagtctacggagcacggaaccaccgccaccattacgccacaggcgcccacatccgagatccagctcaccgactacggtgccctaacacttgactgcagccctcgcacaggcttggacttcaacgaaatggttctcctgaccatgaaggagaagtcctggctcgtccacaagcagtggttcctggatctgccgctcccgtggacttcaggggcatctacctcccaggagacttggaaccggcaggacctgcttgtaaccttcaagaccgcccacgcgaagaagcaggaagtggtcgttctcggcagccaggagggtgccatgcacaccgccttaaccggggctaccgagatccagacgtccggcaccactactatcttcgccggccatctgaagtgccggctcaagatggacaagctgaccttaaagggcatgagctacgtgatgtgcaccgggtccttcaagctcgagaaggaggtcgcggagacgcagcacggcacggtgctggtgcagataaagtacgagggcaccgatgcgccatgcaagattcccttcagcactcaggacgagaagggggcaacccagaacggccggctgatcaccgccaacccgatcgtcacggacaaggagaagcccgttaacatcgaggcggagccgcccttcggagagtcatacattgtcatcggggccggcgagaaagccctgaaactcagctggtttaagaagggctcctctatcggcaagatgttcgaggccactgcccgaggggcgcggcgaatggccatcctgggcgacacggcttgggacttcgggtccgtcggcggtgtgttcacctcggttgggaagctcgttcatcaaatcttcggtaccgcctatggggtcttgttcagtggcgtaagctggaccatgaagataggaatcggggtcttactgacttggctcggcctgaactcccgcagcacctccctgagcatgacctgtatcgccgtggggctcgtaaccctgtatctgggtgttatggtacaggcggactccgggtgcgtgatcaactggaaaggcagagaactcaagtgtggttcgggcatcttcgtaacgaacgaggttcacacatggaccgagcaatacaagttccaagccgactctccgaagcgcctgtccgccgccatcggcaaggcgtgggaagagggggtgtgcggcatccgaagcgcgacccgcctggaaaacatcatgtggaagcagatctccaacgagctcaatcatatcctgctggagaacgacatgaagttcaccgtcgtagtgggggacgttgtgggtattctcgcccagggcaagaaaatgatacggccccagcctatggagcacaaatacagttggaaatcgtggggcaaagccaagatcatcggcgcggacgtccagaacacgacattcatcattgatgggcccaacacccccgagtgtcccgacgaccagagggcgtggaacatctgggaggtcgaggattacggcttcgggatattcgccacaaatatctggctgaagttacgggacagttatacccaagtgtgcgaccaccggctcatgtccgccgccatcaaggacagcaaggccgtccacgcggacatgggctactggatcgagtcagaaaagaacgagacctggaagctggctcgggcctcgttcatagaggtcaagacctgcatctggcctaagtcccacaccctctggagcaatggagtgctagaatctgagatgatcatcccgaaaatctacgggggcccgataagccaacacaactaccgccccggatactttacgcagaccgccggaccatggcacttggggaagctggagctcgatttcgacctgtgcgaaggaaccactgtggtcgtagacgagcactgtggcaaccgggggccctcactgcgcacgaccacggtaaccggcaaaattatccacgagtggtgttgccggagctgcacgctgccgcccctcaggttcaagggtgaagatggctgctggtacgggatggaaatccggcctgttaaagagaaagaagagaacttagtgaagtccatggttagcgcaggcagcggcgaggtcgatagtttcagcctcggtctcttgtgcatcagtatcatgattgaagaggttatgcgtagccggtggtcacgcaagatgctcatgaccgggaccctggcggtgttcctgcttctgatcatggggcagcttacctggaacgacctcatccggctgtgtatcatggtcggtgctaacgcgtcagacagaatggggatgggcactacctatctggccctcatggccacctttaagatgcgccccatgtttgcggtgggcctgttgctccgccgcctgacctcccgggaggtgctgttactgacgatcgggctgagcctcgtcgcgtccgtggaactgccgaacagcctggaggaattgggtgatgggcttgccatgggaatcatgatcttgaaactcctcacggacttccagtcccaccagctgtgggccacccttctgagcctaaccttcattaagactaccctctcactgcactatgcgtggaagaccatggccatggtcctgagcatcgtgtcactctttcccctgtgcctaagcacgacgtcccagaagaccacctggttgccggtgctgctgggaagcttcgggtgcaagccgctcaccatgttcctgatcacggagaacaagatctggggccgcaagtcctggccactgaacgaaggaataatggcagtgggtgtcgtgagcatccttttaagcagcctgctcaagaatgatgtccccctggccgggcccctgatcgccggcggcatgctcatcgcgtgctacgtgatcagcgggtcaagcgccgacctgtccctggagaaggccgccgaggtgtcatgggaagaggaggctgagcactccggcgcgagccacaacatccttgtcgaggtacaggacgacgggactatgaaaatcaaggacgaggagcgggacgatacactgaccatacttctcaaggcaacccttctggccgtgtccggtgtctacccgctcagcataccggcaacgctgttcgtgtggtacttttggcagaagaagaagcaacgctcaggggtgctgtgggacaccccctcgccccctgaggtcgagcgggccgtgttagacgacggcatctaccgcatcatgcagcggggcctcctagggcgcagtcaagtgggcgtcggggtattccaagagaacgtgttccacaccatgtggcacgtcacccggggtgctgtgctgatgtaccaggggaagcgtctcgagccctcgtgggcctccgtcaagaaggaccttatcagctacggcggcgggtggcggctgcagggctcctggaacacgggggaggaggtccaggtgatcgcggttgagccgggtaagaaccccaagaacgtccagaccgcacccgggaccttcaagaccccagagggcgaggtcggcgccatcgcgctggacttcaagcccgggaccagcggctcccccattgtgaaccgcgaaggaaaaatcgtcggactgtacggcaacggggtggttacgaccagcggcacctatgtctccgcaatcgcccaggcaaaggcgtcccaggagggtccgctgcccgaaattgaagacgaggtatttcggaagcgcaacctcacgatcatggatctgcatcccggcagcgggaagacccgacgctaccttcccgccatcgtgcgggaggccatcaagcgcaagctccggaccctgatcctggcgcccacccgcgtcgtggcctcggagatggcggaggccctcaagggcatgccaatccgctaccagacgaccgccgtaaagtctgagcacaccggcaaggagatcgttgacctgatgtgccacgccacgttcacgatgcggctgctgtcgccggtgcgtgtgccgaattacaacatgatcattatggacgaggcccacttcaccgaccccagctcaatagcggcccggggctatatatcaactcgcgtcggcatgggtgaggccgccgccatttttatgacggcgacacctcccggctccgtcgaggccttcccgcagagcaacgcggtgatccaagacgaggagcgggacatacccgagcgttcctggaacagcgggtacgaatggatcactgacttccccggcaagaccgtctggttcgtgccttccatcaagtcgggcaacgacatcgccaactgcctgcggaaaaacggtaagcgcgttattcagctatcccggaagaccttcgatacggaatatcaaaagacaaaaaacaacgactgggactacgtcgtgaccaccgacatcagcgagatgggcgcgaactttcgcgcagacagggttatcgaccctcgccggtgcctaaagcccgtcatcctgaaggacgggcccgagcgcgttatcctggctggtcccatgcctgtgacagtggcctcggcagcccaacggcgtggccggatagggcgcaaccacaacaaagagggcgaccaatacatctacatggggcaacccctcaacaacgacgaggaccatgcacactggaccgaagccaagatgctgctggacaacattaacaccccggagggcatcatccccgccctcttcgagccggagcgggagaagtccgccgcaatcgacggggagtacagactgcgcggcgaggcgcgcaagaccttcgtcgagctgatgcgccgcggggacctccccgtttggctgagttataaagtggctagcgaaggcttccagtacagcgaccgccgatggtgcttcgatggcgaacgcaataatcaggtgcttgaggagaacatggacgtcgagatctggacgaaggagggggagcggaagaagctccgcccccggtggctagacgcccgcacttactccgatccactggcccttcgggagttcaaggagttcgcggccggccgacggagcgtgtcaggggatctgatcctggagatcggcaagctcccgcaacacctcactcagcgcgcccaaaacgccttagacaatctcgtaatgctgcataactcggagcagggcgggcgggcgtaccgccacgccatggaggagctgcccgataccatcgagactctcatgctgctcgccttgatcgccgtcctgactggcggggtgacgctgttcttcctctccggtcggggactgggcaagaccagcatcggcctgctctgtgtgatggccagttccgtcctgctgtggatggcgtccgtggagccgcactggattgccgccagcatcatcttagagttctttctgatggtcctgctcataccagagccggaccgccaacggacaccccaggacaaccagttagcctacgtcgtgatagggctccttttcatgatactgacagtggccgcaaatgagatgggcctgctcgagaccaccaagaaggacttagggataggtcacgtcgctgtggagaaccaccaccacgccacaatgcttgacgtggacctacaccccgcctccgcttggacactgtacgcggtcgccactactatcatcactccgatgatgcgccacacgatcgagaacaccacggccaacatctcactcaccgcaattgccaaccaagcggccatcctgatggggctggacaagggctggcccatctccaagatggacatcggggttccactgcttgccctgggctgttactcccaggtgaaccccctgacgcttaccgccgcggtcctcatgctggtagcccactacgccattatcggcccggggctccaggccaaagccaccagggaggcgcagaagcgaacagcggctggcatcatgaagaaccccacggtggacggtattgtagccatcgacctggatcccgtggtgtacgacgccaaattcgagaagcagctgggccagatcatgctcctaatactgtgcacttcccagattctcctgatgcgaaccacctgggcgctgtgcgagtccatcaccctcgccaccggccccctgaccaccctgtgggagggctccccgggcaagttctggaacaccaccatcgccgtcagtatggccaacatcttccgtggctcctacctcgccggcgcaggcctggccttcagcctgatgaagtccctaggtggcgggcgccggggcaccggggctcagggcgagacgctgggggaaaagtggaagcggcagctgaaccagctctccaaaagcgagtttaacatctataagcggtctggcatcatggaagtcgaccgcagcgaagcgaaagagggcctgaagcgcggggagacgacgcgccacgcagtatctagaggaaccgccaagctccgctggtttgtagagcggaaccttgtgaagccggaagggaaggttatcgacctcggatgcggccgcgggggatggtcctattactgcgccgggctgaagaaagtgaccgaggtgaaaggctacacgaaaggtggtcccggccacgaggagcccatcccgatggccacatacgggtggaacctggttaagcttcacagcggcaaggacgtcttctttacgccgccggagaagtgtgacacactgctgtgtgacataggggagagcagtcccaacccgacgatagaagagggccggacactccgcgtgttaaagatggtggagccctggctgcgggggaaccagttctgcatcaagatcctaaacccctacatgcctagcgtagtggaaaccctggagcagatgcagcgcaagcatggcggcatgcttgtgcgaaacccgctcagcagaaacagcacccacgagatgtactgggtctcctgcgggaccggcaacattgtgagcgccgtgaacatgacgtcccggatgctgctgaaccgcttcaccatggcgcaccgcaaacccacttacgagcgcgacgtcgacttgggagcgggcacccgccacgttgccgtggagcccgaggttgccaacctggatattatcggccagcggatcgaaaacatcaagcacgaacataagagtacgtggcactacgacgaggacaacccgtacaaaacctgggcctatcacggctcctatgaggtgaagccctccggctctgcgagcagcatggtcaacggggtagtgaagctgctcaccaaaccctgggatgtgatccctatggtgacccagatcgccatgacggacaccacccctttcggccagcagcgcgtgttcaaggagaaagttgatacccgcacgccgaaggccaagagggggacagcccagatcatggaagtgaccgccaggtggctctggggcttcctttcaaggaacaagaagccccgaatctgcacccgagaggaattcacacggaaagtgcgcagcaacgctgccatcggcgccgtattcgtggacgagaaccagtggaactccgccaaggaggcagtggaggacgagcggttctgggaccttgtccagaaggagcgcgaactgcacaagcaagggaagtgcgcgacttgcgtttataacatgatgggaaagcgggagaagaagctgggggaatttggcaaggccaaggggtccagggccatatggtacatgtggctcggcgcccggtttctagaattcgaagcgctgggcttcatgaatgaggaccactggttctctcgcgagaacagcctctccggtgtggagggcgaggggcttcacaagctaggctacatcctcagagacatcagcaagattcccgggggaaacatgtacgccgacgacacggccggctgggacacccgcattacggaggatgaccttcaaaacgaggccaagatcaccgacatcatggagccggaacacgccctgctcgcgacctccatattcaagctgacataccagaacaaggtggtacgtgtgcagcgcccggccaagaacgggactgtcatggacgtgatcagccgccgggaccagcgcggctccggtcaagtgggcacctacggcttaaacacatttaccaacatggaagcccagctcatcagacagatggagagcgaggggatcttcctgccctccgagctggagacgccaaaccttgccgagagagtcttagactggctggagaaatacggcgtggagcgtctcaagcgcatggccatctctggggatgactgcgtggtcaagccgatcgacgacagattcgcgaccgcgcttaccgcgctgaacgatatgggcaaggtgcgcaaggacatacctcagtgggagccttcaaaagggtggaatgactggcagcaggtccccttttgcagccaccatttccaccagctcatcatgaaagatggtcgggagatcgttgtcccctgccgcaaccaggacgaactcgttgggcgggcccgcgtcagtcagggggccggctggagcttacgggaaaccgcctgcctgggcaaaagctacgcccagatgtggcagctgatgtacttccacagacgagacctgcgcttagcagccaacgcgatctgctcagccgtccccatcgactgggtgcccactagccggacaacctggtccatccacgcacaccatcagtggatgaccaccgaggacatgctgtccgtgtggaaccgcgtatggatcgaggagaacccttggatggaggacaaaacccacgtgtccagttggggcgacgtcccgtatctgggtaagcgggaggaccagtggtgtggctccctcataggcctgaccgctcgcgccacctgggcgagcaacatccaggtggcaatcaaccaggtgcgccggctgatcggaaacgagaattatttggactacatgacctccatgaagcgcttcaagaacgagggagaccccgagggggccctatggtaa

SEQ ID NO: 24492 - RNA, 9879 nt, synthetic construct
  misc_feature 1..9879: note = derived and/or modified CDS sequence (opt11) from DENV-1__GU131789__SS-prME
  source 1..9879: mol_type = other RNA
agcgtgacgatgctcctaatgctcatgcctaccgccctggccttccacttgaccacgcgtgggggggagccccacatgattgtaagcaagcaggagcggggcaagagccttctgtttaagaccagcgccggggttaacatgtgcaccctcatcgccatggacctcggcgagctgtgcgaggacaccatgacctacaagtgccctcggatcacggaaaccgagcccgatgacgtggactgctggtgcaacgccaccgacacctgggtgacgtacgggacctgtagccaaactggagagcaccggcgcgacaagcggtctgtggctctcgcgccccacgtgggcttaggtctggaaacccgcaccgagacctggatgagctctgagggtgcttggaagcagatccaacgtgtagagacttgggccctccgccaccccgggttcaccgtgatagccttattcctggcccacgctatcggcacaagcatcacacaaaagggcatcatatttattctcctgatgctggtgacgcccagtatggctatgcggtgcgtgggcatcggcagccgcgacttcgtggaggggctctcgggtgccacttgggtagatgtggtgttggagcacgggagttgcgtgacaaccatggcaaaggacaagcccacactcgatatcgagctcctaaagactgaagtcacgaatcctgccatcctgcggaagctctgcatcgaggcgaaaatcagcaacacgacgacggacagccgctgccctacccagggcgaggcaacgctggtggaggaacaggacgccaattttgtgtgccggcgcacgttcgtcgaccggggctgggggaatggctgcggtctgttcgggaagggatccctcatcacgtgcgccaagttcaaatgcgtgaccaagttagagggcaagatagtgcagtatgaaaatctgaagtattccgtaatcgtgaccgtgcatacgggcgaccaacaccaggtggggaacgaatccaccgaacatggcaccaccgccaccatcacgcctcaagcgcccaccactgagattcagctcaccgattacggtgccctgacgcttgactgcagtccacgcacgggcctagacttcaacgagatggtgcttttgaccatgaaagaaaagagctggctcgtccataagcagtggtttctggacctgcccttaccatggaccagcggggcaagcacgtcccaggagacctggaaccggcaggacctattagtgaccttcaagaccgcccatgccaagaaacaggaggtggtcgtgttgggcagccaagagggcgcgatgcacacggctctcaccggggcaacagagatacagacctctggcacgacaacaatcttcgccgggcacctgaagtgccgcctcaagatggacaagctgaccctgaagggaatgagctatgtgatgtgtacaggctcctttaagctagagaaggaagtagccgagacccagcacggcacggttctggtgcaaataaaatatgagggcacagacgcgccctgcaaaatcccattcagcacgcaggatgagaagggggtcactcagaacggccggctgatcacagccaaccctatcgttaccgacaaggagaagcccgtgaatatcgaggccgagccgcccttcggggaatcctacatagttatcggcgctggcgagaaggcgctgaagcttagctggtttaagaaggggtccagcatcgggaagatgttcgaggccacggcccgcggcgctcggcggatggcaatcctgggcgacaccgcttgggacttcgggagtataggcggcgtgttcaccagcgtcgggaagctcgtccaccaaatcttcgggaccgcctacggagtcctcttctccggcgtgagctggacgatgaagataggaattggcgtattgctgacctggctcggcctgaacagccgcagcacatccctgagtatgacctgtatcgccgtgggtctcgtgactctctacctgggagtcatggtacaggccgactccgggtgtgtgatcaattggaagggccgggagctcaaatgcgggagcggcattttcgttaccaatgaggtacacacctggaccgagcagtacaaattccaagccgatagccccaagcgcctgtccgcggccataggtaaggcttgggaggagggggtgtgtgggatccggagcgccactcgcctggagaacatcatgtggaagcagatcagtaacgagctcaaccacatactgctggaaaacgacatgaagtttacggtcgtggtgggagatgtagctggaatactcgcgcaggggaagaaaatgatccggccccagcctatggagtataagtacagctggaagtcatggggcaaggccaagatcatcggcgcggacgtgcagaacaccacctttatcattgacggacctaacacccctgagtgccctgacgaccagcgcgcctggaacatctgggaggtggaggattacggcttcgggatattcacaaccaacatctggcttaagttacgagatagctacacccaggtctgcgaccatcgcctaatgagtgcggctatcaaggacagcaaggccgtgcacgccgacatgggctactggatcgaatccgaaaagaatgaaacctggaagctcgcaagagctagcttcatcgaggtgaagacctgtatctggcccaagtcccatacgttgtggagcaacggcgtcttagagtccgagatgatcatccccaagatctacggcggcccgatcagccagcacaactaccgccccggttacttcacccaaaccgccggcccatggcatttagggaagttggagctcgatttcgacctgtgcgaaggcacaaccgtcgttgtcgatgagcattgcggcaaccgggggccgtccctgcgcacgaccacggtgactggcaaaatcatccacgagtggtgttgccggtcatgcaccctgccgcctctccgcttccgcggtgaggatggctgctggtacgggatggagatacgccccgtgaaggagaaagaggagaacctggtaaaatccatggtgagcgccggctctggcgaagtagactcattcagcctcggactgctgtgcatctccatcatgatcgaggaagttatgcggagccgctggagtagaaagatgctcatgaccggcacgctggccgttttcttgctactgatcatggggcagttgacctggaacgatctcatcagactgtgtatcatggtgggcgccaacgcgagcgataggatggggatggggacgacatatctggccctcatggcgacatttaagatgcggccgatgttcgctgtaggtctgctgttccgccggctcacctcccgcgaggtgctgctgctcactatcgggttgtcgctggtggcctccgtcgagctcccgaatagcctggaggagctgggcgatggactcgcgatgggcataatgatcctgaagcttcttacggacttccagtctcatcagctgtgggccacgctgctctcactgaccttcatcaaaaccaccttctcgctgcactacgcctggaagacgatggccatggtgctcagcatcgtctccctgttccctctgtgcctcagtaccacctcccagaagaccacgtggctgcccgtgctgctcggcagcctggggtgtaagccgctaaccatgttcctcatcgcggaaaataaaatttggggaagacgctcttggccactgaatgaggggatcatggctgtcggcatcgtctcgatcctgctcagctccctactcaagaacgacgtgccactggctgggccactgatcgccggcggcatgctaatcgcgtgctacgtaatcagcgggtcctccgcggacctatcactggaaaaagcggcggaggtcagttgggaggaggaagccgaacactccggcgctagccacaacattctcgtggaggttcaagacgacgggactatgaaaatcaaggacgaagaacgggacgacactctcaccatcctgttgaaggcgaccctcctggcagtctccggcgtttaccccctaagcatccccgcaacactcttcgtgtggtatttttggcagaagaagaagcagcgctccggggttctgtgggatacaccctcgccgcccgaggttgagcgggccgttttagacgatggcatctaccgcatcatgcagcggggcctgctagggcgctcccaggtcggcgtgggggttttccaggaaaacgtcttccatacgatgtggcacgttacccggggcgcagtactgatgtaccaggggaagcgcctggaacccagctgggcgtccgtaaaaaaggacctcataagctacggcggcgggtggcgtctacagggctcctggaacaccggggaggaagtccaggtgatagccgtcgagcctggcaagaatccgaagaatgtgcaaaccacccccgggaccttcaagacccccgagggcgaggtgggcgctatcgccctggacttcaagccaggtacctctggctcacccatagtcaaccgcgagggtaagatcgtcggcttgtacggcaacggagttgtgactacgagcggcacctacgtcagcgccatcgcgcaggccaaagccagccaggaggggcccctgcccgagatcgaggacgaagtgttccggaaaagaaatctgaccatcatggatctgcaccccggaagcgggaaaacccggcgctatctaccggcgatcgtccgtgaggctatcaagcgcaagctccgcacgttaatcctcgcccccacccgagttgtagccagtgaaatggccgaggcacttaagggcatgccaatccgttaccagaccaccgctgtaaagagcgagcacacggggaaggagattgtggacctaatgtgccacgctacctttacgatgcgactgctaagccccgtgcgcgtacccaactacaatatgatcattatggatgaggctcactttaccgaccccagcagcatcgcggctagggggtacatcagcacccgggtgggaatgggggaggccgccgccatcttcatgacagccacgccgcccggctccgtggaggctttccctcaaagcaatgcggtcatccaggacgaagagcgggatatccccgaaaggtcctggaacagcgggtacgagtggatcactgatttccccggcaaaacggtgtggttcgtgccgtccatcaaaagcggcaatgacatcgcgaactgcctccggaagaatggaaagcgcgtcatccagctatcgcggaagacctttgacaccgaataccagaagaccaagaacaacgactgggactacgtggtgacgactgacattagcgagatgggcgccaactttcgggcagaccgcgttatcgacccgcgacgttgcctgaagcccgtaatacttaaggacgggccagagcgcgtgatcctcgccggtccaatgccggtcacagttgcctcagctgcccagcggcgcgggcggatcggccgcaaccataataaagagggggaccagtatatctatatgggacagcccctgaacaatgacgaagaccacgcccactggacggaggcgaagatgttgctggacaatatcaacacaccggaaggtatcatccccgcactgtttgagccggagcgagagaagagtgcagccatcgacggggagtaccggctcagaggcgaggcccggaagacatttgtagagctgatgaggcgcggggatctccccgtatggctctcgtataaggttgcaagcgagggcttccaatactccgatcgccgatggtgtttcgatggagagcgcaataatcaagtcctggaagaaaacatggacgtggagatatggaccaaagaaggggagcggaagaaactgcgaccccgctggctcgacgcgaggacctactctgatcccctggcgctcagagaatttaaggaattcgcggctggccgccgtagcgtgtccggggacctcatcctggagatcggcaaactgccgcagcacctcacacagcgcgcacagaacgccttggacaatctggtaatgttacacaatagcgagcagggggggcgggcctaccgccacgccatggaggaactgcccgacactatcgagacattaatgctcctggcgctgatcgccgtgctcacagggggggtcaccctgttttttctgtcaggccgggggctcggcaagacgagcatcggcctgctctgcgtcatggcctcaagtgtgttactatggatggcgtccgtggagccccattggatcgctgctagcatcatcctggagttctttctcatggtactcctgatcccggagccggataggcagcggactccccaggacaaccagctcgcatacgtggtgattgggctgctgttcatgatcttgaccgtggccgcaaacgagatgggcctgctggagaccacgaagaaggatctcgggattggccacgtggccgtggggaaccaccaccacgccgccatgttggatgtcgacctgcaccccgcctccgcatggaccctctacgctgtggccactacgatcattacgccgatgatgcgccacaccattgagaacaccaccgccaatatcagtctgacggccatcgccaaccaggccgcgattctgatgggcctcgacaaaggctggcccatctctaagatggacatcggggtgcctctattggcgctcggttgctactcacaagtcaaccccctgaccctgaccgccgccgtgctcatgctcgtggcgcactacgctatcatcgggccgggcctgcaggccaaggccacccgcgaggcgcagaagcggacggcggccgggatcatgaagaacccaaccgtagacggaatcgtggccatcgacctcgaccccgtggtttacgacgccaaattcgagaagcagctgggccagataatgcttctgattctttgcacctcccagatactgctcatgcgcactacctgggccctgtgcgagagcatcactctggcgaccgggcccctcacgacgctatgggagggctctccggggaagttctggaacactaccatcgctgtaagcatggcgaacatattcaggggtagttatctggccggggccggattggcattctccctgatgaagtcactcggggggggtcgccgggggacgggcgcccagggcgagacgctcggtgagaagtggaagcgccagctgaaccagctgtctaagagcgagttcaacacctacaagcggtccggcataatggaagttgaccgcagcgaggcaaaggaggggctcaagcggggcgaaaccacaaagcacgccgtctcccgcggaaccgcaaagctgcggtggttcgtagaacgcaacctcgtgaaaccagaaggaaaggtcatcgatctgggctgcgggcggggcgggtggagctactattgcgccggcctcaaaaaagtgacggaggtgaaggggtacaccaagggcggccccgggcacgaagagccgatcccgatggctacgtatggctggaacctggtcaagttgcactccgggaaggacgttttcttcattccgcccgaaaaatgtgatacgcttctgtgcgacataggggaaagttcgcccaaccccactatagaggaaggtaggactctccgtgttctcaagatggttgagccctggctgcgcggcaaccagttctgtatcaagatcctgaacccctacatgccctcagtggtggagaccctcgagcaaatgcagcggaagcacggcgggatgctggtccgcaacccgttgtcccggaacagcacccacgaaatgtactgggtgtcctgcgggacggggaacattgtgagcgccgtaaacatgacctccagaatgctactgaaccgcttcaccatggctcaccggaaacccacctacgagcgcgacgtggatttgggagcgggtacgcggcatgtggccgtcgagcccgaagtggccaaccttgatataatcgggcagcgcatcgaaaacatcaagcatgagcacaaaagtacctggcactacgacgaagacaacccgtacaagacttgggcctaccatggatcctacgaggtgaaacctagcgggtctgcgagcagtatggtcaacggtgtggtcaagctgctgaccaagccatgggacgtgatcccgatggtgacgcagatcgccatgaccgatactacccccttcggccagcagcgggtgtttaaggagaaagtggacacgcggaccccgaaggccaagcggggtaccgcccagatcatggaggtcacagcgaagtggctatggggctttctgtctcgcaacaagaagccccggatatgtacgcgcgaggagttcactcggaaggtccgctcaaacgccgcgattggggctgtatttgtagacgaaaaccagtggaactcagcaaaggaggccgtcgaggacgagcggttttgggacctggtgcaccgcgagcgcgagctccacaaacaaggcaaatgcgcgacctgcgtgtacaacatgatggggaagagggagaagaaactgggcgagttcggtaaagccaagggctcacgcgccatttggtacatgtggctgggcgcacgcttcttagagttcgaagccctggggtttatgaacgaggaccattggttctcccgcgagaacagcctctcaggggtcgagggggaggggctccacaagctgggttacatcctgcgcgacatcagcaagattcccggcggtaacatgtacgcggacgatacggcggggtgggacacgcgtatcaccgaggacgacctccagaatgaagcgcgcattacggacatcatggaaccggagcacgccctattggctaagtctatattcaagctcacttatcagaataaggttgtgagggtccagcggcccgcaaagaatggcacggttatggatgtgatcagccgccgagaccagcgaggttccggccaggtcggtacctacgggctaaacaccttcactaacatggaggcgcagctaattcggcaaatggagagtgagggaatattttcccccagcgagctcgaaacccccatcttagccgagcgcgtgctggactggctcgaaaagtacggggtggaacgccttaaacgcatggccatctccggcgacgactgcgtcgtgaagccgatcgacgaccgtttcgcaaccgccttaacagcgctgaacgacatggggaaggtgcggaaggacattccacagtgggagcctagtaagggatggaatgactggcagcaggtccccttttgcagtcatcatttccatcagctcatcatgaaggatggcagggagatcgtggtaccgtgtcgaaaccaggacgagctggtgggacgtgcccgcgtgagccagggcgccgggtggagtctccgggagacggcctgtttaggcaagtcctacgcgcagatgtggcaactgatgtacttccaccgccgcgacctccgcctggccgccaatgccatctgtagcgcggttcccgtcgactggatacccacatccaggacgacctggagtatccacgcccatcatcagtggatgacgacggaggacatgctgtccgtgtggaatagagtctggattgaggagaacccctggatggaagacaagacccacatcagctcctggggagacgtgccgtacctcggcaagcgcgaggaccagtggtgcggttcgctgatcgggctaaccgcccgcgctacctgggcgaccaacatccaggtggcgataaaccaggtgcgtcgcctcataggcaatgaaaactacttggattacatgacctccatgaaacgcttcaagaacgagagcgacccagagggggctttgtggtga

SEQ ID NO: 24493 - RNA, 9879 nt, synthetic construct
  misc_feature 1..9879: note = derived and/or modified CDS sequence (opt11) from DENV-1__GU131790__SS-prME
  source 1..9879: mol_type = other RNA
tcggtgaccatgctgctgatgctggtgccaaccgccctggccttccatctcaccactcggggcggtgaaccacacatgatcgttagcaagcaggaacggggcaagagtctgctgttcaagaccagcgccggtgttaatatgtgcaccctcatcgccatggacctgggcgagctgtgcgaggacaccatgacctacaaatgcccccggatcaccgaaaccgagccagacgacgtggactgttggtgtaatgccaccgacacttgggtgacgtatgggacgtgcagccaaacgggcgagcatcggcgggacaaacggtctgtggccctcgcgcctcacgttggcctggggctggagacccgcacagagacctggatgagctccgagggcgcctggaaacaaatacagcgggtggagacttgggcactccggcaccccgggttcaccgtgatcgccttgttcctggcccacgcgatcggcaccagcatcacccagaagggaatcatcttcatcctccttatgttagtcactccctccatggcaatgaggtgcgtgggcatcggcagccgcgacttcgtggagggcctctccggcgccacctgggtcgacgtggtgctggagcacgggtcttgcgtcaccaccatggccaaggacaagccgacgctggacatcgagctcctgaaaaccgaggtgaccaatcccgccgtgctgcggaagctttgcatcgaggctaaaatctccaacaccacgaccgactcccgctgcccgactcagggcgaggccacactggtcgaggaacaggacgccaacttcgtgtgccggcgcacgttcgtggacagaggctgggggaacgggtgcggtctgttcggcaagggctccctcataacgtgcgccaagttcaagtgcgtcactaagctggagggcaagatcgttcaatacgagaacctgaagtatagtgtgatcgtcaccgttcacacgggcgaccaacaccaggtcgggaacgagtccaccgagcacgggaccaccgccaccatcaccccccaggcgcccaccaccgagattcagctcaccgactacggggccctgactctcgactgcagcccccgcaccggcctcgacttcaacgagatggttttgctgacaatgaaagaaaagtcgtggctcgtgcacaagcagtggttcctggacctgcccttaccctggaccagcggggccagcacgtcccaggaaacctggaaccggcaggaccttctggtgaccttcaaaaccgcccatgcgaagaagcaggaggtcgtggtccttggcagtcaggagggcgcgatgcacacagcactgaccggggccaccgaaatccagacgtccggaacgaccaccatcttcgccgggcacctgaaatgccgcctcaaaatggacaagctgaccctgaaggggatgagctacgtgatgtgcacgggctccttcaaactcgagaaagaggtggccgaaacccaacacgggaccgtcctagtacagatcaagtacgagggtaccgatgcgccctgcaagatccccttcagcacgcaggacgagaagggagtgacccagaacggccggctgatcaccgccaacccgatcgtcaccgataaggagaagccagtgaacatcgaggccgagcccccctttggggagtcgtatatcgtgatcggcgcaggcgagaaggcgctgaagctcagctggttcaaaaaggggtccagcatcggcaagatgttcgaggccacagcccgcggggcccgtaggatggccatcttaggcgacaccgcgtgggacttcgggtccatcggcggcgtattcaccagcgtggggaagctggtgcatcagatctttggcaccgcctacggtgtcttattctcaggcgtcagctggacgatgaagatcgggataggcgtgctgctgacatggctcggactgaactcccgcagcaccagccttagcatgacctgcatcgcagtagggctcgtgacgctgtaccttggcgtgatggtccaggccgactccgggtgcgtaatcaactggaagggccgggaactcaaatgtgggagtggcattttcgtgaccaacgaagtccacacgtggacagagcaatacaagttccaagcagacagcccgaagcgcctgtccgcggccatcggcaaggcctgggaggagggcgtgtgcggcatccggagcgccacccgcctggagaacatcatgtggaagcagatcagcaacgagttaaaccacatcctgctcgaaaacgacatgaagttcacggtggtagtgggcgacgtggccggcatcctcgcccaggggaagaagatgatccgtccccagccgatggagtacaaatactcatggaagtcctggggcaaggcaaaactgatcggcgccgacgtccagaacaccacttttatcatcgacggacccaacacccccgaatgccccgatgaccagcgagcctggaacatctgggaggttgaggactacgggttcgggatcttcaccaccaacatctggctgaaactccgggacagctacactcaggtgtgcgaccaccgcctgatgtccgcggccatcaaggacagcaaagccgtccacgctgacatgggctactggatcgagagcgagaagaacgagacctggaagctggcgagggcgagtttcatcgaggtgaagacgtgcatctggcccaaatcccacaccctctggtcaaacggagtgctggagtccgagatgattatccccaagatctatgggggccctatcagccagcacaactaccgccccgggtacttcacccagaccgccggaccatggcacctggggaagctagaactggacttcgacttatgcgagggcacgaccgtcgtagtggacgagcattgcggcaatcgggggccgtccctccgcaccaccacggtcaccggaaaaattatccacgagtggtgctgccggagctgtaccctgcctcccttgcgcttcagaggcgaggacggatgctggtacgggatggagatccgccccgtgaaggagaaagaagaaaatctcgtgaagtccatggtctcagccggctcaggagaggtcgactcctttagcttagggctgctctgcatctccataatgattgaggaggtgatgcggagtcgctggtcacggaagatgctgatgaccgggacgcttgccgtctttttcctcttaatcatggggcagctgacctggaacgacctcatacgcctgtgcataatggtgggcgccaacgcaagcgaccgcatggggatgggcaccacctacctggccctcatggccacgttcaaaatgcggccgatgttcgccgtgggcctactgttccgccggctcaccagccgcgaagtcctactgctcaccatcgggctgagcctggtggcctccgtcgagctgcccaacagcctggaagaactgggcgacgggttggcgatggggatcatgattcttaagctgctcaccgacttccagtcgcaccagctgtgggccactctgctcagcctcaccttcatcaaaaccaccttttccctgcactacgcctggaagacgatggccatggtacttagcattgtgtccctgttccccctgtgcctcagcaccacgagtcagaagaccacgtggctgcccgtcctgctcggctcgctgggatgcaagccgctgaccatgttcctcatcgcggaaaacaaaatctggggtcggcgttcctggcccctgaacgaggggataatggccgtgggcatcgttagcatcctgcttagctctctgctgaagaacgacgtccccctcgccggacccttgatcgccggcggcatgctgatcgcctgctacgtcatcagcggatcctcggcggacctctccctggaaaaggccgccgaggtgagctgggaggaggaggccgagcactccggcgccagccataacatcctggttgaggtgcaggacgacgggaccatgaagatcaaggacgaggagcgggacgacaccctcaccatcttgctgaaagcgacgctcctggccgtatccggtgtctacccgctgagcattccggcgaccctcttcgtttggtacttctggcagaagaagaagcagcggtccggggtgctgtgggatacccccagcccgcccgaggtcgagcgagccgtgctggatgacggtatttaccgaattatgcagcgtggcttgctggggcgctcccaagtgggcgtcggggtgtttcaggagaacgtcttccacacgatgtggcacgtcacgcggggcgccgtgcttatgtaccaggggaagcgcctggagcccagctgggcgtccgtaaagaaggatctcatcagctacggaggcgggtggcggctgcagggttcctggaacactggggaagaggtccaggtgattgctgtggagcccggcaagaaccccaagaacgtccaaaccgcaccaggcaccttcaagacgcccgagggtgaggtgggagctattgccttagatttcaaacccgggaccagcggttcccccatcgtgaaccgagagggcaagatcgtcggcttgtacggcaacggggtggtgactaccagcggcacatacgtctccgccatagcccaggcgaaggccagccaggaggggccgttacccgaaatcgaggacgaggtgttccggaaacgcaatctgaccatcatggacctccaccccggtagcgggaagacccggcgctatctgccggcgatcgtgcgggaggctatcaaacgtaagctgcgcaccttaatccttgcccccacgagggttgtcgcgtccgagatggctgaggcgctcaagggaatgccaatcagataccagaccactgccgtcaagagcgagcacacgggcaaggagatcgtcgacctgatgtgccacgcaacgttcaccatgcggctgctgagccccgttagggtgccgaactacaatatgatcatcatggacgaggcccacttcaccgaccccagctccatcgccgcgcggggttacatcagcacccgcgtcggcatgggagaggccgccgccatctttatgaccgccacgccgcccggctccgtcgaggcgttccctcaaagcaacgccgtgatccaggacgaggagcgggacatccccgagcgctcctggaacagcgggtatgagtggatcaccgacttccccggcaagaccgtctggtttgtgccctccatcaagtctggaaacgacatcgcaaactgcctccggaagaacgggaaacgcgtaatccagctgtccaggaagactttcgacacggagtaccagaagaccaagaacaacgactgggattatgtcgtgactacagacatctcagagatgggcgctaacttccgcgcggaccgagtgatcgaccctcgcagatgcctgaagcccgtcattctcaaggacgggcccgagcgcgtaatcttagccgggcccatgccggtcaccgtggcctccgcagcccagcgtcgcggtagaatcggccgcaaccataacaaggagggcgaccagtacatctacatggggcagcccctgaacaatgacgaggaccacgcgcactggacagaggccaagatgctcctggacaacatcaacacccctgagggcataatacccgcgttattcgagccggagcgcgagaaatccgccgccatcgacggggagtacagactccggggcgaggctcggaagacgttcgtggagctgatgcgcagaggggacctgcccgtctggctctcctacaaggtggctagcgagggcttccagtattcagaccgccggtggtgcttcgacggcgagcgcaacaaccaggtgctggaagagaacatggacgtcgagatctggaccaaggaaggtgaacggaagaagctgcggccccggtggctcgacgcccgtacctactccgacccgcttgccctgcgggagttcaaggagttcgctgcgggtcgccggagcgtgagcggcgacctcattctggagatcggcaagctgccgcagcatctcacacagcgcgcccagaacgcgttggacaatctggtgatgctgcacaacagcgagcagggcggacgggcctaccgccacgcgatggaggagctgccagacacgatcgaaaccctgatgctcctggccctgatcgccgtcctcaccggcggggtgaccctgttcttcctgtccggccgcgggctcggcaagacctcaatcggcctgctgtgcgtgatggcctccagcgtcctcctgtggatggcatcggtggaaccccactggattgcggccagtataatactggagtttttcctcatggtcctgctgatccccgagccggatcgccagcggacgccacaggacaaccagctagcctacgttgtgatagggctactgttcatgatcctcaccgtggccgccaacgaaatggggctcctagagaccacaaagaaggacctcgggatcggccacgtggcggtggagaaccatcaccacgccgccatgctggacgtggaccttcaccctgcctccgcctggacgctctacgcggtcgctactacaatcatcactccgatgatgcgccacacgatcgagaataccaccgcgaacattagcctgaccgccatagcgaaccaggcggccatcctgatggggctcgataagggctggccgatctccaagatggacatcggcgtgcccttattggccctcgggtgctacagccaggtgaaccccctgaccctgaccgcggcggtcctcatgttggtggcccactatgccatcattggaccggggctgcaagccaaggccacccgcgaggcacagaaacggaccgccgccggcattatgaagaacccaacggtggacgggatcgtcgccatcgacctcgaccccgtggtgtacgacgcgaagttcgaaaagcaactgggccagatcatgctgctcatcctgtgcacaagccagatcctgctcatgcggaccacctgggcgttgtgcgaaagcataacgcttgccaccggccccctcaccacattatgggaggggtccccgggcaaattctggaacacgaccatcgccgtcagcatggccaacatcttccgggggagctacctagccggcgcgggcctcgccttcagcctgatgaagtccttagggggcgggcgccgggggaccggggcgcagggcgaaaccctcggcgagaagtggaagagacagctgaatcagctgtctaagagcgagttcaatacgtacaagcggtccgggatcatggaagtggaccgcagcgaggccaaagagggcctcaagcgcggggagacaaccaaacacgctgtgtcccgtggcaccgcaaaacttcggtggttcgtcgagcgcaacctggtgaagcccgagggcaaggtgatcgaccttggctgcggccgcgggggctggagctactactgcgccggtctcaaaaaggtcacggaggtgaagggatacaccaaggggggcccgggccatgaggagcccatcccgatggcgacctacgggtggaatctggtgaagctgcatagtggcaaggacgtgttcttcatcccgcccgagaagtgcgacaccctcctgtgcgacatcggggagagttcccccaacccgacaatcgaggagggccgcacgctgcgggtgctaaaaatggtggagccctggctgcgcgggaaccagttttgcatcaagatcctgaatccctacatgcccagcgtcgtggagaccctcgagcagatgcagagaaagcacggcggcatgctggtgcgcaacccgttaagccggaacagcacccacgagatgtattgggtatcctgcggcaccggcaacatcgtgagcgccgtgaacatgacatctcgcatgctgctgaaccgcttcactatggcgcaccggaagcccacctacgagcgcgacgtcgacctgggggccggcacccggcatgtggcggtggagcccgaggtggccaacctcgacatcatcggtcagcgcatcgagaacatcaagcacgagcataaaagcacgtggcactatgacgaagacaacccctacaagacctgggcataccacgggtcgtatgaggtgaaaccgtctggctccgcctcatcaatggtgaacggggtggtgaagcttctgaccaagccctgggacgtcatccccatggtgacccagatcgctatgacggataccaccccctttggccagcagcgggtgtttaaggaaaaggttgatacccgcacgcctaaggcaaagcgggggacagcacaaataatggaggtgaccgccaagtggttgtggggcttcctgtcccgcaacaagaagcctcggatctgcacccgcgaggagtttacgcggaaggtgcgcagcaatgcggcgatcggcgccgtcttcgtggacgaaaaccagtggaactccgccaaggaggcggtcgaggacgagcggttctgggacctggtccaccgcgagcgggagctccacaagcagggaaagtgcgcgacttgcgtgtacaacatgatgggcaagcgcgagaagaagctgggagaattcggcaaggcaaaagggagccgcgccatctggtacatgtggctgggcgcccgcttcctggagtttgaagcgctggggttcatgaacgaggaccactggttctcccgggagaacagcctgtccggtgtggagggcgaggggcttcacaaactcggctacatcctgcgcgacatctctaagatccccgggggcaacatgtatgccgacgacaccgccggctgggacaccagaatcacggaggacgatctccagaacgaggcccgcatcaccgatatcatggagccggaacacgccttactggcgaagtcaatcttcaaactcacctaccagaacaaagtcgtgagagtgcaacggcccgccaagaacgggaccgtcatggacgtgatcagccgcagagaccaacgcggatccggccaggtggggacgtacggcctgaacaccttcaccaacatggaagcccagctgatccgtcagatggaaagcgaggggatcttttcccccagcgagctggagaccccgaacctggccgagcgcgtcctggactggctcgagaaatacggcgtgaaacggctcaagcgcatggccatctccggggacgactgcgtggtcaagcccatcgatgaccggttcgcgacggctctgacagccctcaacgatatgggcaaggtccgcaaggacatcccgcagtgggaacccagcaaagggtggaacgattggcagcaggtccccttctgttcccaccactttcaccagctgatcatgaaggacggccgggagatcgtcgtcccgtgccggaaccaggacgagctggtgggccgggcccgcgtcagccagggcgccggttggagcctccgggagacagcttgcttggggaagtcatacgcgcaaatgtggcagcttatgtacttccatcgccgggacctccgcctggccgccaacgcgatctgcagcgccgtgccggtggactggatccccacctcccggaccacctggtcaattcacgctcaccatcagtggatgactaccgaagatatgctgtccgtttggaaccgcgtgtggatcgaggagaacccgtggatggaggacaagacgcacattagctcgtggggcgacgtgccgtatctcggcaaacgcgaagaccagtggtgcgggtcactgatcggccttacagcccgggccacctgggcgaccaacatccaggtcgccatcaaccaagtgagacggctcatcggtaacgagaactacctagattacatgaccagtatgaagcgcttcaagaacgagagcgaccctgaaggtgccttgtggtga

SEQ ID NO: 24494 - RNA, 9879 nt, synthetic construct
  misc_feature 1..9879: note = derived and/or modified CDS sequence (opt11) from DENV-1__GU131791__SS-prME
  source 1..9879: mol_type = other RNA
agcgtaaccatgctgctcatgctgatgcccaccgccctggccttccacctcaccaccaggggcggggagccacacatgatcgtaagcaagcaggagcggggcaaaagcctgctgttcaagacctctgcaggcgtgaatatgtgtaccctcatcgccatggacctgggggaactgtgcgaggacaccatgacgtataaatgcccccgcatcaccgagaccgagccagatgacgtggactgctggtgcaatgctactgacacctgggtgacctacgggacctgcagccagacgggcgagcatcggcgcgacaagcggagcgtagcgctcgcgccccacgtgggccttgggcttgagacccgcaccgaaacctggatgagctcagagggagcttggaagcagatccagcgggtcgagacgtgggcgctccgccatcccggcttcactgtgatcgccctgttcctggcccacgcgatcggcaccagtatcacccaaaaggggatcatcttcatcttactgatgctggtgacgccctccatggcgatgcgttgcgtcggcatcggcagccgcgattttgttgaggggctctccggcgccacctgggtggacgtcgtactggaacacggttcctgcgtgaccaccatggcaaaggacaagcccacgcttgacatcgagctcctgaagaccgaggtcaccaaccccgccgtgctgagaaagctatgcatcgaggcgaagatctccaacaccacgacggactcacgctgcccgacccagggggaggccacactcgtagaggagcaggacgccaacttcgtctgccggcgaacgttcgtggaccggggctggggaaacggatgcgggttatttggtaaggggtcactcatcacctgcgccaagttcaagtgcgtgaccaaactggaaggcaagatcgtccagtacgagaacttgaagtacagcgtgatcgtgacggtccacacgggcgaccagcaccaggtagggaacgagtccaccgagcacggcaccacggccaccatcaccccccaggcacccacaacggagatccagctgacagattacggggccttaacgctagattgttccccccgcacaggcctcgacttcaacgagatggtcctgctgaccatgaaagaaaagtcctggctcgtgcacaaacagtggttcctagacctgccgctcccctggacctccggggcctcaacttcccaggagacttggaaccggcaggacctgctggtgaccttcaagaccgcccacgccaagaagcaggaggtcgtggttctcggctcccaggagggtgcgatgcacacggccctaaccggggccaccgagatacagacgtccggcacgaccacaatcttcgccggacacctgaagtgcaggttgaagatggacaagctgaccctgaagggcatgagctatgtcatgtgcacggggtccttcaagctcgagaaggaggtggccgagacccagcacggtaccgtgctggtccagatcaagtatgagggtaccgacgcgccctgtaagattccctttagcacacaggatgagaagggggtgactcagaacggccgactgatcacggctaacccgatcgtgaccgataaagagaagcccgtaaacatagaggccgagccgcctttcggggagtcctacattgtaatcggcgccggcgagaaagcgctgaagctcagctggttcaagaaggggtccagcatcggcaagatgttcgaggccacggcccgcggggcccggcgaatggccatcctgggagacaccgcgtgggacttcggatccatcggcggggtattcaccagcgttgggaaactggtgcaccaaatctttggcaccgcctatggtgtgctgttctccggcgtaagctggacgatgaagattgggatcggcgtattactcacctggctcggcctgaactcccgcagcacctctttatccatgacctgcatcgccgtggggctcgtcaccctgtacctgggcgtgatggtgcaggccgactccgggtgcgtcatcaactggaagggccgggaactcaagtgcgggtccggcattttcgtaaccaacgaggtgcatacctggacggagcagtataagttccaggccgacagcccgaagcgcctatccgcggccatcggcaaggcctgggaggagggggtctgcggcatccggagcgcaacccgattggagaatatcatgtggaagcagatcagcaacgagctcaaccacatcctgctggagaacgacatgaaattcacggtggtggtcggggacgtggccggcatcctagcgcaggggaagaagatgatccggccccagccaatggaatacaagtacagctggaagtcctggggtaaggccaagatcatcggcgcagacgtgcagaacacaaccttcattatcgacggtcccaacaccccggagtgccccgacgaccagcgcgcctggaacatctgggaggtcgaggattacggcttcgggatctttacgaccaatatctggctgaagctgcgggactcttacacccaggtctgcgaccaccgtctcatgtccgcggccattaaggatagtaaggccgtgcacgccgacatgggctactggatcgaatccgagaagaatgagacctggaaactggcccgtgcgtcgttcatcgaggtaaagacgtgtatctggccgaagagccacaccctgtggagcaatggcgtgctcgagtccgagatgatcattcccaagatctacgggggcccaatctcccagcacaactatcgcccggggtacttcacccaggccgccggtccttggcacctggggaagctagagctcgacttcgacctgtgcgaaggtactacggtggtcgtggacgaacactgtggcaaccgggggccgtccctgcgcactaccaccgtgacgggcaaaatcatccacgagtggtgctgccggagctgcacccttccgccactccgcttccgcggggaggatggctgctggtacgggatggagatccgccccgtcaaggagaaggaggagaacctagtgaagtccatggtcagcgccggcagcggcgaggtagactccttcagcttaggcctgttatgtatatccatcatgatcgaggaggtgatgaggagccgctggtccaggcgcatgctcatgaccggcacccttgccgtcttctttctgctcatcatgggacagcttacgtggaacgacctcatccgcctctgcataatggtcggcgcgaatgccagcgatcggatggggatgggcaccacctatctagccctgatggccacattcaagatgcgcccgatgttcgccgtgggccttctattccggcgcttgacgtcccgggaggtgctcctgctgaccatcgggctgagcctggtggcgtctgtggagctgcccaacagcttggaggaactgggcgacgggctggctatgggcatcatgatccttaagctgctgacggactttcagtcccaccagctctgggccaccctgctgagcctcactttcatcaagaccaccttcagtttgcactacgcctggaagaccatggcgatggtcttgagcatcgtgtcccttttccccctgtgcctgagcacgacctcccagaagactacctggctcccggtgctgctgggcagcctaggatgcaagccgctgacgatgttccttatcgccgagaacaagatctggggccgccgctcctggcccctgaatgagggcatcatggccgtcggcatcgtgagtatcttgctgagctccttactgaagaacgacgtgcccctggccggacccctcatcgccggcggcatgctgatcgcgtgctacgtaatcagtgggtccagcgctgacctgtccttggagaaggccgccgaggttagctgggaggaggaggccgagcactccggagcaagccacaatatcctggtggaggtccaggacgacgggccaatgaagatcaaggacgaggagcgcgacgacaccctgaccatactcctgaaggccactctgctcgctgtctccggtgtgtaccccctgagcatccccgctaccctgttcgtctggtacttctggcagaagaagaagcaacggtccggggtgctctgggacacgcccagtccacccgaggttgagcgcgccgtcctagatgacggcatctaccggatcatgcagcgcggtctgctggggaggtcgcaggtgggcgtgggggtcttccaggagaacgtgttccacaccatgtggcacgtaaccagaggcgcagtcctcatgtaccaaggaaagaggctggagcccagctgggcatcagtgaagaaagacctgatctcctacggcggcgggtggcgtctccaaggctcctggaacaccggggaagaggtgcaggttatcgccgtggagcccggcaagaacccaaagaacgtgcagactgcccccgggaccttcaagacccccgagggagaagtgggagccatcgcgctagacttcaagccggggactagcggctccccgatcgtgaacagagaggggaaaatcgtgggcctgtacggcaacggggtcgtgacgacctcaggcacgtacgtgagcgcgatagcccaggctaaagcgtcccaggaagggccgttgcccgagatcgaggacgaggtcttccgcaagaggaacctgacaatcatggatctgcacccggggagcgggaagacgcgccggtacctgcccgccatcgttcgcgaggccatcaagcgcaaactacggaccctgatcctcgcccccactcgcgttgtagcctccgagatggcagaggcccttaaggggatgcccatccggtatcagaccacagccgtcaaatccgagcacaccggcaaggagatcgtagacctcatgtgccatgccacttttaccatgcgcctcctgtcccccgtgcgggtgccaaattataacatgatcatcatggacgaggcccacttcaccgaccccagttctatcgcggcacgcgggtatatatcaacccgggtgggcatgggggaggccgccgccatcttcatgactgcgacgccccccggctccgttgaggccttcccccagagcaacgctgtgatacaagacgaggagcgcgacattcccgagcggtcctggaacagcgggtacgagtggatcacggacttccccggaaaaaccgtgtggtttgtcccctccataaagagcggcaacgatatcgctaactgccttcgcaagaacgggaagcgggtgattcagctctctcgcaagacgttcgacaccgagtaccagaagacgaaaaacaacgattgggactacgtggtcaccacagatatcagcgaaatgggagcgaacttcagagccgaccgcgtgatcgacccccgtcgctgcctgaaacccgtgattctgaaagacgggcccgagcgggtcatcctcgccggcccgatgcccgtgaccgtcgcctccgccgcgcagcgccgggggcggattggccgcaaccacaacaaagagggggaccagtatatctacatggggcagcctctgaacaacgacgaggatcacgcccactggacggaggccaagatgctgttggacaacatcaacactccggagggcataatcccggccctgtttgagcccgagcgtgagaagtcagccgcgatcgacggggagtatcgcctgcggggcgaggccaggaagaccttcgtcgagttgatgagacgcggggatcttcctgtgtggcttagctacaaggtcgccagcgagggcttccagtacagcgaccggcgctggtgcttcgacggcgagcgtaacaatcaggtgctcgaggagaacatggacgtggagatctggacgaaggagggagagcgcaagaagctgcggccccgctggctggacgcccggacgtactccgacccgctcgccttacgcgagttcaaagagttcgcggccgggcggagaagcgtctccggagacctgatcctcgagatcggcaagctcccccaacacctgacacagcgggcccagaacgccctcgataacctggtaatcctgcacaactcggagcagggcgggcgtgcgtaccggcatgccatggaggagctgcccgacaccatcgagaccctgatgctgttagccctaatcgccgtgctcacgggcggggtcaccctatttttcctctcgggccgcgggctgggtaagaccagcatcgggctcttgtgcgtgatggcctcgagtgtgctgctctggatggcgagcgtggagccccactggatcgccgccagcatcatcctggaattcttcttgatggtgttactcatccctgagcccgacaggcagcgaacgccccaggacaaccagctggcctatgtggtcatcgggctcctgttcatgatcctgaccgtcgccgccaatgagatgggcctcctggaaacgaccaagaaagaccttgggatcggtcacgtggccgtcgagaaccaccaccacgcggccatgctcgacgtggacctgcaccccgcctccgcctggacactgtacgctgttgccacgacaatcatcacccccatgatgcgccataccatcgagaacaccacggctaacatcagcttgaccgccatcgcgaaccaagccgccatcctgatggggctggataagggctggcccatctccaaaatggacattggcgtccccctcctggccctggggtgctacagccaggtcaacccgctcaccctaacagcggctgtgttgatgctcgtcgcccactacgccataatcggaccagggttacaggccaaggcgacccgtgaggctcagaagcggaccgccgctggcataatgaaaaaccccaccgtggacggtatcgttgctatcgatctggaccccgtcgtgtacgatgcgaagttcgagaaacagctcggccagatcatgctactgattctttgcacctcccagattctgctaatgcggacgacctgggccctatgcgagagcatcaccctggccaccggcccgctgacgaccctctgggaggggtcccccggcaagttctggaacaccaccatagcggtgagcatggccaacatattccgcggctcctacctcgcgggcgccgggctggccttcagcttgatgaaatccttagggggcgggcggcgaggtactggggcccagggcgagacactgggggagaagtggaagcggcagctcaaccagctgtccaaaagcgagttcaacacctacaaacgaagcgggatcatggaggtggacaggagcgaggctaaagaaggcctgaagcgcggggaaaccacgaagcacgccgtgtcccggggcaccgccaagctccgctggttcgtcgagcggaacctggtcaagcctgaaggcaaggtgatcgacttaggctgcggccgcgggggctggagctactactgcgcagggctgaagaaggtgaccgaggtcaagggctacaccaagggcggccccggccatgaggagccgatcccaatggccacgtacggctggaacctcgtgaagcttcactccggcaaagacgtgttcttcatcccccccgagaagtgcgacactctgctctgcgatatcggggagagctcccccaaccccactattgaggagggccggactctgcgcgtcctaaagatggtggagccctggcttagggggaaccagttctgcatcaagatcctgaacccctatatgccgagcgtagtcgaaacgctcgagcagatgcaacggaagcacggcggcatgctcgtgcggaaccccctgtcccgcaacagcacccacgagatgtattgggtgtcctgcgggaccggcaatatcgtaagcgcggtgaatatgacctcccgcatgctgctcaaccgcttcactatggcccaccgcaagcccacgtacgagcgggacgtggacctgggggccggcacccgccacgtagccgtggagcccgaggtggccaacctggacatcatcggccagcggatcgagaacatcaaacacgaacacaaatctacttggcactacgacgaggataacccctacaagacctgggcgtaccacgggtcctatgaggtaaagcccagcggctcggccagctccatggtgaacggagtcgtgaagttgttgacgaagccctgggacgtgatccctatggtcacccagatcgcgatgacggacaccacgccgttcggccagcagcgcgtgttcaaggaaaaggtggacacccggactccaaaggccaagcgcgggaccgcccagatcatggaggtcacggcgaagtggctttggggcttcctctcccggaacaagaagccacgcatttgcacacgggaggagttcacccgtaaggtgcggagcaacgccgccatcggtgccgtgttcgtcgacgagaaccagtggaattccgctaaagaggccgtggaggacgagcgcttctgggatctggtgcaccgggagcgcgagctgcacaagcaggggaagtgtgcgacttgcgtctataacatgatgggcaagcgggaaaagaagctcggagagttcggcaaggccaaggggtcaagagcaatctggtacatgtggctgggcgcgcggttcctggaattcgaggccctaggtttcatgaacgaagaccactggttctccagggagaacagcctgtccggggtagagggggagggtctgcacaagctcggttatatcctgcgggatatcagcaaaatccccgggggcaacatgtatgccgacgatacggccggctgggatacacgcatcaccgaagacgacctgcagaacgaggcccgcatcactgacatcatggagccagaacacgcgctcctggccaagtccatcttcaagctgacgtaccagaacaaagtggtccgcgtacagcgccccgccaagaatgggaccgtgatggacgtcattagccggcgcgaccagcgaggatccggccaggttgggacttacggcctgaacaccttcacgaacatggaggcccagctgatccgccagatggaatcggaggggatcttctcccccagcgagctggagaccccaaacttggccgagagagtgctggactggctggagaagtacggcgtcgagcgcctcaaacgcatggcgatctccggcgatgactgcgtggtaaagcccatagatgaccgctttgccaccgcactgaccgccctgaacgacatgggcaaggtgagaaaggatatcccccagtgggagcccagcaaggggtggaatgactggcagcaggtaccgttctgttcccaccactttcaccagctcatcatgaaggacggccgcgagatagtggtcccctgtaggaaccaggacgagctggtgggtcgcgcccgggtgtcacaaggggcgggctggtcactgcgcgagacggcctgcctcgggaagtcctacgcgcagatgtggcagctgatgtacttccatagacgcgaccttcggttagccgcgaacgccatctgcagcgccgtcccagtggactggatccccacttccaggaccacttggtccatacacgcccaccatcagtggatgacgacagaggacatgctgtccgtgtggaaccgcgtgtggatcgaggagaatccgtggatggaggacaagacccacatatcctcttggggcgacgtaccctacttaggcaaaagagaggaccaatggtgcggcagccttattggactgactgcccgcgcgacgtgggccacaaacatccaagtggccataaaccaggtacggcggctgatcgggaacgagaactatttggactacatgaccagcatgaagagattcaagaacgagagcgaccccgaaggcgcactgtggtga

SEQ ID NO: 24495 - RNA, 9879 nt, synthetic construct
  misc_feature 1..9879: note = derived and/or modified CDS sequence (opt11) from DENV-1__GU131792__SS-prME
  source 1..9879: mol_type = other RNA
tcagtaactatgctcctcatgctgatgcccacggccctcgccttccatctcaccactagaggtggagaaccgcacatgatcgtaactaagcaagaacgcggaaagtcgttgctctttaagaccagcgcaggagttaacatgtgcaccctaatcgcaatggacctaggcgaactgtgcgaagacacaatgacatacaaatgcccgcgcatcacagaagccgaacccgacgacgttgactgctggtgcaacgccaccgacacgtgggtgacctacggcacatgctcacaaacaggagaacatcgaagagacaagaggagtgtggctctggctccacacgttggattaggactcgaaactcgaacagaaacatggatgtcttccgaaggcgcctggaaacaaatccaacgcgtagaaccctgggccctgcgacatcccgggttcacagtcatagctttattcttagcacacgcaattggcacaagcattacacagaaagggatcatattcattttattgatgcttgtcaccccatcgatggccatgagatgcgttggaatcggctccagagctttcgtcgaaggattaagcggcgccacctgggtagatgtagtgctagaacatggttcctgtgttacgaccatggcgaaagacaagcccacactggatatagaactcctcaagaccgaagtcaccaaccccgctgtcctaagaaaactgtgtatcgaagccaaaatctccaacacaacgacggactcacgctgccccacgcagggggaagctacgctaatggaagaacaggacgcgactttcgtatgccgcaggacgttcgtagatagaggctgggggaatggttgcggcctgttcggcaagggcagcctaataacgtgcgcaaaattcaaatgcgtaacaaaactcgagggcaagatcgtccaatacgagaacttgaaatacagtgtcattgtgacagtgcacaccggagatcaacaccaagtcgggaacgaatcaacagagcacgggaccacagcgaccataaccccacaggcacccactagcgaaatacaactacctgactacggcgcgctaactctggactgcagccctagaacagggttagactttaacgaaatggttctgctcacgatgaaagaaaagtcatggttggtccataagcaatggttccttgatttaccgctaccatggaccagtggagcatctacaagccaagaaacctggaaccgtcaggacctgcttgttaccttcaaaacagcgcatgcgaagaagcaggaagtggtggtactaggatcccaagaaggagcaatgcacaccggactaactggtgccaccgagatacagaccagcggaacgacaacaattttcgcaggccacttaaaatgccgcctaaagatggacaaacttaccctaaaagggatgtcatacgtaatgtgcactggctccttcaaattagagaaagaagtcgcagagacacaacacggaacagtcctggtacaaataaaatatgagggtacagatgcaccttgcaaaattccctttagcacacaggatgagaaaggggtaacccaaaatggtcgccttatcactgcgaacccgatcgtaacagacaaggagaaaccggtaaacatagaggccgaaccaccatttggcgaaagctatatcgttataggggcaggcgaaaaagcgttaaaactaagctggttcaagaaagggtcaagcataggaaagatgttcgaggcgacagcacgaggcgcgcggagaatggccatactcggcgacactgcgtgggacttcggaagcgtagggggtgtgttcacgtcggtaggaaaactcgtgcatcaaatattcggcacagcatatggagtactatttagtggcgtctcgtggacaatgaaaataggcatcggtgtcttgcttacatggctcggactaaacagccgctccacaagtttaagcatgacctgcatcgcagtgggccttgtcacattgtacctgggggtcatggtgcaagcagattccggatgcgtaatcaattggaagggaagagaactaaaatgcgggagcggtatcttcgggacaaacgaggtacatacgtggaccgagcagtacaaatttcaagccgacagccccaagagattatcggcggcgatcggaaaaccatgggaagagggcgtctgcggcatacgaagcgccacccgcctcgaaaacataatgtggaaacagattagcaatgagttaaatcacatattactcgaaaatgatatgaagtttaccgtcgtggtgggtgacgtggtgggtatcctcgcccaaggaaagaagatgattcgcccacaaccgatggaacacaaatacagttggaaatcgtgggggaaggccaaaattatcggcgcagatgtgcaaaacaccacatttataatcgatggaccaaacaccccagaatgcccagatgaccagagggcctggaacatatgggaagtggaagactacggcttcggaatcttcaccacaaatatatggcttaaactacgcgactcccacacccaagtctgcgaccaccgcctaatggccgccgcaattaaagacagaaaagcagtccacgcagacatgggttactggatagaaagcgaaaagaacgaaccctggaaactcgcgcgcgcctcatttatagaagtaaaaacatgcatttggccaaaatcccacaccctgtggagcaatggcgtactagaaagtgaaatgatcatcccgaaaatatatggaggacccatcagccagcacaactaccgccccggatacttcacccagacagctgggccctggcacctaggaaaactcgaactagattttgacctttgcgagggcactacggtggttgtcgacgagcactgcggtaaccgaggacctagtctacgcacgacgaccgtaaccggaaaaataattcacgaatggtgctgccgatcatgcaccctaccacccctccggttcaaaggagaggacggatgctggtatggaatggagatccgccccgtcaaagaaaaagaggagaatctggtcaaatcgatggtaagcgcgggcagcggagaagtcgactccttttcccttggcctgttatgcataagtataatgatagaagaagtaatgcgaagcagatggagcagaaaaatgttgatgacagggacacttgcagtattcctgctactcatcatggggcagctgacctggaatgacctgatccgcctatgtatcatggttggagcgaatgcaagcgaccgcatgggcatgggcacaacgtatctcgccctcatggcgaccttcaagatgagaccgatgtttgccgtcggactcctgttccgcaggttaacaagccgcgaagtgctactgctaacgatagggctaagcctcgtcgcatcagtcgaactacccaatagcctggaagaactaggcgatggactagcaatggggattatgatactaaagctactaacagatttccagagccatcaactttgggcaactctcctatccttgacttttataaaaacgacactcagcctacactatgcatggaaaaccatggcaatggtcctgagcatcgtcagcctcttcccactgtgtttgagtactacaagtcaaaagacgacatggctgccagtattgctaggttctctagggtgtaaacctctcaccatgttcctcatcaccgaaaacaagatctgggggcgcaaatcgtggcctttgaatgaaggaattatggctgtgggtgtcgttagtatcctcctgagcagcctgctgaagaatgacgtacccctggccggcccactaatagccggaggaatgctcatagcttgttacgtcatatccggcagctccgctgacctaagcctagagaaggcagccgaagtcagctgggaggaagaggcagaacactccggggcgtcacataacattctcgtcgaagtgcaagacgacgggacaatgaaaataaaggacgaggaacgagacgacacgctcacaattcttctaaaagctacactgctcgccgtcagcggcgtgtacccgctctccataccagccacactcttcgtctggtacttctggcagaagaaaaagcagcgctccggcgtgctatgggacaccccgagccctccggaggtagaaagagccgttctagatgatggaatctacaggatcatgcagcgaggcctattagctcgaagccaagtcggggtgggcgtattccaagagaacgtatttcacacgatgtggcatgtcacgcgtggagccgtgctgatgtaccaaggaaaacgcttagaaccaagttgggctagcgttaagaaagatttaatttcttatggcggcggctggagactgcaaggatcatggaacacgggagaagaggtccaagttatagcggtcgagccaggcaagaatcctaaaaacgtccagacagcaccggggacgtttaagacaccagaaggagaagtaggagcgatagccctagacttcaagccaggtacgtctggtagccctatcgtaaacagggagggcaagatagtcggcctctacgggaacggcgtggtaaccaccagtggaacctacgtctcggcaatagcgcaagccaaagcgtcacaagaaggcccactgccagaaatcgaggacgaggtattcagaaaaagaaacctcaccataatggacctgcaccccggaagtggaaaaacaagaaggtacctcccggcaatagtaagagaggcgataaaacgcaaactgcgaacactcatcctcgccccgactcgcgtagttgccagcgaaatggcagaggccctcaaaggcatgccaataaggtaccaaacaacggcggtgaagtccgagcataccggaaaggaaatagttgacctaatgtgccacgcaacatttactatgcgacttttaagccccgttcgcgtacccaactataacatgataattatggatgaagcgcatttcacggacccctcgtccatcgcggcccgcgggtacattagtacccgtgtcggcatgggggaagccgctgctatcttcatgacagcaacacccccggggtcagtggaggctttcccacaaagcaacgcggtaatacaagacgaagagagagacatacccgaaagaagttggaacagcggttacgagtggataaccgacttccctggaaaaaccgtctggttcgtcccctccatcaaaagcggaaacgacatagcgaactgcctcaggaaaaatggcaagagagtaatccagctatccagaaagacctttgataccgagtaccaaaagacgaagaacaacgattgggactatgtggtgacaaccgacataagcgagatgggggcgaacttccgtgcagatagagtcatcgacccccgccgctgcctgaaacctgtcattcttaaggacggccccgaacgagtcatactagcgggaccgatgcccgtgacagtcgcaagtgcagcgcaacggcgaggaaggattggacgcaatcataacaaagaaggtgaccaatacatctacatgggacaaccattgaacaacgacgaggaccacgcccattggacggaggcaaagatgcttctagataacatcaatacgcccgaaggcatcatcccggctctattcgaaccggagagagaaaaatccgccgcaatagacggggaataccggctccggggcgaggccagaaagactttcgtcgagttaatgagaagaggcgatctgccagtctggctatcctataaggtagcaagcgagggattccagtactccgatcgacggtggtgttttgacggcgaacgcaacaaccaggtgcttgaggaaaatatggacgtagaaatatggaccaaagagggagaacgaaagaaacttcgtccgagatggctagacgcacgcacttacagcgaccctctcgctctacgagagttcaaggagttcgccgcaggacgaagaagtgtcagtggagacctaatattagaaataggtaaactgccacaacacttaacacaacgagcacagaatgcgctcgataatctagtcatgctacacaactcagagcaaggagggagggcctaccggcacgcaatggaggaactgccagacaccatcgagaccctaatgttgctagcgctcattgcggttctgaccggtggtgtaacattattcttcctatcgggacgcggactgggaaagacgagtattggtctactctgcgtaatggccagcagtgttctcctctggatggcaagcgtcgaaccacactggatcgcagctagcatcatactggagttcttcctcatggtcctactgatacctgaacccgatcgtcagcgcacacctcaggacaatcagctcgcttacgtcgtgataggactgctctttatgatcttgacagttgcggccaacgaaatggggctgctcgaaactactaaaaaggacctcgggatagggcatgtcgccgttgaaaaccaccatcacgccaccatgctcgatgtcgacctccaccccgcctcagcgtggacattatatgcagtcgcaacgacaatcataacccctatgatgcgccacacaatagaaaacacaacggcgaacatatccctgacggcaatcgccaaccaagcggccatcctcatggggctggataaggggtggcccatatcgaaaatggacatcggtgtcccattactcgcgctcggatgctattcacaagtaaaccccctaaccctaacagcagctgtactcatgttggttgcccactacgcaataatcggaccgggactacaggcgaaagcaacgcgtgaggcacagaagcggactgcggccgggataatgaaaaaccccacggtagacggaatagtcgcgatcgatttggacccggtagtctacgacgcgaaatttgaaaaacaacttggacaaattatgctcctaatcttgtgtacctcgcaaattctcctcatgcggactacatgggcactatgcgagtctatcacactagcaacaggccccctgaccacactatgggagggctcaccggggaaattttggaacacgacgatcgccgtatcaatggccaacatctttcgaggatcatatctcgctggagcgggactcgcattctcgctgatgaaaagtctgggagggggaaggcgcggcacaggggcgcaaggggaaacattgggagaaaagtggaagcggcaactaaaccagctctcgaagtctgagttcaatatatacaagcgaagcggcataatggaggtcgaccgctccgaggctaaggaaggactgaaacgcggcgagacaacacgccatgcggtctcacgcggaacagccaaactgcgatggttcgtcgaacgaaatctagtgaaacccgaggggaaagttatcgacctcggctgcggacgcggcggctggtcctattattgtgctggactcaaaaaggttacagaggtgaaagggtacaccaagggagggccaggccatgaagaacctattccgatggcaacctacgggtggaacctcgtcaaactgcactcagggaaagacgtattcttcacaccaccagaaaaatgcgacacgttactatgtgacatcggagaaagctctcctaatccaacgatagaagaagggcgcacattacgggttctgaaaatggtcgaaccctggctaagaggcaaccaattctgcatcaaaattctaaatccttacatgccatccgtcgtcgaaacgctggagcaaatgcaaaggaaacacggcgggatgttagtgcgcaatccactgagtcgtaacagcacgcacgagatgtactgggtcagttgcggaacaggcaacattgtgagcgccgtaaacatgacctcaagaatgctcctaaatcgatttacaatggcccacaggaagccaacctacgaacgggacgtcgacctcggagcaggcactaggcatgtcgcagtcgaacccgaagtcgcgaaccttgatataatcggacaacggatcgaaaatatcaaacacgaacacaagagcacatggcactatgacgaagacaatccctataaaacttgggcctaccatggatcgtacgaggttaagccaagtgggtcagcatcctcaatggtaaacggggtagtaaaacttcttaccaagccctgggatgtcatacctatggtcacccaaatagccatgacagacaccactccgttcgggcagcaacgcgttttcaaagaaaaggtcgacaccaggacaccaaaagcaaaaaggggcaccgctcaaattatggaagtcacagctcgctggctatggggtttcctgtcccggaataagaagcccagaatttgcacgcgagaagagttcacgcgaaaagtccgtagcaatgccgccatcggcgcggtgtttgtcgacgaaaatcaatggaactcagctaaagaagcggtcgaagacgagagattctgggatttagtccaaaaagaacgcgaattgcacaagcaaggcaaatgcgcaacctgcgtatacaacatgatggggaaacgagagaaaaagctaggcgagttcggaaaagcaaaaggaagcagagccatctggtacatgtggctaggcgcaaggttcctggagttcgaggccctcggctttatgaatgaagaccattggtttagtagagaaaattctctgtctggagtggaaggagagggactccacaaactaggctacatcttgagggacatctccaagatcccaggaggaaacatgtatgcagatgatactgccggctgggacaccaggataacagaggatgacctacaaaacgaggcgaaaataacagacatcatggaacccgaacacgcgctccttgcaaccagcatattcaaattaacctaccaaaacaaagtcgtacgagtccagaggccagccaaaaacggcacggtaatggacgtaataagtcgcagagaccagagaggctcgggacaagtggggacatacggattgaatacctttaccaacatggaggcacaactaatacgccaaatggaaagtgaaggcatcttcctgccgagcgaactggagacgccaaatctggcagaaagggtactagactggttagaaaaatatggagttgaacgattgaagcgcatggcaatcagcggcgacgactgcgtggtgaagccaatcgacgaccgtttcgcaacagccctgacagccctaaacgacatgggcaaggtgcgaaaggacataccacagtgggaacccagcaaaggctggaatgactggcaacaagtacccttctgctcccatcacttccaccagctgatcatgaaggacggccgggaaatagtggtgccatgcagaaaccaagacgagttggtcggaagggcacgagtctctcagggagccggctggagcctccgggaaacggcctgcctaggcaagtcctatgcacaaatgtggcaactcatgtactttcaccggcgtgaccttcgattagcggcaaatgcaatttgcagtgctgttcccgtagactgggtccccacgagccgcacgacgtggagcattcacgcgcaccatcagtggatgacgactgaagacatgctaagcgtatggaaccgagtgtggatcgaggagaacccgtggatggaagacaaaacacatgtatcgtcatggggagatgtaccgtaccttggaaaacgagaggatcaatggtgtgggagtttaattggattgacagcaagggcgacatgggccagtaacatccaggtagcgataaaccaagtcaggaggctaatcgggaatgagaactacctcgactatatgacctccatgaaaagatttaaaaacgaaggcgatccggaaggggcactgtggtag

SEQ ID NO: 24496 - RNA, 9879 nt, synthetic construct
  misc_feature 1..9879: note = derived and/or modified CDS sequence (opt11) from DENV-1__HM488256__SS-prME
  source 1..9879: mol_type = other RNA
agcgtcaccatgctactcatgctgatgcccaccgccctcgccttccacctcactacccggggcggggagccccacatgatcgtgagcaagcaggaacggggcaagagcctgcttttcaagaccagcgccggcgttaacatgtgcaccctcatcgccatggacctgggggagctctgtgaggacacgatgacctacaagtgcccccggattaccgaaaccgagcccgacgacgtcgactgctggtgtaatgccacagacacttgggtaacatacggaacctgcagccagacgggcgagcaccggcgcgacaagcggagcgtggccctcgcgccccacgttggcctggggctggagacccgaaccgagacctggatgtcttccgagggcgcctggaagcagatccaaagggtggagacgtgggccctcaggcacccaggcttcaccgtgattgcactgttccttgcccacgccatcggaaccagcatcacccagaaggggataatcttcattctcctgatgttagtgacaccatccatggctatgcggtgcgtaggcattggctcgcgtgacttcgttgaggggctctccggcgccacctgggtggacgtcgtgctggagcacgggagctgcgtgaccaccatggccaaggacaagcccacgctggacatcgagctcctgaaaaccgaggttaccaaccccgccgtgctgcgtaagctctgcatagaggcgaagatctccaacaccactaccgacagccgctgcccgacccagggggaggccaccttagtcgaagagcaggacgccaacttcgtgtgccggcgcacgttcgttgaccggggatgggggaatggctgtggtctgttcggcaaagggtccctaatcacgtgcgccaagttcaagtgtgtgaccaagctggagggcaagatcgtccagtacgagaacctgaagtatagcgtgatcgtgaccgtccacacgggggaccagcaccaggtggggaacgagtctaccgagcacggcaccaccgccaccatcacgccccaggcacccaccaccgagatccagctccccgactatggggccctgaccctggactgcagtccgcgcacgggactcgatttcaacgagatggtcctgctgaccatgaaggaaaagtcttggctcgtgcacaaacagtggtttctggacttgcccctgccctggaccagcggggccagcacctcccaggagacgtggaaccggcaggacctgctcgtcaccttcaagaccgcccacgccaaaaagcaagaggtagtggtgctgggcagccaggagggcgcgatgcacacggccctgacaggggccaccgagatccagacctccggcactacgaccatcttcgccgggcacctgaagtgtcgcctcaaaatggacaagctgactctgaaaggtatgagctacgtcatgtgcaccgggtccttcaagctcgaaaaggagctggctgagacgcaacacggcaccgttctcgtgcagatcaaatacgagggcacagacgcgccctgcaagataccgttctccactcaggatgagaagggggtcacgcagaacggccggctcataaccgcgaaccccatcgtcaccgacaaggagaagcccgtgaatatcgaagctgagccccctttcggggagtcctacattgtcattggcgccggcgagaaggcgctcaagctgagctggttcaaaaaggggtcctcaataggcaagatgttcgaggccactgcacgcggggcccgacgcatggcaatcctgggcgcgcccgcctgggacttcgggtccatcggcggtgtgttcacgagcgtgggcaagctcgtccatcagatcttcggtacagcctatggggtgctattctccggcgttagctggacaatgaagatcgggatcggcgtcctgttgacatggctggggctgaattcccgcagcacgtcgttaagcatgacctgcatcgccgtagggcttgttaccttgtacttgggcgtcatggtgcaagccgattccgggtgcgtgattaactggaagggtcgggagctcaagtgcgggtccggcattttcgtcactaacgaggtacatacgtggaccgagcagtacaaattccaagcggactcccccaagcgcctgtccgccgctatcggcaaggcctgggaggagggtgtttgcggcatccgaagcgccacccgcttggagaacatcatgtggaaacagatctccaacgaactgaaccacatcctgctagagaatgacatgaagttcaccgtggtggtgggggatgtcgcgggtatcctggcacaggggaagaagatgatccggccgcaaccgatggagcacaagtacagctggaagtcctggggcaaggccaagatcataggcgccgacgtgcagaacaccacgttcatcattgatgggcccaacacccccgaatgcccagacgaccagcgagcgtggaatatctgggaggttgaagactacggcttcgggatctttaccaccaacatctggctgaagctccgggacagctacacgcaggtttgcgaccaccgcctcatgtccgcagccattaaagacagcaaggccgtgcacgccgacatgggctactggatcgagtccgagaagaatgagacatggaagctggcgcgggcctcgttcatcgaagtgaagacctgcatctgggccaagtcacacaccctctggagcaatggggtgctggagtccgagatgattataccaaagatctacgggggccccatcagccaacacaactacagacccggctacttcacgcagaccgcaggcccgtggcacttaggtaagctagagctggacttcgacctgtgcgaggggaccaccgttgtggtcgacgagcactgcggcaaccgcgggccgtcgctccgcacgaccacggtgaccggaaagatcatccacgagtggtgctgtcgttcgtgcacgcttccgcccctgcgattccgaggggaagacgggtgctggtacggaatggagatatccccggtgaaggagaaggaagagaacctggtcaagagcatggtgagcgccggctctggcgaggtggacagcttttccctggggctgctctgcatcagcatcatgatcgaggaagtcatgcgctcccggtggagccgcaagatgctgatgaccggcacgctggcggttttctttctgctgatagtggggcagctgccctggaacgacctgatccggttgtgcattatggtcggcgccaccgcctcagcccgcatggggatgggcacgaccagcctggccttaatggcgaccttcaagatgcgccccatgttcgccgtgggcctgctgtttcgccgcctgacctccagagaggtgctgctgctcacgatcgggctgagcctggtcgccagcgtggaactccccaacagcctggaggagctgggcgacgggctcgcaatggggatcatgatccttaagctgctcaccgatttccagtcccaccagctgtgggcgaccctgctcagcctgacctttataaagacaaccttctccctacactacgcgtggaagaccatggccatggggctcagcgtcgtgtccctgttcccgctgtgcctcagcaccacgtcccagaagaccacctggctgccggtgctgctcgggagcctgggctgcaagccgttgaccatgtttctcatcgccgagaacaagatatgggggcgtaggagctggcccttgaacgagggcatcatggctgtagggatcgtgtccattctgctcagctccctcttaaagaacgatgttccgctcgcgggacccctgatagccggcgggatgctgatagcctgctacgtcatcagcggctccagcgccgacctctccctggagaaagccgcggaggtgagctgggaggaggaggccgaacactccggtgcaagccacaacatcctggtggaggtgcaagacgacggcacgatgaagatcaaggacgaggagcgggacgacaccctcaccatcctgctcaaagccacgctcctggccgtttccggggtgtaccccctgtcaatccccgccaccctcttcgtgtggtacttctggcagaagaaaaagcagcggtccggcgtgctgtgggacacaccgtccccgcccgaggtggaacgtgccgtcctggacgacgggatctacaggatcatgcagcgcgggctgctcgggcggtcccaagtgggggtgggcgtcttccaggagaacgtgttccacaccatgtggcacgtgacccgcggggccgtcctaatgtatcagggaaagcggttagagcccagctgggcctccgtgaagaaggaccttattagctacggcggcggctggaggctgcaggggagctggaacaccggtgaggaggtgcaggtcatcgctgttgaaccgggcaagaacccaaagaatgtccagacggcgcccggcaccttcaagacccccgagggagaggtcggggccatcgccctggactttaagccggggaccagcgggagccccatcgtgaatcgggagggcaagatcgtgggcctctacgggaacggagtcgtgacgacctctgggacctacgtgtcagccatagcgcaggccaaggcctcccaggagggccccctgccggagattgaggacgaggtctttcgcaagcggaacctgaccatcatggatctccaccctgggagcggcaagacacgtcggtacctccccgccatcgtgcgcgaggccatcaagcggaagcttcgcacccttatcttggcgcccacccgcgtggtcgccagcgagatggccgaggccctgaagggcatgccgatccggtaccagacaacggccgtcaagtcggagcacactgggaaggagatcgtggacctcatgtgccacgcgaccttcaccatgcgcctgctgtcccccgtccgggtgccaaactacaatatgatcattatggacgaggcgcactttaccgatcccagctcgatagctgccagaggctacatcagcacccgggtggggatgggcgaggccgcggcgatcttcatgacagccaccccccccgggtccgttgaggcctttccacagagcaacgcggtgatccaggacgaagagcgcgacatccccgagagatcctggaattctggctacgagtggatcacggacttcccgggtaagactgtctggttcgtcccctccatcaagtccgggaacgacatcgccaactgtctccgcaaaaacggcaagcgcgtgatccagctgtcccgcaagaccttcgacaccgagtaccagaagactaagaataatgactgggactacgtggtcaccaccgatatcagcgagatgggggccaactttcgggcagaccgcgtgatcgaccctcggcgctgcctgaagcccgtgatccttaaggacggtccggagcgggtcatccttgccgggcccatgcccgtgaccgtagcgtccgccgcccagaggcgaggccgcatcggccggaatcacaacaaggagggggaccaatacatctacatgggccagccgctgaacaacgacgaggaccacgcacattggactgaggcgaagatgctactggacaacatcaacacccccgaggggataatacccgcgctgttcgagcccgagcgcgagaagtccgccgccatcgacggcgaataccggctccgtggagaggcccgcaagacctttgtggagttgatgcgccgcggcgacctgcccgtgtggttgagctacaaagtcgcttccgaaggattccagtactcagaccggcgctggtgcttcgacggtgagcggaacaaccaggtgctggaggagaatatggatgtggaaatctggaccaaggagggcgagcgcaagaaactacggcctaggtggcttgacgcccggacgtactccgaccccctggccctgcgcgagttcaaagaattcgccgccggccggcgcagcgtatccggcgacctgatcctggagatcggcaaactgccccagcacttaacccagcgggcacaaaacgccctagacaatctggtaatgttacataactcagagcaaggaggccgagcataccggcacgccatggaggagctgcccgacaccatcgaaaccctgatgcttctggccctgattgctgtgctcaccggcggtgtcacccttttcttcctgtccgggaggggtctcgggaagaccagcatcggcctgctgtgcgttatggcctccagcgttttactgtggatggcctccgtcgagcctcactggatcgccgcgagcattatcctggaattcttcctcatggtgctgctgatcccggagcccgaccggcaacgcaccccgcaagacaaccagttggcgtacgtggtcatcgggttactgttcatgatcttaaccgtggccgccaacgaaatgggtctgctcgaaacgaccaaaaaagacctgggcatcggtcacgtcgccgtcgagaaccaccaccacgccgcgatgctcgacgtggacctccaccccgccagcgcctggaccctctacgccgtggccacgacgatcatcacccccatgatgcggcacaccatcgagaacaccacggcgaatatcagcctgaccgccatcgccaaccaggcggcgatcttgatgggtctcgacaagggctggcccatttccaagatggatatcggggtcccgcttctggccctcggatgctacagccaggtgaaccccctgaccctgaccgccgccgtgctcatgctggtcgcccactacgcaatcattgggcccggcttgcaggccaaagcgacgcgcgaggcccaaaagagaaccgcagcgggcatcatgaagaacccgaccgtggacggcatcgtagcaatagacctcgatccggtcgtgtatgacgccaaattcgagaagcagctgggccagatcatgctgctcatcctgtgcaccagtcagatcttgctcatgcggacgacgtgggccctgtgcgagtcaataaccctggccaccgggcccctcacaaccctgtgggagggctctcctgggaagttctggaacaccacgatcgcagtgagcatggccaacatcttccgcggctcatacctggcgggtgccgggctcgcgttctccctgatgaagtcattaggtggcggccgtcgcgggacaggggcccagggcgaaaccctcggtgagaagtggaagcggcagctgaatcagctgtccaagagcgagttcaacacctacaagcgcagcgggatcatggaggttgatcgaagcgaggctaaagagggcctcaagcgcggcgagaccaccaagcacgccgtgtccagaggcaccgccaagctgcgctggttcgtggagcggaacctggtcaagcccgagggtaaggttatagacctgggctgcggacgcggcgggtggtcttactactgcgcgggcctcaagaaggtcaccgaggtcaagggttatacgaagggcgggccggggcacgaggagcccatccccatggccacgtacggctggaatctggtgaagttacactctgggaaagacgtgttcttcataccacccgagaagtgcgacacccttttatgcgacatcggcgagagctcccccaaccccaccatcgaggaggggcggaccctgcgcgttctcaagatggtggagccatggctgcggggtaaccagttctgtattaagattctgaacccatacatgccatcagtggtcgaaactctcgagcagatgcagcgcaagcatggcggcatgctggtgcggaaccctctatctcgcaactcaacccatgagatgtattgggtctcttgcggcaccgggaacattgtcagcgccgtgaacatgacctcacggatgctcctgaaccgcttcaccatggcccaccgcaagcccacttacgagcgggacgtggacctgggcgccggcacccgccacgtcgcggtagagccggaggtggccaacctcgacatcattgggcagcggatcgagaacatcaagcatgagcacaagagcacatggcattatgatgaagacaacccttacaagacctgggcctaccacggttcctacgaggttaagccgtccgggtccgcatccagcatggtgaacggagtggtgaagctgcttaccaagccctgggacgtgatcccgatggtcacgcagatcgccatgactgacaccacgccctttgggcagcagagagtctttaaggagaaggttgacacacggacccccaaggcgaagcgcggcaccgcccagataatggaggtgacagccaagtggctctgggggttcctgtcccggaacaagaagccgcgtatctgcacccgggaggaattcacacgcaaggtgcggagcaacgccgccatcggggccgtgtttgtggatgagaaccagtggaactcagccaaggaggcggtggaggacgaaaggttctgggacctggtgcaccgggagcgcgagctccacaagcagggcaagtgtgcgacctgcgtctacaacatgatggggaagcgggagaaaaagctgggggagtttgggaaagcgaagggctcccgcgcgatctggtacatgtggctgggcgcccggttcctcgagtttgaggccctgggcttcatgaacgaagaccactggttctcacgcgagaacagcctgtccggcgttgagggggagggactccacaagctgggatacatcctgcgggacatcagcaagatccccggcggcaatatgtacgccgacgacacggcggggtgggacacccgcattaccgaggatgacctccagaatgaagcgcggatcactgacatcatggagcccgagcatgccttgctggccaagtcaatcttcaagttgacgtatcagaataaggtggttcgcgtgcagcgtcccgccaagaacgggaccgtgatggacgtcatcagccggcgcgaccaacgggggtccggccaggtaggtacctacgggctgaacaccttcacgaacatggaggcccagctgatccgccagatggagagcgagggcattttttccccgtcggagctcgagaccccaaacctggccgagcgggtgctggactggctcgagaagtatggggtcgagcgcctgaagcggatggccatctccggcgacgactgtgtggtgaagcccatcgacgataggttcgccaccgctctaaccgctctcaacgatatgggaaaggttcgtaaggacatcccacagtgggagccgagcaaaggctggaacgactggcagcaggtacccttctgcagccaccatttccaccagctgattatgaaggacggccgcgagatcgtggtaccctgccggaaccaggacgagttagtaggacgagcccgggtgtcccagggcgccgggtggagccttcgagagacggcctgcctgggaaagagctacgcgcagatgtggcagttgatgtacttccacaggcgcgacctgcggctggctgccaacgctatctgcagtgccgtccccgtggactggatcccgacctcccgcactacctggagcatccacgcccaccaccagtggatgaccaccgaggacatgctgtccgtgtggaaccgggtctggatcgaggaaaacccctggatggaggacaagacgcacatcagctcctggggcgacgtgccctatctcggcaagcgggaggaccagtggtgcggcagcttgatcgggctcaccgcccgggccacttgggcgaccaacatacaggtggccatcaatcaggtccggagacttatcggcaacgagaactacctcgattacatgacatccatgaagcgcttcaaaaacgagagcgaccccgagggagcgctgtggtga

SEQ ID NO: 24497 - RNA, 9879 nt, synthetic construct
  misc_feature 1..9879: note = derived and/or modified CDS sequence (opt11) from DENV-1__GU131793__SS-prME
  source 1..9879: mol_type = other RNA
tctgtgaccatgctgctcatgctgatgcctactgccctggccttccacctcactacccgcggcggtgaaccccacatgatcgtcagtaaacaggagaggggcaagagcctgctattcaaaacatccgccggggttaacatgtgcaccctcatcgccatggacctgggggagctgtgtgaggacaccatgacatataagtgccctcgaatcaccgagacagaacccgacgacgtggattgctggtgcaacgccaccgacacctgggtgacctatgggacctgttcgcagaccggtgagcaccggcgcgacaagcggtccgtcgctctcgcgccgcacgtgggcctggggctcgaaactcggaccgagacgtggatgagctcggagggcgcctggaaacaaatccagcgggttgagacttgggccctccgacaccccgggtttaccgtgattgcccttttcctggcccacgcgatcggcactagcaccacgcagaaggggatcatcttcattcttttgatgctggtgaccccctcaatggcgatgcggtgcgtcggcattggcagccgagacttcgtggaggggctctccggcgcgacctgggttgacgtagtactggagcacgggagttgcgtgaccacgatggccaaggacaagcccaccctcgacatcgagttacttaagaccgaggtcaccaatcccgccgtacttcggaaactctgcatagaggcaaagatcagtaacacgacaaccgacagccgctgcccaacccaaggcgaggccacgctggtagaggaacaggacgccaacttcgtatgtcggcgcacgtttgtggaccgggggtgggggaacggttgcggcctgttcggcaagggatccctcatcacgtgcgctaagttcaagtgcgtaaccaagctggagggcaagatcgtccagtacgagaacctgaagtatagcgtgatcgtgacggtccacaccggcgaccagcaccaggtcgggaacgagtccaccgaacacggcacgaccgctacgatcacgccccaggcgcccacgactgagatccagctcacagactatggagccctgacgctggattgtagccccaggacgggcctcgacttcaacgagatggttctgctgaccatgaaggagaagagttggctcgtgcacaagcagtggttcctggacttacctctcccctggacaagtggcgcgagcacttcccaagaaacttggaaccgacaggacctgctggtaacattcaagacggcacatgccaagaagcaggaggtcgtcgtcctaggctcgcaggagggcgcgatgcacaccgccctgaccggtgcaaccgagatccagaccagcggcaccaccaccatcttcgccggtcacctgaagtgccgcctcaagatggacaagttaacgctgcgcggcatgagctacgtaatgtgcaccgggagtttcaagcttgagaaggaggtggccgagacccagcatggcactgtgttggtccagatcaagtacgaaggcacggacgcgccctgcaaaatcccattctcgactcaggacgagaagggagtgacccagaatgggaggctaatcaccgcgaacccgatcgtaacggacaaggagaagcccgttaacatagaggccgagccgccctttggagagtcctacatcgtaatcggcgccggagaaaaggctctgaagctaagttggttcaagaaagggtcgtctatcggcaagatgtttgaggccaccgctcgcggggcccgccgcatggccattctgggtgatacggcgtgggacttcggaagcatcggcggcgtgttcacgtcagttgggaagctcgtacaccaaatctttggaacggcatacggggtgttgttctccggcgtgtcatggaccatgaagatcggaatcggcgtgttactgacatggttaggcctgaactcccggagcacctccctttctatgacgtgcatcgcggtcgggctcgtcaccctgtaccttggcgtgatggtacaagccgactcgggctgcgtcataaactggaagggccgggaactcaagtgtgggtcaggcatcttcgttaccaatgaggtacacacctggaccgaacagtacaaattccaagcggacagcccgaagcggctgtctgcggccatcggcaaagcgtgggaggaaggggtgtgcggcatccggtctgcgacccggctcgagaacattatgtggaagcaaatctccaacgagctcaaccacatcctgctggagaacgacatgaagttcaccgtggtggtcggggacgtggctgggatactcgcacagggcaagaagatgatccgcccccaacccatggagtacaagtatagctggaaatcctggggcaaggccaagatcatcggcgccgatgttcaaaacacgacatttattatagacggacccaatacgccggaatgcccggacgatcagcgggcctggaatatctgggaggtcgaagactacggcttcgggatattcaccactaacatctggctgaagctgcgtgacagttacacccaggtgtgcgatcaccgcctcatgtccgcggctattaaggacagtaaggccgtgcatgccgacatgggctactggatcgaatccgagaaaaacgagacgtggaagctggccagggcgagcttcatagaggtcaagacctgcatctggcccaagtcccacaccctctggagtaacggcgtgctcgagtccgagatgataatccccaagatctatgggggccctatcagccagcacaactaccggcccgggtacttcacgcagacggctggcccctggcacctggggaaactggaactcgactttgacctgtgtgagggcaccaccgtggtcgtggatgagcactgcggcaaccgtggtccgtcactgcggacaacgaccgtgacaggcaagataattcacgagtggtgctgccgcagctgcacgttaccccccctccgatttcgcggggaggacggctgctggtacggcatggaaataaggcccgtcaaggagaaagaggaaaacttggtgaagtccatggtgagcgcgggttcaggcgaggtcgactccttcagcctcgggctattgtgtatctccattatgatcgaggaggtgatgcgctcccgatggagccgcaagatgctcatgacggggaccctggcagtgttcttcttactcataatggggcagctgacctggaatgacctgatcagactctgcatcatggtgggcgccaacgcaagcgaccggatgggcatgggcaccacgtacctagcccttatggccacgttcaagatgcgaccgatgttcgccgtaggactcctgttccgacgcctgacgtcccgggaggtgctcctgttaactatcgggctaagccttgtggcgtccgtggagctgcccaacagcttagaggagcttggagacgggttagcaatgggcatcatgatcctcaaattactgaccgatttccagagtcaccaactctgggccactctgctctccctgaccttcatcaagacgaccttcagcctgcactgcgcgtggaagactatggccatggtcctcagcatcgtgtccctcttcccactgtgcctgagcaccacgtcccaaaagacgacctggctccccgtgctgctaggctcactcgggtgtaagccgctgaccatgtttctgatcgcggagaataagatctggggtcgccggagctggccactaaacgaggggattatggctgtcggcattgtgagcatcctgctgtcctctctccttaagaacgatgtgcccctggccgggcccctcatcgcaggcggcatgctgatcgcctgttatgtcatcagcgggtccagcgcagacctgtcgctcgagaaagccgctgaggtgtcgtgggaggaagaggctgagcattccggcgccagccacaacatcctggtagaagtccaggatgacggcactatgaaaatcaaagacgaggaacgagatgacaccctgacgatcctcctcaaagcgaccctgctcgctgtgtctggcgtttaccctttgtctatccccgccaccctgttcgtctggtatttttggcaaaaaaaaaagcagcggagtggggtgctatgggatacccccagcccgcccgaggttgagagggccgtactggatgacggcatctaccggatcatgcagcgcggcctgctcggccggtcccaggtgggcgtgggggtcttccaggagaacgtgtttcatactatgtggcacgtgacccgcggcgcagttctcatgtaccaggggaagcggttggagccaagctgggcctccgttaagaaggacctgatttcctatggaggcgggtggcgcctccagggctcctggaacaccggggaggaggtacaggtcatcgctgtagagcccggcaagaacccgaagaacgtgcagactgccccggggacgttcaagacccccgagggcgaggtcggtgccatagccctggacttcaagcccggaacctccggatcccccatcgtgaaccgggaggggaagatcgtggggctttacggaaacggggtcgtcaccacatccggcacatacgtgagcgccatagcacaggccaaggcgagtcaggagggtccgctccccgaaattgaagatgaggtctttcgcaagaggaatctaacaatcatggacctgcatcccggatccggtaagacccgccggtatctccctgcgatagtccgcgaagctatcaagcgcaaactgcggacgctgatcctcgcccccaccagggtggtcgcctccgaaatggcggaggctctgaagggcatgcctatccggtaccagaccaccgccgtcaagagcgagcacacaggtaaggagatagttgacctgatgtgccacgctaccttcaccatgcggcttttaagccccgtgcgtgtcccgaactacaatatgattatcatggatgaggcccacttcaccgacccaagctccattgcggcgcgcgggtacatcagcacgcgggtgggcatgggggaggccgccgccatcttcatgaccgccaccccgcccggctccgtcgaggcgttcccgcagtcaaacgctgtgatccaggacgaggagagggacatacccgaacggtcgtggaacagcgggtacgagtggattaccgacttcccgggcaagaccgtgtggttcgtcccctccataaagagcggcaacgacatcgccaactgtcttcgcaagaacgggaagcgcgtgatccaactctcccgcaaaacctttgacaccgagtaccagaagacaaagaacaatgactgggactacgtcgttacgaccgacatttcagagatgggtgccaacttccgggccgaccgcgtcatcgacccgcggaggtgcctgaagcccgtgatcctgaaggatggtcccgagcgggtcatactcgccggaccgatgcccgtgaccgtcgcctccgccgctcaacgtcgggggcggataggccggaatcataacaaggagggcgaccaatacatttacatggggcaaccactgaacaacgacgaggaccatgcacactggacagaggccaagatgctcctggacaacatcaacacgcccgaggggatcattccggccctgttcgagccggagcgcgagaagtccgcagccatagatggggagtaccgcttacggggcgaggcacgcaagacctttgtggaactcatgcggcgtggcgatctgcccgtatggctgtcatacaaggtcgccagcgagggctttcagtactcagaccggaggtggtgtttcgacggcgagcggaacaatcaggtgctagaagaaaatatggatgtcgaaatctggactaaggagggggagcgcaagaagctgcggccccggtggttagacgcaagaacctattccgacccgctcgccctgcgagaattcaaggagtttgccgccggccggcgatctgtatccggggacctgatcctcgagatcggcaagctgccgcaacatctgacgcagcgggcccagaatgcactcgacaacctagttatgctgcacaacagcgagcagggggggcgcgcctatcggcacgcgatggaggaacttcctgacacaatcgaaaccttgatgttactcgccctaatcgccgtgctgaccggcggggtcaccctgttctttctgtccggccgcggcttaggcaaaacgagcatcggcctactgtgtgttatggcgtcgtcagtgctgttatggatggcctccgttgagccccattggatcgcggctagcatcatcctggagttcttcctaatggttctgctgatcccggagccggacaagcagcggacgccccaggacaaccagctggcgtacgtggtcatagggctactattcatgatcttaaccgtagccgccaacgaaatgggccttctggagaccacgaaaaaggacttagggatcggccacgtggcggttgagaatcaccaccacgccgctatgctcgacgtggacctgcaccccgcctctgcctggaccctgtacgctgtggccactacaattatcacacctatgatgcgccacacgattgagaacacgaccgccaatattagcctgacggcaatcgccaaccaggcggcgatcctgatggggctagacaaaggctggccaatatccaagatggacatcggcgttccgcttctggccctggggtgctatagccaggtgaacccgctaactctgaccgccgcggtgctcatgttagtggcccattacgccattatcggcccgggtttacaggccaaagccacccgtgaggcccagaagcggacggccgccggcatcatgaagaaccccaccgtggatggaatcgtggcaatagacttagatcctgtcgtctacgacgccaagttcgagaagcagctcggtcagattatgctgctgatcctctgcacgtcacaaattcttctgatgcggaccacgtgggccctctgtgagtcaatcactctggccacaggacccttgaccacgttgtgggaggggtccccgggcaagttctggaacacaactatcgccgtgagcatggcaaacatctttcgggggtcctacttggcaggcgcgggcctggctttctcgttgatgaagagtctggggggcggccggcgcggtacaggggcccagggagaaactcttggcgagaagtggaagcgccaactcaaccagctatccaagagcgagtttaatacctataagcggagtggcataatggaggttgataggagcgaggccaaggagggactgaagcgcggggaaaccacaaagcacgcggttagtcgcggcacggccaagctccggtggttcgtcgagcgcaacctggtcaagcctgaggggaaagtgatcgacctgggctgcgggcgcggcgggtggagctactattgcgccggcctgaaaaaggtgacagaagtcaaggggtacactaagggcggccccggccacgaagagccgatcccaatggccacctatgggtggaacctggtgaaactacacagcggcaaggacgttttcttcatcccgcccgagaaatgtgatacgctactgtgtgacatcggcgagagcagtcccaaccccaccatagaggagggcagaaccctgcgggtgttaaagatggtggagccctggttacgcgggaaccaattctgcatcaagatcctgaatccttatatgcccagcgtagtcgagactctggagcagatgcagcggaagcacggcggaatgctcgttcgcaacccgctgtcgcgtaacagcacccatgagatgtattgggtatcctgcgggacgggcaacatcgtcagcgccgtgaatatgaccagtcgcatgctgctcaatcgcttcacgatggcgcatcggaagccgacctatgagcgtgacgtggatctgggtgccggcacgcggcacgtcgccgtggagcccgaggtagccaacttagacatcataggccaacgcatagagaacatcaagcacgagcataagagcacctggcattacgacgaggacaacccctacaagacctgggcctatcacggctcctacgaggtgaaaccgagcggaagcgcgtcatctatggtgaacggggtagtcaagctcctaaccaagccctgggacgttatccccatggtcacgcaaatcgccatgaccgacaccacaccgtttggccagcagcgggtgttcaaggagaaggttgatactaggaccccaaaagccaaacggggcactgcgcagattatggaggtcacagcgaagtggctctggggttttctctcacgcaacaagaagccacgcatttgcacacgcgaggaatttacccgcaaggtgcgttccaacgctgcaattggggcggtgttcgtcgacgagaaccagtggaactccgccaaggaggcggtagaggacgagcggttctgggacctcgtacaccgcgagagagagctgcataagcaggggaagtgcgcaacctgcgtctacaacatgatgggcaagcgcgagaaaaagctaggggagttcggcaaagccaagggcagcagagccatatggtacatgtggctgggcgcccgcttcctggagtttgaagccctcggctttatgaacgaggaccactggttctcccgggagaacagcctgtccggcgtggaaggcgaggggctgcataagctcggctacattttaagagacatcagcaagatacctgggggcaacatgtacgcggacgacactgcaggatgggacacgcgaatcactgaggacgacctgcagaacgaggcacgtatcactgacatcatggagcccgaacatgccctccttgcaaagtcgatctttaagctaacctatcagaacaaggttgtccgcgtgcagcggcccgctaagaacgggaccgtgatggacgtgatcagcagacgggaccagcgcggctcgggccaagtgggcacctacggcctcaacaccttcacgaacatggaggcccaattaatccgccagatggagagcgaggggatcttctccccttctgagcttgagacgcccaatctcgccgagcgcgtgctggactggctggagaagtacggggtcgagcgacttaagcgcatggctatatccggggatgactgcgtggtgaagccgatcgacgaccggttcgcaaccgccctgaccgctctgaatgatatgggcaaggtgcgcaaggatatcccccagtgggagcccagcaaggggtggaacgactggcagcaggtccccttctgctcccaccacttccatcaactgatcatgaaggacggtcgggagatcgtggtcccgtgccgcaaccaggacgaactggtgggcagagcccgagtatcgcagggagccggctggagcctccgggagaccgcgtgcttaggtaagtcctacgcccaaatgtggcaactgatgtacttccaccgccgggacctgaggctcgccgccaacgcgatctgttctgcggtccccgtggattggatccctacgtcaaggaccacgtggagcatccacgcccaccaccagtggatgaccacggaagatatgctgtccgtgtggaaccgcgtctggatcgaggagaacccctggatggaggacaagacccacatctcttcctggggcgacgtgccgtaccttgggaagcgggaagatcaatggtgcggcagcctcatcggcctaaccgcccgggccacctgggcgacgaacatacaggtggcgataaaccaggtcagacgattaatagggaacgagaactatctcgactatatgacttcaatgaagaggttcaagaacgaaagcgacccagagggtgctctgtggtag

SEQ ID NO: 24498 - RNA, 9879 nt, synthetic construct
  misc_feature 1..9879: note = derived and/or modified CDS sequence (opt11) from DENV-1__GU131794__SS-prME
  source 1..9879: mol_type = other RNA
agcgttaccatgctgctgatgctgatgcctaccgccttggccttccacctcacgacccgcggcggggaaccccacatgatcgtgagcaagcaggaacgggggaagtcactgctgtttaagaccagcgcaggggtgaacatgtgcaccctcatagccatggacctgggcgagttctgtgaagacacaatgacctacaagtgccccaggattaccgaggccgagccagacgatgtggactgctggtgcaacgccactgacacgtgggtcacctacggaacctgcagtcaaactggcgagcaccggcgcgacaagaggtccgtggccctggcaccacacgtaggactcgggctggagacgagaaccgagacctggatgtcttccgagggcgcctggaagcaaatccagcgggttgaaacctgggccctgcgccacccggggttcacggtgatcgccctcttcttggcccacgccataggcaccagcatcacgcagaaggggatcattttcatattgctcatgctggtgacccccagtatggccatgcgatgtgtaggcataggcagccgcgactttgttgaggggctatccggcgccacttgggtggacgtcgtgctcgagcacgggagctgcgtgaccaccatggccaaggataagcccaccctggacatcgagttgctcaagacggaggtcacgaaccccgcggttttacggaagctgtgcatcgaggccaagatctccaataccaccactgacagccgctgtcctacccagggcgaggccacactcgtggaggagcaggacgccaacttcgtctgccggagaaccttcgtggaccgggggtgggggaacggctgcggtttatttggcaaggggagcctcatcacgtgcgccaagttcaagtgcgtgacgaagctcgagggcaagatcgtacagtacgagaaccttaagtacagcgtgatagtgaccgtccacacaggcgaccagcaccaggtgggcaacgagtccacggaacatggcaccaccgcgaccatcacacctcaggccccctcaacggagatccagctgaccgactacggggccctcaccctggactgcagcccccggactggactggactttaacgagatggtattgctcacgatgaaggaaaagtcctggctcgttcacaagcagtggttcctcgatttaccgctaccctggaccagcggggcctccaccagccaggaaacctggaacagacaggatctcctggttacgttcaaaacggcccatgcgaagaagcaggaagtcgtagtgctgggctcccaggaaggcgccatgcatacggccctcactggggccacggagatccagaccagcggcaccaccacgatcttcgcggggcacctgaagtgccgcctgaaaatggacaagctcacgctgaaaggcatgtcctacgtcatgtgcaccggttcgttcaagctggagaaggaggttgcggagacccagcacggcacggtgctagtccagatcaagtacgagggcaccgacgcgccctgcaagatccccttctccacccaggacgaaaagggggtaacccaaaacggacggctcattacggccaatccgattgtgaccgacaaggagaagcccgtcaacatcgaggccgagccgcccttcggggaaagctacatcgtgattggagcgggcgagaaggccctcaaactgtcctggttcaaaaaggggagctccatcggaaagatgttcgaggccaccgccaggggagcccgtcgcatggcgatactcggagacacggcctgggacttcgggtcaatcggcggcgtgttcacgagtgtggggaagctggtgcaccagatcttcggcaccgcctatggggtgctgttcagcggcgtctcctggaccatgaagatcgggataggcgtgttactgacctggctgggcctcaactcgcgctcgacgagcctgtccatgacctgcatcgccgtgggtctggtcacgctctacctgggcgtgatggtgcaggcagacagcgggtgcgtcatcaactggaagggccgggagcttaagtgcgggagcggcatcttcgtgaccaatgaggttcacacgtggaccgaacagtacaagttccaggcggattccccaaagcgcctcagcgccgccatcggaaaggcttgggaggagggcgtctgcggcattcggtccgccacccgactcgagaacatcatgtggaagcagatcagtaacgagctgaaccacatcctcctggaaaatgacatgaagctgaccgtggtggtgggggacgtggcgggtatattggcacaggggaagaagatgatccgaccacaacccatggagtacaagtactcctggaaatcctggggaaaggccaagataatcggcgcggacgtgcagaacaccacgttcatcatagatggtccgaacacaccggagtgtcccgacgaccagcgtgcgtggaatatatgggaagtcgaggattacggcttcgggatctttacaaccaacatctggctgaagctgagggactcctacacccaggtgtgcgaccaccgcttaatgtcagccgcgatcaaggactccaaagccgtgcacgccgacatgggttattggatcgagagcgaaaagaatgagacctggaagctggcgcgtgcatccttcatcgaggtcaaaacctgcatctggcccaagtcgcatactctgtggtccaacggggtgctcgaaagcgagatgataatccccaagatctatgggggcccgatatcgcaacacaactatcgccccggatatttcacgcagaccgccggtccgtggcacctggggaaacttgagctcgacttcgacctgtgcgaaggcaccaccgtggtcgttgatgagcactgcggcaacagggggccgagcctccgcacgaccacagtgaccggcaagatcatccacgagtggtgctgccggtcctgcactctgccgccgctccgatttaagggagaagacgggtgctggtacgggatggagatccggcccgtcaaggagaaggaagagaacctagtcaagagcatggtgtcggccggctccggcgaagtcgattcgttctccttagggctgctgtgcatcagcattatgatcgaggaggtgatgcggtctcggtggagccgaaagatgctcatgaccggcacgttagccgtgttcttcctgctcatcatggggcagctgacctggaacgacctgattcggctctgcatcatggtcggcgcgaacgcctccgacagaatggggatgggcacgacatacctggcactgatggcgaccttcaagatgcgcccgatgtttgctgtggggttgttgttccggcgcctcaccagccgagaagtgctcctgctcacgatcgggctatccctggtcgcaagcgtggagctgccaaacagcctcgaggagctgggggacgggctggccatgggcatcatgatcctcaagctgctgaccgacttccagagccaccagctctgggctaccctgctgtccttaaccttcatccgcacgaccttcagcctgcattacgcctggaagactatggcgatggttctgtccatcgtgagcctcttccccttgtgcctatccacgacgtcccagaagactacctggctccccgtgctgctgggctccctcgggtgtaagccgctgaccatgtttctgatcgcagagaacaagatctggggtcgcaagtcgtggccactcaacgaggggatcatggcggtcggcatcgtgagcatcctgctgtccagcctcctgaagaacgacgtacccctggccggtcccctcatagccggaggcatgctgatagcgtgctacgtcatctcggggagctccgcagacttaagcctcgagaaggccgccgtggtgtcctgggaagaggaggccgagcatagcggcgcaagccacaacatcctggtcgaggtgcaggacgacgggacgatgaagatcaaggacgaggagcgcgatgatactctgaccatacttctgaaggccaccctgctcgcagtatctggcgtgtacccgctgagcatacccgccaccctgttcgtgtggtacttctggcagaagaagaagcagcggtctggcgtgctctgggacacacccagcccgcccgaagtcgagcgtgcagtgcttgacgacgggatctaccggattatgcaacgcggtctgctcgggagaagccaggtgggggtcggagtctttcaagagaacgttttccacaccatgtggcacgtaacccgcggcgcagtgctgatgtaccaggggaaacggctggagccctcctgggccagcgtgaagaaggacctaatctcctacggcggcgggtggcgccttcagggcagctggaataccggggaggaggtccaggtgatcgctgtggagcccggaaagaaccccaagaacgttcagactgcccccgggacgtttaagacctccgagggggaagtcggcgccatagcgctggatttcaagcccgggacctcaggaagccccatcgtgaatagggaggggaaaatcgtcggcctgtacggcaacggtgtggtgacgacctcaggaacctacgtcagcgccatcgcccaagctaaggcttcccaggaggggccactcccggagatcgaggacgaagtgttccgcaagcggaacctgacaatcatggatctgcaccccggcagcggaaagacacgccgttacctccccgccatcgtgcgcgaggccatcaagcggaaacttcgcaccctaatcctcgcaccgacccgcgtcgtggccagtgagatggcggaggcgcttaaggggatgcctatccggtaccagacgacggccgtcaagagcgagcacacgggcaaggagatcgtcgacctgatgtgccacgccaccttcaccatgcggctcctctccccagttcgagtgcccaactacaatatgatcatcatggatgaggcccacttcacggaccccagctccatcgcggcccgcggttacatcagcaccagagtcggcatgggggaggcggcagccatatttatgaccgccactccgcccggctccgtggaggccttcccccagagcaacgccgtgatccaggacgaggagcgcgacatccccgagaggagctggaacagcgggtatgagtggatcacggactttcccggcaagaccgtgtggttcgtgccctccattaagagcggcaacgacatcgccaactgcctgcgcaagaacgggaaacgggtgatccagctatcccgcaagaccttcgacaccgagtaccagaagacgaagaataatgactgggattacgtcgtgaccaccgacataagtgagatgggagcgaacttccgggctgaccgcgtcattgacccccggcggtgcctgaaaccagtcatattgaaagacggaccggagcgggtgatcctcgctggccctatgccagtcaccgtggcgtccgccgcgcaacggcgggggcgcatcggtcggaaccacaataaggagggcgaccaatacatttacatggggcagccactgaacaacgatgaagaccacgcccattggacggaggcaaagatgctgctcgacaacattaatacccccgagggcatcatccccgcgctgtttgagcccgagcgcgagaagtccgccgcgattgacggtgagtaccgcctgcggggcgaggcccgcaagaccttcgtagagcttatgcggcgcggggacctgccggtctggctttcctacaaggtcgcctcggagggattccagtatagcgaccggcgatggtgcttcgacggcgagcggaataaccaggtgcttgaggagaacatggacgtcgagatctggaccaaggagggggagcgcaagaagctgagacctcgctggctggacgcccggacgtactccgaccctctcgccctacgcgagttcaaggagtttgcggccggccggcgctcaatctccggggacctgatactcgaaattggcaaacttccccagcacctgacccagcgcgctcagaacgccctcgacaacctggttatgctgcacaacagcgagcagggaggccgcgcataccgtcatgccatggaagaactccccgacaccatcgagacactgatgctcctcgcccttatcgccgtactgacgggcggcgtaacgctctttttcctgtccggccgcgggctgggcaaaacgagcattggactcctatgcgtgatggcctccagcgtgctgctctggatggcgtccgtcgaaccccactggatcgccgcatccatcatcctggagttctttctgatggttttacttatacccgagcccgatcggcagcggaccccgcaagacaaccagctggcatacgtggtcatcgggctcctgttcatgatattaaccgtagccgcgaacgaaatgggcctcctggagacgaccaagaaggacctggggataggccacgtggccgtcgaaaatcaccaccacgcagccatgttagacgtagacctgcaccccgcctcggcttggaccctctacgccgtggcaacaacgatcatcaccccaatgatgcggcacaccattgagaacaccacggccaacataagccttaccgcgatcgccaaccaggccgccatactaatggggctggataagggctggcccatctccaagatggacatcggcgtccccctcctcgccctgggttgctacagccaggtgaaccccctgactttgaccgccgccgtcctgatgctcgtcgcccactacgccatcatcgggcccgggctgcaggccaaggcgacgcgcgaagcccagaagcgcacggcagcgggcattatgaagaacccgactgtggacggcatcgtagccatcgatctggaccccgtagtgtatgacgcgaagttcgagaagcagctcggccaaatcatgctgctgatcctctgcacgtcccagatcttacttatgcggacgacgtgggccttatgcgaaagcataaccctggccaccggccccctgactaccctctgggaggggtccccgggtaagttctggaacactaccatcgccgtgtcaatggccaacattttccgggggtcttacctggcgggcgccggactcgccttctccctcatgaagtcccttggaggcgggcggcgggggacgggtgcccaaggcgagaccctgggcgagaagtggaaacgacagctgaatcagctgtccaaaagcgagttcaacacctacaagcgctctgggatcatggaggtcgaccggagcgaggcgaaggagggcctgaagcgcggggagaccacgaagcatgccgtgtcgcggggcaccgccaagctgcgttggtttgtggagcggaacctggtcaagcccgaggggaaggtgattgatctgggctgcggccgcgggggctggagctactactgtgccgggctgaagaaggtgacagaggtcaagggctacaccaagggcgggcccggtcacgaggagccaatccccatggccacgtacgggtggaacctcgtgaaactgcactccggcaaagatgtgtttttcattccacccgagaagtgcgacaccttgctctgcgacataggggaaagctcccccaaccccactatcgaagagggccggaccctgcgcgtactgaaaatggtggagccgtggctccgggggaaccagttctgcataaagatcctgaacccatacatgccgagcgtggttgagactctagagcagatgcagcgcaagcacggcggcatgctcgtgcggaaccccttgtcccgcaacagtacccacgagatgtactgggtgtcctgcggtaccggcaatatcgtcagcgccgtgaacatgacctcccggatgctgctcaaccgcttcaccatggcccatcgaaagccgacgtacgagcgagatgtggacttaggtgccggcacccgccacgtcgcggtggaacctgaggtggctaatctggacatcatcggccagcggatcgagaatatcaagcacgagcataagagcacctggcactacgacgaggacaatccctacaaaacctgggcgtatcacgggtcgtacgaagtcaagcccagcggcagcgcctccagcatggtgaacggggtcgtgaagctcctgacgaagccgtgggacgtgatccccatggtcacccagatcgcaatgacagacaccacgcccttcggccagcagcgtgtattcaaggagaaggtggacaccagaacgccaaaggcaaagcgcggtaccgcccagattatggaggtcactgccaagtggctgtgggggttcctctcccggaacaagaagccgcgcatctgcacccgggaggagttcacccgcaaggtgcggagtaacgccgccatcggtgccgtgttcgtcgacgagaaccagtggaactccgcgaaggaggccgtggaggacgaacgcttttgggatctggtgcaccgggagcgcgagctgcacaagcaggggaagtgcgcgacgtgcgtctacaacatgatgggcaagcgggagaagaaactcggggagttcggtaaggccaaggggagccgcgccatatggtacatgtggctgggcgcgcggttcctggagttcgaggccctcggcttcatgaacgaggatcactggttctcccgcgagaacagcctgtccggggtggagggcgaagggcttcataagctgggctacattcttcgggacatcagcaagattcccggagggaatatgtacgccgacgacacagccggctgggatactcgcatcaccgaggacgacctacagaacgaggccaagattaccgacatcatggagcccgaacacgctctcctggccaagtccattttcaagctgacatatcagaacaaggtggtcagagtgcagcgtccggccaagaacgggaccgtgatggacgtcatcagcagacgggaccagcgcggctccggccaggtgggcacctacgggctcaacaccttcacgaacatggaggcccagctgatccggcaaatggaaagcgaggggatcttctcccccagcgagctcgagacccctaacctagccggccgcgtactggactggctggagaagcacggagtcgagagactcaagagaatggccatcagtggcgacgactgcgtggtaaagcccatcgacgaccgattcgctaccgccctcactgccctgaacgacatgggcaaggtccgcaaggacatcccgcagtgggagcccagcaaaggctggaacgactggcagcaggtacccttctgctcgcatcacttccaccaattaatcatgaaggacggacgggagatcgtggtcccctgccgcaaccaggacgagcttgtgggccgggcccgcgtatcccagggcgcggggtggagcctgcgggagacggcctgcttaggcaaatcctacgcccagatgtggcagctgatgtacttccaccgtcgggacctgcgcctggccgcgaacgccatctgcagcgccgtcccggtggactgggtgcccacctcccggacaacctggagcatccatgcccaccaccagtggatgacgaccgaggatatgctgtccgtatggaaccgagtgtggatcgaggagaacccctggatggaggacaaaacccacatcagctcctggggcgatgtgccctacctgggcaagcgtgaggaccagtggtgcggctcactcatcgggctgaccgccagagcaacgtgggccactaatatccaggtggccattaatcaggtgcgccggctgctcggcaacgagaactacctcgattacatgacctccatgaagagattcaagaacgagtcagacccggaaggtgccctgtggtga

SEQ ID NO: 24499 - RNA, 9879 nt, synthetic construct
  misc_feature 1..9879: note = derived and/or modified CDS sequence (opt11) from DENV-1__GU131796__SS-prME
  source 1..9879: mol_type = other RNA
tccgtgaccatgctgctgatgttgatgcccaccgccctggccttccacctaacgacccggggaggggagccacacatgatcgtgagcaagcaggagcggggcaagagcttacttttcaagaccagcgcgggggtgaacatgtgtaccctcatagccatggacctgggggagttctgtgaggataccatgacgtataagtgcccccgcatcaccgaggctgagcccgacgatgtggactgctggtgcaatgccaccgacacgtgggtgacctacgggacctgcagccagaccggcgagcaccggcgggacaagcggtccgtggccctggcgccccacgtcggcctcgggctggagacgcgtaccgaaacttggatgagctccgagggtgcatggaagcaaatccagcgggtcgagacctgggccctgcgccaccccgggttcaccgtgatcgccctctttctggcgcacgccatcggcaccagcatcactcagaaggggatcatctttatcctactcatgctggtgaccccctccatggccatgcggtgcgtcggcattggctcccgtgacttcgtggaggggctgtccggtgccacttgggtggacgtcgtgctcgagcatgggagctgcgtgactacaatggcaaaggacaaacccaccctggatattgagctgctcaagacggaggtcaccgaccccgcggtgctgcggaagctgtgcgtggaggccaaaatctccaacacgaccacggacagccgctgcccgacccagggtgaagcgaccctagtcgaagagcaggacgccaacttcgtttgccggcgcaccttcgtggaccggggctgggggaacgggtgcgggctgttcggtaaggggtccctaatgacgtgcgccaagttcaagtgcgtaaccaaactcgagggcaagatcgtgcagtatgagaacctgaagtatagcgtgatcgtcaccgtgcacaccggcgaccagcaccaggttggaaacgaatccacggagcacggcaccaccgcgaccatcacgccccaggcccctagcacggagatacagctcaccgactacggggccctcactctggactgctcgcccaggacgggcctggactttaacgagatggtattactgacgatgaaggagaagtcctggctagtgcacaagcagtggtttctcgacctgccgctgccctggaccagcggggcatccaccagccaggagacctggaaccggaaagacctcctggtcaccttcaagaccgcccacgcgaagaagcaggaggtggtggtactgggctcccaggaaggagccatgcacactgctcttaccggggccactgagatccagacctctggcaccaccacgatcttcgcagggcacctgaagtgccgcctgaagatggacaagcttaccctgaagggcatgtcctacgtgatgtgcaccgggagcttcaagctggagaaagaggtggcggagacacaacacgggacggtacttgtgcagataaagtacgagggcacagacgccccatgtaagatccccttttccacccaggacgagaagggagtgacccagaacggccggctgatcactgccaatccgatcgtcactgacaaggagaagcccgtgaacatcgaagccgagccgcccttcggcgaaagctacatcgtgatcggcgcgggggagaaggccctgaagctgtcctggttcaagaaggggagctctatcggcaaaatgttcgaggccaccgcccgcggggcccggaggatggcgatcctcggcgacaccgcctgggacttcgggagcatcggcggcgtctttacgtccgtgggcaagctggtgcaccagatcttcggcaccgcctacggggtcctgttcagcggggtgtcctggaccatgaagatcggtatcggcgtgctcctgacctggctgggcctcaattcccgctccacgagcttatccatgacctgcatcgccgtcgggctggtgaccctctatctgggggttatggtccaagccgacagcgggtgcgtgatcaactggaagggccgggagctgaagtgcgggagcgggatcttcgtgacaaacgaggtgcacacgtggaccgagcagtacaaattccaggcggactccccgaaacgactctcagccgccatcggtaaggcctgggaagagggggtatgcggcatccggtccgcgacccgcttagaaaacatcatgtggaagcagatcagcaacgaactgaaccacatcctcctggaaaacgacatgaagctgaccgtggtcgtgggggacgtggccggaatccttgcccaagggaagaagatgatcagaccccagcctatggagtacaagtactcctggaagtcctggggaaaggccaagatcatcggcgccgacgtccagaacaccacgttcatcatcgacggacccaacacaccggagtgccccgacgatcagcgcgcatggaacatatgggaggtggaggattatggcttcgggatcttcacgaccaacatttggctgaagctgcgggactcctatacccaggtgtgcgaccatcgcctgatgtccgccgccattaaggacagcaaagcggtccacgccgacatgggctactggatcgagagcgagaagaacgagacctggaagctggcgcgcgccagcttcatcgaggtcaagacctgcatctggcccaagagccacaccctctggagtaacggcgtcctcgagagcgagatgatcatccccaagatttacgggggcccgatctcccagcacaactaccgcccaggttacttcacgcagaccgccggcccctggcacctggggaaactggagctcgacttcgacctgtgcgagggcaccacggtagtggtggacgagcactgtggcaaccgggggccgagcctgaggacgaccaccgtcaccggcaagatcatccacgaatggtgctgccggtcgtgcaccctgccgcccctccgcttcaagggggaggacggttgctggtacgggatggaaatccggcccgtgaaggagaaggaggagaatctggtcaaaagcatggttagcgccggctccggcgaggtggacagcttctccctcggactgctgtgcatcagcatcatgatcgaagaggtgatgcggtcccggtggagccgcaagatgctcatgaccggcaccctggccgtattctttctgttaatcatggggcagctgacctggaacgacctgatccggctctgcatcatggtgggcgccaacgcctccgaccggatggggatgggcacgacctacctggccctgatggccaccttcaagatgcgcccgatgttcgccgtgggcctcttattccggcgccttaccagccgggaggtcctcctgctgacgatcgggctctccctggtggcgagcgtcgagctgcccaactctctcgaggagctgggcgacggactcgccatgggtatcatgattctcaagctgctgaccgacttccagtcgcaccagctctgggccaccctgctgtccctcactttcatcaagacgaccagcagcctgcactacgcctggaagacgatggcgatggtgctgagcattgtgtccctcttccccctctgcttgagcaccacgtcccagaagaccacttggctgccagtcctgctgggtagcctcggttgcaagccgctgaccatgttcttgatcgccgagaacaagatttgggggcgcaagagctggcccctcaacgaggggatcatggccgtgggcatcgtgtccatcctgctgagcgccctcctgaagaacgacgtccccctggccgggcccctcatcgcgggtggcatgctgatagcctgctacgtgatctccggtagctccgccgacctgtcgctcgagaaggccgccgaggtgtcctgggaggaggaggcggagcatagcggcgcttcccacaacatcttagtggaggtgcaggatgacgggacgatgaagatcaaggacgaagaacgggacgatacgctgacaatactcctgaaggccaccctgttagccgtgtcaggcgtctacccgctgagtatcccggcgaccctgttcgtgtggtacttctggcagaagaagaaacagcggagcggggtgctctgggacacacccagcccgcccgaggtcgagcgggcggtgctggacgacggcatctaccgcatcatgcagcggggcctgcttgggcgcagccaggtgggtgtcggagttttccaggagaacgtgttccacaccatgtggcacgtcacgcggggcgccgtgctcatgtaccagggtaagcgcctggagcccagttgggccagcgtgaagaaggacctgatcagttacggcggcgggtggcggctccagggcagctggaacaccggggaggaagtccaggtgatcgccgtggagcccggcaagaaccccaagaacgtccagacggccccggggacctttaaaacctcggagggggaggtgggcgctatcgccctggacttcaagcccggaacgagcggcagcccgatcgtgaatcgcgaagggaagatagtaggcctgtacggcaatggggtggtgacgacctccggcacgtacgtcagcgccatcgcccaggcaaaggcctcccaggaggggcccctcccggaaatcgaagacgaggtgttccggaagcgcaacctgaccatcatggacctgcaccccggcagcgggaagacgcggcgctaccttcccgccatcgtgcgagaggccatcaagagaaagcttcggaccctgatcctcgccccgacgcgcgtcgtcgcctccgaaatggccgaggccctgaaaggcatgccgatccgctaccagaccacggccgtcaagagcgagcacaccggcaaggagatcgtcgacctgatgtgccacgctaccttcaccatgcgcctcctgtccccggtgcgcgtgcccaactacaacatgatcatcatggacgaggcacatttcacggacccgagctccatcgccgcccgggggtacatcagcacccgcgtcgggatgggagaggccgccgccatatttatgaccgccacgccgcccggctccgtggaggccttcccccagagcaacgccgtgattcaggacgaggagcgggacataccggagaggtcgtggaactcggggtacgagtggataaccgacttccccggcaagaccgtgtggttcgttccttccatcaagagcggcaacgacatcgcgaactgcctgcggaagaatggtaagcgcgtgatccagctctcccggaagaccttcgacaccgagtaccaaaagacgaagaataacgattgggactacgtcgtcaccactgatatcagcgagatgggcgccaattttcgcgccgatcgggtgatcgaccccagacggtgcctgaagccggtcatcctgaaggacgggcccgagcgcgtcattctcgccggtcccatgcccgtcaccgtggcctccgcggcccagcggcgcggacgcattggccgcaaccacaacaaggagggcgaccagtacatctacatggggcagccgctgaacaacgacgaggaccacgcccattggaccgaggccaagatgctgcttgacaacatcaacacccccgagggcatcatccccgctctgttcgagcccgagcgggaaaagtctgcggccatcgacggggagtaccgcctgcgcggagaagcccggaagaccttcgtggagctcatgcgccgcggggacctgccggtctggcttagctacaaggtggccagcgaggggttccagtattccgatcgccggtggtgtttcgacggcgagcgcaacaaccaggttctcgaggaaaacatggacgtcgagatctggaccaaagagggggagaggaagaagctgcgcccccggtggttagatgcccgcacctactccgaccccctggcgctgcgggagttcaaggagttcgccgcagggcgccggtccgtgtccggggacctgatcttagagatcggcaaactgccccagcacctgacccagcgcgcccagaacgcgctcgacaacctggtgatgctgcacaacagcgagcagggcgggcgggcctaccgacacgccatggaggagctccctgacaccatcgaaaccctgatgctgctcgccctaatcgccgtcctaacgggcggggtgaccctcttctttctgtccggccgggggctgggcaagacctctatcggccttctgtgtgtgatggcgtcctccgtcctgctctggatggcctccgtagagccgcactggattgccgcctccatcatccttgaattcttcctgatggtgctcctgattcccgaacccgaccgccagcgtactccgcaggacaaccaactggcctacgtcgttatcgggctcctgttcatgatcctgaccgtcgcggccaacgagatgggcctcttagagacgacgaagaaggacctggggataggccacgtcgccgttgagaatcatcaccacgccgccatgctcgacgtggatctgcaccccgcgtccgcctggacgctgtatgccgtcgccaccacgatcataaccccgatgatgcgccacaccatcgagaacaccaccgccaacatcagcctcaccgccatcgccaaccaagccgcaatcctgatggggctggacaagggctggccgatctccaagatggacatcggcgtgcccctcctggcgctgggatgctacagtcaggtgaaccccctcaccctgaccgctgccgtcctgatgctcgtggcccactacgccatcatcggccccgggttacaggccaaggccacccgcgaggcccagaagcgaaccgccgccggcatcatgaagaacccgaccgtggacgggattgtcgcaatcgacctggatcccgtggtctatgacgccaaattcgagaaacagctcggtcagatcatgctgctaatcctctgcacctcccagatcctgctgatgcgcaccacctgggccctctgtgagagcataaccctggccaccggccccctgacaaccctctgggaggggtcccccggcaagttttggaacaccaccatcgcggtcagcatggccaacattttccgggggagctacctggcaggcgccggactggccttctctttaatgaagagtctcgggggcggacgtcgggggactggggctcagggcgagaccctgggcgaaaagtggaagcgccagctcaaccagctgtccaagtccgagttcaacacctacaagcggtccgggatcatggaggtggaccgcagcgaagccaaggagggcctgaagcgcggggagacaacgaaacatgccgtgagccgcgggaccgctaagctccggtggttcgtcgagcgcaacctggtgaaacctgaggggaaggtgatcgacctgggctgcggccgcggcgggtggagctactactgtgcagggctgaagaaggtcaccgaggtgaaggggtacaccaagggcggccccggccatgaggagcccatcccaatggcaacgtacggctggaacctcgtgaagctgcactccggcaaggacgtgttcttcatcccgcccgagaagtgcgacaccttattgtgcgacatcggggagagctcccccaaccccaccattgaagagggccgcacactgagagtactgaagatggtggaaccgtggctccgggggaaccagttttgtatcaagatcctgaacccctacatgcccagcgtcgtggagaccctggagcagatgcagcggaagcacggcggcatgctagtgcgcaaccccctgtcccggaacagcacccacgagatgtattgggtctcctgcggaaccggcaacatcgtaagcgccgtgaacatgacctcccgcatgctgctcaaccggttcaccatggcccaccgaaagccgacgtacgagcgcgatgttgacctgggggccggcacccggcacgtggccgtggagcccgaagttgcgaatctggacatcatcggccagagaatcgagaacatcaagcacgaacacaagtcgacctggcactacgacgaggacaacccctataagacctgggcctaccacgggtcctacgaggtgaagcccagcgggagcgcctcctcaatggtcaatggagtggtgaaactcctgacgaaaccttgggacgtcattcccatggtgacccagatcgccatgaccgacaccacgcccttcgggcagcagagggtgttcaaggagaaggtcgacacacgcacccccaaagcaaagcgggggaccgcccagatcatggaggtgacggccaagtggctgtggggtttcctctcccgcaacaagaagccgcggatctgtacccgcgaggaattcacccggaaggtgcgcagcaacgccgccatcggagcggtcttcgtggacgagaatcagtggaactccgccaaggaggccgtggaggacgagcggttctgggacctggtccaccgcgagcgggaactgcacaaacaggggaaatgcgcgacctgtgtgtataacatgatgggcaaacgcgagaaaaagctcggcgagttcggcaaggccaaggggtcccgagcgatctggtacatgtggctgggcgcccgctttctcgagttcgaggccctcggcttcatgaatgaagaccactggttttcccgggagaacagtctgtccggggtggagggcgaggggctgcacaagctcggctacatcctccgcgacatcagcaagattcccgggggcaacatgtacgccgacgacacggccggctgggacacccggatcaccgaggacgatctgcagaatgaggcgaagatcaccgacattatggagccggagcacgccctcctggccaaatccatcttcaagctgacttaccaaaacaaggtcgtgcgcgtgcagcggccggccaagaacgggaccgtgatggacgtaatcagccgccgcgaccaacggggctccggccaggtgggcacatacggcctaaacaccttcacgaacatggaggctcagctgatccgccagatggagtccgagggcatcttcagccccagcgagctggagaccccaaacctcgctggccgggtcctagattggctggagaagcacggggtggagcgcctcaagcggatggccattagtggcgacgactgtgttgtcaagccaatcgacgaccgcttcgccgccgccctgaccgcgctaaacgacatgggtaaggtgcggaaagacatcccccaatgggagcccagcaagggctggaacgactggcagcaggtccccttctgtagccatcacttccaccagctcatcatgaaggacggccgcgagatcgtggtgccatgcagaaaccaagacgaactggtcgggcgagcccgggtctcacaaggcgcagggtggagcctgcgcgagaccgcctgccttggcaagtcctacgcgcaaatgtggcagctgatgtacttccatcggcgcgacctgcggctcgctgccaacgcgatctgcagcgccgtgccggtggattgggtccccacgtcccgcaccacctggagcatccacgcgcaccaccagtggatgaccactgaggacatgctgtccgtgtggaatcgggtttggatcgaggagaacccctggatggaggacaagacacacatcagctcctggggcgacgtcccctacttgggcaagcgcgaggaccaatggtgcggcagcctcatcgggctgaccgcccgggcgacgtgggccacgaatatccaggtggccatcaaccaggtgcgccgcctgatcggcaacgagaactacctcgactacatgacctccatgaaacggttcaagaacgagtctgacccggagggtgcgctgtggtga

SEQ ID NO: 24500 - RNA, 9879 nt, synthetic construct
  misc_feature 1..9879: note = derived and/or modified CDS sequence (opt11) from DENV-1__GU131797__SS-prME
  source 1..9879: mol_type = other RNA
agcgttaccatgctgctcatgctgatgcccaccgccctggcgttccacctcaccacccggggcggggaaccccacatgatcgtgagcaagcaggaacggggcaagtcactactcttcaagacgagcgctggggtgaatatgtgcactctcatcgccatggaccttggcgagctgtgcgaggacaccatgacctacaaatgcccccgtatcaccgagaccgaacctgacgacgtggactgctggtgcaacgccacggacacctgggtgacctacggaacttgttcacagacgggcgagcatcggcgcgacaagcgatctgtggccctcgcaccccacgtgggcctgggtttagagacccggactgagacttggatgtcatcggagggagcctggaagcagatacagcgggtggagacctgggccctccgccaccctgggttcaccgtaatcgcactttttctggcccatgcgatcggcacttcaatcacccagaaagggatcatcttcatactccttatgctggtaacgccgtccatggccatgcggtgtgttggcatcggctcccgggactttgtggaggggctctccggtgccacctgggtggacgtcgttctggagcacgggagctgcgtgaccaccatggccaaggacaagccgacgctggacatcgagctcctcaagaccgaggtcacgaatcccgccgtcctgcggaaactctgtatcgaggcgaagatctcaaataccactacagactctaggtgcccgacccagggcgaagccactttggtagaggaacaggacgccaacttcgtctgccgccgcactttcgtggaccggggctggggcaacggctgcgggctgttcggcaaggggtctctgataacgtgtgccaaatttaagtgtgtgaccaagctggaggggaagatcgtccagtatgagaacctgaagtacagcgtgatcgtgactgtacacacaggagatcaacaccaagtggggaatgagtcaaccgagcacgggaccaccgccacaatcacgccacaggctccgaccaccgagatccagctcaccgactacggggccctcacgctagactgcagcccccgcaccggcctcgacttcaacgagatggtcctattgacgatgaaggagaagtcctggctggtacacaagcagtggttcctggacttacccctcccgtggacaagcggggccagcacgagccaggagacctggaaccgccaggacctgctggtgaccttcaagactgcccatgcgaagaagcaggaagtcgtcgtgctcggtagccaggagggcgcgatgcacacggccttaaccggggcgaccgaaatccagacctccggaaccacaacgatcttcgccgggcatctgaaatgccgactcaagatggacaagctgaccctgcgggggatgagctacgtcatgtgtacgggtagctttaagctcgagaaggaggtggccgagacacagcacggcaccgtgctggtccagatcaagtacgaaggcacagacgcaccctgcaagatacccttcagcacgcaggacgagaagggggtgacccagaatgggaggctaataaccgccaacccgatcgtgaccgacaaagagaagcccgtgaatatcgaggctgagccaccctttggggaatcctatatagtgataggcgcaggcgagaaggcactaaaactcagctggtttaagaaggggtcgagcataggaaaaatgttcgaggcaacagccagaggggctaggcgcatggccatactaggcgacactgcttgggattttgggtccatcggcggcgtgttcaccagcgtcgggaagctggttcatcagatttttggcactgcctacggggtgttattttccggtgtcagctggaccatgaagatcgggataggggtgctgctgacctggctcggcttgaactcccggagtacctccctgagtatgacctgcatcgccgtggggttggtaacgctgtacctaggcgtaatggtccaggccgattccgggtgcgtaatcaactggaagggccgcgagctaaagtgcggtagtggcatcttcgtaaccaacgaggtgcacacctggacggaacagtacaaattccaggccgatagcccgaagcgtctatccgctgccataggcaaagcctgggaggagggggtctgcggcatccgcagcgccacccggctagagaacatcatgtggaagcagatctcaaatgagttaaaccacatcttactggagaacgacatgaaattcactgtggtggtcggtgacgtagccggaatcctcgcgcagggaaagaagatgattagaccgcagccgatggagtacaagtacagctggaaatcctggggcaaggccaagatcatcggagcggatgtgcagaacacgaccttcatcatcgacggaccgaacaccccagagtgccccgacgaccagcgggcctggaacatttgggaggtcgaggattacggcttcggcatcttcactaccaatatctggctgaaacttcgcgacagctacacacaggtgtgcgaccacagactcatgtccgcggccatcaaggactctaaggccgtgcacgccgatatgggttactggatcgagtcggaaaagaacgagacctggaagctggctcgcgctagcttcatcgaggtcaagacgtgcatatggcccaaatcccacaccttgtggagcaacggcgtgctggagagcgagatgataatccccaagatctacgggggaccgatttcacagcacaactaccgccccgggtatttcacgcaaaccgcggggccctggcacctgggaaaacttgaactagacttcgatctctgtgagggcacgaccgttgtagtagacgagcactgtggcaatcgagggccgtccctgcggaccactacggtaaccggtaagatcatccacgagtggtgctgccggagctgcaccctacctccactccgtttccgcggggaagacggctgctggtatgggatggaaatccggcccgttaaggagaaggaagagaacttagtaaagagcatggtgagcgccggcagcggcgaagtagactccttcagcctagggctgctgtgcatctcaattatgatcgaggaggttatgcggagtaggtggtcgcgcaaaatgctcatgaccgggacgctggctgtctttttcttactcatcatggggcagctcacctggaatgacctgatccgcctgtgcattatggtaggcgccaatgcgagcgatcgtatggggatgggcaccacctacttagccctgatggccacattcaagatgcgccctatgttcgcagtaggactcctgttccggcggcttacctcccgggaggttctactgctgaccatcgggttgagtctagtagcctcggtggagttacccaacagcctcgaggaactgggcgacgggctggcgatgggtataatgatcctcaagctgttaactgatttccagagtcaccagctctgggccaccctgctgagcctcaccttcataaagaccacattctccctgcactgtgcgtggaagacgatggccatggtcctaagcatagtatcccttttccccctgtgcctctcaaccacctcacagaaaacgacgtggctccccgtgctgctgggcagcctcgggtgcaaaccgctgaccatgttcctaatagcggaaaacaaaatctggggcaggcgatcctggcccctaaatgaagggataatggctgtcggcatcgtgtcaattctactgtcatccctcctgaaaaatgacgtgccactggccgggccattaattgcaggcggcatgcttatcgcctgctacgtcatctccgggtccagcgcagacttatccctcgagaaggccgccgaggtgagctgggaggaggaggccgagcactccggcgccagccacaacatcctcgtagaggtccaggacgacggaaccatgaagattaaggacgaggaacgcgatgacacacttacgatcttactgaaggcgacgctgctagccgtgtccggcgtgtacccgctgagcatccccgctacccttttcgtctggtatttttggcagaagaagaaacagcggtccggggtgctctgggacacccccagcccacccgaggtcgagcgcgctgtcttagacgacggaatctaccggatcatgcagcgcggacttttggggcggtcccaggtgggcgtgggagttttccaagagaacgtgttccataccatgtggcatgtgacgagaggggccgtcctcatgtatcagggaaaacgcctcgagcccagctgggcatccgtgaagaaggatctgatctcttacggcggagggtggcgcctccagggcagctggaatacgggtgaggaggtgcaggtcatcgcagtcgagcctggcaagaatcccaagaatgtgcagaccgcccccgggacgttcaagacgcccgagggcgaggtcggcgccatcgccctggacttcaagcccgggaccagcggctccccgatcgtgaaccgggagggcaagatagtgggactatatggtaatggggtcgtgaccaccagcggtacgtacgtgagcgcgatcgcccaggccaaggcctcccaggaggggccgttgccagagatcgaggacgaggtgttcaggaagcgtaacctgacaatcatggacctccaccccggcagcgggaagacccgccggtatctcccggcgatagttcgcgaggccataaaaaggaagctgcggaccttgatcctcgcccccactcgcgttgtggcgtcggagatggccgaggccttgaagggcatgcccatccggtatcagacaaccgctgtcaagtctgagcacactggaaaggagatcgtcgacctgatgtgtcatgcgaccttcacgatgcgcctactatcccccgtccgggtgccgaactataacatgattatcatggacgaggcccatttcactgaccccagctccatcgctgcgcgcggctacatatccaccagagtcggtatgggcgaggccgccgcgatcttcatgacggccacgccgcccggatcagtggaggcgttcccgcaaagcaacgccgtgattcaggacgaggagagggacatccccgagcggtcgtggaatagcgggtacgagtggatcactgacttccctggcaaaactgtgtggttcgtcccctccatcaagagcgggaatgacatagccaactgcctacgcaagaacggtaagcgggtgattcagctctcccgcaagacgttcgataccgagtaccagaaaactaaaaacaacgattgggactacgttgtcactacagacatcagcgaaatgggcgcgaacttccgggcggaccgcgttatcgatccgcggcgctgcctgaagcccgttatcctgaaagacgggccggagcgggtcatcctcgccggccccatgccggtcacggtcgccagtgccgcccagcgcagagggaggatcggcagaaaccacaacaaggagggcgatcagtacatctacatgggccagccgctgaacaacgacgaagaccacgcacactggaccgaagcaaagatgctgctcgataatatcaacacgcccgaaggcataatccccgccttattcgagccggagagagagaagtcggccgccatcgatggagagtaccgcctacgcggtgaggcgcgcaagacgtttgttgagctcatgcggagaggggatctgcccgtgtggctgagctacaaggtcgcctctgaggggttccagtacagcgaccggcgatggtgtttcgacggcgagcggaacaaccaggtgctcgaagagaacatggatgttgaaatctggaccaaggaaggtgagcgaaagaagctgcgaccccgctggctggacgccaggacctactccgacccgctcgcgttgcgtgagtttaaggagtttgccgcggggagacgaagcgtctccggcgacctgatcctcgaaatcggcaagctgccgcagcacctcacccagcgggcccagaacgcactcgacaaccttgtaatgctgcacaatagcgaacagggaggtcgcgcctaccggcacgcgatggaggagttacccgacacgatagagacgctgatgctcctcgctcttatcgctgtgctgacgggcggcgtcacactcttcttcctctccggacgcgggctcggcaagacctctatcggtctcctgtgcgtgatggcatccagcgtgctgctctggatggcatctgttgagccgcactggatcgcggccagcattattctggagtttttcctgatggtgctcctgataccagagccggacaagcagaggacgccccaggacaaccagctggcgtacgtagtgatcgggctcctgttcatgatcctgaccgtggccgccaacgagatggggctcctggagacgactaagaaagacctggggatcggccacgttgcggtggagaaccatcatcatgccgctatgctcgacgtggacttacaccccgccagtgcctggacgctgtacgcggttgccaccaccatcatcactccgatgatgcgccatactatagagaatactacggctaatattagcttgaccgccatcgcaaaccaggcggccattctcatgggattagacaagggatggcctatctccaaaatggatatcggcgtccccctcctggctctgggatgttacagtcaggtgaatcccttaacactgaccgccgcggtgttaatgctcgtggcccattacgcaatcattggcccggggctgcaggcaaaggccacccgcgaggcgcagaagcggaccgccgccggtatcatgaagaaccccacggtggacgggatcgttgccatcgatctggaccccgtcgtctacgacgccaagttcgagaagcagctcggccagatcatgctgctgatcctctgcacctcccaaatcctgttgatgcgcaccacctgggcgctgtgcgaaagcatcacccttgccaccggccccctgacgaccctctgggagggaagcccgggcaagttctggaatacgaccatcgccgtaagcatggccaacatcttccgggggtcctatctggccggcgcaggactggccttctctctaatgaagtcactaggaggcggccgccgcgggaccggggcccagggcgaaaccctgggcgagaaatggaaacggcagctcaaccagctatccaaaagcgagttcaatacgtacaagcgatccggtatcatggaggtcgaccgcagcgaggcaaaggagggcctgaaacgcggggaaaccacaaaacacgcggtgtcccgcgggacggccaagctacggtggttcgttgagaggaacctggtaaagccggaggggaaagtcatcgatctggggtgtggcaggggtgggtggtcatactattgcgccgggctgaagaaagtgaccgaagtcaaaggatacactaagggcggccccggacacgaggagccaatcccgatggccacatacgggtggaacctcgtgaaactgcactctggcaaggacgtgttcttcattccgccggagaagtgcgacacactgctctgcgacatcggggaaagctcccccaacccaacgatcgaggagggccgcaccctaagagttctgaagatggtagagccctggctcagggggaaccagttctgcatcaaaatcctgaacccctatatgcccagcgtggtagagactcttgaacagatgcagcggaagcatgggggaatgctcgtgcgcaacccgctgtcccggaatagcacgcacgagatgtactgggtgagttgtgggacagggaacatcgtctctgccgtaaacatgacatcccgcatgctcctcaaccgctttaccatggcgcaccgtaagcccacatacgagcgcgacgtggacctgggcgccggcaccaggcacgtcgccgtggagcccgaggtagccaacctggatatcataggacagcgcatcgagaatattaagcatgaacacaagtcgacatggcactacgacgaggacaacccgtacaagacttgggcctaccatgggtcctacgaggtgaagcccagcggctccgcgtcttcaatggtgaacggcgtcgtcaaacttttaaccaagccctgggatgtgatcccgatggtcacccagatcgcgatgacagacaccacacccttcggccagcaacgggtcttcaaggagaaagtggacaccagaacgccgaaggccaaacggggaaccgcacagatcatggaggtcacggccaagtggctgtgggggttcctctcccgaaacaagaagccgcggatctgcaccagggaggaatttacacgaaaggtgcgctcaaacgctgctatcggggcagtgtttgtcgacgagaaccagtggaactccgccaaggaggcggtggaagacgaaaggttctgggacctggtgcaccgcgagcgggagttacacaaacaggggaagtgcgctacatgcgtctataacatgatgggcaagcgcgagaagaagctcggggagttcgggaaggccaaagggagccgggccatctggtatatgtggctgggcgcccgcttcctggagtttgaagcgttgggcttcatgaatgaggaccactggttctcccgtgagaactcattatccggggtggagggagaggggctgcacaaactcgggtacatcctgcgcgacataagcaagatcccagggggcaacatgtacgccgacgacacggctggctgggacacccggatcactgaggacgacctgcaaaatgaggcccgcattaccgacatcatggaaccggagcacgccttactggccaaatccatctttaagctgacataccagaacaaggtggtgagagtgcagcgtcccgccaaaaatggtaccgtaatggacgtcatcagccgccgggaccagcgcggctctggccaggtgggcacgtacggccttaatacctttaccaacatggaggcccagctcatccggcagatggagagtgaggggattttctccccgagtgagctggagacccccaacctcgccgagcgcgtcctggactggctggagaagtatggcgttgagagactcaagagaatggccataagtggcgatgactgcgtggtgaagcccatcgacgaccggtttgcaaccgccctgaccgctctcaacgacatgggcaaagtccgcaaggacataccccagtgggagcccagcaaggggtggaatgactggcaacaggtcccattttgctcacaccacttccatcagctaatcatgaaggacggccgggagatcgtggtcccatgccgcaaccaggacgagctggtgggccgggcccgcgtgagtcaaggggccggctggtctctgagggagaccgcttgcttggggaagtcctacgcgcagatgtggcagctgatgtacttccaccgcagagatctgcgcctcgcggctaacgcgatctgcagcgccgttccagtagactggatccccacttcacggacgacttggagtattcacgctcatcaccagtggatgaccaccgaagatatgctcagtgtgtggaaccgcgtgtggatagaggagaacccgtggatggaggacaagacccacatcagcagctggggcgacgtgccgtatctggggaagcgcgaagaccagtggtgcgggtcgctcatcggcctcaccgcacgcgccacttgggcgaccaatatccaggtagcgataaatcaggtccgcaggcttattggtaacgagaactacctcgactacatgacttccatgaagcgcttcaagaacgagtccgacccagagggcgccctgtggtag

SEQ ID NO: 24501 - RNA, 9879 nt, synthetic construct
  misc_feature 1..9879: note = derived and/or modified CDS sequence (opt11) from DENV-1__GU131801__SS-prME
  source 1..9879: mol_type = other RNA
tctgtgaccatgctgctcatgctaatgcccactgcgctggccttccacctaaccacccggggcggcgaaccccacatgatcgtgagcaagcaagagaggggcaagagtctgctgttcaagaccagcgctggcgtgaacatgtgtaccctgatcgccatggacctgggggaactctgtgaggacaccatgacctacaaatgcccccgcatcaccgaagccgagcctgacgacgtggactgctggtgcaacgccaccgacacttgggtaacgtacgggacctgtagccagaccggcgagcaccggcgcgagaagcggagcgtggccctcgcaccccatgtgggtctggggctggagactcgcaccgagacctggatgagctccgagggggcctggaaacagatccaacgggtcgagacttgggccctccgccaccccgggtttacggtgatcgctctattcttagctcacgccataggcacaagcatcacccaaaaagggatcatcttcatcctcctaatgttagtgaccccgtccatggcgatgcggtgcgtgggaatcggctcccgcgacttcgtggaggggctctccggcgcaacgtgggtggacgtcgtgctagagcacgggagctgcgtaaccaccatggccaaggataagcccacactggacatcgagctcctgaaaaccgaggtcaccaaccccgcggtgctgcgtaagctctgtatcgaagcaaagatttccaacaccacaacggacagccgctgccctacccagggcgaggccaccctggtggaggagcaggacgctaacttcgtctgccggaggaccttcgtggataggggctgggggaacgggtgcgggctgtttggcaaggggtcattactgacatgcgcaaagttcaagtgcgtgaccaagctggagggcaagatcgtccagtacgagaacctcaagtacagcgtcatcgtgaccgtccacaccggcgatcagcaccaggtgggtaatgagagcacagaacacggcaccacagcgacaatcacgccccaggcccccacaaccgagatccagctgaccgactatggtgccctgaccctcgactgcagcccccgaacgggactggacttcaacgagatggttctgttgaccatgaaggaaaagtcctggctagtgcacaagcaatggttcctagacctccccctaccctggaccagcggggccagcacctcccaggagacctggaaccggcaggacctgctggtgaccttcaagaccgcccacgcgaagaagcaggaggtagtggttctgggcagccaggagggtgcgatgcacaccgccctgacgggggccaccgagatccagacaagtggcacaactaccattttcgccgggcacctcaagtgccggttaaagatggacaagctgaccctcaagggcatgagctacgtcatgtgcacagggtccttcaaactcgagaaggaagtggcggagacgcagcacggtaccgtgctggtacaaatcaagtacgaagggaccgatgctccctgcaagatacccttttctacccaggatgagaaaggtgtgacgcaaaacggacggctgatcaccgcgaaccccatcgttaccgacaaggaaaagccggtaaacatcgaagccgagccgcccttcggggagtcctatatcggcatcggcgcgggggagaaggccttaaagctcagctgggtgaagaagggatcttcaatagggaagatggtagaagccacggcccgcggcgctcggcgcatggcgatcctgggtgacacggcgtgggactttggttccatcggaggggtcttcacgagcgtggggaagctcgtgcaccagatcttcgggacggcctacggcgtcttattcagcggagtgagctggaccatgaagataggtatcggcgtgcttctcacgtggcttgggctgaactcccgcagcacatccctcagcatgacctgtatcgccgtcggcctggtgaccttatacctcggggtgatggtgcaggcggactccggctgcgtaatcaactggaaggggcgggagttaaagtgcgggagcggcattttcgtgacgaacgaggtgcacacctggaccgagcagtacaagttccaggcggacagcccgaagcgcctgtccgctgcgattgggaaggcgtgggaggagggcgtctgcgggatccggagcgccacccgtctggaaaatattatgtggaaacaaatctccaacgagctgaaccacatcctgttggagaacgacatgaagtttaccgtggtcgttggcgatgtggcgggcatccttgtccagggcaagaagatgatacgtccccagcccatggagtacaaatacagttggaaaagctgggggaaggccaaaatcatcggggcggacgtacagaatagcacgttcatcatcgacggccccaacactccggagtgtcccgacgatcaacgcgcgtggaatatctgggaggtggaggattacggattcggcatcttcaccaccaatatctggctgaaacttcgggactcctacacccaggtctgcgaccaccgcctgatgagcgcggctatcaaggacagcaaggccgtacatgccgacatgggatactggatcgagagcgagaagaacgagacctggaagctggcgcgggcgtccttcattgaggtgaagacctgcatctggcccaagagccacaccctctggagcaacggggtcctggagagcgagatgattatccccaaaatacatggcgggccgatctcccagcacaactaccggcccgggtacttcacgcagaccgcagggccctggcatctgggcaaactcgaactggacttcgatttgtgcgagggcaccaccgtggtggttgacgagcactgcgggaaccgtggccccagcctccggacgaccaccgtgacgggaaaaatcattcatgagtggtgctgtcgatcctgcacgctgccaccccttcgcttccggggcgaggatgggtgttggtatggtatggagatccgccctgtgaaggagaaggaggaaaatctggtaaagagcatggtatcagccggctccggagaggtagactctttctccctgggactactctgcattagcatcatgattgaggaggtcatgcggtcccgctggtcccggaagatgctgatgaccggaaccctggctgtgttcttcctccttatcatgggccaattgacctggaatgacttgatccgcctgtgtatcatggtgggagccaacgcgtcagaccgcatgggcatgggaacgacctacctggccctcatggccacctttaagatgcggcccatgttcgctgtggggctgctgttccgccggctcaccagccgcgaggtgctgctgctcacgatcggcctgtccctggtcgccagcgtggagctccccaatagcctggaggaactgggggacggcctagcgatgggaatcatgatccttaaactgctcaccgacttccagagctaccagctgtgggccaccctcctctcactgacgttcatcaagacgacctttagcttacactacgcctggaagacaatggctatggtcctctctattgtaagcctgttccccctgtgcctcagcacaacaagccagaagaccacctggctgcccgtgctgctgggtagcctgggctgcaagccgctgaccatgttcctcatcgcggagaacaagatctgggggcggaagtcctggcccttaaacgagggcatcatggccgtggggatcgtgtctatcctcctttcctccttgctgaagaacgacgtgcccttggccggccctctgatcgccgggggaatgctgatcgcctgctacgttatcagcggcagctccgccgacctcagcctggagaaggctgccgaggtttcctgggaggaagaagctgagcacagcggggcttcccacaacatcctggtggaggtgcaggacgacggcacgatgaagatcaaggatgaggagcgcgacgacaccctcacaatcctcctgaaggctaccctcttagccgtgagcggggtgtacccgcttagtatcccagccacacttttcgtgtggcacttctggcagaagaaaaagcagaggagtggcgtcctgtgggacacgcccagcccgcccgaggtggagcgcgccgtactggacgacggtatctatcggatcatgcagcggggtctcctggggcggagtcaagtcggggtcggagtgttccaggagaatgtcttccacactatgtggcacgtaacccgcggggccgttctgatgtaccagggcaaacgacttgagccctcctgggctagcgtgaagaaggatctcatcagctacggcgggggatggcgcttccaggggagctggaacacaggcgaggaggtacaggtgatagcagtcgagcccgggaagaatcccaagaatgtgcagacggcccccgggacctttaagacccccgaaggcgaggtcggtgccatcgcactggacttcaaacccggaacgtccgggtcgcccattgtgaaccgggagggcaagatcgtggggctgtacgggaacggcgtagtcacgacctcagggacgtacgtgtccgcgatcgcccaggccaaggccagccaagaaggaccgcttcccgagatcgaggacgaggtgttccggaagcggaacctgaccataatggacctgcaccccgggtcaggcaagacgcgccggtacctcccagcgatcgtacgcgaggccatcaagcggaagctgcgcaccttgatacttgctcccacccgcgtggtggccagcgaaatggctgaggcgctcaagggcatgcccatccggtaccagaccacggctgtcaaatctgagcacaccggcaaggagatcgtggacttgatgtgccacgcgaccttcaccatgagactcctcagccccgtgcgggtccccaactacaacatgatcataatggacgaggcccacttcacagacccctccagcatcgccgcgcgtggctacatttccacccgggtcgggatgggcgaggccgccgctatcttcatgaccgccacgccacccgggagcatggaggctttcccacagtctaacgccgtgatacaagacgaggaacgtgacatcccagagcggagctggaactccggctacgagtggatcactgacttccccggcaaaaccgtctggttcgtgcccagtataaaagccggcaacgacatcgccaactgtctgcggaagaatggcaagcgggtgattcaactctcccgcaaaaccttcgacaccgagtaccagaagacgaagaacaacgattgggactacgttgttaccaccgacataagcgagatgggcgcgaatttccgggctgacagagtgatcgacccacgtcgctgtttaaaacccgttatcttaaaggatggccccgagagagtgatcctcgcagggcctatgccggtcaccgtggcctccgccgcgcagcgacggggccgcatcggcagaaaccacaataaggagggggaccagtacatatacatgggccagcccctgaacaacgacgaggaccacgcgcactggacggaggcaaagatgctactcgataacatcaatacccccgaggggatcatccccgcgctgtttgagccggagcgcgagaagtccgcggcgatcgacggcgagtaccgcctgcgcggagaggcccgcaaaacctttgtggaactcatgcggagaggcgatctgcctgtctggctgtcctacaaggtggccagcgaaggcttccagtacagcgatcggcgttggtgcttcgacggggagcggaacaaccaggtgttagaggaaaacatggacgtcgagatctggaccaaggagggcgagcgcaaaaagctgcgaccgcgctggctggacgcacggacgtactccgaccccctagcgctgcgcgagttcaaggagttcgcggctggccggcgcagcgtgtccggcgacctgatcctggaaatcggcaaactgccgcagcacctgacccagcgggcccagaacgcactcgacaacctggtaatgcttcacaacagcgagcaaggcggccgcgcgtaccggcacgccatggaggagctccccgacacgatcgagaccctcatgctgctcgccctgatcgcagtcctgaccggaggggtgaccctattcttcctgtccgggaaggggctgggcaaaaccagcataggattactgtgcgtgatggcatccagcgtcctgctctggatggcgtccgtggagccccactggattgcggccagcatcatactggagtttttcctgatggtgctcctgatcccggaaccggaccggcagcggacgccccaggacaaccagctggcctacgtcgtgattgggctcttgtttatgatcctgaccgtagccgccaacgagatggggctgctggagacgaccaagaaagacttgggtatagggcatgtcgccgtagagaaccaccatcacgccgctatgctcgacgtggacctgcacccggcatccgcgtggaccctgtatgcggtcgccaccaccataatcacgccgatgatgcgacacactatcgagaataccacggcgaacatcagcctcacagccatcgcgaaccaggccgccatactgatgggcctggacaagggctggcccatatccaagatggacatcggggtgcccctcctggcgttaggctgttatagccaggtgaaccccctcaccctgactgccgccgtccttatgttagttgcccactacgccatcatcgggccgggcctgcaggcaaaggcgacgcgggaggcacagaagcggaccgccgctggtatcatgaaaaaccctaccattgacggtatagtggccatagacctggaccccgtggtctacgacgcgaagttcgagaagcagctcggccagataatgctgctgatcctctgcacctcccagatactcctgatgcgcacgacctgggccttgtgcgagagcattaccctggcaaccggtcccttgacaaccctctgggagggctccccggggaagttctggaataccaccatagcagtgtcgatggccaatatctttcggggctcctacctggccggcgccggtctggcatttagcctcatgaagtccctgggcggtggccgacgtgggacaggcgcccagggcgagaccttgggtgaaaaatggaagagacagctaaatcagctgtccaaaagcgagttcaacacctacaagcggtctggcatcatggaggtcgacagatccgaagcgaaggaggggctgaaaagaggggagaccacaaagcacgccgtgtcccgcggaaccgccaaacttagatggttcgtggagcgcaacctggtcaagcctgaaggcaaggtgatcgacctaggctgcgggcggggcgggtggtcctactactgcgccggcctgaagaaggtgaccgaggtcaagggttacaccaaaggcggccccgggcacgaggagcccatcccaatggccacgtacggctggaacctggtgaagctccactctggtaaggatgtatttttcattcccccagaaaagtgcgacaccctgctctgcgacatcggcgaaagctcccccaaccccacaatcgaagagggacgcacccttcgggtcctgaagatggtggagccctggctccgcgggaaccagttttgcatcaagatcttaaacccctacatgcctagcgtggtcgaaaccctcgagcaaatgcagcggaagcacggcggaatgctagtgcgcaacccgctgtcgaggaatagcacccacgagatgtactgggtgtcctgcggcactgggaacatcgtcagcgccgtgaacatgacatcccgcatgctgctcaacaggttcaccatggcccatcgcaagcccacgtacgagcgcgacgtggacctgggcgccggcacccggcacgtagccgtcgagcccgaggtggcgaacctggacatcatcggtcagcgcatagagaacatcaagcacgagcataagagcacgtggcactacgacgaggacaacccctataagacctgggcgtatcacgggtcctacgaggtgaagccgagcggttcggctagcagcatggtgaacggcgtcgtcaagctcctgacgaagccttgggacgtgatccccatggtcacacagatcgccatgaccgacaccacgcccttcgggcagcagagggtgttcaaggagaaggtggacactcgcaccccaaaggccaagcggggtaccgcccaaatcatggaggtgaccgcgcgctggctgtggggtttcctaagccggaataagaaaccccgcatttgcacccgggaggagttcaccaggaaagtacgtagcaacgccgccattggggcggtgtttgtcgatgagaaccagtggaactccgccaaagaggctgtggaggatgaccggttctgggatcttgttcaccgggaacgtgagctgcataaacagggcaagtgcgcgacctgtgtgtacaacatgatgggcaagagagagaagaagctcggggagttcgggaaggcgaagggctctcgcgccatctggtacatgtggctgggcgcgcgctttctggagttcgaagccctcggttttatgaacgaggatcactggttctcccgcgagaacagcctatccggcgtggaaggagaggggcttcacaaattgggatacattctgcgggacatctcgaagatccccggcggcaacatgtacgccgatgacacggccgggtgggacacacgcatcaccgaggatgatctgcagaatgaggccaagatcaccgacatcatggagccggagcacgcgctgttagccaagtccatcttcaagctgacgtaccagaacaaagttgtccgggtgcagcgccctgccaagaacggcaccgtgatggacgtaatctcccgcagagatcagcgcgggtcaggccaagtgggcacctatgggttgaacaccttcaccaacatggaagctcagctgatacggcagatggagagcgagggcatcttcctgcctaacgagctcgagacccccaacctggccgggagagtgctggattggctcgagaagtacggcgtagagcggctgaagaggatggcgatctccggcgatgactgcgtggtgaagccgatagacgatcggttcgccacagccctgaccgctctcaacgacatgggaaaggtccgcaaggacataccccagtgggagcccagcaaaggctggaacgattggcaacaggtaccattctgctcccaccacttccaccagctcatcatgaaggacggacgggagatcgtggtcccgtgccgcaaccaggacgagttggtgggccgggcccgcgtgagccaaggggcgggctggagtctccgggaaaccgcctgtctgggcaagtcatacgcccagatgtggcagcttatgtacttccaccgcagagacctccggctggcagcgaacgccatttgcagcgccgtgcccgtggattgggtgcccacctcccggacgacctggagcatccacgcccatcaccagtggatgacgaccgaagacatgctgtcggtctggaatcgcgtgtggatcgaggagaacccctggatggaggataagactaggatctcaagctgggaggacgtgccgtacctcggcaagcgagaggaccagtggtgcggctcgttgatcgggctgaccgcccgggccacgtgggccacgaatatccaggtcgccataaaccaggtgcgacgccttatcggcaacgagaactactccgattacatgactagcatgaaacggttcaaaaacgagagtgagcccgagggggccctgtggtga

SEQ ID NO: 24502 - RNA, 9879 nt, synthetic construct
  misc_feature 1..9879: note = derived and/or modified CDS sequence (opt11) from DENV-1__GU131804__SS-prME
  source 1..9879: mol_type = other RNA
agcgtgacgatgttcctgatgctcatgcccactgccctggccttccatctaaccactcggggcggggagcctcacatgatcgtgtcgaagcaggagcggggcaagagcctcctgttcaagaccagcgccggggtaaacatgtgcaccctgatcgccatggacctcggcgagctgtgcgaggacaccatgacttacaagtgcccgcgcatcactgaaacggagcccgatgatgtcgactgctggtgcaacgccacggacacctgggtgacctatggaacctgcagccagacgggcgagcatcggcgcgacaagcgttccgtggccctggcgccgcacgtgggcctagggctggagaccaggaccgagacctggatgagctcagagggcgcctggaagcagatccagcgtgtcgagacttgggccctgcgccaccccgggtttaccgtgatcgccttgtttctggcacacgctatcggcaccagcatcacccagaaggggatcatcttcatcctgttaatgctggttacgccctccatggccatgcgttgcgtcggcatcgggagccgagacttcgtggaagggttatccggcgcgacctgggtagacgtcgtgctggagcatgggagctgcgtgaccaccatggccaaggataagcccacgctggatattgagcttctcaagaccgaggtcaccaaccccgcagtgctgcgaaagctgtgtatcgaggcgaagatttcgaacaccaccaccgactctagatgcccgacccagggcgaggccacccttgtggaagaacaggacgccaacttcgtctgccggcgcacgttcgttgaccggggctggggcaacggctgtgggctgttcggcaaggggtccctgatcacgtgcgctaagtttaaatgcgtgaccaagctcgaaggcaagatcgtccagtacgagaacctgaagtactcagtgatcgtaactgtccacacgggggaccagcaccaggtggggaacgaatccacagagcacgggacaaccgccaccatcacgccccaggcgcccaccaccgagatccagctgaccgactacggcgccctaacgttagattgcagcccccgcacgggccttgacttcaacgagatggtcctgctgaccatgaaggagaagagttggctggtgcacaaacagtggttcctcgacctgccgctaccctggacctcgggggccagcaccagtcaggagacctggaaccgtcaagatcttctggtgacctttaagacggcccacgccaagaagcaagaggtcgtggtgctgggctcccaagagggcgcgatgcacaccgccctgaccggtgccaccgagatccaaacctccggcacgaccaccatcttcgccgggcacctgaagtgccggctgaagatggacaaactcactttaaagggcatgagctacgtcatgtgcacagggtccttcaagctggagaaggagctcgccgagacacaacacggcacagtgctggtgcagatcaagtacgagggcactgacgcgccctgcaagatccccttcagcacacaggacgaaaagggtgtcacccagaacggccggctgatcaccgccaatccgatcgtgaccgataaggaaaaaccggtaaacattgaggcagagccgccgttcggggaatcgtacatcgttatcggcgctggcgagaaagcgctgaagctcagctggttcaagaagggctctagcatcggcaagatgttcgaggccaccgcccgaggggcccggcgcatggccatactgggcgataccgcatgggacttcggatccatcggcggggtgtttacaagcgtagggaagctggtccaccagatctttggcaccgcctacggggtgctgttctcaggcgtgagctggacgatgaaaatcgggatcggcgttctgctgacctggctaggcctcaactcccgcagcacctccttatcaatgacctgcatcgccgttgggctagttacgctgtatctgggcgtaatggtgcaggccgactccgggtgtgtaatcaactggaagggccgggaactcaaatgcgggagcggcatcttcgtcaccaacgaggtgcacacctggaccgagcagtacaaattccaggccgacagcccgaagcgcctctccgcggccatcggcaaggcctgggaagagggcgtgtgcggcattcggagcgccacccgcctggagaacattatgtggaagcaaatctcgaacgagctaaatcacatcctgctggaaaacgatatgaagttcactgttgtggtgggtgacgtcgccggtattctcgcgcagggaaagaagatgatccggccgcagccaatggaatacaagtatagctggaaaagctggggcaaggccaagatcataggcgccgacgtgcagaacaccaccttcatcatcgacgggcccaacacccctgagtgccccgacgaccagcgtgcctggaacatttgggaggtagaggactacggcttcgggatcttcacgaccaacatctggctgaagctgcgggacagctacactcaagtctgtgaccaccgcctcatgtcagcggccatcaaggactctaaggccgtgcatgccgacatgggctactggatcgagtccgagaagaacgagacctggaagctggcgcgagcgtcattcatcgaggtgaagacttgcatctggcccaagtcccacaccctatggagcaacggcgtacttgagtccgagatgatcatccccaagatttatggtggaccgatcagccaacataattacaggcccgggtacttcacccagactgccggcccctggcacctggggaagctggagctcgacttcgacctttgtgagggcacgaccgtggtggtcgacgagcactgcggcaaccgcgggccgtccttacgcaccaccacagtgaccggcaagatcatccacgagtggtgctgccggagctgcacccttccacccctccgctttcgcggggaggacggctgctggtacgggatggagatccgccccgtgaaggaaaaggaggagaatctggtcaagtctatggtgagcgccggcagcggcgaagtggactccttcagcctcgggctgctgtgtatttccatcatgattgaggaggtgatgcggagccgctggtcccggaagatgctcatgaccggcacgctggccgtgttcttcctactcataatggggcaactgacctggaacgacctgatcaggctctgcatcatggtgggcgccaacgcgtccgaccgcatggggatgggaaccacctaccttgctctgatggccacgttcaagatgcggccaatgttcgccgtcggtcttctgttccgccgactgacctccagagaggtactcctgctgacgatcgggctgagcttggtggcttccgttgagctccccaacagcctcgaggaactgggcgacgggctggcgatgggcataatgatccttaagctgctgactgacttccagtcccaccagctctgggccaccctgctgagcctcaccttcatcaagaccactttttccctgcactatgcctggaagacgatggccatggtgctgtccatcgtatcattatttccactgtgcctgagcaccacatcccagaagactacctggctccccgtgctgcttggcagtctcggttgcaagccgcttaccatgttcctgatcgcggagaacaagatatggggccggcgctcctggcccctcaacgaggggatcatggccgtgggcatcgtcagcatcctgctgagcagcctcctgaagaacgacgtcccacttgcggggcccctcatcgcgggcggcatgctgattgcctgctacgtgatcagcgggtcctctgcggacctgtccctcgaaaaggccgccgaggtctcctgggaagaggaggctgaacactccggcgccagccacaacatcctggtggaggtgcaggacgacgggaccatgaagatcaaggacgaggagagggatgataccctcacgatcctcttaaaggcgactctgctcgcggtctctggcgtgtatccgttaagcatccctgccaccctgtttgtctggtacttctggcagaaaaagaaacagcgttcaggggtcctctgggacactccatctccgcccgaggtggagcgggccgtcctggacgacggcatctaccgcatcatgcagcgcggtctgctggggcgctcccaggtaggcgtgggggtcttccaggagaacgtcttccacaccatgtggcacgtgacccggggcgccgtgctcatgtaccaggggaagagactagagccctcgtgggcgtccgtgaagaaggacctgattagctatggcgggggttggcggttgcagggctcctggaacaccggggaggaggtccaggtgatcgccgtggaacccggcaagaaccccaagaacgtgcagaccgctcccggaaccttcaaaactcccgagggagaagtgggtgccatcgccctggacttcaagcccgggaccagcggctcccccatcgtcaaccgcgaggggaaaatcgtgggcttgtacggtaacggtgtggtcacgaccagcggcacctacgtgtccgcgattgcccaggcccgggcctcgcaggagggacctctccccgagatcgaggacgaggtgttccgcaagcggaatctgaccatcatggacttacatcccggcagcgggaagaccagacggtacctcccggcgatcgtccgagaggccatcaagcgcaagctgcgtacactcatcctcgcgcccacgcgcgtggtggcgtctgagatggcggaggcgctgaagggaatgcccatacgttatcagaccaccgccgtcaagagtgagcacacgggtaaggagatcgtggacctgatgtgccacgccacgttcaccatgcgcctcctctcccccgtgcgggtcccgaattacaacatgatcatcatggacgaggcccacttcaccgatcccagctccatagcggcgcgcgggtacatcagcacaagggtaggcatgggggaggccgccgccatttttatgacagctacgccgcccggctccgtggaggcatttccgcagagcaacgccgtcatacaagatgaggagcgtgacatccccgaacgttcctggaacagcggatatgagtggatcacagacttccccggcaagaccgtgtggttcgtgccctccatcaagtcaggcaacgacatcgccaactgcctgcgcaagaacgggaaacgggtcatccagctttcccgaaagacattcgataccgagtaccagaagaccaagaacaacgattgggactacgttgtaacgacggacatcagcgaaatgggcgccaatttccgggcggacagagtcatcgacccgcggcgttgtctgaagcccgtgatcctgaaagacggtcccgagcgagtgatcttagctgggcccatgcccgtcaccgtggcctccgccgcccagcgccgggggcgcatcggtcgcaaccacaacaaggagggcgaccagtatatctacatggggcaacccctgaacaacgatgaggaccacgcgcactggaccgaggccaagatgctgctagacaacattaacaccccagagggcataatccccgccctgttcgagccggaacgggagaagtccgccgcaatcgacggggagtaccggctgcggggcgaagcgagaaagacgttcgtagagctcatgcggcgcggggatctgcccgtgtggctgagctacaaggtggccagcgagggctttcagtacagcgaccggcgctggtgcttcgacggcgagcgtaacaaccaggtcctcgaggagaacatggacgtggaaatctggaccaaggaaggggaacgcaagaaactgcggccgcgctggctggacgcccggacttatagcgaccccctcgcactgcgcgaatttaaggagttcgccgcgggccggcgcagcgtttccggggatctgatccttgaaatcggcaagctgcctcagcacctgacccagcgggcgcagaacgcccttgacaacctggtcatgctgcacaacagcgaacagggagggcgcgcctaccggcacgcgatggaggagctgcccgacacgatcgaaaccctgatgctgctcgctctaatagccgtgcttaccggcggggttacactcttctttttgtcaggccgcgggctcggcaagaccagcataggcctcctgtgcgtgatggcttccagcgtgctactatggatggcctctgtggagccccactggatcgcggccagcattatcctggagtttttccttatggtcctgttaatcccagagccggatcggcagcgcacgccccaggataaccagctggcctacgttgtgatagggcttctgttcatgattctgaccgttgccgcaaacgaaatgggattgttggagaccaccaaaaaggacctgggcatcggccacgcggccgtcgagaaccaccaccacgccgccatgctcgacgtcgacctgcatcccgcctccgcgtggacactgtacgcggtagccaccaccatcatcaccccgatgatgcgccacacgatagaaaacaccaccgccaatatcagcctcaccgccatcgcgaaccaagccgccatcctgatggggctggacaagggatggcctatctctaagatggacatcggcgtgcccttactggccctggggtgttacagccaggtgaaccccctcacgctgaccgccgccgtcctgatgctcgtggcccactatgctatcataggcccggggctgcaggcgaaggctacacgggaggcccagaagcgcaccgccgccggcatcatgaagaaccccacggtggacggcatcgttgccatcgacctggaccccgtggtgtacgacgccaaattcgagaagcagctcggccagatcatgctgctgatcctctgcacctcccagatcctgctcatgcggacgacctgggccctctgtgagagcatcacgctggccactgggcccctgaccaccctctgggagggttccccgggcaagttttggaacacaactatcgctgtgagtatggccaacatcttccgcggctcctacctggcgggcgccggactggccttctctctcatgaagtccctcggtggtgggcggcgcggtacgggcgctcagggcgagactctgggtgagaagtggaagcggcagctcaaccagctgagtaagagcgagttcaatacgtacaagcgctccgggatcatggaggtggatcggagcgaggctaaagaaggcctgaagcgcggggagaccaccaagcatgccgtctcccgaggcaccgccaagttgcgctggttcgtcgagcggaacctggttaagcccgaggggaaggtgatagacctaggctgcggtcgcggaggatggagctactactgcgccgggctgaagaaagtcacggaggtgaaaggctacacgaagggcggccccggccacgaggagcccatcccgatggctacctacgggtggaacctcgttaaactgcactccgggaaggatgtcttcttcatcccgcctgagaagtgcgataccctgctctgcgacatcggagaaagctcccccaatccgactatcgaggagggccggaccctgagggtgctgaagatggtggaaccctggctcagagggaaccagttctgcatcaaaatcctgaatccctacatgcccagcgtcgtggagactctggagcagatgcagcgcaagcacggcggcatgctcgtgcggaacccgctgtcccgcaacagcacccatgagatgtactgggtctcctgcgggaccggcaacattgtgagcgcggtgaacatgacgtcccgcatgctgctcaacaggttcaccatggcccacagaaaacctacctacgagcgggacgtcgacctgggggccggcactcgccacgtggccgtggagcccgaggttgcgaatatagacatcatcgggcagcgcatagagaacataaagcacgagcacaagagcacatggcactacgacgaagacaatccatacaagacgtgggcgtaccacggatcctacgaggtgaagccgagcggcagtgccagctcgatggtgaacggggtcgtgaaacttctcaccaagccctgggacgtcatccccatggtgacccagatcgccatgaccgacaccacccctttcggtcagcaacgcgtgttcaaggagaaggtcgacacccggacgccgaaggccaagcgggggaccgcccagatcatggaggtgacggcgaagtggctgtggggctttttatcccggaacaagaagccccgaatctgcacccgggaagagttcacgagaaaggtgagaagcaacgccgcgatcggcgccgtcttcgtggacgaaaaccagtggaactccgcgaaggaggccgtggaggacgagcgcttctgggacctcgtgcaccgggagcgcgagctgcacaagcaggggaagtgcgcgacatgcgtgtacaatatgatggggaagcgagagaagaagctgggggagttcggaaaggccaaaggcagccgcgctatctggtacatgtggctaggcgcgcgattcctcgagttcgaggccttgggattcatgaatgaggaccactggttctcccgagagaacagcctctccggggtcgagggggaggggctgcataagctgggctacatactccgggatataagcaaaatccccggcggcaacatgtatgccgacgacactgccggctgggacacccgcatcacggaggacgatctgcagaacgaagcccgcatcaccgacatcatggagccggagcacgcgctgctcgccaagtccatctttaagctgacctatcagaacaaggttgtgcgggtgcagaggccggccaagaacgggaccgtcatggacgtgataagccggagagaccagcggggctccggccaggtggggacgtacggactgaacaccttcactaacatggaggcccagctcatccggcagatggagagcgagggcatcttctcccccagtgagctggagaccccaaacctggccgaacgggttctggactggctggagaagtacggcgtggagcgcctgaagcggatggccatctccggggacgactgcgtggtcaagccgatcgacgaccgtttcgcaacggcactaaccgccctgaacgacatgggcaaggtgaggaaagacatcccccagtgggagcccagcaaagggtggaacgactggcaacaggtccccttctgctcgcatcactttcaccagctaatcatgaaggatggccgggagatcgtcgtaccgtgcagaaaccaggacgagctcgtgggccgcgcccgggtcagccagggggccgggtggagcctgcgcgagactgcctgcctggggaagtcctacgcccagatgtggcagctcatgtacttccatagacgcgacctgcgtctagccgcgaacgccatctgttccgccgtgcctgtggactggatccctacctccaggacgacctggagcatccacgcccatcaccagtggatgaccaccgaggacatgctctccgtctggaaccgcgtgtggatcgaggagaacccctggatggaagacaagacgcacatctcctcctggggcgacgtgccgtacttagggaagcgagaggaccagtggtgcgggagcctaatcggccttaccgcccgggcgacttgggcgaccaacatccaggtcgccatcaaccaggttcggcgcctgatcgggaacgagaactacctggactacatgacctccatgaagcgcttcaaaaacgagagcgaccccgaaggcgctctctggtag

SEQ ID NO: 24503 - RNA, 9879 nt, synthetic construct
  misc_feature 1..9879: note = derived and/or modified CDS sequence (opt11) from DENV-1__GU131805__SS-prME
  source 1..9879: mol_type = other RNA
agcgtgaccatgctgctcatgttgatgcccaccgccctggcgttccacctcaccaccagaggaggagagccccatatgatcgtgtcgaagcaggagcgcggcaagagcttgctgttcaagaccagtgcgggtgtaaacatgtgcaccttgatcgccatggacctgggcgaattttgcgaggacaccatgacctacaagtgcccacgcatcaccgaggccgaacccgacgacgttgactgctggtgcaatgccactgacacctgggtcacttacggaacctgcagtcagaccggtgaacataggcgcgacaaacggtccgtggccctggcgccccacgttggcctgggcttggaaacgcgcacggagacctggatgtcgtccgaaggcgcctggaaacaaatccagcgggtggagacctgggccctgcgccaccccggcttcacggttatcgcacttttcctggcacacgccatcggcaccagcatcacgcagaaggggatcatcttcatcctgctcatgctggtgaccccctctatggccatgcggtgcgtggggatcgggagccgcgacttcgtcgaagggctgtccggcgccacgtgggtggacgttgtgctcgagcacgggagctgcgtgactaccatggccaaggacaagcccactctcgatatcgagcttctcaagacggaggtcaccgatcctgccgtgctgcgcaagctttgtatagaagccaagatctccaacaccaccacggactcccgctgcccaactcagggtgaggcaacactcgtggaggagcaggacgctaactttgtctgccggcgcaccttcgtggatcggggctggggtaacggctgtggactgttcggcaaagggagccttatgacttgcgccaagttcaagtgcgtgaccaagctcgaaggaaagatcgtccaatacgagaatctgaagtacagcgtgatagttacagtacatactggcgatcaacaccaagtggggaacgagagtacggagcacggcaccaccgctaccatcactccgcaggcccccagccccgagattcagctgcccgactacggggccctcacgctggactgcagccccagacccggcctggacttcaatgagatggttctcctgccaatgaaggaaaagtcctggctggtgcacaagcagtggttcctcgacctaccgctgccatggacaagcggggcctccaccagccaagagacgtggaatcggaaggacctcctgggcacgttcaagaccgcccacgcgaaggagcaggaagtggtcgtgctgggttcccaagagggggccatgcacaccgccctgacaggcgcaacagagatccagaccagcgggaccaccactatatttgccggccacctgaagtgccggctgaagatggacaagctcaccctgaaggggatgtcctacgttatgtgcacgggcagcttcaagctggagaaggaagtcgcagagacccagcacggcacggtgctcgtgcagatcaaatacgaggggacagacgccccatgcaagatccccttctccactcaggacgaaaaaggcgtcacacagaacgggcggctgatcaccgctaacccgattgtgacagacaaggagaagcccgtgaacatcgaggcggagcccgccttcggcgagagctacatcgtcatcggcgccggggagaaggccctgaagctgtcctgggtgaagaaaggcagctctatcgggaaaatgtttgaagccaccgcacgcggcgcgagacgcatggccatcctcggggacaccgcctgggatttcggtagcataggaggggttttcacatccgtaggtaagttggtgcaccaaatcttcgggaccgcatacggcgtgctgttctcgggggtctcctggaccatgaagatcggcatcggcgtgctactgacttggctcggcctcaacagccgcagtacgagcctatccatgacctgtattgccgttggtctggtcacactctatctgggggtgatggtgcaggcggatagcggctgcgtcatcaactggaagggtagggagctgaagtgcggcagcggaatcttcggaaccaacgaggtgcacacgtggaccgaacagtacaagtttcaagctgactctcccaagcgtctcagcgccgccatagggaaggcctgggaggagggggtgtgcgggatccggtccgcgacccgtctggagaacatcatgtggaagcagatcagcaacgagctgaaccacatcctcctggagaacgccatgaagctgaccgtggtggtgggggacgtcgccggcattctcgcccagggcaagaaaatgatcagaccgcaacccatggagtacaagtactcttggaagtcctgggggaaggcgaagatcatcggcgccgacgtccagaacactaccttcatcatcgacgggccgaacacccccgagtgccctgacgatcagcgcgcctggaacatctgggaggtggaggactacggcttcggcatcttcaccaccaacatctggctgaagctgcgggacagttacacgcaagtctgcgaccaccgcctgatgagcgccgctatcaaggactccaaggcggtgcacgccgacatgggctattggatagagagcgagaagaacgagccctggaaactggcccgggcgagtttcatcgaggtgaaaacgtgcatctggcccaagagccacaccctgtggagcaacggcgtgctcgagagcgagatgatcatcccgaagatttacgggggtcccatctcccagcacaactaccgcccagggtacttcacccaaacggccggcccatggcacctgggcaaactagagctcgacttcgatctctgcgaagggaccacagtggtggtcgacgagcactgcggcaatcgggggcctagcctgcgcaccacgaccgtgcccggcaagatcatccatgagtggtgctgccggagttgcactctgccgcccctccgctttaagggggaggatggctgctggtacggcatggagatctctccggtgaaggagaaggaagagaatctggtcaagagcatggtgagtgcggggtcaggcgaagtggactcgttcagcctagggctgctgtgcatctccatcatgatcgaggaggtaatgcggagccgttggtctaggaaaatgctcatgacaggccccctgccagtgttcttcttgctcataatggggcaactcccctggaacgacttgatccgcctctgcatcatggtgggcgctaatgccagcgatcggatgggcatggggacgccgtacctggcattaatggccaccttcaagatgcgccccatgttcgcggtaggcctcctgttccgccggttaaccagccgcgaaggactactgctgaccattggcctaagcctggtggcttccgtggagcttcccaactcgctcgaggagctgggcgacgggctggccatgggcatcatgatcctcaagctgctgaccgacttccagtcccaccagctctgggccaccctgctggcgcttacctttatcaagaccactttcagcctggattacgcctggaagaccatggcaatggtcctgtcaatcgtgagcctcttccccctgtgcctgtccaccaccagccagaagacaacatggctcccagtactgctggggtccttaggctgcaaacccctgactatgtttctgatcgccgagaataagatctggggtcgcaagagctggcccctcaacgagggtatcatggccgtgggcatcgtaagcatcctgctatcagcgctcctgaagaatgacgtccccctggccgggcccctcattgccggcgggatgcttattgcctgttacgtgatcagcgggtcctctgccgatctctcactcgagaaggccgccgaggtgagctgggaggaggaggccgagcactccgggggcagccacaacattctagtcgaggtccaggacgacggcaccatgaagatcaaggacgaggaaagggacgcgacactgaccatactcctgaaggctacgctgctggcggtgtccggggtctatcctctatctatccccgccaccctgtttgtgtggtacttctggcagaagaagaagcagcgctcaggcgtgctctgggacacgcccagcccgcccgaggtcgagcgcgcagtgctggacgacgggatctaccggatcatgcagcgcggattgctcgggcggtcccaggtgggcgtcggagtgttccaggagaatgtgttccacaccatgtggcatgtcacgcgcggcgccgtgttaatgtaccagggcaagcggctggagccctcctgggcctccgtaaagaaggacctgatcagctatggaggcgggtggcgcctccaggggtcctggaacacgggcgaggaggtccaggttatcgcggtggagccggggaagaatcccaagaacgtccagacagccccgggcaccttcaagaccagcgagggggaggtgggcgcgatcgccctggacttcaagcccggcacctctggcagtccgatcgtgaacagagagggaaagatcgtcggactgtacgggaacggggttgtgaccacaagcggcacgtacgtctccgcgatcgcccaggccaaggccagccaggagggccccctccccgagatagaggacgaagtgtttcgcaagcggaacctgaccatcatggacctgcaccccgggtccggcaaaacccgccggtacctaccggccattgtgcgcgaagcgataaaacgcaagttgcgcactctgatcctcgcccccacccgggtcgtggccagcgagatggcggaagcccttaaggggatgcccatccgttaccagaccaccgcggtgaaaagcgagcacacgggcaaggagatcgtcgacctgatgtgccacgccaccttcaccatgagactcctgagcccggtgcgggtgccgaactataacatgataatcatggacgaagcccatttcaccgatccatccagcatcgctgctcgcggctacatctctacgagagtcgggatgggggaggcggctgccatcttcatgacggccacgccgcccgggtccgtggaggcgtttccgcaatccaacgccgtgatccaggacgaggagcgcgacatccccgaaagaagctggaactccggttacgagtggatcaccgacttccccggcaaaacggtctggttcgtgccaagcattaagtcgggcaacgatatcgccaactgcctgcgcaagaacgggaagcgggtgatccaactcagccgcaagaccttcgacaccgagtaccagaagaccaagaacaatgactgggattatgtcgtgacgaccgacatctccgagatgggcgctaacttccgggccgaccgcgtgatcgacccgcgtcgctgcctgaagcctgtcatcctgaaggatggccccgagcgggtgatcctcgcggggccaatgccggtgacagtcgccagcgccgcccagcgccggggccgcatagggcgcaaccacaacaaggagggcgaccagtacatctacatggggcagccactgaacaacgacgaggaccacgcccactggaccgaggcgaagatgctgctagacaacatcaatacgcccgagggcataatccccgcactgttcgaaccggagcgcgagaaatcagccgccattgacggcgagtaccggctgcgcggggaggcccggaagaccttcgtggagctcatgcggcgcggcgacctgcccgtttggttgagctacaaggtagcgagcgaggggttccagtactccgatcggcgatggtgcttcgacggcgagcggaacaatcaggtactcgaggaaaacatggatgtcgagatctggactaaagagggagagcgcaagaagctgcggccccgctggctggacgcccggacctactcagacccgcttgccctgcgcgagttcaaagagttcgcggcggggcggcgctcagtgtccggggacctgatcctcgaaattgggaagctgccccagcacctcacgcaaagggcacagaacgccctcgacaacctggtaatgctgcacaactccgagcagggggggcgcgcctaccggcacgccatggaggaactccccgacaccatcgagaccctgatgctgctcgccctgatcgccgtcctgaccggcggcgtgacactgttcttcctgagcggccgcggcctggggaaaacctccatcggcctactgtgcgtaatggcgagcagcgtcctgctgtggatggccagcgtggaaccccactggattgccgcgtcgattatcctggagttcttcctgatggtgctcctgatcccggagcccgaccggcagcgcactccccaggacaaccagctggcctacgtcgtaatagggctgctgtttatgatcctaacggtggccgccaacgagatgggactccttgagaccaccaagaaggatctgggcatcggtcacgtcgcagtggagaaccaccaccatgcggccatgctcgacgtggacctgcaccccgccagtgcctggacactatacgccgtcgcgaccacgatcatcaccccgatgatgcggcacaccatcgagaacaccaccgccaatatctccctcacggccatcgccaaccaggcggccatactcatggggctggacaagggttggcccatcagcaagatggacatcggcgtgcccctgctggccctggggtgctactcccaggtgaaccccttgaccctgaccgccgccgtcttaatgctcgtagctcactacgccatcatcgggccgggcctacaggccaaggccactcgcgaggcccaaaagcggacggccgccgggattatgaagaaccccactgtcgatggcatcgtcgccatcgacctggaccccgtggtgtatgacgcaaaattcgagaagcagctcggtcaaatcatgttgctcatcctctgcaccagccagatcctgctgatgcgtaccacgtgggccctctgcgagtccataactcttgcgaccggtccgctaaccacgttatgggagggcagtccggggaagttctggaacaccaccatcgccgtctcgatggcaaacatctttcgcggcagctacctggccggggccggcctggcctttagccttatgaagtccctcgggggcgggcgccgcgggaccggcgcccaaggcgagacgctgggagagaagtggaagcggcaactcaaccagctgagcaagagcgagttcaacacctataagcggagcggcatcatggaggtggaccggtccgaggccaaggagggcctgaagagaggcgagaccaccaaacacgcagtgagcagggggactgcgaaactccgctggttcgtcgagcggaacctggtgaagccggaaggaaaggtgatagacctggggtgcggccgcgggggctggtcctactactgtgctggcctgaagaaggtcacggaggtgaaggggtacaccaaaggcggtcccggccacgaggaacccatccctatggcgacgtacgggtggaacctcgtcaagctgcacagcggaaaggacgttttcttcattcccccagagaagtgcgacacgctgttatgcgacatcggcgagtccagtccaaacccgacaatagaggagggtcggaccctgagagtactgaagatggtggagccctggctccggggcaaccagttctgcatcaaaatcctgaacccatacatgccctcggtcgtggagaccctggagcagatgcagcgcaagcacgggggcatgctcgtgcggaacccactgagcagaaactccacacacgagatgtactgggtctcatgcggcaccgggaatatcgtgtccgccgtgaacatgaccagccggatgctgctcaaccgtttcactatggcccatcggaaacccacgtatgagagggacgtcgacctgggcgcgggcaccaggcacgtggccgtggagcccgaggttgctaacttggacatcatcgggcagcgcatcgaaaacatcaaacacgagcacaagtcaacatggcattatgatgaggacaacccgtataagacttgggcctaccacggaagctacgaagtgaagccctccggctccgctagcagcatggtgaacggcgtcgtgaagctactgactaagccctgggacgtcatccccatggtgacccagatcgcgatgaccgacaccaccccgtttgggcaacagcgcgtgttcaaggagaaggtggacacgagaacccctaaggccaagcgtggcaccgcccagatcatggaggttaccgccaagtggctgtggggattcttgagccggaacaaaaagccccgcatctgcacgcgggaagagttcacccgcaaggtgcggtccaatgcggccatcggcgcagtgttcgtggatgagaaccagtggaacagcgccaaggaggccgtggaggacgagcgcttctgggatctagtccatcgggagcgcgagttacacaagcaggggaagtgcgcgacttgtgtgtacaacatgatgggcaagcgggagaagaaactcggcgagttcgggaaggccaagggctcacgcgccatctggtacatgtggctgggggcccggttcctggagtttgaggccctcgggttcatgaatgaagaccactggttcagccgcgaaaattccctgagcggtgtggagggcgagggcctgcacaagctcgggtacatcctgcgggacatctccaagatccccggcgggaacatgtacgcggacgatacggccggttgggatactcgcataaccgaagacgacctgcagaacgaggccaagataaccgatatcatggagccggagcacgccctcctggccaagtctatcttcaaactgacctaccagaacaaggtcgtgcgggtgcagcgccccgcgaagaacggcacggttatggacgttatctcccggagggaccagcgcggcagcggccaggtggggacctacggtttgaacacattcaccaatatggaggcccaactgatccggcagatggagtccgaggggatcttctcgccctcggagctggaaacgcccaacctcgccggccgcgtcctggactggctggagaagcatggcgtcgagcggctcaagcgcatggccattagcggggatgactgcgttgtcaagccgatcgatgaccggttcgccgcggcacttaccgccctgaacgacatgggcaaggtgcgcaaggacatcccccagtgggagccctccaaggggtggaacgactggcagcaggttcctttctgttcgcaccacttccatcagctcatcatgaaggacggcagagagatcgtcgtgccgtgtcgaaatcaggacgagttggtgggacgggcccgggtgtctcagggcgcgggctggtccctgcgggagaccgcctgcctcggcaagagctacgcccagatgtggcagttaatgtacttccaccgacgggacctgcgcctcgccgcaaacgcgatatgctccgccgtgcccgtggattgggtgcccaccagcaggacgacttggtccatccacgcacaccaccagtggatgaccaccgaggacatgctgagcgtctggaaccgagtgtggatcgaggagaacccatggatggaggacaagacgcacatatccagctggggtgacgtcccatacctgggcaagcgggaggatcagtggtgcggcagtctcatcgggctcaccgccagagctacttgggcaaccaatatccaggtggccattaaccaggtgcggcgcctgattggtaacgagaactacttggactacatgacgagcatgaagcgcttcaagaatgagtccgaccccgagggcgccctttggtag

SEQ ID NO: 24504 - RNA, 9879 nt, synthetic construct
  misc_feature 1..9879: note = derived and/or modified CDS sequence (opt11) from DENV-1__GU131806__SS-prME
  source 1..9879: mol_type = other RNA
agcgtgaccatgtttctgatgttgatgccaacagccctggccttccacctgaccacccggggcggagagccacacatgatcgttagcaagcaggaacgggggaagagcctgcttttcaagaccagcgccggggtaaatatgtgtaccctgatcgccatggacttaggcgagctgtgcgaggataccatgacctacaagtgccctcggatcacagaaactgagcccgacgacgtggactgttggtgcaacgccacggacacctgggtcacttacggtacatgcagccaaacgggcgagcaccggcgcgacaagcggtccgtggcattagcgccccacgtgggcctcgggctggaaacccgcaccgagacttggatgagctccgagggtgcgtggaagcaaatccaacgggtcgagacgtgggccctgcgtcatccggggttcaccgtgatcgccctctttttagctcacgcgatcggcacctcaatcacccagaagggcatcatcttcatcctgctcatgctggtgacgccctccatggcgatgaggtgcgtcggcataggaagccgcgattttgtggagggtctcagtggcgccacctgggtggacgtagttctcgagcacgggagctgtgtgaccacaatggccaaggacaagccgacactagatatcgagcttctcaagaccgaagtcaccaaccccgcggtgctgcggaagctgtgcatcgaagcaaaaattagcaacaccacgacagattcccgctgtcccacacaaggggaggcaaccctggtggaggagcaagacgccaacttcgtgtgccggagaactttcgtcgaccgggggtggggcaatggatgcggcctgttcggcaaggggtccctgatcacgtgcgccaagttcaagtgtgtgacaaaactcgaggggaaaatcgtccagtacgagaatctgaagtattccgtaatcgtgaccgtccacaccggtgaccaacatcaggtgggcaatgagtcaaccgagcatggaacaaccgccaccatcacgccccaggcacccaccaccgagatccagttgactgactacggggccttgacgctggattgcagcccgcgaactggcttagacttcaacgaaatggtactcctgactatgaaggagaagtcctggctggtgcacaaacagtggttcctcgacctgccgctggcttggactagcggcggttctacgtcccaggagacctggaaccggcaggatctcgtggtcaccttcaagaccgcccacggcaagaagcaagaggtagtggtactggggtcccaggagggggccatgcacaccgctctgaccggggccaccgaaatacaaacttcgggcacgaccactatcttcgccgggcacctcaagtgcaggctgaaaatggataagctgacactcaagggcatgtcatacgtgatgtgcacgggctcctttaaactggagaaggaactggcagagactcagcatgggaccgtcctcgtacagataaagtacgagggcaccgatgcaccttgcaagatccccttcagcacgcaggacgagaagggtgtgacccagaacggacgactgatcaccgccaatccaatcgtgaccgacaaggaaaagccggtaaatattgaggccgaaccgccgttcggcgagtcctatatcgtgataggagccggagagaaggccctgaagctgagctggttcaagaaggggtcgagcatcggcaagatgttcgaggccacggcccgcggtgcccggcgcatggccatcttgggggacacagcctgggacttcgggtccataggtggggtgttcacctctgtcggaaaacttgtgcatcagatctttggcaccgcgtacggggtgctgttcagcggcgtaagctggacgatgaagatcggcatcggggttttactgacctggctgggacttaactcccgctcgacaagccttagcatgacatgcattgctgtggggctggtcacgctttacctgggcgtaatggtgcaggcggacagcgggtgcgtcattaactggaagggccgggagctaaagtgcggtagcgggatcttcgtgacaaacgaggtgcacacctggaccgagcagtacaagttccaagctgactcccccaagaggctctccgccgcgataggtaaggcctgggaggagggggtctgcggaatccggtctgccaccagattggaaaacatcatgtggaagcagatctctaatgagctgaaccacatactcctagagaacgatatgaagtttacggtggtggtgggggatgtcgcggggatcctggcccagggcaaaaaaatgatccgtccgcagcccatggagtacaagtactcgtggaagtcctgggggaaggcgaagatcattggcgccgacgttcagaacaccactttcatcatagatgggcccaacacacccgagtgccctgacgaccagcgcgcttggaacatctgggaggtagaagactatggctttggcatcttcacgactaacatctggttaaagttacgggactcctatactcaggtttgcgaccaccgcctgatgtcggcagcgatcaaggacagcaaggcagtgcatgcagacatggggtactggatcgagtccgaaaagaatgagacttggaaattggcgcgggccagcttcattgaggtcaagacgtgtatctggcccaagtcacacaccctgtggagcaacggcgtgctagagagcgagatgatcatccccaagatctatgggggccctataagccaacacaattatcgccctggttacttcacccagaccgcgggaccttggcatctcgcaaagctggagctcgacttcgacctatgtgagggcacgaccgtggttgtggacgaacactgcggcaaccggggcccttccttgcgcaccaccacggtgaccgggaagatcatacatgagtggtgctgccgctcttgtacccttccgcccctgcgcttccggggcgaggacggatgctggtacggcatggaaatccggcccgtcaaggagaaagaggaaaacctggtgaagtccatggtgagcgctggcagcggagaggtcgacagttttagcctggggttactttgcatctccatcatgatagaggaggtgatgcggagccgatggtctcggaagatgctcatgacgggaacactcgcagtcttcttcctgttaattatgggccagttaacgtggaacgacctgatacgcttatgtatcatggtcggcgccaatgcgagcgatcgcatggggatggggaccacgtaccttgcccttatggccacgttcaagatgcggcccatgtttgccgtggggctcctgttccgccggcttaccagtcgcgaggtgcttctcctgacaatcgggctttcactcgtagccagtgtcgagctaccgaattctcttgaggagctgggcgacggcctggcgatgggcatcatgatcctgaaactcctgaccgacttccagagccaccagctgtgggccacgctcctgagcctgaccttcatcaagaccacctttagtctccactacgcctggaagacgatggccatggtcctgtcgatcgtctcattgttccccctctgcctgagcaccacatcccagaaaactacgtggctgcccgtgctcctgggtagtttagggtgcaagcccctcactatgttcctgatcgctgagaacaagatctgggggcggcgctcctggccgctgaacgaaggcattatggccgtcggaattgtgagcatcctcctgagctccctgctcaagaacgatgtgcccctcgccggccccctgatcgccggagggatgctcatcgcatgctacgtcatcagcggatccagcgcggacctgtcgctagagaaggccgccgaggtgagctgggaggaggaggctgaacacagcggcccctcacacaacatactcgtggaggtccaggacgacggcccaatgaagatcaaggacgaggagcgggacgataccctaacaatcctcttgaaggcaaccctactcgccgtgtccggggtttaccccctcagcatccccgccaccctgtttgtatggtacttctggcagaaaaagaagcagcgctccggagtgctgtgggacactccgagcccgcccgaggtggagcgagccgtcctagacgacggcatctaccgcataatgcaacggggtctgctgggccggtcccaggtgggtgtgggcgtcttccaggagaacgtcttccacactatgtggcacgttacccgcggggcggtactgatgtaccagggaaagcgtctcgaacccagctgggcctccgtgaagaaggatttgatcagctatggcgggggctggcgcctgcaagggtcctggaatacgggcgaagaggtccaggtaatcgcggtggagcccgggaaaaacccgaagaacgtccaaaccgcacccggtacattcaaaacccccgaaggcgaggtgggggccattgccctggacttcaagcccggcaccagcgggtcccctatcgtaaatagagagggcaagatcctgggactgtacggtaacggcgtggttacgaccagcggtacctacgttagtgcaatcgcccaggcccgggcctcccaagagggccccctccccgaaatcgaggacgaagtgttcaggaaaaggaacctgacaatcatggatctgcaccccgggtcgggcaaaacccgccggtacctccctgccatcgtcagggaggccatcaagcgcaaactgagaactctaatcctagcacccacccgcgtggttgcgtccgaaatggcagaggcgcttaagggaatgcccatccggtaccagacgacggcggtaaaaagcgagcatacggggaaagagatcgtggacctgatgtgccacgccaccttcaccatgcgtctcctgtccccggtgcgggtcccaaactacaacatgataatcatggacgaggcccactttaccgatccctcctccatcgccgcccgcggttatatctcgaccagagtgggaatgggcgaggcggcagccatcttcatgaccgccacgcccccggggtccgtggaggccttcccccagagcaacgcggtaatccaggacgaggagcgcgacatccccgagcgcagttggaacagcgggtacgagtggatcacggacttccccggcaaaaccgtgtggttcgtgccgtccatcaagagcggcaacgatatcgctaactgcctacgtaagaacggcaaacgggtgatccagctgtcccgcaagaccttcgacacggagtatcagaagaccaagaacaacgactgggattacgtggtgaccacagacatcagcgagatgggagccaacttcagggctgaccgggtcatcgacccacggcgctgcctgaagcccgtgatcctgaaggacggccccgagagagtgatcctcgcaggaccaatgcccgtgaccgtggcctccgcggctcagcgccggggccgcatcggccgcaatcacaacaaggagggggaccagtacatctacatgggccagcccctgaataatgatgaagaccacgcccattggaccgaagcgaagatgttgctcgacaacattaacacccccgaagggatcattccggcattattcgagcccgagcgggagaagtcggcggcgatcgatggcgagtatagactgcgcggggaggcccgcaagacgttcgtcgaattaatgcggaggggcgatctgcccgtgtggctctcctataaggtggcttcagagggctttcaatacagcgaccggcgctggtgcttcgacggcgaacgtaacaaccaggttctcgaggagaacatggacgtggagatctggacgaaggagggcgagcgcaagaagctgaggccccgctggctagacgcccggacttactccgatccgttagcccttcgcgagttcaaggagttcgcagccgggagacgcagcgtgagtggcgacttgatcctagagattggcaagctgccccaacacctgacgcagcgggcccagaacgccttggataacctggtcatgctacacaattctgagcagggcgggagagcctaccggcacgccatggaggagctaccggacaccatcgagacgctgatgctcctcgcgcttatcgccgtcctaaccgggggcgtgaccctcttcttcctgagtggacgcggcctgggcaagaccagcattgggttactgtgcgtcatggcgagcagcgttctgttatggatggcatcggtggagccccactggatagccgcgagcatcatcctggagttcttcctgatggttctcctgatcccggagcccgatcggcaacgcacgccacaagataaccagctcgcctacgtcgtgatcggcctcctgttcatgatcctgacggtcgctgccaacgagatgggacttctggaaaccaccaaaaaagatttaggcatcgggcacgtggccgtggagaaccaccatcatgcggccatgctagacgtggacttacacccggcctccgcctggaccctctacgccgtggctacgactatcattacccccatgatgaggcatactatcgagaacacgacggccaacatcagcctcaccgctatcgcgaaccaggccgctatactgatgggactggataagggctggccgatctccaagatggacatcggagttcccttactggcactgggctgctacagtcaggttaacccgctcacgctgacggccgcagtactcatgctcgtggcgcactacgccatcatcggtccaggcctgcaggccaaagccacccgggaagcccagaagcgcacggcggcggggatcatgaagaacccaaccgtcgacggcatcgtggccatcgacctggaccccgtggtctacgacgccaagttcgagaaacagctagggcaaataatgctgctgatactctgcacgtcccagattctgctgatgcggaccacctgggctctctgtgagtctattaccctggcgactgggccgctaaccaccctctgggagggctcccccggcaagttttggaacaccactatcgcagtgagcatggccaacatcttccgcggatcctacctggcgggcgccgggttagccttctctctcatgaaatccctgggcgggggccgacgcggtaccggagcacaaggcgagactctgggggagaagtggaagcggcagctcaaccagctgtccaagtcggaattcaacacttacaagaggtcaggcatcatggaggtggaccggagcgaagccaaggaggggctgaaacgcggcgagactaccaagcatgccgtgtcgcggggcacagcgaagctccgctggttcgtagagcgtaacctggtgaaacccgaaggaaaggtcattgatctgggatgtgggcgcggtggatggtcctactactgcgccggcctgaaaaaggtgactgaggtaaagggctatacgaaaggcggccccgggcacgaggagccgatccctatggccacatacggctggaatctcgttaagctgcactccggtaaggacgtgttcttcatcccacccgagaagtgcgacaccctgctttgtgatattggcgagagctccccgaaccccaccatcgaagagggacggacgctacgagtgctgaagatggtagagccctggcttagagggaaccagttttgcatcaagatcctgaacccctacatgccgtctgtagtggagaccttggagcagatgcagagaaagcacggggggatgctagtccggaacccgctgtcccgcaacagcacgcatgaaatgtattgggtcagctgcgggacggggaacatcgtgagcgctgtaaacatgacctcccgaatgctgctcaatcggtttaccatggcgcaccgtaaacccacctacgagcgggacgtggacctgggcgcgggcacccggcacgtggcagtcgaacccgaggtggccaacctggacatcatcggacagcggattgagaacattaagcacgagcataaaagcacatggcactacgacgaggataatccctacaagacgtgggcgtaccacggctcttacgaggtcaaaccatctggatccgcctcctcgatggtgaacggcgtagtgaaactcttgactaaaccctgggatgtgatccccatggtgactcagatcgcgatgaccgacacaaccccgttcggccaacagcgcgtcttcaaagagaaggtggatacccgcacccccaaggccaagcgcggcaccgcccaaataatggaggtgacggccaagtggttatggggcttcctctcccggaacaagaagccgagaatctgcacccgtgaagagtttacgcggaaggttcggagcaacgccgcgatcggggcggtgtttgtggatgagaaccagtggaactccgccaaggaggcggtggaggacgaaaggttctgggacctggttcaccgcgagcgagaactgcacaaacagggcaagtgcgcaacttgcgtgtacaatatgatgggtaagcgggagaagaagttgggggaattcggtaaggccaagggtagccgcgccatctggtacatgtggctgggtgccaggtttttggagttcgaggcacttgggtttatgaacgaagaccattggttttcacgtgaaaacagcctgtcaggtgtcgagggggagggcctgcacaagttaggctacatcctccgggacatcagcaaaattccaggcgggaacatgtacgccgatgacacagccggttgggacacacgcatcaccgaagacgacctgcagaatgaggcccgcatcacggacattatggagcccgagcacgcgctcctggccaagagcatattcaagttgacatatcagaacaaggtggtccgggtccaacgccccgcaaagaatggcaccgtgatggacgttatcagccggcgcgaccagcgggggagcggacaggtcggcacctacggtctcaacacgtttaccaacatggaggctcagttgatccgccagatggaaagtgagggcatcttttcccccagcgagctggagaccccgaacctcgccgagcgggtgctggactggttagagaaatatggggtggagcgtttaaagcggatggccatctccggcgacgactgcgtagtgaagcccatcgacgaccgcttcgcgacagcgctgacagccttaaacgacatggggaaggtgagaaaggatatcccccagtgggagccaagcaaaggctggaacgactggcagcaagtaccgttttgctctcatcacttccaccagctcataatgaaggatgggagggagattgtcgtgccctgcaggaaccaggacgagctcgtggggcgcgcccgggttagccagggcgccgggtggagcctgcgagagaccgcttgcctcggcaagtcttacgctcagatgtggcaattaatgtacttccaccggcgcgacctgcgcctcgccgccaatgctatctgcagcgcagtccccgttgattggatccccacgtcccgcaccacgtggtccattcacgcccaccaccagtggatgacaaccgaggacatgctgtcggtgtggaaccgcgtatggatcgaggagaacccgtggatggaggacaaaacgcacatctcatcctggggtgacgtcccctacctgggcaaacgggaggatcaatggtgcggatccctcattggactgacggcacgcgccacctgggccaccaacatccaggtggcgatcaaccaggtgcggcgacttatcggcaatgagaactacctcgactatatgacatcaatgaagcgcttcaaaaacgaaagcgacccagagggggcactgtggtag

SEQ ID NO: 24505 - RNA, 9879 nt, synthetic construct
  misc_feature 1..9879: note = derived and/or modified CDS sequence (opt11) from DENV-1__GU131807__SS-prME
  source 1..9879: mol_type = other RNA
agtgtgaccatgctgctcatgttgatgcccacggccctagccttccacctcaccacccggggcggggagccccatatgatcgtgtctaagcaggagcggggcaaaagcctgttatttaaaactagcgccggggtcaacatgtgcacgcttatcgccatggacctgggtgagctctgtgaagataccatgacctacaagtgtccgcgcatcacagagaccgagcccgatgatgtggattgctggtgcaacgcaactgacacctgggttacgtacgggacctgtagccagactggcgagcaccggagagataagcgaagcgtggccctcgcgccccatgtgggtctgggattggagacccgcaccgagacatggatgagctccgagggtgcctggaagcaaattcagcgggttgagacctgggcgctccgtcaccccgggtttaccgtcatcgcgctgtttctggcacacgctatcggaaccagcatcacgcagaaggggataatcttcatcctcctgatgctggtcacgccctccatggctatgcggtgcgtcggcatcggaagccgcgatttcgtagagggactctcgggggccacatgggtggacgtcgtgttagaacacgggtcatgcgtgacgaccatggccaaggacaagcccacccttgacattgagctgctgaaacccgaggtcaccaacccggccgtgctgcggaagttgtgcatcgaagcgaagatatccaataccactacagactctcgctgccccacccagggcgaagcgaccctggtggaggagcaagacgcaaacttcgtttgtcggcgcaccttcgtggaccggggctgggggaacggctgcgggctgttcggcaaggggagcctgatcacgtgcgcaaagttcaagtgtgtgacgaaactagagggaaagatcgtccagtacgagaacctgaagtacagcgtgatagtgaccgtccacaccggggatcagcaccaggtggggaacgagtccacggaacacggcaccaccgcgaccatcacgcctcaagcgccgacaacggagatccagctcacagactacggtgccttgactctggactgctcaccccgcaccggcctcgacttcaacgagatggtccttgtgacaatgaaagagaagtcctggctcgtgcacaagcaatggttcctcgatcttcccttaccttggaccagcggggcaagtacctcccaggagacctggaaccggcaagacctcctggtcacatttaagaccgcgcacgcgaaaaagcaggaagtggttgttttgggcagtcaggagggcgcgatgcacaccgccctgacaggggcaaccgagatacagacctccggcaccacgaccatcttcgccgggcatctgaagtgccgcctgaagatggacaagctaaccctgaggggtatgagctacgtgatgtgcaccgggtcctttaagctggagaaggaggtggctgaaacgcaacacggaaccgtcttagtgcagatcaagtacgagggcaccgacgctccctgcaagatcccgttcagcacccaggacgagaagggagtgacgcagaacgggcgcttaatcaccgccaaccctatcgtcactgataaggagaaacccgttaacatagaggcggagcccccgttcggggagtcctacatcgtcattggggccggtgagaaggcgctgaagctatcatggttcaaaaaggggtccagcatcggaaagatgttcgaggccaccgcgcgcggggcccgccggatggccatcctgggcgatacggcatgggacttcggatccatcggaggcgtgttcacctcagtagggaagctggtgcatcagatcttcggacccgcctacggagttcttttctcgggggtgtcttggcccatgaagatcgggatcggcgttttgctgacctggctcggcctcaactcccggagcaccagcctgagcatgacgtgcatcgccgtcgggctggttactctctacctgggcgtcatggtccaggcagattccgggtgcgtgattaactggaagggccgcgagctaaagtgcgggagcggcatcttcgtcaccaacgaggtgcacacctggacggagcagtacaagttccaggctgatagccccaagcgcctctccgccgcgattggcaaggcatgggaagagggcgtgtgcggcatccgcagcgccacccggctggagaacattatgtggaaacagatcagcaacgagcttaaccacatcctccttgagaacgatatgaagttcaccgtcgtcgtgggggacgtggctggcatcctggcgcaagggaagaaaatgatacgaccgcagcccatggagtataagtacagctggaaatcctggggcaaagccaagatcatcggcgccgacgtccaaaacactaccttcatcattgacggacccaacacacctgaatgcccagacgaccagcgggcctggaacatatgggaagtcgaggattacggcttcggaatcttcaccaccaacatctggctcaagttgagggatagctatacccaggtgtgtgaccacagactgatgagcgctgctataaaggacagcaaggccgttcacgccgacatgggctactggattgagtccgagaaaaatgagacatggaagctggctcgcgcgagcttcatcgaagtgaagacctgcatttggcccaagtcccacacactgtggagcaacggcgttctggagagtgagatgataatccctaagatctatgggggcccaatctcgcagcacaactatcggccaggatactttacccagacagctggcccctggcacctcggcaagttagagctggacttcgacctctgcgaggggacaaccgtcgtagtggacgaccactgcggcaaccgcgggccttctctgaggactacgaccgtcacgggcaagatcatacatgagtggtgctgccgcagttgcaccctgccgcctctacggttccgcggtgaggacggctgttggtatggaatggaaatccggcccgtaaaggagaaagaggagaatttagttaagtcgatggtcagcgctggcagcggcgaggtggattccttcagcctgggcttgctgtgcattagtattatgattgaagaggtgatgcgtagtcggtggtcgcgcaagatgctgatgacgggcaccctcgccgtattcttcctgcttattatgggacagctcacctggaacgacttaattcggctgtgtatcatggtgggcgccaacgcgagtgaccgcatggggatgggcaccacttatctagcccttatggccaccttcaaaattcgccctatgttcgcagttggtctgctgtttcgtcgcctgacctcccgagaggtcttgctccttacaatcgggctgagcctcgtggcctccgtagagctgccgaactcgttggaggagctcggtgacgggctggcgatggggatcatgatcctgaaactcctgacagacttccagtcccaccagctatgggctaccctcttgagcctgacctttatcaaaaccactttctcgttgcactgcgcctggaagacgatggccatggtgctaagcatcgtgtccctgtttcccctatgcctgagcaccacctcccagaagactacctggctgcccgttctcctgggatcactgggttgcaagcccctcaccatgttccttatcgcggagaacaagatttggggccgacgttcatggccgctgaacgaggggatcatggccgtgggcatcgtgagcatcctccttagctccttgttaaagaacgatgtaccccttgcaggcccccttatcgccggcggcatgttgatagcctgctatgtgatcagtgggtccagcgcggacttgtccctggagaaggctgccgaagtgagctgggaggaggaagcggagcactccggggccagccacaatatactcgtagaggtgcaggacgacgggaccatgaagataaaagacgaggagagggacgacacgctcacgatcctacttaaggcgaccctgctggccgtgtccggcgtctacccgctctcaatccctgctaccctgttcgtgtggtatttctggcagaagaaaaagcagaggtcgggggtattgtgggataccccctccccgcccgaggtagaacgagccgtcctcgacgacggcatctaccggatcatgcagcgcggcctgctggggcgcagtcaggtcggcgtcggtgtgttccaagagaatgtcttccacacgatgtggcacgtcaccaggggtgccgtgctcatgtaccagggaaagcgactcgagccgagctgggcgtcggtcaagaaggatctgatcagctacggaggtggatggcgtctgcagggctcgtggaataccggggaggaagtccaggttattgccgtcgaacccggaaagaaccctaagaacgtccagaccgcccccggcacgtttaagactcccgagggagaggtaggcgccatcgccctagacttcaagcccgggaccagcggctcccccatcgttaaccgcgaaggaaaaatcgttggcttatacggcaacggggtggtgaccacaagcggcacctatgtctcggctatcgcccaggccaaggcctcccaagaggggccgctgcccgagattgaggacgaagtcttccgcaagcggaatctcactatcatggacctacacccgggcagcgggaagacccggcggtacctgcctgcgatagttagggaggccataaagcgcaagctccggaccttgatcctggccccgacccgagtcgttgcgtccgagatggcggaggcattgaaaggcatgccgatccggtatcagacaaccgccgtaaagtctgagcacactggcaaagagattgtcgacctaatgtgccacgccaccttcaccatgcgcctgctctcccccgtgcgggtgcccaactacaacatgatcataatggacgaggcgcacttcaccgacccgagctccatcgccgctcgcgggtacatcagcacgcgggtagggatgggggaggccgctgctatcttcatgaccgctacaccacccggctccgtcgaggccttcccgcagagcaacgccgtaatccaggacgaggagcgcgacatcccggagcggtcctggaactctgggtacgaatggatcaccgacttccccggcaagacggtttggttcgtgccctccataaagtccgggaatgacattgctaactgcctgcgcaagaacggtaagcgggtcattcagctgagccgcaagactttcgacacagaataccagaagactaagaacaatgattgggattacgtggtgacgaccgacattagcgaaatgggagccaacttccgggcggaccgcgtcatcgaccccaggcgctgtctcaagcccgtcatcctcaaggacgggccagaacgggtgattctagccggccccatgcccgttaccgtagcctcagccgcacagcgtcgggggcgcatcggccgcaaccacaataaggaaggcgatcagtacatctacatggggcagccgctcaacaacgacgaggaccacgcacactggaccgaagccaagatgctgctggacaacattaacacgcccgaaggcatcatccccgccttatttgaacctgagagagagaaaagcgctgccatcgacggggaataccggctgcggggcgaggctcgcaaaaccttcgtagagctgatgcggcgcggggacttgcctgtctggctgtcatacaaggtggcgagcgagggcttccaatacagcgatcgtaggtggtgcttcgacggagagaagaacaatcaggtgctggaggagaacatggacgttgagatctggaccaaggagggagagcggaaaaagctccgccctcggtggctggacgcccgcacctactcggatcccctggccctccgggagtttaaggagttcgccgcggggcgccggtcggtctctggagacctaattctagagatcgggaagctcccccagcatctcacgcagcgtgcccagaacgctctggacaacctcgttatgctgcacaactcggagcagggaggtcgggcctaccgccacgcgatggaggagctgcccgacacaatcgaaacccttatgttgctcgccctcatcgctgttctgaccggaggggtgacgctatttttcttgtcagggcggggactgggcaagaccagcatcggtctgctctgtgtgatggcatccagcgtcctgctgtggatggcctcggtggagcctcattggatagcagcctcaatcatcttggagtttttcctgatggtcctactgataccggaaccagacaaacagcgcaccccgcaagacaaccaactggcttatgtcgttatcgggctcttattcatgatactgacagtagcagctaacgagatgggcctgctcgagacgaccaagaaggacctggggatcggtcatgtcgcggtcgagaatcaccaccatgctgcgatgctcgacgtggatctccaccctgcctctgcctggaccctatatgcggtcgcaaccacgattatcacgcccatgatgcggcataccatcgagaacaccaccgccaacattagcctgacggccatcgccaaccaggcggccatccttatgggcctcgacaagggctggccgatatccaagatggacatcggggtacccctcctcgccctggggtgctactcacaggtgaaccccctgaccctcactgctgcggtcctgatgctggtggctcattacgccatcatcggccccggtctccaggccaaagcgacccgcgaagctcagaagcgaacggccgccggcatcatgaagaacccaactgtggacgggatcgtcgccatcgacctggatcccgtggtgtacgacgcgaagttcgaaaagcagttaggtcagatcatgctcctgatcctgtgcacctcccagattctcctgatgaggacgacgtgggcgctatgcgaaagcatcaccctcgccaccggcccccttaccacgctgtgggaggggtcccccggcaagttttggaacaccaccatcgccgtatctatggccaacatctttcgcggtagctacctcgccggcgctggcctggccttctctctcatgaagtccctcggtggcgggcgtcggggcaccggtgcccagggcgagaccctgggcgagaaatggaagcgccaactgaaccaactctccaaaagcgagttcaatacttataagcgctccggcatcatggaagtggaccggtcagaagccaaagagggccttaaacgcggggaaacaacgaagcacgctgtgagtcgcgggacggccaagctgagatggttcgtcgagcgcaacctagtgaagccggaagggaaggtgatagacctaggctgtggcagagggggctggagctactactgcgctggtctgaagaaagtcaccgaggtgaagggctataccaagggcggccctggccacgaagaacccatccccatggccacctatgggtggaaccttgttaaacttcattccggcaaggacgtcttcttcataccacccgagaagtgtgacacattgctgtgtgacattggcgagtcttcgcccaaccctaccatcgaagagggccggactttgcgcgtgttaaagatggtggagccgtggctgcgagggaatcagttctgcatcaagatcctgaatccctacatgcccagcgtcgtggagaccctggagcagatgcaacgcaagcacggaggaatgctcgtgcgaaaccccctatcccgcaatagcacgcacgagatgtattgggtatcctgcgggaccggcaacatcgttagcgccgtcaatatgacatcacggatgctgttaaatcgtttcacgatggcgcaccgcaaaccgacctacgagagagacgtcgacctcggggccggtacccgccacgtggccgtagagcccgaggttgccaacctggatatcatcggccaacggatcgagaacataaaacacgagcacaagagcacctggcactacgatgaggacaatccctacaaaacctgggcctaccacgggtcctatgaggtgaagccctccggctccgcatctagcatggtcaacggtgtggtgaagctattaaccaagccgtgggacgtcattccgatggtgacacagatcgcaatgacggacaccacccctttcgggcagcagagagtgttcaaggaaaaggttgacactcggaccccgaaggccaagcgcgggaccgcgcagatcatggaggtgacagcgaagtggctgtgggggtttttgtctcggaacaagaaacccagaatctgcacgcgcgaggagttcacccgcaaggtgaggtcgaacgcggccatcggcgcggtcttcgttgacgagaatcagtggaactccgccaaggaggccgtcgaggacgagaggttctgggacttggtgcaccgggaaagagagttgcacaaacaggggaagtgtgcaacctgcgtgtacaacatgatgggcaagcgtgagaagaagctgggggagttcggcaaggccaaaggcagccgcgccatctggtacatgtggctcggcgcccgattccttgagttcgaagcacttggcttcatgaacgaggaccactggttctcccgcgaaaactcattgagcggtgtagagggcgaaggcctgcacaagctgggttatatcctcagggatatctctaaaatccccggaggtaatatgtacgctgacgacaccgccgggtgggacacgcgcatcaccgaggacgacctgcagaacgaagccagaatcaccgatatcatggagcccgagcacgccctgcttgcgaagtcgatcttcaagctgacctatcagaacaaggtcgtgagggtgcaacgaccggctaagaatgggacggtcatggacgttatctctcggagagaccagcgaggaagcggccaggtgggcacctacggcctgaacactttcaccaatatggaggcccagctcatcaggcagatggagagcgaaggtatcttctcccctagtgagctggaaacaccaaacctggccgaacgggtcttggattggctggagaaatacggggtggagcggcttaagagaatggccatttccggggacgactgcgttgtaaaacctatcgacgaccgattcgcgacagccctcaccgccctgaacgatatgggaaaagtgcggaaggacatcccgcagtgggaaccgagcaaggggtggaacgactggcagcaagtccccttctgtagccatcacttccaccagctgatcatgaaagacggccgcgagatcgtagtaccctgccggaaccaggacgagctcgtgggccgcgcccgggtcagtcaaggggccgggtggagcctgcgcgagaccgcgtgccttgggaagtcctacgcccagatgtggcagctcatgtacttccaccgccgcgatctgaggttggccgctaatgccatatgctccgccgtgcctgtagattggatccccacatccaggactacctggagcatccacgcccatcaccagtggatgacaactgaggatatgctctccgtctggaaccgggtgtggatcgaggagaacccatggatggaggacaaaacgcacatctcctcctggggcgacgtgccctatctcggcaagcgcgaggaccagtggtgtggcagcctgatcgggcttactgcccgcgccacctgggcaacaaacatacaggtggccatcaaccaggtgcggcgcctgatcgggaacgagaactacctggattatatgacctcgatgaagcggttcaaaaatgagagcgacccagaaggtgcgctctggtga

SEQ ID NO: 24506 - RNA, 9879 nt, synthetic construct
  misc_feature 1..9879: note = derived and/or modified CDS sequence (opt11) from DENV-1__GU131811__SS-prME
  source 1..9879: mol_type = other RNA
agcgtgaccatgctgctaatgctgatgcccactgccctggcctttcacttgacaacaagaggaggtgagccacacatgatagtgtcgaagcaggaacggggtaaaagcctgctctttaagacctccgcgggggttaacatgtgcactctcatcgccatggacctgggcgaattttgtgaagatactatgacctacaaatgtccccgcatcaccgaagctgaacccgacgacgttgactgttggtgtaacgctaccgacacgtgggtgacttatggcacctgctcccagatcggtgagcaccggcgcgacaaacgttcggtggccctcgcacctcacgtgggcctcgggctggagacgcgtactgagacctggatgagcagcgagggcgcctggaagcagatccaacgggtggaaacctgggccctgcgtcacccgggttttacggtgatcgcactctttctggcccacgccattggtacaagcatcacccagaaggggataatcttcattctgctcatgttagtgaccccctccatggcgatgcggtgcgtcggtatcggaagccgcgacttcgtagagggacttagtggcgccacctgggtagacgtcgtactcgagcacggaagctgcgtgacgactatggcgaaggacaaacccacgcttgacatcgagctacttaaaacggaagtcactaaccccgcggtgctgcggaaactgtgtatcgaagccaagatttccaacacaaccaccgacagccgctgtccgactcagggcgaggccaccctagtggaagagcaggacgccaacttcgtctgtcgccgtaccttcgtcgaccgcggctgggggaacggttgtgggctgttcggcaaggggtccctaatcacatgcgcaaaattcaagtgcgtgacgaagctcgaaggaaagatcgttcaatatgagaacctgaagtacagtgttatcgttaccgtgcacaccggcgaccagcaccaagttggaaatgagtccacggagcatggtacgaccgcgactatcacgccacaggcaccatcgaccgaaatccagctgacggactacggggccctcaccctggactgcagcccccggacaggccttgactttaacgagatggtcttactgactatgaaagaaaagtcctggctagtgcacaaacagtggttcctcgacctaccgctgccctggactagcggggcctcaaccagtcaagagacttggaaccggcaggacctccttgtaacctttaagacggcgcatgcgaaaaagcaggaggtcgttgtcctgggctcccaggaaggagccatgcacactgcgctcactggagccaccgagatccagacgtctggcaccaccacgatttttgctgggcatttgaaatgtcgcctaaagatggataagcttacgctgaaaggcatgtcctatgtgatgtgcaccggcagcttcaagctcgagaaggaggtggccgaaacccagcacggcaccgtgttagtccagataaagtacgagggcacggacgccccttgtaagatccccttctctacccaggacgagaagggggtgacccaaaatggacggctgattaccgcaaacccgatcgtgacggacaaagaaaagcctgtcaatatcgaggccgagccgccgttcggggagagctatatcgtgatcggggtcggcgaaaaggcgctgaagctgtcctggttcaagaaaggtagcagcatcggcaaaatgttcgagaccacagcgagaggagcaagacgcatggcaatcctcggtgatacagcttgggactttgggagcataggcggtgtcttcacgtcagtagggaaactggtgcaccagattttcggaaccgcgtacggggttctgttcagtggcgttagttggaccatgaaaatcggaattggggtgctcctgacttggttagggttaaatagccgctccaccagcctatccatgacctgtatcgccgtgggactggtgaccttatacctgggcgtgatggtccaggccgacagcggttgcgtgatcaactggaagggccgggagctgaagtgtgggagcggcatctttgtgacgaacgaagtccacacttggacggagcaatacaaattccaggctgactcccccaagagactcagcgctgcgattggcaaagcctgggaagagggcgtctgcggcatacggagtgcaacccgcctagagaacatcatgtggaaacaaatcagcaacgagcttaaccacatactactggagaacgacatgaagctaacagttgtggtgggggacgtggccggaatcctcgcccaggggaagaagatgatccggccccagcctatggaatataagtattcatggaagtcctggggcaaggctaagatcatcggcgccgatgttcagaataccacgtttataatcgacgggccgaacacccccgagtgccccgacgaccaacgcgcctggaacatatgggaggtagaggactatggatttggaatctttaccaccaacatatggcttaagttgcgggattcctacacacaggtgtgtgaccacagactcatgagcgcggcgattaaagattccaaggccgtgcacgccgacatggggtattggatcgaaagcgagaaaaacgagacgtggaagctggcccgggcctccttcattgaagtgaagacctgcatctggcccaagagccacacattgtggtccaacggagtgttggagagcgagatgatcatccccaagatttacggaggcccgatttcccagcacaactatcgccctggctacttcacgcagaccgctggcccctggcacttaggtaagttggagttagacttcgacctctgcgagggcactaccgtcgtggtcgacgagcactgcggcaatcgcgggcccagcctgcgcacgactaccgtcacaggcaaaatcatccatgagtggtgctgccggtcctgcaccttaccccccctccgatttaagggggaggatggctgctggtacgggatggagattcggcctgtaaaggaaaaggaggagaacttagtcaagagcatggtctctgctggatccggcgaggtggacagcttctccctcgggcttttatgcatcagcatcatgatagaggaagttatgcgcagtcggtggagcaggaagatgctcatgaccggcaccctggccgtcttcttcctgctcatcatggggcagctcacttggaatgacctgatccgcctctgcatcatggtgggcgccaacgcctccgaccgcatgggcatggggacaacatacctggcgctgatggcgaccttcaagatgcgcccgatgtttgccgtcggcctcctattcagacgcctcacctcccgggaagtgctcctgctgactatagggttatccctggtagcctctgttgagctgccgaactcgcttgaggagctgggtgatggcctggccatgggcatcatgatcctcaagctgctgaccgattttcaaagccaccagctctgggcgactctactttccatgaccttcatcagaactactttctccttgcattacgcgtggaaaaccatggccatggttctgtccatcgtgtcgttgtttccactctgcctgtccaccacaagccaaaagaccacctggctgccagtcctcctgggttcactcgggtgcaagccgcttaccatgttcttaatcgccgagaacaaaatctggggacgcaaatcctggcccttaaacgaggggattatggcggtgggaatcgtgagcatcctgctaagcagcctgctaaagaatgacgtgcccctggccgggcccctgatcgccggtggcatgctcatagcctgttacgtgatctccgggagctccgctgatttgtcactggagaaagcggccgtagtcagctgggaggaggaggccgagcacagcggggcctctcacaatatccttgtggaggtgcaggacgacgggacaatgaagatcaaggatgaggaacgcgacgacacgctgactattctgctgaaggcaactctgctggcggtcagcggcgtgtaccctctcagtataccggccaccctgttcgtctggtacttctggcagaagaagaagcagcgcagcggggtcctgtgggacacgcccagcccacccgaggtggagcgcgccgttctcgacgatggcatctaccggatcatgcagcgaggtctgcttggccggagccaggtcggggtgggtgttttccaggagaacgtcttccacaccatgtggcacgtgacccgcggcgccgtccttatgtatcaggggaagcggcttgaaccctcttgggccagcgtcaagaaggacctgatctcctacggcggcggatggcgcctgcagggctcgtggaacacaggagaggaggtccaggtgatcgctgtcgaacccgggaagaaccctaagaacgttcagaccgccccgggaacctttaaaacctctgagggcgaagtgggagccatcgccctcgacttcaagcccgggacatcgggcagccctatcgtcaaccgggagggcaaggtggtaggcctgtatggtaacggggtcgtgaccacctctggcacctatgtgagcgccatagcgcaggcaaaggcctcccaggaggggccccttccggagatcgaggacgaggtcttccgaaagcgcaatctcactattatggatctgcatcccggaagcgggaagacgagacggtatttgcccgccattgtgcgcgaagctatcaaacggaaactccgaactttgatactagcccccaccagagtggtcgccagtgaaatggccgaggcactcaagggaatgcctatccggtatcagaccacggcggtcaagagtgagcacaccgggaaggagatagtcgacctgatgtgccacgccaccttcactatgcgcctgttgtcccccgtccgagtgcccaactataatatgatcatcatggatgaggcacacttcacggacccctcctccatcgcagcccgcggttacatctctacccgggtgggcatgggcgaggctgcggcgatcttcatgacggctaccccaccgggctcggtcgaagccttcccccagagcaatgccgtcatacaagacgaggaacgcgatatcccagaacggtcctggaacagcgggtatgaatggattaccgacttccccgggaagaccgtgtggttcgtcccgtccatcaagtccgggaacgacattgccaactgcctgagaaaaaatggcaaacgggtgatacaactctcccgaaaaacctttgacactgagtaccagaaaacgaagaacaacgactgggactacgtcgtcacgaccgacatcagcgagatgggcgccaatttccgcgccgaccgcgtgatcgacccgcggcgctgcctcaagccggtcatcctgaaggacgggcccgagagagtgatcctagcgggtccaatgcccgtgaccgtcgcttccgctgcccagcgtcgagggaggatcggccggaaccacaacaaggagggcgatcagtacatctatatggggcaaccgctcaacaacgacgaggatcacgcccactggacggaggcgaagatgctactggataacatcaacactcctgagggcatcattcccgccctattcgagcccgaacgcgaaaagagtgccgctattgacggggagtatcgcctgcggggcgaggcccgaaaaaccttcgtggagctaatgcgtcgtggagacttgccggtgtggctgtcctacaaggtcgcttccgagggtttccaatacagcgaccgtcgctggtgcttcgacggagagcggaacaaccaagtgctggaagagaatatggacgtggaaatctggaccaaagagggggagcgcaaaaagctccggccccgatggcttgacgccagaacgtactccgatcccctggccctccgagagtttaaggagttcgccgcgggtaggagaagcgtctccggggacctgatcctagagatcggcaagctcccacagcacttgacccaacgcgcgcagaacgcgttagataacttggtgatgctccacaacagcgagcagggagggcgcgcataccggcacgcaatggaagagctgccggataccatcgagaccctcatgttactggcgcttatagccgtgctgacgggcggggtcaccctgttctttctctccggccgcggactcggcaaaacgagtatcggactgctctgtgtaatggcatccagcgtgctcctgtggatggcctccgtcgagccacactggatcgccgccagcatcatactagagttctttctgatggtactgctcatccctgagccagacagacaacgcaccccgcaagataaccagttagcctacgtggtcataggtttactcttcatgatcttgaccgttgccgcgaacgagatgggattgctcgagaccaccaagaaggacctggggatcggccacgtggccgttgagaaccaccaccacgcagccatgctggatgtcgacctccatcccgcctctgcctggacactgtacgccgtggcgactacgatcataacccccatgatgcggcacacaatcgagaacacaacagccaacatcagtctcaccgccatagctaaccaggccgccatactgatgggactagacaaagggtggccgatttccaagatggatataggggtccctttactcgccttagggtgctattcacaggtgaatcccctgaccctcacagccgcagttttaatgttagtcgcccactacgccattataggacccgggctccaggccaaggcgacgcgcgaggcccagaagcgaaccgcggccggcatcatgaagaacccgaccgtggatggtatagtggccatcgacctcgacccggtcgtttacgatgccaagttcgagaagcagttaggccagatcatgctactgatcctgtgcacctcccagatcttactgatgcgtacgacctgggcgttatgcgagtcaatcaccctcgcgacgggacccctcaccaccctgtgggaggggtctcccggcaagttctggaataccacgattgccgtgagcatggccaacatcttcagggggagctacctcgccggcgccggcctggctttcagtctgatgaaatcactcgggggcggccggcgcggcacgggcgctcagggcgaaactcttggcgaaaagtggaaacgtcagctgaaccagctttccaagagcgaattcaacacatacaaacggtccggcattatggaagtagacaggtccgaagcgaaggaaggcctgaagcgaggggaaaccacgaaacatgccgtgagccgtggtaccgcgaagctgcggtggttcgttgaaaggaacctcgtcaaaccggagggaaaagtgatcgacctgggctgcggccgcgggggctggagctactactgcgccgggctcaagaaggtgacagaggttaagggctacaccaaaggcgggcccggccacgaagagcccatcccgatggccacttacgggtggaacttggtgaagctacactccgggaaagatgtgttcttcatcccccccgagaaatgtgacaccctcctgtgcgatattggggagtcgtcgcccaaccctaccattgaagagggccggaccctccgcgtcctaaagatggtcgagccctggctgcgtgggaaccaattttgcatcaagatcctaaacccctacatgccctcggtcgtcgaaacgctggagcaaatgcaacgcaagcacgggggcatgctggtccggaaccctttgagtcgcaatagcacacacgaaatgtactgggtgtcgtgcggtacggggaacatagtgagcgccgtgaacatgacgagccgaatgctgctaaaccgctttaccatggcgcatcgcaaaccgacatacgagcgggacgtggatctcggggcgggcacccgccacgtcgccgtggaacccgaggtcgccaatctcgacattatcggtcaacggatcgagaacataaagcacgagcacaaaagcacgtggcactatgacgaggacaacccatacaagacgtgggcctaccacgggtcctacgaggtcaagccatcaggctctgcatctagtatggtgaatggggtcgtgaagctgctaacaaaaccgtgggatgtgatccccatggtcacccagatcgcaatgaccgataccacgccattcggacagcagcgcgtgttcaaggaaaaggtggacacccggactcccaaggccaagcgcgggaccgcgcagatcatggaagtcaccgctaagtggctctggggcttcctgtcgcgaaacaagaagccgcgcatctgcacccgggaggagttcacccgcaaagtacgaagcaacgcggcgatcggcgccgtgttcgtcgatgagaatcagtggaattcagccaaggaggccgtagaggacgaacgcttctgggacctcgtacatcgcgagcgcgaactgcacaagcaggggaagtgcgcgacctgcgtctataacatgatgggtaagcgggagaaaaagctgggggagtttgggaaggccaaaggaagccgcgcaatatggtacatgtggctaggcgcccggttcctggagttcgaagcactgggcttcatgaatgaagaccactggttctcccgcgagaactcgctgagtggggtagagggagaggggctgcacaagctgggctacatcctgcgggacatcagcaagatccccggcggaaatatgtacgctgacgacacggcgggctgggacacccggataaccgaggacgatctgcaaaacgaggccaagattacggacatcatggagcccgaacacgcactccttgccaagtccatcttcaaactaacgtaccagaacaaggtcgtcagggtacagcgccccgcaaagaacgggactgtaatggacgtcatctctcggcgcgaccagagggggtccggccaggtaggcacctacggtctgaatacgttcacgaacatggaggcccagttaattcggcagatggagagcgaggggatcttcagcccgagcgagcttgagacccccaatctggctgggcgcgctcttgactggctggagaaacacggagtagagcggctgaagcgtatggccatctctggcgatgactgcgtcgttaaacccattgacgacagatttgcgaccgccctaacggcgttgaacgatatgggaaaagtgcggaaagacatcccgcaatgggagcccagcaagggctggaacgattggcagcaggtccccttctgctctcaccacttccaccaactgatcatgaaggacggccgggagatagtggtgccctgcaggaatcaggatgaacttgtcgggcgggccagagtatcccaaggggccgggtggagcttacgggagacggcgtgtcttggaaagagttacgcacagatgtggcaactcatgtatttccaccgtcgggatctcaggctggccgccaacgcaatttgtagcgccgttcctgtcgactgggtccctacctcccgaactacctggtccatccacgcccaccatcaatggatgacgaccgaagacatgctctccgtgtggaaccgtgtctggatcgaggagaacccctggatggaggacaaaacccacataagtagctggggggacgtaccatacctgggcaagcgggaggatcaatggtgtggctccctgatcggtctcactgcccgcgctacgtgggccaccaacatccaggtggccattaaccaggtccgccggctgcttggtaacgagaactacctcgactacatgacttctatgaagagattcaagaacgagtctgatcccgagggggccctgtggtga

SEQ ID NO: 24507 - RNA, 9882 nt, synthetic construct
  misc_feature 1..9882: note = derived and/or modified CDS sequence (opt11) from DENV-1__JF937615__SS-prME
  source 1..9882: mol_type = other RNA
agcgttactatgctgctcatgctaatgcccaccgccctggccttccacttaaccacccgtggtggtgagccccacatgatcgtgtcgaagcaggagcgcggcaagagcctgctgttcaagacctcggccggggtgaacatgtgcacattgatcgcgatggacctgggcgagttctgcgaggacactatgacctacaagtgcccccggatcaccgaggccgagcccgatgatgtggactgctggtgtaacgcgactgacacatgggtgacctatgggacctgcagccagaccggtgaacatcgccgggacaagagaagtgtagctttagcgccccacgtaggcctcgggctggagacccgcaccgagacatggatgagttccgagggcgcctggaagcagattcagcgggtcgagacctgggctctgcgtcaccccggcttcacggtgatcgccctctttctcgcgcacgccattggcaccagcatcacccaaaagggcatcatcttcatcttactaatgctggtgaccccctccatggccatgcggtgcgttggtatcggcagccgtgatttcgtggaagggctgtccggagccacgtgggtagacgtcgtcctcgagcacggtagttgcgtaaccaccatggccaaggacaagcccaccctggacatcgagctgctaaagacagaggtaaccgacccagccgtcttgcggaagctgtgcatcgaggccaaaatcagcaacacaaccacggacagccgatgtccaacacagggcgaggcaacgctcgtggaagaacaggacgccaactttgtttgccggcggacttttgtcgaccgggggtggggcaacggctgcggcttgttcggaaaggggtccctgatgacgtgcgctaagtttaagtgcgtgaccaagttggaaggcaagatcgtccagtatgagaatctgaagtacagcgtcatcgtaacggtccacaccggcgaccagcaccaagtagggaatgagtctactgagcacggcaccaccgcaaccatcacgccccaggctcctagcacggaaattcaactcacggactatggggccctcaccttggactgttctccccgcaccggtctggacttcaacgagatggtcctgctgacgatgaaagagaagtcatggcttgtacacaaacagtggttcctcgacctgccgctgccctggacgagcggagcctccacaagtcaagagacctggaataggaaggatttactagtgacattcaagaccgcccatgccaagaaacaggaggtcgtggtgctgggcagccaggaaggcgccatgcacaccgctctcaccggagcaacggaaatacaaacctccgggaccaccacaatcttcgcgggccacttaaagtgcagactcaagatggacaagctcaccttaaagggcatgagctacgtgatgtgcactgactcattcaagctggagaaggaggtggctgagactcagcacgggacggtgttagttcagatcaagtacgaagggaccgatgcaccgtgcaagattcctttctccacccaggacgagaagggagttactcagaatggacggctgatcacagccaaccccatcgtaaccgacaaggaaaagcccgtcaatatcgaggctgagccgcccttcggcgagagttacatcgtgatcggggcgggagagaaggccctgaagctgtcatggttcaaaaagggctcgtccatcggcaaaatgttcgaagccaccgcccgcggcgctcggcgcatggctatattgggggacaccgcatgggacttcggcagcatcggaggagtattcacatccgttggaaagctggtgcaccagatatttgggaccgcctatggcgtactgttcagcggggtttcctggacaatgaagataggtattggtgttctcctgacttggcttggactaaacagccgctccacgtcgcttagcatgacctgcatcgccgtcggtctagtcacgctctacctgggggtcatggtgcaggcggactccggctgcgtcattaactggaagggtcgggagctgaagtgcgggtcggggatctttgtgaccaacgaggtgcacacgtggaccgaacagtacaaattccaagcggacagcccgaagcgcctctcagccgccatcggcaaggcgtgggaggaaggtgtgtgcggcatccggtccgccacccgcctagagaacatcatgtggaagcagatctccaacgagctgaaccacatcctactagagaatgatatgaagttcacagtggtggtcggggatgtcgcgggtatactggcccagggcaagaagatgatacggccccagcccatggaatacaagtactcctggaaatcctggggtaaagctaaaatcatcggcgccgacgtgcaaaacacaacgttcataatcgacggccccaacaccccggagtgccctgacgatcaaagggcatggaacatctgggaagtagaggactacgggttcggcatctttaccaccaacatctggttgaagctgcgcgactcctacacccaggtctgcgaccatcgcttgatgagtgccgccatcaaggacagtaaggccgtacacgccgacatggggtactggatcgagagcgagaaaaacgagacctggaagttggcgcgggccagctttatcgaggtgaagacttgcatctggccgaaaagccacaccctgtggagcaacggggtgttagaaagcgagatgatcatccccaaaatctacgggggacccatctcccaacacaactacaggcccggctacttcacgcaaaccgccgggccttggcacctcggcaagctggagcttgacttcgatctctgcgaagggaccaccgtggtagtcgacgaacactgcggaaacagaggcccgagccttcgcaccaccaccgtgactgggaagatcatccacgagtggtgctgccggtcctgtacgctgccgcccctgaggttcaagggagaggacggctgctggtacggaatggagatccgacccgttaaggaaaaggaggagaacttagtcaagagcatggtgagcgccggttccggtgaggtcgacagcttctctctgggcctgctgtgcattagcatcatgatcgaggaagtgatgcgctcccgttggtctcgcaaaatgctgatgacagggaccctcgccgttttctttctgctgatcatgggacagctcacctggaacgacctgatccggctgtgcatcatggtcggagcgaacgcctccgatcggatgggtatgggtaccacctacctcgccctgatggccacctttaagatgcgccctatgttcgccgtgggcctcctgttccggagactgaccagtagggaggtgttactcctgacgatcggcctctctctcgtggcgagcgtagagctgcccaactccctcgaggagctcggcgacggcctggcgatggggatcatgattctgaagctcttgatcgatttccagtcacaccaactctgggccaccctcctgagtttaactttcatcaagaccacgtttagcctccattatgcctggaaaaccatggcgatggtcctgtcaatcgtgagtttgttccccctcctgcccgtgcatgacctgccaaagaagactacctggctcccagtcctgttaggctccctaggctgtaagcccctaacgatgttcctgatagccgagaacaagatctggggtcgcaagagctggcccctcaatgagggtattatggccgtggggatcgtgagtatcctgcttagcgccctcctaaagaacgacgtgccgctggcaggccccctcatagccggcggaatgctaatcgcctgctacgtgatcagcggatcatccgccgacctatccctcgagaaggccgccgaggtgagctgggaagaggaagcggagcattccggggccagtcacaacattctagtcgaggtccaagacgacggcaccatgaagatcaaggacgaggagcgggatgacacgcttaccatcctcctgaaggccacgctgctcgccgtctccggggtttaccccctgagcatccctgccaccttgtttgtgtggtacttctggcaaaagaagaagcagcgttccggcgtgttgtgggacaccccttcaccccccgaagtcgagcgggctgtgttggatgacggtatatatcgcatcatgcagcgggggctgctggggcgctcccaggtgggggtcggtgtttttcaggaaaacgtgtttcacaccatgtggcacgtcacccgcggtgctgtactcatgtaccagggcaagcggttggagccatcttgggcctccgtgaaaaaagacctgatcagctacgggggcggctggcggctacaaggttcttggaacacgggagaggaggtccaggtgatcgccgtggagcccgggaagaaccccaaaaacgtccagaccgccccgggtaccttcaagacttcggagggggaggtgggggcgatcgccctggatttcaaacccggcacatccgggagcccgatcgtcaacagagagggcaagatcgtaggcctgtatggcaatggcgtagtgaccacctctgggacttatgtaagcgccatcgctcaggccaaggccagtcaggagggccccttacccgagatagaggacgaggtctttcggaaacgtaacctgacgatcatggatctgcacccggggtccggaaagacccggcgctatctcccagcgattgtgcgcgaggcaatcaagcgtaagctgcggaccctgatcctggcccccaccagagtcgtcgcgagcgagatggcagaggccttaaaggggatgcccatccgctaccaaacgaccgccgtgaagagtgaacacaccggcaaagaaatagtcgacctgatgtgccatgccacctttaccatgcggctactgagcccggtacgcgtgcccaattacaacatgatcataatggacgaggcgcacttcacggacccatcgtcgattgcggccagaggctatattagcacacgcgtcggcatgggtgaagccgcagcgatcttcatgaccgcaacgcccccagggagcgtggaggcgttcccccagtccaatgccgtgatccaagacgaggagcgggatatccccgagagatcatggaattctggctatgagtggatcacagacttccccgggaagacggtctggtttgtgccgtccataaaatccggcaacgacatcgcgaactgtctgaggaagaacggcaagcgcgtgatccagctaagccggaaaaccttcgatacggagtaccagaagaccaaaaacaacgactgggactacgtcgtgaccaccgacatctcggagatgggggccaacttccgcgcggatcgggtgatcgacccccgacgatgcctgaagcccgtgatattgaaagacggccctgagcgcgtgatcctagccgggccaatgcccgtcacggtggccagcgcggcccagcggcgaggtcggatcgggcgtaaccacaacaaggagggagatcagtacatctacatgggccaaccactgaacaatgacgaggatcacgcacactggaccgaggcgaagatgctgctcgacaacataaataccccagagggcataattccagcgcttttcgagccggagcgggaaaagtctgcggccatagacggcgagtaccgcctgcgaggagaagcgcggaagaccttcgtggagcttatgagacggggtgacctgcccgtgtggcttagctacaaagtggcctccgaggggtttcaatattcagaccgccgctggtgtttcgacggcgagcgcaacaatcaggtgttagaggagaacatggacgttgaaatctggacgaaggagggcgaacggaaaaagctccgcccccggtggcttgatgcccgcacctacagcgacccgctcgcgctgcgagagttcaaggagttcgccgctggccgccgttccgtgagcggcgacttgatactcgagataggaaagctgccccagcacctgacccaacgcgctcagaacgcgctcgacaacctagtgatgctgcacaactccgagcagggcggccgggcctaccgccacgccatggaggagctccccgataccattgaaactctgatgttcctggcactaatagccgtcctgacaggaggcgtaaccctgttcttcctcagcgggcggggcctgggcaagacatcaatcggcctgctttgcgtgatggcgagtagtgtcctcctctggatggcaagtgtggagccgcactggatcgcggcctccatcatcctcgagtttttcttaatggtgttattgattccggagcccgaccggcaacgaacaccccaggacaaccagctggcctatgtagtgatcggcctactcttcatgatactgaccgtggccgccaacgagatggggctgctggagaccaccaagaaggacttaggtatcgggcacgtcgccgtggagaaccaccatcacgccgctatgctggacgtggacctccatccggctagcgcgtggaccctgtacgccgtcgccacgaccatcatcacccccatgatgagacacaccatcgagaacacgaccgccaacatctccctgaccgcgattgccaatcaggcggccatcttaatgggcctggacaaggggtggcccattagcaaaatggatatcggcgtgcccctgctcgcactgggctgctactcccaggtgaaccctctaacccttacggccgcggtcctcatgctggttgcccactacgccatcatcgggccaggcctccaagcgaaggccactcgagaggcacagaagcgcaccgccgcagggatcatgaagaaccccaccgtcgatggtatcgtcgcaatagacctggacccggtggtgtacgacgcgaagttcgagaagcagctgggccagatcatgcttctgatcctgtgcacgtcacaaatcctcctgatgcgcaccacctgggccctgtgcgagtccatcaccctcgccactggcccgctgaccacactgtgggaaggcagtcccggaaagttttggaatacaacgatcgcagtgtccatggcgaatattttcagaggcagctatctagccggggccggcctggccttcagcctgatgaagtccctcggcggaggccggcgggggactggggcgcagggggagaccctcggagagaagtggaagcgccaactgaatcagctctctaagtccgagttcaacacctacaagcggtcagggatcatggaggtggaccgctcggaggccaaggagggtctaaagagaggcgagacgaccaagcacgctgtcagccgcgggacagccaagctgcggtggttcgtcgagcgcaacctggtgaagccagaggggaaagtgatcgacctggggtgtggccggggcgggtggtcctactattgcgccggtctgaagaaagtaaccgaggtgaaagggtacacgaagggcgggcctggacacgaggagccaatccccatggcgacttacggctggaatctggtgaagctccacagcgggaaggacgtctttttcatcccgccggagaagtgcgataccttgctatgtgacataggcgaatcaagtccaaaccctaccatagaggaagggagaacgctccgagtgctgaaaatggtcgagccctggctgcgtgggaaccagttctgcatcaagatccttaacccctacatgcccagtgtcgtggagacactggagcaaatgcagcggaagcacggaggcatgctagtgcgcaaccccctctcacggaactccacccacgagatgtactgggtcagctgcggcaccggcaacatcgtgtccgccgtaaacatgactagccgcatgcttctaaacagattcacgatggcccaccgcaaacccacctacgagcgcgatgtggacctcggtgccggtaccaggcacgtagccgtggagcccgaggtcgcgaacctggacataatcggccagcgcatcgagaacatcaagcacgaacacaagagtacctggcactacgacgaggacaacccgtacaagacgtgggcctaccacggcagctacgaggtaaagccctccgggagcgcttccagtatggtgaacggcgtggtgaagctcctcacaaagccctgggacgtcatccctatggtcacgcagatcgcgatgacagacacgactccctttgggcagcaacgggtgttcaaagagaaggtcgacaccaggacccctaaagccaagcgaggcactgcgcaaattatggaggtaaccgccaagtggctatgggggttcttgagccgcaacaagaagccccggatctgcactagagaggagttcacccggaaggtgcgttcaaatgcagcgatcggagcggtctttgtcgatgagaaccagtggaactcggctaaggaggcagtggaggatgaacggttttgggacctggtccatcgcgagcgggagctgcacaagcaggggaagtgcgccacttgcgtgtacaacatgatgggaaaacgtgagaaaaagctgggcgagtttggaaaagcaaagggtagtcgggcaatctggtacatgtggctaggggcgcgctttctggaatttgaagcgctgggcttcatgaacgaggaccactggttcagccgggaaaactcattatccggcgtcgagggggagggactacacaagcttgggtacatccttcgcgatatttcaaagattcctggtgggaacatgtacgccgatgacaccgcgggctgggacacccggataaccgaggacgatctccagaacgaggccaagatcacggatattatggagccagagcacgccctgcttgcgaagtccatcttcaagctgacgtaccagaacaaggttgtgcgcgtacagagacccgccaaaaacggcaccgtcatggacgtgatttcccgcagagaccagcgtgggagcggccaggtgggcacctatggcctcaacaccttcaccaacatggaggcccagctcatacgccagatggagtctgaaggtattttcagcccctcggaactggagaccccgaacctggcgggccgagtattagactggctggagaagcatggtgtggagcgcctgaagcggatggccattagcggcgacgactgtgtggtcaagcccatcgacgaccgctttgccgccgccctcacggctcttaacgacatgggaaaggtccggaaagacatcccccagtgggagccgtccaaggggtggaacgactggcagcaggtacccttctgctctcaccacttccaccaactgattatgaaggacggcagggagatcgttgtgccgtgccggaaccaagacgagttggtaggccgtgcgcgagtctcccagggggctggatggtctctgcgtgagacggcctgcctgggcaaaagctacgcccagatgtggcaactaatgtacttccacaggcgcgatctgcgtttggcagccaatgctatctgctccgccgtgcctgtcgactgggttcccacctcccgcaccacctggtccatccacgcccaccaccagtggatgaccaccgaggacatgttatccgtttggaacagagtatggatcgaggagaacccgtggatggaggacaagacgcacatctccagctggggcgacgtcccctaccttggcaagagagaagatcaatggtgcggcagtctaatcggcctcactgcgcgggcaacttgggcgactaacatacaggtggctatcaatcaagtgcggcgcctgatcgggaacgagaactacctcgactatatgacttccatgaaacggtttaagaatgagtctgaccccgagggagcgctctggtaa

SEQ ID NO: 24508 - RNA, 9879 nt, synthetic construct
  misc_feature 1..9879: note = derived and/or modified CDS sequence (opt11) from DENV-1__GU131814__SS-prME
  source 1..9879: mol_type = other RNA
agcgtgaccatgttactcatgctgatgcccacggccctggcctttcatctaaccacccgaggcggagaaccccacatgatagtttccaagcaggaacggggcaagtccctgctgttcaagaccagcgccggggtgaatatgtgcaccctcattgccatggacctaggcgaactgtgcgaagataccatgacgtacaagtgtccgaggatcacggaaacagaaccagatgacgtggattgctggtgcaatgccacagacacctgggtgacttatgggacatgtagtcagaccggcgaacacaggcgggacaagcggagcgtggccctcgccccacatgtcggtctgggtctggagaccaggactgagacatggatgagctcagagggcgcgtggaagcagatccagcgggttgagacgtgggccctccgccaccccggattcacagtgatagcactcttccttgcccatgcgatcggaacctcgatcacccaaaaggggatcatcttcatattactgatgctggtgactccgtctatggccatgcggtgcgtgggaatcggtagtcgagacttcgtggaggggctgtcgggcgccacctgggtggacgtcgtgttagagcatggcagttgcgtgaccacaatggccaaagacaagcccacgctggacatagagctcctgaagaccgaggtcaccaatccggcgatcctacggaaactatgtatcgaagctaagatttccaataccacaaccgacagccgttgccctacccagggcgaagccaccctggtggaggagcaggacgccaactttgtctgccggcgtactttcgttgaccgtggctggggcaacggctgcgggctgttcggcaaggggtctctcatcacgtgcgccaagttcaagtgcgtgaccaagctggaggggaagatcgtacagtacgagaacctgaaatacagcgtcattgtgacagtgcacacgggggatcaacaccaggtcggaaacgagtccaccgagcacggcaccaccgccacgatcacgccccaggcgccgactacggaaatccagctcaccgactatggggctctcaccctggactgcagtccccgcaccggacttgactttaacgagatggtgctcctgaccatgaaagagaaatcctggctcgtccataagcagtggttcctggacctgcccttaccctggacaagcggtgcctcgacatcccaggagacttggaaccggcaggacctgttagtgacctttaagacggcccacgcgaagaagcaagaggttgtagtgttggggagccaggagggggctatgcacacggccctgacaggcgccaccgagatccaaacgtccggcactaccaccatcttcgccgggcaccttaagtgccgccttaagatggacaagttgacgctgaagggaatgagctacgtgatgtgcactgggtcctttaaactcgagaaggaagttgccgagacccagcacggcaccgtgctagtgcagatcaaatatgagggcaccgatgcgccgtgcaaaattccattcagtacgcaggacgaaaaaggggtgacccagaatggccggctgataacggccaaccccattgttaccgataaagagaagccggtgaacatcgaggctgagccgcccttcggggagtcctacatcgtcatcggcgccggtgagaaagcgctgaagttaagctggttcaaaaaggggtccagtatcggcaagatgttcgaggccacggccagaggggcccggcgcatggccatcctgggggacacagcatgggatttcgggtcaatcggcggtgtgttcacatctgtgggtaagctggtccaccagatcttcggcaccgcctacggggtactcttctccggcgtgtcgtggactatgaaaatcgggatcggggtcctgctgacctggctgggcctgaactcccggtctacatcattgagcatgacctgcatcgctgtgggactcgtgacgttgtacctgggggtcatggtgcaggccgactccgggtgtgtgatcaattggaaaggccgggagctaaagtgcggcagcggcattttcgtcaccaacgaagtacatacctggaccgagcagtacaagtttcaggccgacagcccaaagcgactgtccgcggcgataggaaaggcctgggaggagggcgtgtgcggcatccggtcagccacgaggctagagaacataatgtggaaacaaatctcaaacgagctcaatcatatcttgctagagaacgatatgaagtttacggtcgtggtcggagacgtcgccggcatccttgcgcagggcaagaaaatgatcagaccgcaacccatggagtataaatacagttggaagtcctggggtaaggccaagataataggcgctgatgtccaaaacaccacctttatcatcgatgggcccaataccccggagtgccccgatgaccaacgcgcctggaacatctgggaggtggaagactacggctttgggatctttacgaccaacatttggctaaaactccgggacagctacacacaggtctgcgaccaccgcctcatgtccgcggcgataaaggattcaaaggccgttcacgctgacatgggctactggatagagtcggagaagaatgagacctggaagttagcccgtgcgtctttcattgaggtgaaaacttgcatctggccaaagtcccacaccttgtggtcgaacggagtgctcgaatcagaaatgatcatccccaagatctacggtggcccgatatctcagcataactaccgccccggttactttacccaaaccgctggcccctggcatttgggcaaactggagctcgacttcgacctgtgcgagggcacgacggtcgtggtcgacgagcactgcggcaaccggggaccaagtctgcgcaccaccactgtgaccggcaaaatcatccacgagtggtgctgccgatcctgcactctacccccgctccgcttcagaggcgaggacggctgctggtacgggatggagatccgcccggtgaaagagaaagaagagaacctagtcaaatccatggtaagcgcagggtctggagaagtggactccttcagcctcggtctgctctgcatctccataatgattgaggaagtcatgagaagccgctggtctcgtaagatgctcatgaccggcactctggccgtcttcttactcttgatcatggggcagctgacctggaacgacctcatccgcctgtgtattatggtgggcgccaacgcgtcggaccgtatgggcatgggcactacctacctggccttaatggcaacgttcaagatgcggccgatgtttgcggtcgggctactgtttcggcggttgacctcccgcgaggtactgctgcttaccatcggactaagcctggtggcctccgtcgagctgcccaatagcctggaagaactgggggacgggctcgcgatgggcataatgatactcaagctgctgacagacttccagtcacatcagctatgggccacccttctaagcctcactttcattaagaccacctttagtctacattacgcatggaagacgatggccatggtgctctccatcgtcagtcttttccccttatgcttgagcaccacttcccagaagaccacgtggttgcccgtgctactcggtagcctggggtgcaagccgctgactatgttcctcatcgcggagaataagatctggggccggcgcagctggccccttaacgagggtataatggccgtgggcattgtcagcatactgctcagttccctgctcaagaacgacgtgccccttgccgggcccctgatagccggcggcatgcttatcgcctgctacgtcatctcagggtccagtgcggacttatccttggagaaggccgcggaggtctcctgggaagaggaggcagaacattccggggcgagtcacaacattctggttgaggtgcaggacgacgggaccatgaagatcaaggacgaggagcgggacgataccctcacgatattactaaaggctactctcttggctgtttccggcgtgtacccgctgtcgatccccgccacactcttcgtttggtacttctggcagaagaagaagcaaaggtccggggtactgtgggacaccccctcaccgcctgaggtggaacgggcggtcttggacgacggcatctaccgcatcatgcagcgaggcctgctcggacgctcacaggttggcgtgggggtgtttcaggagaatgtctttcacaccatgtggcacgtgacgcggggcgctgtgctgatgtatcagggtaagcggctggagcccagctgggcgtccgtaaagaaggacctcataagttacggcggcgggtggcgcttgcagggctcatggaacaccggagaagaggtccaggtaatagcagtcgagcccggtaagaaccccaagaacgttcagaccactcccggcacgttcaagactcccgagggcgaagttggcgccatcgcgcttgacttcaagccgggaaccagcggatcccccatcgttaaccgtgaggggaagatagtgggcctctacggcaatggtgtggtcacaacgtcgggcacctacgtgagcgccatcgcgcaggcaaaggccagtcaggaagggccgctgcccgagatcgaagatgaggtgttccggaagcggaatctgaccataatggacctgcacccgggcagcggaaaaacccggcgttatctgccggccatcgtccgggaggcgattaagcgcaagctgcgcaccttgatcctcgcccccacgcgcgtggtggcgtccgaaatggcggaagcactaaagggtatgccgattcgctaccaaaccaccgcggtcaaaagcgaacacactggcaaagagatcgtagacttaatgtgccacgcaaccttcaccatgcgacttctgtcccccgtacgcgtaccaaactacaacatgatcatcatggacgaagcgcacttcaccgaccccagctccatagctgcaagggggtatatctcaacacgcgtgggaatgggagaggcggcagcgattttcatgacggcaacgccgccaggctccgtcgaggctttcccacagagcaacgcggtcatccaagatgaggaacgcgatatcccagagcgcagttggaatagcggatatgaatggatcaccgacttcccaggcaagacggtgtggttcgtaccctcaatcaaatctggcaacgacattgccaattgcctccggaaaaacgggaaacgtgtcatacaactgtctcggaaaacgtttgataccgagtaccagaagaccaagaacaacgactgggattacgtggtaacgaccgatatcagcgagatgggcgccaacttccgcgcagatcgggtcatcgatccgcgtcgttgcctgaaaccggtgatcctcaaagacggccccgaacgcgtgatcctagcgggacccatgccggtcaccgtggctagcgccgcccagcggagagggcggatcggcaggaatcacaacaaggagggcgaccaatatatttacatggggcagcccctgaataacgatgaggatcatgcccattggaccgaggcgaaaatgctactggataacatcaatacgcccgagggcatcattcctgcgttattcgagccggagcgcgagaaatccgccgccatagacggggagtaccggctccggggagaagcccggaagaccttcgtcgaactgatgcgtagaggcgatctccccgtttggttatcctataaggtggcaagcgagggctttcagtattcagatcgccgctggtgctttgatggcgagcgaaacaaccaggtcctcgaggagaacatggatgttgagatctggactaaggagggggagcgcaagaagctgagacccagatggctcgatgcccgcacctacagcgaccccttagccctgcgggagttcaaggagtttgccgcaggacgacggtcggtgtccggggacctcatcctggagataggtaaactgccgcagcacctcacgcagcgcgcgcagaatgcgctagacaacctggttatgctccacaattccgaacagggcgggcgggcgtacaggcacgcaatggaggagctgcccgacaccattgaaaccctgatgctcctggcgctgatcgctgtgctcacagggggcgtgaccctgttctttctatcggggcgcgggctcggtaagacgagcataggcttgctatgcgtcatggcctcaagcgtgctcctctggatggcttccgtggagccccactggatagccgcgagcatcatcctggagttctttctcatggtcctgttaatcccggagccggaccgccagagaaccccacaagacaatcagctcgcttacgtggtgattggtctgctgttcatgatcctaaccgttgctgccaatgagatgggcctgctagagactacgaaaaaggacctcggcatcggccacgtagcggtaggcaaccaccaccacgccgcaatgctagacgtcgacttgcatcccgcctccgcatggaccctatacgccgtggcgaccaccataatcacacctatgatgcgccacaccatcgagaacacaactgctaatattagcttaacggccatcgcaaaccaggcggcgattctaatgggcctcgacaagggctggccgatatccaaaatggacatcggagtgcccctgctagccttgggctgctacagtcaggtcaaccccctgaccctgaccgccgccgtgctgatgctggtggcgcactatgccatcataggacctgggctacaagccaaggccaccagagaggcccaaaagcggaccgcggccggtataatgaaaaaccccaccgtcgatggcattgtggccattgacctggacccagtggtctacgacgcaaagtttgaaaagcaactggggcagattatgctgctcatcctctgcaccagtcagatcctgctcatgagaacgacgtgggctctttgtgagagcatcacgcttgcgacagggcccctgaccacgctgtgggagggctccccagggaagttttggaacaccaccatcgccgtgtcgatggcaaatatcttccggggctcttacctggcgggagcagggctcgcgttcagcctgatgaaaagccttggtggtggacgccgggggaccggagcccagggcgagacgctcggggagaaatggaagcgccagttgaatcaactttccaagagcgagttcaacacctacaagcgatccggcatcatggaagtggatagatccgaggcaaaggaggggttaaagcgaggcgagaccaccaaacatgccgtctcccgcggtacggctaagctgcgatggttcgttgagcgcaatctggtcaagccggaggggaaggtcatcgacctgggctgtgggcggggtgggtggtcatattactgtgccggcctaaagaaagtgaccgaggtgaaaggctatacgaaaggcgggccggggcacgaggagcccatcccgatggccacatacggatggaacctagtaaagctgcactccgggaaggatgtgttctttatcccgccggagaagtgtgatactctcctctgtgacattggagagagcagccccaaccctaccatagaggaagggcgcaccctacgggtactaaagatggtcgagccctggctgcgaggaaaccagttttgcatcaagatccttaacccctacatgcccagcgtggttgagaccctcgagcaaatgcagcgcaagcacggcgggatgctagtccgcaaccccctgtcccggaatagcacccacgagatgtactgggtgtcctgtggaacgggcaatatcgtgtcggctgtcaacatgacgtcccgtatgttactaaaccgcttcaccatggcgcacagaaagccaacatacgagcgcgacgtggacttgggggcgggcacgcggcacgtggccgttgaaccagaggtggccaaccttgatataatcgggcaacgcatcgagaacatcaagcacgagcacgaatctacgtggcactacgacgaggacaacccttacaagacctgggcgtaccacggaagctacgaagttaagccgagcgggagcgcgagcagcatggtgaacggcgttgtaaagctgctgaccaagccgtgggacgtcatccccatggtgacgcagatcgcgatgaccgacaccaccccatttgggcagcaacgggtgttcaaagaaaaggtggacacgcgcacccctaaggccaaacgcggcaccgctcagataatggaggtgaccgcgaagtggttgtggggcttcttgtcgcgtaacaagaaaccccgaatctgcacgcgcgaggagttcacccggaaggtcagaagcaatgccgctatcggggccgtgttcgttgatgaaaatcagtggaactccgcaaaagaggccgtcgaggacgaacggttctgggatcttgttcatcgggagagagagctacataagcagggtaaatgcgcgacctgtgtgtataacatgatggggaagcgcgagaagaagctgggcgagttcgggaaggcgaagggctccagagcgatatggtacatgtggctgggggcgcgctttctagagttcgaggcgctggggttcatgaacgaagaccactggttctccagagaaaacagcctgtccggcgtcgaaggggagggcctccacaagctgggatacatcctccgagatatcagcaagatccccggcgggaacatgtacgccgatgacacagccgggtgggacacgaggataacagaggacgaccttcagaatgaagcccgcatcaccgatatcatggagccggagcatgccctgctcgccaagtcgatcttcaagctaacctaccagaataaggtagtgcgagtccagcgccccgcgaagaatggcaccgtgatggatgtgataagcagacgggaccagcgcgggagcggccaagtaggcacctacggattgaacacctttaccaacatggaagcgcagctgatccggcagatggagtccgagggcatatttagccccagcgagctagagactccaaacttagccgaacgagtgctggactggctagagaaatacggggtggagcggctcaagcggatggcgatctccggtgatgactgtgtcgtgaagccgatagacgaccgtttcgccaccgcactgaccgctctcaacgacatggggaaagttcgaaaggacatcccgcagtgggagccgagcaagggttggaacgattggcagcaggtccctttttgttcccaccacttccaccagctgattatgaaggacggccgggagatcgtagtaccgtgccgcaaccaggatgagctagtcggtcgagcgcgggtgtcccaaggggcaggctggtccctcagagaaaccgcctgtctgggcaagagttacgcgcagatgtggcagcttatgtacttccaccgtcgagacctcagactggcggccaatgccatctgcagcgctgttcccgtagattggatcccaacgagccggacgacatggtccatccatgcccaccaccagtggatgacaacggaggacatgctgagtgtgtggaatcgggtgtggatagaggagaatccctggatggaggacaaaacgcacatcagctcctggggcgatgtgccgtacctaggcaagcgcgaggaccagtggtgcggtagcctgattggtctgaccgcccgggccacctgggcaaccaatatccaagtggcgatcaaccaagtacgccggctaatcggcaatgaaaactacctggactatatgacgtccatgaagcgcttcaaaaacgagagcgaccccgagggagcactgtggtga

SEQ ID NO: 24509 - RNA, 9879 nt, synthetic construct
  misc_feature 1..9879: note = derived and/or modified CDS sequence (opt11) from DENV-1__GU131815__SS-prME
  source 1..9879: mol_type = other RNA
tcagtgacgatgctgctcatgcttatgccaaccgccctggccttccacctcaccacccgggggggggaaccgcacatgatcgtgagcaagcaggaacggggcaagtctctgctgttcaagacctccgccggggtgaacatgtgtaccctcatcgccatggatctgggtgagctgtgcgaggacacaatgacctataagtgtccccgaatcaccgagaccgagcctgacgacgtggactgctggtgcaacgccaccgacacctgggtcacctacgggacctgtagccagacgggtgagcaccggcgcgacaagaggtccgttgccttggccccccacgtgggccttggcttggaaactcgcactgagacctggatgagctccgagggcgcttggaagcagatccagcgggtagagacttgggccttacgccaccccgggttcaccgtgattgcgctattcctggcccacgccatcggcaccagcatcacccaaaagggtataatattcatcctcctgatgctggtgacgccctctatggctatgcggtgcgtcgggatcgggagccgcgacttcgtggaggggctatccggcgcgacctgggtggacgtcgtgctcgaacacgggagctgcgttaccacgatggccaaagacaagccaacgttagacatcgagctcctgaagaccgaggtaaccaaccctgccgtgctgcggaagctctgcatcgaggcgaaaatttccaacaccacgactgacagccgctgcccgacgcagggcgaggccaccctggtggaggaacaagacgccaacttcgtatgccgtcgcacgtttgtggaccgaggctggggaaacggctgtgggctgtttggcaaggggtccctaatcacgtgcgccaagtttaagtgcgtgacgcgccttgagggtaaaatcgtccaatacgagaacctgaagtacagcgtcatcgtgaccgtccatacgggcgaccagcatcaggttggcaacgaaagtaccgaacacggtaccaccgccaccataacgccccaggcgcccaccaccgaaatccagctaaccgactacggggccttgacgctggactgcagcccacggactgggctcgacttcaacgagatggtcctgctgactatgaaggaaaagagttggctcgtgcacaagcagtggttcctggacctgcccctcccgtggacaagcggtgccagtacgtcccaagagacctggaaccgccaagacctgctagtcaccttcaagaccgcccatgccaagaaacaggaggtggtggtgctcggctcccaggagggcgcgatgcacactgctttgacgggggctacggaaatccagacctcaggcacgaccaccatcttcgccgggcacctgaagtgccgactcaagatggataaactaaccctgaagggcatgagctacgtcatgtgtacggggagtttcaagctcgagaaagaggtggctgaaacccaacacgggaccgtactggtccagataaagtatgaaggcacggacgcgccatgtaagatccccttcctgactcaggacgagaaaggggtcacccaaaatgggcgcctgataacagccaacccaatcgtgaccgacaaggagaagcccgtaaacatcgaggccgagccacccttcggggaaagctacatcacgatcggcgccggcgaaaaggcgctcaagttatcctggttcaagaaggggagcagcattggcaagatgttcgaggccacagctcgcggggctcgccgcatggccatcctgggcgataccgcgtgggattttgggtcaatcggcggcgttttcacgtccgtggggaagctcgtccatcagatcttcggcacggcttatggtgtgctgttctccggcgtatcctggaccatgaagatcggtatcggcgtcctactcacctggctgggcctgaactctcgatccacaagcctctccatgacgtgcatagccgtggggctggtgacactgtatctcggcgtcatggtgcaggccgacagcggttgcgtgattaactggaaaggtcgcgagctgaagtgcggatccggcatcttcgtcaccaatgaggtgcacacctggaccgagcagtacaaattccaagctgacagcccgaaacggctgagcgcggccatcggcaaggcctgggaggagggggtgtgcggcatccgctccgctacccggctcgaaaatatcatgtggaagcagatcagcaacgaactgaatcacatcctgctcgaaaatgatatgaagttcaccgtcgtggtgggcgacgtcgcaggcattctagcgcaggggaagaagatgattcggccgcagcccatggagtataaatacagttggaagtcctgggggaaggcgaaaatcatcggcgccgacgtacagaacacaaccttcatcatcgatgggcccaacacgccggagtgcccggatgaccagagagcctggaatatctgggaggttgaggactatggctttgggatcttcaccaccaatatatggctgaaactacgcgactcttacactcaggtctgcgaccaccggttgatgtcggcggccatcaaggactcaaaggctgtgcacgccgacatgggctactggattgagagcgagaagaatgagacgtggaagctggcccgagcgagttttatcgaggtgaaaacctgtatttggccgaaatcacacaccctctggtccaatggcgtccttgaaagcgagatgatcatcccaaaaatctacgggggaccgatctcccagcacaactaccggcccgggtactttacgcaaacggccggcccatggcacctgggcaagctcgagctggatttcgacctgtgcgaaggaaccaccgtggttgtcgacgagcactgcggtaaccgcgggccgagcctccggactacgaccgttaccggcaagatcatccacgagtggtgctgccgctcctgcacccttccgcccctgaggttcaggggggaggacggctgttggtacgggatggaaatccggcccgtgaaggagaaggaggagaatctcgtaaagagcatggtgtcagccggaagcggcgaggtggacagcttctccttggggctgctctgtattagcatcatgatcgaggaggttatgcgctcccggtggagccgcaagatgctgatgacaggaactctggccgtgtttttcctcctgattatggggcagctaacatggaatgacctcattcgtctgtgcatcatggtcggcgccaacgcatccgatagaatggggatgggaacgacttacctagccctcatggccaccttcaaaatgcgcccgatgttcgccgtcggcttgctgttcaggcgcttgaccagccgcgaggtcctgctgctcaccatcggactctcattagttgcaagcgtcgagctccccaactccctggaggagctgggcgacgggctagcgatgggcattatgatcttaaaattactcacggacttccagtcgcaccagctgtgggccaccttactctccctgaccttcatcaaaactacgttcagcctgcactacgcctggaagaccatggcgatggtgctctcgatcgtctccctgttccctctgtgcctatcaaccacatcccagaagacgacctggctaccggtgctgctcggctccctggggtgcaaaccactgaccatgttccttatcgcggagaacaagatctgggggcgccggagctggcctctgaatgaggggatcatggctgttgggatcgtcagcatactactatccagcctgctcaaaaacgacgtgcccctcgccgggcctttgatcgctggcggcatgctgatcgcgtgttacgttatatccgggagctccgccgacctaagcctggagaaggccgctgaggtgtcctgggaggaggaagccgagcatagcggagcctcacacaacattctggtggaagtgcaggacgacgggaccatgaagatcaaggacgaggagcgcgacgacacactcacgatcctgctaaaggcaacactcctggccgccagcggagtctaccctctgtccattccggccactctctttgtgtggtatttctggcaaaagaaaaagcagcggtcgggggtgctgtgggacacccccagcccgcccgaggtcgaacgcgccgtgctggacgacggcatctaccggatcatgcagcgcggcctgttggggcggagccaggtgggcgtgggtgtgtttcaggaaaacgtgtttcacaccatgtggcatgttacccgcggggctgtgctgatgtaccaggggaagagactggaaccttcctgggctagcgtgaagaaggacctcatctcctatggcggggggtggcgactgcagggctcatggaacacaggggaggaggtccaggtgatcgctgttgagcccggcaagaaccccaagaacgtccaaaccgccccagggacgttcaagaccccagaaggagaggtgggcgccatcgcgcttgactttaagcccggaacctccggcagcccgatcgtgaaccgggaggggaaaatcgtcggcctctacggcaacggggttgtgaccacgtccgggacctacgtcagcgccatcgcacaagccaaggcgtcgcaggaggggcctttacccgagatcgaggacgaggtttttcggaagcggaacctgaccatcatggatctccaccccggctccggcaagactaggcgctacttgccggccatagttcgcgaggcgatcaagcgcaagctgcggacgcttatcctcgcccctacgcgcgtagtcgccagcgagatggcggaggccctgaagggcatgcccatcagatatcagactaccgcggtgaaatcagagcacacgggaaaagagatcgtagacttaatgtgccacgcaaccttcaccatgcgccttctgagccccgtgcgggtacccaattacaacatgatcattatggacgaggctcacttcaccgacccatccagcgtcgcagcccgcggctacatctccacgcgggttgggatgggagaggccgccgctatattcatgaccgcgacgccgcctggcagcgtggaggccttcccgcagtccaatgccgtcatccaggatgaggagcgcgacatcccggagcggagctggaactccggctatgagtggatcaccgacttccccgggaagacggtgtggtttgtgcccagtatcaaatccggcaacgacatcgcgaactgtctccgcaaaaacgggaagagagttatccagctgagccgtaagacattcgacaccgagtaccagaagaccaagaacaacgactgggactacgttgtgacgaccgacatttccgagatgggtgcgaacttccgggccgatcgcgtcatcgacccgcggcgttgcctgaagcccgtgatcctcaaggacggccccgaacgggtgatcctggccggcccaatgccggtcaccgtggcctcggccgcgcaaagacgggggcgcataggtcgcaaccacaataaggagggcgatcagtacatttacatggggcagccccttaacaacgacgaggaccacgcccactggacggaggccaagatgctccttgataatatcaacacccccgagggcataatcccagcactgtttgaaccggaacgggagaagtcggccgcgatagacggggagtaccgcctccgtggtgaagcgagaaagactttcgtcgagctaatgcggcgaggggacctgcccgtgtggttgagctacaaagtggcctccgaggggttccaatattcagatagacgctggtgtttcgacggcgagcggaacaaccaggtcctggaagagaacatggacgtcgagatctggaccaaggagggagaacgaaagaagctgcggccccgctggctcgacgccagaacctacagcgacccccttgccctccgagagttcaaggagttcgccgccggccgacgctcggtgagtggggacctcatccttgagatcggcaaactgccgcaacatctgacgcaacgggcccagaacgcactggacaatctggtaatgctccacaactccgagcagggcggacgtgcgtaccggcacgcaatggaagagttgcctgacaccatcgagacactgatgttgctagcgctcatcgccgttctcaccggtggggtgaccctgttcttcctgagcggccgcgggctcggcaagacgagtatcggcctgctttgcgttatggccagctccgttctcttatggatggcatccgtggagccccactggatcgccgcttccataatcctggagttcttcctcatggtcctgctgatccccgaaccggaccggcagcgcacgccccaggacaatcaactcgcttacgttgtgatcgggcttctgttcatgatcctcaccgtcgccgcgaatgaaatgggcctcctggagaccacgaaaaaagacctagggatcgggcatgtggccgcggagaatcaccatcatgcggccatgctggacgtcgatttacaccccgcgagcgcctggaccctatacgctgtggcaaccaccattatcacgccgatgatgcgccacaccattgagaacaccaccgccaacatctccctgacggccattgccaaccaggccgccatcctgatggggctcgacaagggttggcccattagcaagatggacatcggcgtgcccctgctggcgctgggttgctactcccaggtgaatccccttaccctgactgccgccgttctcatgctggtggctcactacgccataattgggccggggctgcaagcaaaggctacgcgggaggcccagaagcgcacggccgccggcatcatgaagaaccccaccgtggacggcatcgtggcgatcgacctcgacccagtggtatacgacgccaagttcgagaagcagttggggcaaatcatgctgttgattttatgcaccagccagatccttctcatgcggaccacgtgggccctgtgcgagtctatcaccctggccaccggccccctcaccacgctgtgggaagggagtccgggcaagttctggaacaccacaatcgccgtctccatggccaacatcttccgcggcagctacctcgccggcgccggcctcgccttttccctgatgaagtccctgggtggcgggcggcgcgggaccggggcgcaaggcgagacgctcggcgaaaagtggaagcggcagctgaaccagttatcgaaatccgagttcaacacatacaagaggagcgggattatggaagtggaccggtccgaggccaaggagggcctgaagcgcggggagaccaccaaacatgcggtgagccggggcacggccaaattacgctggttcgtcgagcggaacctagtgaagcccgagggaaaggtgatagacctgggctgcggtcgcgggggctggtcctactactgcgccgggctcaagaaggttaccgaagtgaagggctacaccaagggcgggcccggccatgaggagcccatcccaatggcgacctacgggtggaacttggtaaaactgcactctggcaaagacgtcttcttcatcccgcccgagaagtgcgacacgctcctgtgcgacattggtgagtccagcccaaacccgaccatcgaagagggccggacactgcgcgtgctcaagatggtcgagccctggctgcgaggtaaccagttttgtatcaagatcctaaacccgtacatgccctccgtcgtggagacactcgagcaaatgcagcgcaaacacgggggcatgctggtgcggaacccgctgtcaagaaactccacccacgaaatgtactgggtctcgtgcgggacgggcaatattgtgtcggcggtgaacatgaccagccgcatgctcttgaaccggttcaccatggcccaccgcaaacccacctacgaacgggacgtcgatctgggtgccggcacgcgccacgtggccgtggagcccgaggtagcgaatctcgacatcatcggccaacgaatcgagaacatcaagcacgagcacaagtctacctggcactacgacgaggataacccctacaagacctgggcctaccacgggagctacgaggtgaagccgtcgggcagcgccagcagcatggtgaatggggttgtgaagctgctgacgaagccttgggacgtcatccccatggtgacgcagatcgccatgaccgacaccacgcccttcggccaacaacgagtgttcaaggaaaaagtagatacgaggacaccgaaagctaagcgcgggacagcacagatcatggaggttaccgccaagtggctctggggattccttagccggaacaaaaagcccaggatctgcacgagggaggagttcacccgcaaggtccggtccaacgccgccatcggcgcggtattcgtggatgagaaccagtggaatagcgccaaggaggccgttgaggatgagcgcttctgggatctggtccatcgggagcgcgagctccacaagcaagggaagtgcgccacttgcgtgtacaatatgatgggcaagcgtgagaaaaaactgggggagttcggaaaggccaaggggtcccgcgcgatctggtacatgtggctgggcgcccggttcttagagttcgaggccctggggttcatgaacgaggaccactggttcagcagggagaactctctgtcaggggttgagggcgaggggctccacaaactgggctacatcctgcgggacatttccaagattcccgggggcaacatgtacgccgacgacacagccgggtgggatacgcgcatcaccgaggacgacctccagaacgaggctcgcatcaccgacatcatggagccagagcatgccttgttggccaagagcatcttcaagctaacctaccagaacaaagtcgtgcgagtgcagcgccccgccaagaacggcaccgtcatggacgtgatcagtcggcgcgaccaacggggtagcggtcaggtggggacctatggcctgaacactttcacgaacatggaggcccaattgatcagacagatggagagcgagggaatcttcagcccctccgagctcgagacgcccaacctggcggaacgcgttctggactggctcgagaagtacggcgtggaacgcctcaaacggatggccatttctggtgacgattgcgtggtcaagccgatcgacgatcgctttgccaccgccctgaccgccctcaacgacatgggcaaggtgagaaaagacattccccaatgggagccttctaagggctggaacgactggcagcaggtccccttctgcagccaccacttccaccagctgatcatgaaggacggccgcgagatcgtcgtgccgtgccgcaaccaggacgaactggtgggccgcgcgcgggtcagccagggcgccggctggtcgctccgcgagaccgcctgcctgggcaagtcctacgcacagatgtggcagctgatgtatttccaccggcgcgacctccggctggccgccaatgcaatctgctccgccgtccccgtggactggatccccactagcagaacgacttggtcgattcatgcccaccaccagtggatgaccacggaggacatgctgagcgtctggaaccgcgtgtggatagaagagaacccatggatggaggacaaaacccatatctcctcatggggcgacgtgccgtacctcgggaagcgagaggaccagtggtgcggctccctgatcggactgaccgcgcgcgctacctgggccacgaacatccaggtcgccatcaatcaggtccgccgtctcatcgggaacgagaactacctggactatatgacgagcatgaagagattcaagaacgaatcggacccagagggcgccctgtggtga

SEQ ID NO: 24510 - RNA, 9879 nt, synthetic construct
  misc_feature 1..9879: note = derived and/or modified CDS sequence (opt11) from DENV-1__GU131818__SS-prME
  source 1..9879: mol_type = other RNA
tcagtgactatgctgcttatgctgatgccaaccgctttagcattccacttaaccacccgaggaggggagccccacatgatagtgagtaagcaagagagaggcaagagcctgctgttcaagaccagtgccggtgtgaacatgtgcacccttatagccatggacctaggcgagttctgcgaggacaccatgacctacaagtgtccccggatcacggaagccgaaccggacgacgtggactgctggtgcaacgctacggacacatgggtgacctacggtacctgtagccaaaccggcgaacaccggagggacaaacgctccgttgctctagcgccgcacgtgggcttggggctggagacgcgcactgagacctggatgtcgagcgagggcgcctggaagcagatacagaaggtggagacctgggccctgcggcaccccgggttcacggttatcgcactatttctggcgcatgccattgggacgagcattacccagaaggggatcatcttcattcttttaatgctggtgacgccctcaatggctatgcgatgcgtcggcataggctcccgggactttgtggaaggcctgtccggtgccacgtgggtggacgtagtgctcgagcatgggagctgcgtaactacgatggcaaaagacaagcccaccctggatatcgagcttttaaagacagaggtcaccaacccagcggtgctacgcaaactgtgcatcgaggcaaagatctccaataccaccacggactctcggtgtccgacacagggcgaggccacccttgtggaggaacaggacgccaacttcgtctgccgacgaaccttcgtggaccgcggttggggcaacgggtgcggtctgttcggcaaggggtcactgatcacttgcgccaagttcaaatgcgttacgaagctcgagggcaagaccgttcaacatgagaacctgaagtacagcgtcatcgtgaccgtccacacgggcgatcaacatcaggtgggtaacgagtccaccgaacacggcaccaccgcgactatcacaccccaggccccgagcaccgagattcaactgactgactacggggcccttacactggactgctcccctcggacgggcctggacttcaacgagatggtcctccttacgatgaaggaaaagtcctggctggtgcataaacagtggttcctcgacctgccgttgccctggacctcaggtgcatccaccagtcaggagacatggaaccgcaaggacctcctcgtaaccttcaagacggcacacgcgaagaaacaggaggtcgtggtgctgggctcccaggagggcgccatgcataccgccctcaccggggccactgaaatccagaccagtggcaccacgacaatcttcgcagggcacctgaagtgccgactgaagatggacaaactcactctgaagggtacctcctacgtcatgtgcacaggctccttcaagttggagaaagaggtcgccgagacccagcacgggacagtgctcgtccagatcaaatacgagggcacggacgcaccctgcaagatcccgttctccacgcaggacgaaaagggggtgacccagaacggccgcctgatcacggccaatcccatcgtcaccgacaaggagaagcccgtcaacatagaggccgagccgcccttcggagaatcatacatcgtgatcggcgcgggcgagaaggccctgaagttgtcctggttcaagaaggggagttcgataggaaagatgttcgaagcaacagcccgcggggcgcgccggatggctatcctcggggacaccgcgtgggacttcgggtcaataggaggggtgtttacctccgtcggcaagctggtgcaccaaattttcggaactgcctacggtgtgctgttctctggggtttcgtggacgatgaagatcgggatcggggtgctcctgacgtggctggggctaaacagccgcagcacttcactgtccatgacttgcatagccgtagggctggtcacgttgtacttaggcgtgatggtacaggctgattccggctgcgtaatcaactggaagggccgagagctgaagtgcgggagcggcatctttgtgaccaacgaggtgcacacctggaccgagcagtacaagtttcaggcggactccccgaagcggctctcagccgcgataggaaaggcctgggaggaaggggtctgtggcatacgttccgccacccggctggaaaatatcatgtggaagcagatatcgaatgagctgaaccacatcctcctggagaacgacatgaagttcacggtcgtcgttggggacgtggccggtatcctagctcaagggaagaaaatgatccggccgcagcccatggagtataagtactcctggaagtcctggggcaaggccaagatcatcggagctgacgtgcagaacaccacgtttatcatagacgggccgaacactcctgagtgtcctgacgaccagcgggcgtggaatatctgggaggtggaggattatggcttcgggatctttacaaccaacatctggctcaagctcagagacagttacactcaggtgtgtgaccaccggctgatgagcgccgccataaaggactccaaagccgttcatgccgacatgggatactggatcgagagcgagaagaatgagacgtggaagctcgcccgtgcttccttcatcgaggtaaagacatgcatctggccaaagagccacaccctgtggtccaacggtgtactggagagcgagatgatcatccccaagatctatgggggaccgatatcccagcataactatcgtcccgggtacttcacccagactgccggcccctggcatctcgggaaacttgagctggacttcgacttgtgtgagggaaccactgtcgttgtggacgaacactgcggaaaccgaggaccgagccttcgaaccaccacggtgaccggcaagatcatccacgagtggtgttgccgcagctgcaccctgccgcccctccggttcaaaggagaggacggctgctggtacgggatggaaatcagacccgtcaaggagaaggaggagaacctcgtcaaatccatggtcagcgcagggtccggcgaggtcgacagctttagtctggggctcctgtgcatcagcattatgatagaagaagtaatgcgctcccgctggtcaagaaagatgctgatgaccggcaccctcgccgtgttcttcctgttaataatggggcagctaacctggaatgatctgatacgcctctgcatcatggtcggcgcgaacgctagcgaccgaatggggatgggcaccacgtacctcgccctgatggccacattcaagatgcgtccgatgttcgccgtggggctcctgttccgtcggctgaccagcagagaggtgctgctcttaaccatcgggctatccctcgtcgcaagcgtggagctccccaactccctggaagaactgggcgacgggctggccatgggcatcatgatcttgaaacttctgaccgactttcaaagccaccaactgtgggccactctcttgtccctgacgttcattaaaaccaccttcagcctccattacgcctggaaaactatggcgatggtcctctccatcgtcagcctgttcccgctctgcctgtccaccacgagtcagaaaaccacctggctgcccgtactcctgggctccttagggtgcaagcctctcacgatgttcctgatcgccgaaaataagatctggggccgcaagtcatggcctctgaacgaaggaatcatggccgtcggcatcgtgagtatactcctctctagcctgctcaagaacgacgttcccttagccggaccgctaatagccggcggcatgctcatcgcgtgctacgttatatccgggagctccgccgacctgtctcttgagaaggccgccgaggtttcgtgggaggaggaggccgagcattctggcgcctcccataacatattggtggaggtgcaggacgacgggaccatgaagattaaggacgaggagcgagatgacacgctaaccatcctgctcaaggctacgctgctggcggtgtcgggggtgtatccgctttccatacccgccaccctgttcgtctggtacttctggcagaagaagaagcaacggtctggggtcctctgggacacccccagcccgccggaggtggagagggccgtcctagacgatggaatctaccggatcatgcagcgcggtctgctggggagaagccaggtgggcgtgggagtcttccaagagaacgttttccacaccatgtggcacgtgacgcggggtgcggtcctgatgtaccaggggaagagactcgagccctcctgggctagcgttaagaaggacctgatcagttacggaggcggctggcgtttgcagggcagctggaataccggggaggaggtacaagtaatagccgtggaacccggcaagaaccccaaaaacgtgcaaaccgcccctgggacctttaagacgagtgagggagaggtcggcgcgatcgctttagacttcaagcctggaaccagcggtagccccatagtgaaccgggaggggaagatcgtaggtctctacggaaatggggtggtgaccacctccggtacatacgtgagcgccatagcacaagctaaggcgtcacaggaggggcccttaccggagatcgaagacgaagtcttccgcaagcggaacctcaccatcatggatctgcacccaggttcgggcaagacccgccgataccttcccgccatcgttcgcgaggccattaagcggaagctccgcacgctgattctggccccgacacgggtggtagcttccgagatggcggaggccctcaagggcatgccgatacgctatcagaccaccgcagtgaaaagcgagcacactggaaaggagatagtggacctgatgtgccatgccacgttcaccatgcgcctgctctcccccgttcgggtgcccaactacaacatgataatcatggatgaagcgcacttcaccgatcccagctctatagcggctagagggtacatcagcacgcgggtcggcatgggggaagccgccgcgatattcatgacggcgacgccgccgggctccgtagaggctttcccccagagcaatgcggtgatccaagatgaggagcgcgacatcccggaacggtcgtggaacagcgggtacgagtggatcaccgacttccccggcaagaccgtgtggttcgtaccctcaatcaagtcgggcaacgacatcgcgaattgcttacgcaagaacgggaaacgggtgatccagctgtcccgcaagacgttcgacaccgagtaccaaaagaccaagaacaacgactgggactatgtggtcaccacggacatttcggagatgggcgcgaatttccgggccgaccgcgtgatcgacccccgacgctgcctcaagccggtgatccttaaggacgggcccgagagagttatcctggccggccccatgcctgtgaccgtcgcgtccgccgcgcaacgccgcgggcgcatcggccggaaccacaacaaggagggcgaccagtacatctacatggggcagccgctcaataacgacgaagatcacgcccactggaccgaagccaaaatgctactggacaacatcaacacccccgagggcatcatccctgccctgttcgaaccggagcgcgaaaagagcgccgcgatcgatggggagtaccggctgcgcggcgaagcccgcaagacgttcgtggagctaatgcggaggggtgacctccctgtgtggctgagctacaaggtcgcctccgaagggtttcaatacagcgacaggcgctggtgctttgacggcgagcgcaacaaccaggtgctagaggaaaacatggatgtggagatctggacgaaggagggggagcgcaaaaagctccgtccccgatggcttgatgctcggacctattccgaccccttagctctccgcgagttcaaggagttcgcggccggccggaggtccgtttccggtgacctgatcctggaaatcggtaagttgcctcagcacctgacccaacgcgcccaaaacgccctggacaacttggtaatgctgcacaacagcgagcagggcggccgcgcctacaggcatgccatggaggaactgccggatactatcgagaccctcatgctactggctctcatcgcagttctgaccggtggggtcactctgttcttcttgagcggcagagggctgggcaagaccagtataggactgctctgcgtcatggcttctagcgcgcttctgtggatggcctccgtggaaccccactggatcgccgctagtataatcctcgagttcttcttaatggtcctgctcatccccgagcccgaccggcagcggacgccgcaggacaaccagctggcctacgtggtgatcggacttctctttatgatccttaccgtcgctgcaaatgagatgggtctgctcgagaccaccaagaaggacttgggcatcggccacgtggccgtggaaaatcatcaccacgcggcaatgctggacgtcgacctccaccccgcgtccgcttggacgctttacgccgttgccactaccatcatcacccccatgatgcggcacacgatcgagaacaccactgccaacatcagtttgaccgccatcgccaaccaggcagccatcttgatgggcctggataagggctggcccatttccaaaatggatataggtgtgcccctactcgcgttggggtgctactcccaagtcaaccctctgacgctcactgccgcagtgctgatgctggtggcccactacgccatcatcggcccggggttacaggcgaaagccacgcgcgaggcccagaaacggaccgctgccggcatcatgaagaacccgaccgtggacgggatagtggcaatagacttggaccccgttgtctacgacgctaagtttgagaagcaacttggccaaattatgctcttggtgctgtgcacctcacagatcctcctgatgcgcaccacctgggccctttgtgagtcaatcactctagccaccggcccgctgaccacgctgtgggaggggtcccccggtaagttctggaacacgaccatcgctgtgagcatggcgaatatctttagggggagctacctcgctggtgccagcctggcctttagcctaatgaagtcccttggaggaggccggcgagggaccggagcgcagggggagacgctgggcgagaagtggaagcggcagctgaaccagctcagcaaatccgagtttaacacgtataaacgctccggcattatggaggttgacaggtccgaggccaaggaagggctgaagagaggcgaaacaacgaagcacgctgtaagccgggggaccgccaaactccgctggttcgtcgagcggaacctggtcaagccggagggtaaggtgattgacctggggtgcggtcgcggagggtggagttactattgcgccggcctgaaaaaggtgactgaggttaaggggtacacgaagggcgggcccggccacgaggagcccatcccaatggcgacctatggatggaacttggtgaagctccacagcgggaaggacgtgttcttcatccctccggagaagtgcgacaccctgctgtgcgacatcggtgagtcgtctcctaatcccacgatcgaggaggggcggaccttgcgcgtgctgaagatggtcgagccgtggttacgggggaaccagttctgcataaagatcctcaatccctacatgcccagtgtcgtcgagaccctggagcagatgcagagaaagcacggcggcatgctagtgaggaaccccctgtcccgcaactccacccatgagatgtactgggtgagctgcggtaccgggaatatcgtctccgcagtgaacatgacgagccggatgctgttgaaccgcttcacgatggcccaccgaaagccgacatacgagcgcgacgtggacttgggcgccgggacacgccacgtcgccgtggagcccgaggtagcgaacctcgatatcatcggccagcggatcgaaaacatcaagcatgaacacaagtcaacatggcactacgacgaggacaacccctacaagacatgggcctaccacggctcttacgaggtcaagccctcggggtccgccagcagtatggtgaacggagtcgtcaagctactcaccaagccgtgggacgtcattcctatggtcacccaaatcgccatgacggacaccacgccctttggccagcagagggtgttcaaggagaaggttgacacccggacgcccaaggcgaaaagaggtactgcgcagatcatggaggtgaccgccaagtggctgtggggtttcctaagccgcaataagaaaccgagaatctgcaccagggaggagttcactcgcaaggtgcggtccaacgccgccatcggggcggtgttcgtcgacgagaatcagtggaactcagctaaagaagccgtggaggacgaacgcttctgggacctcgtgcaccgggaacgggagctgcacaagcaaggcaaatgcgctacctgtgtctataacatgatggggaagcgcgagaagaaactgggcgagttcgggaaggccaaggggtcccgcgctatatggtatatgtggctcggggcccggttcctggagttcgaggccctgggctttatgaacgaggaccactggttctctcgcgagaactccttatctggcgtggagggagaaggtctgcacaagctggggtacatactacgcgacatctccaagatccccggcgggaacatgtacgccgacgacacggccggatgggatacccgcattacggaagacgacctgcagaacgaagcgaagatcaccgacatcatggagcccgaacacgccctgctggccaaatcaatattcaagttgacctaccagaacaaggtggtccgggtgcagagacccgccaaaaacggcaccgtcatggacgtcatatcccggcgcgaccagcgcgggagcggccaggtggggacgtacggactgaacacattcacgaacatggaggctcaactcatcaggcagatggaaagtgaggaaatcttcagcccctccgagctggaaacgcccaatctagctggccgcgtgctagactggctggagaaacacggtgtcgagcggctgaagcgcatggccatcagcggggacgactgcgtcgtgaagcccatcgacgacagattcgccacagccctcaccgcgcttaatgatatgggaaaagtccgcaaggacatcccgcagtgggaacccagtaagggctggaacgactggcagcaagtcccattctgttcccatcacttccaccagctgatcatgaaggatgggagggagatagtggtcccctgccgcaaccaggacgagctcgttggccgcgcaagagtaagtcaaggtgccgggtggtcactgaaggagaccgcctgcctaggcaagagctacgcccagatgtggcagctcatgtacttccaccggagagacctccggctggcagcgaacgcaatctgttccgccgtcccggtcgactgggtccccaccagccgtacgacctggtccattcacgcccaccaccaatggatgacaaccgaggacatgctcagcgtttggaaccgggtgtggatcgaggagaacccctggatggaggacaagacccacatctcgagttggggcgatgttccctaccttggtaagcgcgaagaccaatggtgtggatccctgatcggccttactgcgcgggccacctgggccacaaacatccaggtcgccatcaaccaggtgcgcaggctcatcggtaacgagaactacctcgattacatgactagcatgaagaggttcaaaaatgagtccgacccggagggagccctctggtga

SEQ ID NO: 24511 - RNA, 9879 nt, synthetic construct
  misc_feature 1..9879: note = derived and/or modified CDS sequence (opt11) from DENV-1__GU131820__SS-prME
  source 1..9879: mol_type = other RNA
agcgtgaccatgctgctcatgctgatgcccacagccttggctttccacctcaccacccggggcggggagccccacatgatcgtgacgaaacaagagcgggggaagtcccttctgttcaaaaccagcgcgggggtgaatatgtgcaccctcatcgcgatggacctgggtgagttgtgtgaggacaccatgacatacaagtgcccacggatcaccgaggctgagcccgacgacgtagactgttggtgtaatgccaccgatacatgggtcacttacgggacgtgctcccagaccggtgagcacagaagagacaagcggagcgttgcactcgcgccccatgtgggccttgggttggaaactcgtactgagacctggatgagtagcgagggtgcctggaaacagatccaacgggtcgaaacgtgggccctccgccaccccggctttaccgtgatagccctgtttctggcccacgccattggcaccagtatcacccagaaggggatcatcttcatactcctgatgctggtgacgcccagcatggccatgcgctgcgtaggcatcggtagtagagactttgtggagggcttatccggcgccacctgggttgacgtagtattagaacacggaagctgcgtcaccaccatggcaaaggacaagcccacgctggacatcgagctcctgaagaccgaggtcacgaaccccgcagtgctgcggaagctgtgcatagaggcgaagatatcgaacacgacgaccgactccaggtgtccgacacagggagaggcaaccctaatggaggagcaggatgccaacttcgtgtgccgtcgcaccttcgtcgatcggggctggggtaacgggtgcgggctgttcggtaagggaagcctcatcacatgcgccaaattcaagtgcgtaaccaagctggagggcaaaatcgtgcaatacgagaacctgaagtactccgtcatagtgaccgtccacactggcgaccagcaccaagtcgggaacgagagcaccgaacacggcaccaccgcgaccatcacgccccaggcgcccaccagcgagatccagctcaccgactacggggccctgacgcttgattgcagccccagaacgggcctggacttcaacgagatggtactgctgactatgaaggagaagtcctggctcgttcacaagcagtggttcctggatttaccactcccttggacctccggcgcgagcacttcccaggagacttggaaccgtcaggacctgcttgtgaccttcaagactgcccacgcgaagaagcaagaagtggtcgttctgggcagccaggagggtgccatgcacaccgcactgacaggggccaccgaaatccagactagtggcactacgacaattttcgccgggcacctgaagtgccgcctcaagatggacaagctgacactgaagggtatgtcctacgtgatgtgcactgggagttttaagcttgagaaggaagtcgccgaaactcagcacggcactgtgttagtacaaatcaagtacgaaggcaccgacgccccctgcaagatccccttctccacgcaggacgagaagggtgttacgcagaacggccgactgattacagccaaccccattgtgaccgataaagagaagcctgtgaacatcgaggccgagccgcccttcggggagtcctacatcgtcattggcgcgggcgagaaggctctgaagctcagctggttcaagaaaggctccagcatagggaagatgtttgaagccaccgcccggggagcccgtcgcatggcgatcctgggtgatacggcctgggacttcgggtctattggcggagtgtttacaagcgtcggcaagctggtccaccagatcttcggcaccgcctacggggtgcttttttccggggtgtcttggaccatgaaaatcggcatcggggttttattgacttggttaggcctgaactcccgaagcacgtcactgagcatgacatgtatcgctgtggggctcgtgacactgtacctgggcgtcatggtacaggccgactccgggtgcgtgatcaactggaaggggcgggagctcaaatgtgggagtggcatctttgtcaccaacgaagtgcatacctggactgagcagtacaagttccaggcggacagcccgaagcgcctgtctgcagctatcggcaaggcctgggaggagggggtgtgcggcatacgtagcgccacccgcctggaaaacatcatgtggaaacagattagtaacgagctcaatcacatcctgctggagaacgatatgaagtttaccgtagtggtgggcgatgtcgtgggtatcctcgcgcagggcaagaagatgatcaggccgcagcccatggagcacaagtattcgtggaaatcttggggtaaggctaagatcatcggcgcagacgtacagaacacgaccttcatcatcgacgggccgaataccccggagtgccccgacgaccaacgcgcctggaacatctgggaggtagaagactacgggtttgggatcttcaccacaaatatctggcttaaactacgggatagctacacacaggtctgcgaccaccgcctcatgtccgctgccattaaggactcgaaggctgttcacgcggatatgggctactggatcgagtccgagaagaacgagacctggaagctggcccgggcgtccttcattgaggtaaagacatgtatctggcccaaaagtcacacgctgtggagcaacggggtgctcgagtccgagatgataatccccaaaatctacgggggcccgataagtcagcataactaccgacccgggtacttcacccagaccgccggcccctggcatttaggtaagttggagctcgactttgacctgtgcgagggcaccacagtggtggtagacgagcactgcggcaaccgagggcccagtttgcgcactaccaccgttacgggcaagatcatccacgagtggtgttgccggagctgcaccctgccgcccttacgattcaagggggaagatggctgctggtacggcatggagatccggcccgtcaaggagaaggaggagaacctggtgaagagtatggtcagcgctggcctcggcgaggtagacagcttttccctgggacttctctgcatctccatcatgatcgaggaggtgatgcggtccagatggtcacgcaagatgcttatggccggcaccctcgccgtttttctcctgctcataatgggtcaacttacttggaatgacctgatccggctatgtataatggtcggagcgaacgcctcggaccgcatggggatgggcacgacctacctagcgttgatggccacctttaagatgcgcccgatgttcgccgtgggcctcctgttccggcgcttaacgagccgggaggtgctgttactgacgatcgggctgtccctcgtagcgtcggtggaactgcccaactccctggaagagctcggcgacgggctggccatgggcatcatgatcctgaagcttctgaccgacttccagagccaccagctgtgggctaccctcctgtcactgacattcatcaagacgactctctccctgcactacgcctggaagaccatggccatggtcctgtccatcgtaagcctctttcccctgtgcctgtccacgacgtcgcagaagaccacctggctgcccgtgctgctgggatccctcgggtgcaaacccctcaccatgttcttgatcgccgagaacaagatctggggccgaaagagctggccgcttaacgaaggcatcatggccgtcggcgtggtctccatcctgctgtctagcctcctcaagaacgatgttcccctggccggacccctcatcgccggcggcatgctaatcgcgtgctacgtgatttccggcagctctgccgacctgagtttagagaaggccgccgaagtgtcctgggaagaagaggccgagcacagcggggcgtcccacaacatcctggtcgaggtgcaggacgacgggacgatgaagataaaagatgaggaacgggacgacaccctgacaatcctcttaaaggccaccttgctcgccattagcggcgtgtacccgctttcgatccccgcgaccctgttcgtctggtacttctggcaaaaaaaaaaacagcgcagcggggtgctttgggatacacccagcccgccggaggttgagagagccgtcctcgacgacggcatctaccgcatcatgcagcggggcctgctggggcgcagccaggttggtgtgggggtgttccaggagaacgtgtttcacaccatgtggcacgtgacccgcggcgcggtcctcatgtaccaggggaagcgcctggagccttcgtgggccagcgtgaaaaaagacctcatcagctacggcggcgggtggcggctccagggctcctggaacaccggtgaggaggtgcaagtcatcgctgtggagcccggcaagaacccgaaaaacgtgcagacggcacccgggaccttcaagacacccgagggcgaggtcggtgctatcgcgctcgacttcaagccaggtacctccggaagccccatcgtgaatcgagaggggaagatcgttggcctttacggcaacggagtcgtgacgacatccggcacctacgtgagcgcgattgcccaggccaaggcgagccaggaggggccgctccccgagatagaggacgaggtctttcggaagcgcaacctgaccatcatggacctccaccccggctcagggaagacgcggcgatatctccccgccatcgtgcgggaggccatcaagcgcaaactgcggaccctgatcctcgcgcccacccgcgtggtcgccagcgagatggcggaagccctgaaggggatgcccatccgctatcagaccacggccgtgaagtccgaacacacgggcaaggagatcgtggacctgatgtgtcacgccacgttcaccatgagactcctcagccccgtccgcgtcccgaactataacatgatcatcatggacgaggcccacttcaccgatccctcaagcatcgcggcccggggttacatatcaacccgcgtaggcatgggggaagccgcagccatcttcatgaccgccaccccgcccggcagcgtcgaggccttccctcagtccaatgccgtgatccaggacgaggagcgggacataccggagcgcagctggaattccgggtacgaatggatcacggatttccccggcaagaccgtgtggttcgtccccagcatcaagtccgggaacgacatcgccaactgtctgcggaaaaacggcaagcgggtaatccagctgagccgcaagacattcgataccgagtaccagaagacgaagaacaacgactgggactacgtcgtcaccacggacatcagcgaaatgggcgctaacttccgcgccgatcgggtgatcgacccgcgccggtgtctgaaacctgtgatcctcaaggacgggcccgagcgcgtcatcctcgccgggccgatgccggtgaccgtcgccagcgccgcgcagcggcgcgggagaatcggtcgcaaccacaacaaggagggcgaccagtacatatacatggggcagccattaaacaatgacgaagaccacgcgcactggactgaggccaagatgctgctagacaatatcaacactcccgagggcatcatccccgccctgttcgaaccggagcgggagaaatccgcggctatcgacggagagtaccgtctgcgcggcgaggcccggaagaccttcgtggagctcatgcgtcgcggggacctgcccgtgtggctaagctacaaggtcgcctccgagggcttccagtattctgaccgccggtggtgcttcgacggcgagcgaaacaatcaggtgctcgaggagaatatggacgtggagatatggaccaaggagggggagcggaagaagcttcgccccaggtggctggacgcccgcacgtacagcgacccactcgcccttcgggagttcaaggagttcgcggccggccggcggtccgtcagcggtgacctgatcctcgagatcgggaagctgccgcagcacctaacccagcgcgcccagaacgccctcgacaacttggtgatgctgcacaactccgaacagggcgggcgtgcgtatcggcacgccatggaagagctccccgacaccatcgagaccctgatgctgctcgccctgatcgccgtactaactggcggagtcaccctcttcttcctgagcgggagaggactgggcaagacctccatcggcctcctgtgcgtgatggcttcatccgtgctactctggatggcgagcgtcgagccgcactggatcgccgcctccatcatccttgaattcttcctcatggtgctcctgatccccgagccggatcgacagcggacgccccaagacaaccagctggcctatgtagtcattgggctcctgttcatgatcctgacggtggcagccaacgagatgggcctactggagactaccaagaaggacctggggatcggccacgtggctgtcgagaaccaccaccatgccacaatgctcgacgtggatctgcaccccgccagcgcgtggaccctgtacgcggtggctacaacaatcataaccccgatgatgcgacatactattgagaacactaccgccaacatctccctcaccgccattgcaaaccaggcggccatcctgatggggctcgacaagggctggcccatcagcaagatggacatcggcgttcccctcctggccttagggtgctactcccaggtgaaccccttaaccttaacggccgctgtgctgatgctcgtggcccactacgcaatcatcggcccagggctgcaggctaaggccaccagagaggctcagaagcgaaccgccgccggcatcatgaagaaccccaccgtggatggtatcgtggcgatcgacctggaccccgttgtgtacgacgccaagtttgagaagcagttgggccagatcatgctgctgatcctctgcacgtcacagatcctgcttatgcgtaccacctgggcgttgtgtgagtcgatcaccttagcgacgggcccgctgacgaccttatgggaggggagtccgggcaaattctggaatacgacgatcgccgtgtcgatggccaacatcttccgtgggagctacctggcgggcgcgggcctggccttctcactcatgaagagtctgggtggcggacgccgagggaccggggcacagggcgagacgctgggcgaaaagtggaagcgccaactcaaccagctgagcaagtccgaattcaacatctacaagcggagcgggattatggaagtcgaccgctccgaggcgaaggagggtctgaagcgtggggaaaccacgcgccacgcggtcagccggggcaccgccaaactcaggtggttcgtggagcgaaatcttgtcaagcctgaaggcaaggtgatagacctgggttgcggccgtggggggtggtcctactactgtgccggtctgaaaaaggtgaccgaggtcaagggctacaccaagggcggacccggccacgaagagcccatccccatggccacatatggctggaacctcgttaaactacacagcggcaaggacgtgttctttacgccgcccgagcggtgtgacaccctactttgcgatataggcgaatctagcccaaacccgaccatcgaggagggccgcacgctgcgggtgctgaagatggtagagccctggctccgcgggaaccagttctgcatcaagatcctgaatccttacatgccctccgtggtcgagaccctggagcagatgcagcgcaagcacgggggcatgctcgtgagaaatccgttaagccggaactccactcacgaaatgtactgggtgagctgtgggaccggcaacatcgtctccgccgtgaacatgaccagccgcatgctgcttaaccgcttcacgatggcccaccggaagcccacctacgagcgtgacgtggaccttggggccggcacccggcacgtggccgtggagccagaagtcgccaacctggacatcatcggccagcgtatcgagaacatcaagcacgagcacaagtccacctggcattatgacgaggacaacccctacaagacgtgggcataccacgggagctacgaggtcaaaccgtccgggtccgcgtccagtatggtgaacggggtcgtgaagctcctcactaaaccctgggacgtgatccccatggttactcagatcgcaatgaccgatacgaccccctttggccagcagcgggtgttcaaggagaaggtggacacccgaaccccgaaggccaaaagaggtacggctcagatcatggaagtgaccgcacgttggttgtggggctttttgagccggaacaagaagccccgcatctgcacccgggaggagttcacccgcaaggtccggtccaacgcggccataggagccgtgttcgtcgacgagaaccagtggaacagcgccaaggaggcggtggaggacgagcgcttctgggacctggtgcagaaggagcgggagctgcacaagcaggggaagtgcgccacgtgcgtctacaacatgatgggcaagcgcgagaagaagctcggggagttcggcaaggccaaggggtcccgggcgatctggtatatgtggctgggcgctcgcttcctggagtttgaggctttaggtttcatgaatgaagaccactggttctcgagggagaattccctgagtggggtggagggcgagggtctgcacaaactcggctacatcctgcgtgacatctccaagatcccagggggcaacatgtacgccgacgacaccgcgggttgggacactcggatcacggaggacgacctccagaacgaggccaagattacggacattatggagccggaacacgccctcctcgcaaccagcatctttaagctgacctaccagaacaaggtcgtcagagtccaacgccccgccaagaacgggaccgtgatggacgtaatttcccgtcgagaccagcggggcagcggccaggtgggaacgtacggcctcaacaccttcacgaacatggaggcccaactcatccgccagatggagtccgaagggatcttcttacccagcgagctcgagacccctaacctggccgaacgggtcctggactggctcgagaagcacggcgtagagcgcctgaagcggatggccatttccggggacgattgcgtggtgaagccgatagacgaccgcttcgcgacggccctgacagccctgaacgacatgggcaaggtgcggaaggatatcccgcagtgggagccctcaaaagggtggaacgactggcagcaggtcccattctgttcccaccatttccatcagctgatcatgaaagacggccgcgaaatcgtggttccgtgccggaaccaggacgagctggtaggccgagcccgtgtgagccagggggcaggttggtccttgcgcgagaccgcgtgcctgggcaaatcctacgcacagatgtggcagctgatgtactttcaccggagagacctccggctggccgccaacgctatatgcagtgcagtacccgtggactgggtgccaacctcgcgtacgacctggagcatccatgcacaccaccagtggatgactaccgaggacatgctgtccgtgtggaacagggtgtggatcgaggagaatccctggatggaggacaagacgcacgtgtcttcctggggcgatgttccctatctcgggaagcgggaggatcaatggtgcggcagcctgataggcttaaccgcccgcgcgacctgggcttccaacatacaggtggccatcaaccaggtccggcgactcatcgggaacgaaaactatctcgattacatgacctcaatgaaacggttcaaaaacgaaggcgaccctgaaggggccttatggtga

SEQ ID NO: 24512 - RNA, 9879 nt, synthetic construct
  misc_feature 1..9879: note = derived and/or modified CDS sequence (opt11) from DENV-1__HM181970__SS-prME
  source 1..9879: mol_type = other RNA
agcgtgaccatgctgctaatgctaatgcccaccgcactggcgttccacctcaccacccgcggtggcgagccccatatgatcgtcagcaagcaggagcggggcaagtccctgctgttcaagacctccgccggggtgaacatgtgcaccctcatagccatggacttgggagagctatgcgaggacacgatgacctacaagtgcccgcgcattaccgaggccgagcccgacgacgtggactgctggtgcaacgccactgacacgtgggtgacatacggcacctgcagccagacgggagagcacaggcgcgacaagcggagcgtggctctcgcgccccacgtgggcctggggctggagacgcgtaccgaaacctggatgagctccgagggcgcttggaagcagatccaacgggttgagacctgggccctccgccaccccgggttcacggtgatagccctattcctggcgcacgccatcggcacctccatcacccagaaggggatcatcttcatcctgctgatgctggtgaccccatccatggccatgcggtgcgtcggcatcggcagccgagacttcgtggaggggctcagtggcgccacgtgggtggacgtcgttctggagcacgggtcctgcgtgaccacaatggccaaggacaagcccacgctcgacatcgaactcctaaagacggaggtcacaaaccccgcggtcctgcggaagctctgcatcgaggccaagatctccaacaccaccacagacagcagatgcccgactcagggcgaagccaccctggtggaggaacaggacgccaacttcgtctgccggcgcacgttcgtggaccgtggctgggggaacggctgcgggctgttcggcaaggggtcccttatcacgtgcgccaaattcaagtgcgtaacgaagttagagggcaagatcgtgcagtacgagaacctgaaatacagcgtgatcgtgacggttcacaccggcgaccaacaccaagtcgggaatgagagcaccgagcacggcaccaccgcgaccatcacgccacaagcccccacgaccgagatacagctcacagattacggggccctgacactggattgctctccccgaacgggcctcgacttcaacgagatggtcctgctgactatgaaagaaaagtcttggttggtgcacaaacagtggttcctggatctgcccctgccctggaccagcggcgcgagcacctcccaggagacgtggaaccggcaggacctgctggtaacctttaaaacagcccacgcgaagaagcaggaggtcgtggtgctaggttcgcaagagggtgccatgcacactgccctgacgggggccaccgagatacagacctccggcaccacaaccatcttcgcgggacacctaaagtgccgcctcaagatggacaaattgaccctgaagggtatgagctacgtaatgtgcaccgggagtttcaagctcgagaaggaagtggcggagacgcagcacggcacggtgctcgtccaaatcaaatacgagggcaccgacgccccctgcaagatccccttttcgacccaggacgagaagggggtgactcagaacgggcggctgatcaccgccaacccaattgtgaccgataaagagaagcccgtcaacatcgaggcggaaccgcccttcggggagtcctacatcgtgatcggagcgggcgagaaggccctgaagttgtcctggttcaagaaggggtcctccatcggcaaaatgtttgaggcaaccgcccgcggggcccggcgcatggcgatcctgggcgacacggcctgggatttcgggtccatcggaggcgtgttcactagcgtcgggaagctgatacaccagatcttcgggaccgcctacggggtactcttctccggagtgagctggaccatgaagatcgggataggcgtgctgcttacgtggctcggcctgaactcaaggagcacctccctgagcatgacctgcatcgccgtggggctagtgactctgtacctcggcgtcatggtgcaggccgactccgggtgcgtgatcaactggaagggccgggagttgaagtgtgggagcgggatcttcgtgacgaatgaggtgcacacgtggaccgagcagtacaagttccaggccgacagcccgaagaggctgtccgccgccatcggaaaggcctgggaggaaggcgtgtgcggaatccggagcgccacccgcctagagaacattatgtggaagcagatctccaacgagctcaaccacatactgctggagaacgacatgaaactcaccgtcgtcgtgggagacgtcgcgggcatcctcgggcaggggaagaagatgatacggccccaacccatggagtacaagtacagctggaagtcctggggcaaggccaaaatcatcggtgccgacgcccagaacacgacgttcatcatcgacggtcccaatactccggagtgccccgacgaccagcgcgcgtggaacatctgggaggtggaggactacgggttcggcatcttcaccacgaacatctggctgaagctccgggactcttacacccaggtttgcgaccatcgcctgatgtccgccgccataaaggacagcaaggccgtccacgccgacatgggctactggattgagtccgagaagaacgagacttggaagcttgcgcgggcctcgttcatcgaggtgaagacatgcatctggcccaagtcccacacgctctggagcaacggagtgttggagtccgagatgatcatccccaaaatctacggagggccgatctcacaacacaactaccgccccggttactttactcagacagcggggccatggcacctgggcaagctagagctggacttcgacctctgcgagggcaccacagtagtggtggacgagcactgcggcaaccggggcccgtccctccgcaccaccaccgtgacgggcaagataatccacgagtggtgctgccgaagctgcacccttccgccccttcgcttccggggcgaggatgggtgttggtacggcatggagatccgccccgtgaaagagaaggaagagaacctcgtgaagagtatggtcagcgcaggtagcggcgaggttgactctttctcactgggcctgctctgcatctccatcatgatcgaggaggtgatgcggtcacgctggtccagaaagatgctgatgaccgggaccctggccgtcttcttcctcctgatcatgggccagctgacgtggaacgacctcataagactgtgtatcatggtgggggcgaacgccttcgaccgcatgggcatgggcactacctaccttgcccttatggccaccttcaagatgcggccgatgttcgccgtgggactgctgtttaggcgtctcacgtcccgcgaggtcctgctgcttacgatcggcctgtccctggtggcgagcgttgagctcccaaattccctggaggagctaggggacggcctcgccatgggcatcatgatactgaaactactcaccgatttccagtcacaccagctgtgggccaccctgctctccctgacgttcatcaaaaccacgttcagcctgcattatgcctggaagacgatggcgatggtcctctccatcgtgagtctgttccccctgtgcttatccacgaccagccagaagaccacctggctgcccgtactgcttgggtccctcggctgcaagccgctgacgatgtttctcatcgccgagaacaaaatctgggggcggaaaagctggcccctgaacgaggggatcatggccgtcgggattgtctccatccttctcagcagcctgctgaagaatgacgtccccctcgccggccccctcatcgccggcgggatgctaattgcgtgttacgtgatctccgggtcgtccgccgacttgagcctggagaaggcggcggaggtgtcatgggaggaggaggccgagcacagcggggcgtcccacaacatcctggtcgaggtgcaggacgacgggaccatgaagatcaaggacgaggagcgcgacgacaccctgacgatcctgctgaaggccacactcctggctgtgagcggagtctacccgctgtctatccccgccaccctctttgtgtggtatttttggcagaaaaagaagcaacggagcggcgtactgtgggacacccccagcccgcccgaagttgagcgcgccgtgctcgatgacggcatctacagaatcatgcagcgcgggctgttaggccggtcgcaggtgggagtaggtgtattccaggaggacgtgttccacaccatgtggcacgtcaccagaggtgcggtgctgatgtaccagggcaaacgcctggagccctcctgggcctctgtgaagaaggacttaatctcctacggcgggggctggcgcctgcgggggagctggaacacgggcgaggaggtccaggtgatagccgtggagccagggaagaaccccaagaacgtccagaccgcccccgggaccttcaagacccctgagggcgaggtgggggcaattgcgctggacttcaaacccggaacgtccggctcccccatcgtcaaccgcgagggcaagatcgtcggcctctacggcaacggcgtggtgaccacttccgggacctacgtctccgccatcgcccaggccaaggcgagccaggagggcccgctccccgagatagaagacgaggtcttccggaagcgcaacctgacgataatggacctacaccccgggtccggcaagacccggcgctacctcccggccatcgttcgtgaggcgattaagcgaaagctgcgcaccctcatcctggccccgacccgggtcgtagccagtgaaatggcggaggccctgaagggcatgccaatacgctatcagacgaccgccgttaagtccgagcacacggggaaggagatcgtcgacctgatgtgccatgccaccttcactatgcggctgctgagccccgtgcgagtgcccaactacaatatgatcatcatggacgaggcccacttcaccgatccgtcgtccattgcagccaggggctacatctccacacgcgtcgggatgggcgaggccgcggccatattcatgaccgcgactccgcccgggagcgtcgaggctttcccgcagtccaacgctgtgatccaggacgaggagcgggacatccccgaacgctcatggaactccggccacgagtggatcaccgacttcccgggcaagaccgtatggttcgtgcccagcatcaagtccgggaacgacatcgccaactgcttgcgtaagaacggaaagcgtgtgatccagctgagccggaagaccttcgacaccgagtaccaaaagaccaaaaataacgactgggactacgttgtgaccaccgacatctccgaaatgggggcaaacttccgcgccgaccgggtcatcgacccgcgccgatgcctgaagcccgtcatcctcaaggacggcccggaacgcgtgatcctggccgggcccatgcctgtcacagtcgcctcagccgcacagcggcgcggccggattggccgcaaccataacaaggagggggaccagtacatctacatgggacagcccctgaacaacgatgaggaccacgcccactggaccgaggccaagatgctactggacaacatcaacacaccggaggggatcatccccgccttgttcgagccggagcgcgaaaaatccgccgcggtggacggagaataccggctccgcggcgaggcccgaaagacctttgtcgagctgatgcgccggggcgacctgcccgtgtggctcagctacaaggtggcctccgagggcttccagtactcagaccgccggtggtgtttcgacggggaacgcaacaaccaggtactggaggagaacatggacgtggagatctggacgaaggagggcgagaggaagaagctgcgtcccaggtggctcgacgccagaacctacagcgaccctctggcactgcgggagttcaaggagttcgcggcggggcgccggtccgtgagcggcgacctcatcttggagatcggcaagttacctcaacacctgacccagcgcgcgcagaacgcgctcgataatctggtcatgctgcacaacagtgagcagggtgggcgggcgtaccgccacgccatggaggagctgcccgacaccatcgagacgctgatgctcctggctctgatcgccgtgctcaccgggggcgtgactctgttcttcctgagcgggcggggcttagggaagacctctatcgggttgctgtgcgtcatggccagctccgtactcctgtggatggcatcggttgagccccactggatcgcggcatccatcatcctggagttctttctcatggtcctactgatccccgagcccgacaggcagcggacgccccaggataatcagctagcatacgtcgtgatcggcctgttgttcatgatcctaactgtcgccgcgaacgaaatggggctgctagagaccaccaagaaagacctcggcatcgggcacgtggccgttgagaaccaccaccacgccgccatgcttgacgttgacctacaccccgcgagcgcgtggaccctctacgccgtggccacgaccataatcaccccgatgatgcgccacaccatcgagaacacgaccgccaatatcagcctgaccgcaatcgcgaatcaggccgcaatcctgatgggcctagacaaaggttggcccatcagcaagatggacatcggtgtgcccctgctggccctcggctgctattcccaggtgaaccccctgacgctgacggcggccgtgctcatgcttgtggcccactacgctatcatcgggccgggcctccaggctaaggcgacacgcgaggcccagaagagaaccgcagcagggatcatgaagaatccgaccgtcgacggcatcgtggcaattgacctcgaccccgtggtctacgacgcgaagttcgagaaacaactgggccagatcatgcttctcatactgtgcacgagccagatcctgctgatgcgtaccacctgggccttgtgcgagtccatcactctcgccacgggacccctcaccactctgtgggagggcagcccggggaagttctggaacacgacgatcgccgtatccatggccaacatcttccggggcagctacctggcgggggctgggctcgccttttccctgatgaagtctctgggagggggccgccgagggaccggcgcacaaggcgagactctaggggagaagtggaagcggcagctgaaccagctgagcaagagcgagttcaatacctataagcggagtggcatcatggaggtggacagatccgaggcgaaggagggtctcaagcggggcgagacgaccaagcacgccgtcagccgggggaccgccaagctgcggtggttcgtggagcgcaatctggttaaaccggagggcaaggtcatcgacctggggtgtgggcggggaggctggtcctactactgtgctggcctcaagaaggtgaccgaggtgaaggggtacacaaagggcggccccgggcacgaggagcccatcccgatggccacctacggctggaacttggtgaaactgcacagcgggaaggacgtgttcttcatcccgcccgagaagtgcgataccctcctgtgtgacatcggcgagtcgtcccctaacccgaccatcgaggaggggcgcacgctacgggtgctcaagatggtggagccctggctgcgcggcaaccaattctgcataaagatcctgaacccctacatgccctctgtggtggagaccctcgagcagatgcagcggaagcacggcgggatgctggtccgcaacccgctgagccggaattccacccacgagatgtattgggtatcgtgcggcacgggtaacatcgtgtccgcggtaaacatgactagccgcatgctcctcaaccgtttcacgatggcccaccgtaagcccacctacgagcgcgacgtggacctgggaaccggcacccggcacgtggcagtggagcccgaggtggccaaccttgacatcatcgggcagcgcatcgagaacatcaagcacgaacataagtccacgtggcactacgacgaagataacccctacaaaacctgggcctaccacggctcctacgaggtgaaaccttccgggagcgcgagctcgatggtgaacggcgtcgtcaagctactcaccaagccctgggacgtgatccctatggtgacccagatcgcgatgacggataccacccccttcgggcagcagcgtgtctttaaggagaaggtggacacccgcacgcctaaagccaagcggggcaccgcccagatcatggaggtgaccgcccgctggctctggggcttcttgtcacggaacaagaagccccgaatctgcacccgggaggagttcacgagaaaggtccggtccaacgcagctatcggggcggtgttcgtggacgagaaccaatggaacagcgctaaggaggcggtcgaggacgagcgcttctgggacctggtgcatcgggaacgcgagttgcacaagcaaggcaagtgcgcgacgtgcgtgtacaatatgatggggaagcgggaaaagaagctgggggaattcggtaaagccaagggctcacgcgcaatctggtacatgtggctgggagcccggttcttagagttcgaggcgctggggttcatgaacgaggatcactggttcagccgcgagaactccctgtcgggcgtcgagggggaaggcctccataagctcgggtatatcctgcgggacatctccaagatcccgggcggcaacatgtacgccgacgacaccgccgggtgggacacacgcatcacggaagacgacctccagaacgaggccaaaatcactgacatcatggagcccgagcacgccctcctggccaaggccatcttcaagctcacctatcagaacaaggtggtgcgcgtgcagcgtcccgccaagaacggcaccgtgatggacgtcatcagccggcgggaccagcgggggtccggccaggtaggcacatacggactgaatacattcaccaacatggaggctcagctgatacggcagatggaatctgagggcatcttctcccccagcgagctcgagacccctaacctagcggagcgtgcgctggactggctcgagaaatacggggtggagcggctgaagcgaatggccatctccggtgacgactgcgtggttaagccgatcgacgatcggttcgccaccgccctgactgccctcaacgacatgggcaaagtgcgcaaggacatcccccagtgggaacccagcaagggatggaacgactggcagcaggtcccattttgtagccaccactttcatcagctgataatgaaggacggtcgggagatcgtcgtgccctgtagaaaccaggacgagcttgtggggcgggcccgcgtatcacagggcgccggctggtccctccgggagactgcttgcctgggcaagagctacgcccaaatgtggcagttgatgtacttccaccgccgggacctgcgcttagcggccaacgccatatgcagcgccgtacccgtggactgggtcccgacctcccggaccacctggagcatccacgcccaccaccagtggatgaccaccgaagatatgctgtctgtgtggaaccgcgtttggatagaggagaacccttggatggaggacaagacgcacatcagctcctgggaggacgtcccgtacctcgggaagcgcgaggatcagtggtgcggctccctaatcggtttgacggcgcgcgccacctgggccaccaatatacaggtagccatcaatcaagtgaggagactcatcgggaacgagaactacctagactacatgacctccatgaagcgctttaaaaacgagagtgaccctgaaggtgccctgtggtga

SEQ ID NO: 24513 - RNA, 9879 nt, synthetic construct
  misc_feature 1..9879: note = derived and/or modified CDS sequence (opt11) from DENV-1__GU131821__SS-prME
  source 1..9879: mol_type = other RNA
agcgtgacaatgctgctcatgctgatgcctaccgccctggcctttcacctcactacccgaggcggggaacctcacatgatagtaagcaagcaggagagaggcaagagcctgctgttcaagacgagcgccggcgtgaatatgtgcaccttaatcgctatggacctgggcgagttctgcgaggacacgatgacatataagtgcccacgcataacggaggcagagcccgatgacgtcgattgctggtgcaacgcaacagacacgtgggtgacctatgggacctgcagccagaccggcgagcatcgtcgggacaagcggagtgtggcgctagcgcctcatgtggggctcggccttgagacacgcacagaaacctggatgagctccgaaggggcctggaagcagattcagaaagtggaaacctgggccttacggcatccagggtttactgtaatcgccctctttctggcgcatgccataggcaccagcatcacccagaaggggatcatcttcatcttactcatgctggtgacacctagtatggcgatgcgatgcgtaggcatcggctcccgggactttgtggaggggctgtccggcgccacttgggtggacgtggttctcgagcatgggagctgtgtgaccacgatggccaaggacaagcctaccctggacatcgagctgttgaaaacggaggttaccaacccggcggtgctccgcaagctgtgtattgaagccaagataagtaacactacgacggacagccggtgcccgactcagggcgaggccacactcgtggaggagcaagatgccaatttcgtttgtcgccggacattcgtggaccgcggctggggcaacggctgcggtctctttggcaaagggtctctgataacgtgcgccaaatttaagtgcgtgaccaagctcgagggcaagacagtccagcacgagaacctgaaatacagcgtaattgtgacagtccacacaggagaccagcaccaagtcggtaacgagtcaaccgaacacggcaccaccgcgaccataacacctcaggcacccagcacggagatccagctgaccgactacggggccctcaccttagactgcagcccgcggacgggccttgacttcaacgagatggtactcctaaccatgaaggagaagtcctggctggtgcataagcagtggttcttagacctcccgctgccgtggacgtcaggggcctcgacgtcacaggaaacttggaaccgcaaggacctattggtgaccttcaagaccgcacatgctaagaagcaagaggtcgtggtattaggctcacaggagggcgcgatgcacaccgccctcacaggggccacagagatccaaacctccggcaccacgaccattttcgcagggcacttaaagtgccggctgaagatggacaagctcaccctgaagggcatgagctacgttatgtgtacagggagcttcaagctggagaaggaggtggcggagacgcagcacggaactgtgctcgtacaaatcaagtacgagggcaccgacgcgccttgcaagatacccttctccacgcaagacgagaaaggggtgacgcaaaacggccgcctcatcaccgccaatccgattgtgactgacaaagagaagcccgtcaacatcgaggcagagccgccgttcggggagagctatattgtgataggtgccggcgagaaagcactgaagctgtcctggttcaagaaaggaagctccatcggaaaaatgttcgaggccaccgcccgtggggcccgccggatggcgatcctcggtgacacggcctgggacttcgggtctatcggcggtgtgttcacttccgtagggaaattagtgcaccagatcttcggcacagcctacggtgtgctcttcagcggcgtatcctggacaatgaagatcgggatcggagtgctcctgacatggctcggcctcaactctcgcagtacctctctgtccatgacctgcatcgccgtgggccttgtcaccctctacctgggcgtgatggtacaagctgacagcgggtgcgtcatcaactggaaagggcgcgagttgaaatgcgggtcgggcatcttcgtgacgaacgaggtgcacacctggaccgagcagtataagttccaggccgactccccgaagcggttaagcgcggccatcggcaaagcctgggaagaaggggtctgtggcatccgaagcgccacccggctggagaacattatgtggaagcagatcagcaacgaactgaaccacatcctccttgagaacgatatgaagttcactgtggtggtgggggatgtggcgggcatcctggctcaggggaagaagatgattagaccccaacccatggagtacaagtactcctggaagtcgtggggcaaggctaagataatcggcgctgacgtgcagaacacgaccttcatcattgacgggcctaacaccccggaatgtccggacgaccagcgggcgtggaacatctgggaggtcgaggactatggcttcgggatctttactacgaacatatggctcaagttgcgcgatagttacactcaggtttgtgatcacaggctcatgagcgcagctataaaggactccaaggccgtgcacgcagatatgggatactggattgagtcagagaagaatgagacctggaaactcgcgagagcgtcctttatcgaggtaaaaacctgcatctggcccaagagccatacgctgtggtccaacggcgtgttagaaagcgagatgataataccaaagatatatgggggcccgatctctcagcacaactaccggcccgggtacttcacccagaccgcgggcccctggcacctcggaaagctggagctcgacttcgacctctgtgaagggaccactgtggtcgtggatgagcactgcggtaaccgcggtccgagcctgcgcaccactaccgtgaccggaaaaatcatccacgagtggtgttgtagatcctgcacgttgccgcccctccggtttaaaggggaggatggttgctggtacgggatggagatccgccccgtcaaggaaaaggaggaaaacctggtcaaaagcatggtaagcgccggttccggcgaggtcgactccttctccctggggttactgtgcatttcaataatgatagaagaggtaatgcgctctcgctggagcagaaagatgctgatgaccggcacactcgccgtgtttttcctactcatcatgggtcagctcacgtggaacgacctgatccgcctatgtatcatggtaggcgcgaacgcctctgataggatggggatgggcaccacttacctcgccctgatggctacgttcaaaatgcgccctatgttcgctgtgggcttgctgtttcgccgtctgacatcacgcgaggttttgctcctgacaatcggactgtctcttgtcgcgtcagtggaactgcccaacagtttggaggagctcggcgatgggctagctatgggcattatgatcctgaaattgctgacggacttccagagccaccaactgtgggccacactcctgtctctgacgttcatcaagaccactttcagcctccactacgcctggaagaccatggcgatggtcctgtctattgtgtcactgttccccctatgcttgtccacgacctcccagaagaccacctggctcccagttctcctgggcagcctgggatgcaagccgttaaccatgttcctgatcgccgagaacaaaatctggggccggaagagctggccactgaacgagggaatcatggccgtcgggatcgtgagcattttattgtccagccttctcaagaacgatgtgcccctggcagggccactcatcgctggcggcatgctgatagcctgctacgtcatctctgggtcatccgccgacctgagcttagagaaggccgccgaggtgtcctgggaggaagaggctgagcacagcggcgcgtcccacaacatcctcgtggaagtacaggatgacgggaccatgaagatcaaggacgaggagcgtgatgatactctgaccatcctcctcaaagcgaccttgctcgccgtaagcggagtttaccctctctccatccccgccacgctgttcgtctggtacttttggcaaaagaaaaagcagcgcagcggggtgctctgggacacgcccagcccacctgaggttgaacgagccgtcctcgatgacggcatatacagaatcatgcagcgcggcttgttagggaggagccaggtcggcgttggagtgttccaggagaacgtgttccataccatgtggcacgtgacgcgaggcgcggtactgatgtaccaggggaagcgattagaaccctcctgggcctcagtgaagaaagacctgatctcctacggcggcgggtggcgcctccaaggcagttggaacacaggggaagaggtgcaggtcatcgccgttgagcccgggaagaaccccaagaacgttcagaccgcccccgggacgtttaaaacctccgagggcgaggtgggcgccatcgccctcgattttaagcccggaacgtctggctcgcctattgtaaacagagaggggaaaatagtgggcctgtacggcaacggggtggtgaccacctccggcacatacgtgtccgccatcgcccaagccaaagcgagccaagaaggtcccctgccggagattgaggacgaggtgtttcgtaaacggaacctaacgatcatggacctgcaccccggcagcgggaagacccgccggtacctgcccgccattgttagagaggctattaagcggaaactccgtaccctaatcttagctccaaccagagtcgtcgcctccgagatggcggaggcccttaagggaatgccgatccgctatcaaactaccgccgttaagagcgagcacactggcaaggagattgtggacttaatgtgccatgccaccttcacgatgagactgctctccccagtcagggtacccaactataacatgataatcatggatgaggcccatttcaccgacccgtcctcgatcgccgcccgtggatacattagcacccgggtgggcatgggggaggccgcagccatcttcatgacggcgacgccgcctggctccgtcgaggcgttcccccagagcaacgcggtgatacaggacgaagagcgcgacattcccgagcggtcctggaacagcgggtacgaatggatcacggatttccccggcaagacggtgtggtttgtaccctcaatcaagtccggtaacgatatcgcgaactgcttgcgcaaaaacggtaagcgcgtaatccagctgtcccggaagaccttcgacacggaatatcagaaaacaaaaaacaacgactgggactatgtcgtgactacggacataagcgagatgggagcaaatttccgtgctgaccgcgtaatcgacccccggcgctgtctcaagccggtcatactcaaggacggtcccgagcgagtcatcctggccggtcccatgcccgtgacagtcgcctccgccgcgcaacgccgtggacgcataggccggaaccataataaagagggcgatcaatacatctacatggggcaaccgttaaacaacgatgaggaccacgcccactggacagaggccaagatgctcctagacaacatcaacacacccgagggaatcatccccgccctcttcgagcccgagagggagaagtccgccgcgatagatggggagtatagattacgcggcgaggccagaaagacgttcgtggagctgatgcggcgcggggatctcccggtgtggctgagctacaaggttgcctccgaggggttccagtacagcgaccggcgctggtgtttcgacggagaacggaacaaccaggtgctggaggaaaacatggatgtagagatctggaccaaggaaggggaacgaaagaaattacggccgcgttggctggatgcacggacctactccgaccccctcgccctccgtgagttcaaagagtttgcggcaggccggcgcagcgtatccggggacctaatcctggagataggcaaactcccacagcatttaacacagcgggcccagaacgccctggacaacctggtgatgctgcacaacagcgaacaaggcgggcgcgcgtatcgacacgccatggaggagctgcccgatacgatcgagacgctcatgttgttagccctcatcgccgtgctgactggcggggtgacactgttcttcctctcggggaggggactgggcaagacgagcatcggcctgttatgcgtgatggcctccagcgcacttctgtggatggcctcagtggaaccgcactggatcgccgcttcgattatcttggagttcttcctgatggtccttctcatacccgaacccgaccggcagcgcacccctcaggacaaccagctggcctatgtggtgatcggcctcctcttcatgatactgacggtcgcggcaaacgaaatgggcctgcttgagacaacaaaaaaggacctggggataggccacgtagccgtggagaaccaccatcacgcaactatgctggatgtcgaccttcaccccgcctcagcgtggactctatacgccgtagccaccactattataaccccgatgatgcgacatacgatcgagaataccaccgctaacatcagtctgactgccatcgcaaaccaggccgcaattctcatggggctggacaagggctggccaatctccaagatggacataggcgttccacttctcgccctggggtgttatagccaggtcaaccccctgacgctgaccgcagcggtgctgatgctggtggcccactatgccatcataggccccgggctacaggccaaggcaacccgcgaggctcagaaacggacagccgccggcatcatgaagaacccaacggtcgacggcatcgtggccatcgacctggaccctgtggtctatgacgcgaagtttgagaagcagctaggccagatcatgctcctgattctgtgcaccagccaaatcctattgatgcgcaccacctgggcgctgtgcgaaagcatcacgctcgcgaccggccctttgaccaccctctgggagggctcgcccggcaagttctggaacacgactatagctgtgagcatggccaacattttccgagggagctacctcgcgggagctggattggccttttccctgatgaaatcactcggaggcgggcgccgtggaactggggcccagggagagaccctgggcgaaaagtggaagagacagctcaaccagctcagtaagagcgagtttaacacgtacaaacgctctgggatcatggaagtcgaccggtcagaggccaaagagggactgaagcgcggggaaaccaccaagcacgccgtctcgcgaggaaccgcgaagctaaggtggttcgtcgagcgaaacctcgtgaaaccggagggcaaggtcattgacttgggctgcggccgtggaggatggagctactactgtgcgggccttaaaaaagttacagaggtcaagggctacacgaagggtgggcccggccatgaggagcccatcccaatggccacatatggttggaacctggtcaagctacactctggcaaggacgtattcttcatcccgcccgagaagtgcgataccttactgtgcgacatcggagaaagctcacccaaccctacgatcgaggaaggccggaccctccgagtgctgaaaatggtcgagccctggcttcgtgggaaccagttctgcataaagatcctcaacccctatatgccgagtgttgtggagaccctggagcagatgcagcgcaagcacggcgggatgctagtgcggaaccccctctctaggaacagcacccacgagatgtattgggtgtcctgcgggacaggcaacatcgttagcgcggtcaatatgacgagtcggatgctgcttaacagattcactatggcccaccggaagccaacgtacgagcgcgatgtggaccttggtgccggcacacgccatgttgccgtcgaacccgaagtggccaacctggacatcatcggccagcgcatcgaaaacatcaagcacgagcacaagtctacgtggcattacgacgaggacaacccctacaaaacctgggcataccatggaagttacgaagtgaagcccagcggcagcgccagcagcatggttaacggtgtggtcaagctgctcactaaaccgtgggacgtgatccccatggtgacccagattgccatgacagacacgacccccttcggccagcagcgcgtgttcaaggaaaaggtggacacccggacacccaaagccaagcgagggaccgcccagatcatggaggtgaccgcgaaatggctgtggggctttctatcgcggaacaagaagcctcgcatatgcaccagggaagagttcacgcgcaaagtgcggagcaacgccgccattggtgccgttttcgtagacgagaaccagtggaattcagcgaaggaggccgtggaagacgagcggttctgggatctagttcaccgggagagggagctgcacaaacaggggaagtgtgccacatgcgtctacaatatgatgggcaaaagagaaaagaaactgggggaattcgggaaggctaaggggagtcgcgccatctggtacatgtggctgggcgcgcggttcctggaattcgaagctctgggcttcatgaacgaggatcactggttctcccgcgaaaacagcctctcaggcgtagagggcgagggcctgcacaagctgggatacattctccgtgatatctctaagatacccggcggcaacatgtacgccgatgacactgcgggctgggacacccgcatcacggaggacgatctccagaatgaggccaagatcaccgacattatggagcccgagcacgcgctgctcgccaagtccatattcaagctgacctaccaaaacaaggtggtacgcgtccagcgccctgccaagaacgggacggttatggatgtgattagtcgccgcgaccagcgtggcagcggacaggtgggaacgtacggcctcaacaccttcaccaacatggaggctcaactgatccggcagatggagtcagagggcatttttagtccctccgagctagagacccccaacttggcgggccgcgtgctcgactggctggaaaaacacggggtggagagacttaagcgcatggcgatctccggcgacgactgcgttgtgaagcccatcgacgaccggtttgctacggctctcaccgccttaaacgacatggggaaggtacgcaaggacatcccgcagtgggagcccagcaaaggttggaacgactggcaacaagtacctttctgcagccaccactttcaccagctgatcatgaaggacggccgggaaatagtggtcccctgccgcaaccaggacgagttggttgggcgcgctcgcgtgagtcaaggcgcggggtggtccttaagagagacagcgtgtctgggcaagagctacgcacagatgtggcagctcatgtacttccaccgccgggacctgcgccttgccgccaatgccatctgctcagccgtgccggtcgagtgggtgcccacaagtagaactacatggagcatccacgcgcaccaccagtggatgaccactgaggacatgctctctgtttggaaccgcgtctggatcgaggagaacccctggatggaggacaagacgcatatcagctcctggggcgacgtcccatatctgggcaagcgagaggatcaatggtgcggctcactgattggactcactgcccgcgcgacatgggccaccaacatccaggtggccatcaaccaagtccgacggctgatcggcaatgagaactacttggactacatgacctccatgaaaaggttcaagaatgagtccgacccggagggggccctctggtga

SEQ ID NO: 24514 - RNA, 9879 nt, synthetic construct
  misc_feature 1..9879: note = derived and/or modified CDS sequence (opt11) from DENV-1__JF937617__SS-prME
  source 1..9879: mol_type = other RNA
tcagtcacaatgcttttaatgttgatgcctacagcactggccttccacctgaccacgagaggcggggagccccatatggtagtttcaaagcaagaacgggggaaaagcctactattcaaaaccagtgcgggggtcaacatgtgcacgttaatcgctatggatctgggagagctgtgcgaagacaccatgacgtacaaatgcccgcgcataacagaagcagagcccgacgacgtggactgctggtgcaacgccacggatacgtgggtcacatacggcacgtgtagccaaaccggggaacaccggagggacaaacgatcagtcgcgctcgcaccgcacgttggactaggcctagaaactcgaacggagacgtggatgagtagtgagggcgcctggaaacaaatacaacgagtggagacgtgggcactccgacaccctggcttcacggtgatcgccttattcctcgcgcacgcaatcggcaccagcataacacaaaaaggaatcatattcatactacttatgctggtaacgcctagcatggcaatgcggtgcgtcggcataggcagtcgggatttcgtagagggactctcgggtgcgacttgggtagatgtggtattagagcacggctcttgcgtaaccacaatggctaaggacaagccgacactagatatagaactccttaagaccgaagttacaaacccagcgattctgagaaaactatgtatcgaggccaagataagtaacacgactacggacagtcgatgcccaacgcaaggggaagctacgctggtggaagaacaagatgcgaacttcgtatgcaggcggaccttcgtggaccggggctggggcaacgggtgcggattattcggaaaaggatccctgatcacgtgtgccaaattcaagtgtgtgaccaagctggagggaaagattgtgcagtacgaaaacctcaaatatagtgttatcgtgacggtccataccggcgatcaacaccaagtcggtaatgagagtactgagcacgggacaaccgccaccataacgccgcaagccccaaccacggaaatccagctcacagattacggagcactcacgctcgactgcagcccgcggaccggactcgacttcaacgagatggtactattaacgatgaaggagaaaagctggcttgttcataaacaatggttcctcgatttgcccctaccatggacgagcggagcaagcacttctcaagagacgtggaaccgccaagacctcctagtgacattcaagacggcacacgccaagaaacaggaagtagtcgttctcggcagccaagaaggagccatgcacacagcactcacgggcgcaacggaaatacagacgtcgggaactaccaccatttttgcgggccaccttaagtgccggttaaagatggacaaactcacgctcaagggaatgtcatacgtcatgtgtactgggagtttcaaattggaaaaagaagtcgcagaaacacaacacggcacagtactggtccaaatcaagtatgaaggcaccgacgcaccctgtaaaatccccttcagcacgcaagacgaaaaaggggtcacacaaaacggccgcctcatcacggccaacccaatagtaacagacaaggaaaaacctgtcaacatagaggcagaacccccattcggagagtcctacatagtgatcggcgctggcgaaaaagctctaaaactgagttggttcaagaaaggttcctcaatcggcaagatgttcgaggctacggcgagaggtgcgcgccgaatggccatactaggcgacactgcttgggactttgggagcataggaggggtgttcacgagcgtcgggaagctggtacatcaaatatttggaacagcatatggggtactgttctctggggttagttggacaatgaagattggattaggcgtgctactaacctggttggggttaaacagccgctcgacgagcttgtcaatgacctgcatcgccgtcggattagtcacactgtacctaggtgtgatggtacaggctgactcagggtgcgttattaattggaaaggcagggaattaaaatgcggcagcggaatctttgtaacaaacgaagttcacacctggaccgagcaatacaaatttcaggccgatagccccaagagactgtccgctgcaataggcaaggcgtgggaagagggcgtctgcggaatacgttcggcaacccggttggaaaacgtaatgtggaaacagatcagcaacgagctgaaccacatattacttgagaatgacatgaagttcacggtggttgtcggtgatgttgcagggatcctcgctcaagggaaaaagatgatacgaccacaaccgatggaatacaaatacagctggaaatcctggggaaaagcgaaaattatgggagccgacgtgcaaaatactacctttatcatcgatggcccgaatacccccgagtgtcccgacgatcagcgagcttggaatatatgggaggtagaagactacggatttggaatatttaccaccaacatctggctcaaactccgagacagctacacacaagtatgtgaccaccggctgatgagcgccgccataaaggacagcaaagcagtacacgcagacatgggttactggatcgaaagcgagaaaaatgagacatggaagctagcgcgcgcctcattcatcgaggtcaaaacatgcatatggcccaaaagtcacaccctgtggagcaacggtgtccttgaatctgagatgataatccccaaaatctacggtggacccatatctcagcacaactaccgcccaggatacttcacacagacggcgggaccatggcacctagggaagctggaactagactttgacctctgcgaaggcacaacggtcgtagtcgacgagcactgcggcaaccgcgggcctagcttgagaacaaccacagtaacagggaaaatcatccacgagtggtgctgcagaagctgtaccctcccacccctgaggtttcgaggagaggacggctgttggtatggcatggaaatacgtcctgtaaaagaaaaagaagaaaaccttgtgaaatcaatggtaagtgccggctccggggaagtcgatagcttctcgctaggactcctatgtatatcaattatgatcgaagaagttatgagaagccgatggtccaggaagatgctgatgacgggcaccctagtcgtgttcctgctgctaataatgggccaactaacatggaacgacctcatcagactatgcatcatggtaggcgccaacgccagtgacaggatgggtatgggaacaacatacctcgccctgatggccacattcaagatgaggccgatgtttgcagttggactactattccggcggttaacaagtcgcgaggtgctactactgactatcggcctcagcctagtcgcgagcgtggaattacctaactcactagaggaactaggtgacgggctggctatgggaataatgatacttaagctcctgacggacttccagtcccaccagctttgggcgacactactctcattaacgttcatcaaaaccacgttcagcttgcactacgcctggaaaaccatggccatggtgcttagtatcgtatctctattccctctatgcctcagcacaacctcgcagaaaaccacatggctcccagtactccttggctcactgggctgcaagccgctaacgatgtttctgattgcggagaataagatctggggccggaggagctggccgctgaatgaaggcataatggccgtgggaatagtaagcatactgctatcgtcactactcaaaaacgacgtacctctcgccggtccactgatagccggaggcatgctaatagcgtgctacgttataagcggctccagtgccgatctaagtctagagaaggcagcagaagtgtcttgggaggaagaagccgaacactccggagccagtcacaacattctagtggaagtacaggacgacggcaccatgaaaataaaggacgaggaacgagacgacacacttaccatcttactcaaagcaaccctgctggctgtatctggcgtatatcccttaagcatcccggcgacactgtttgtctggtacttctggcagaaaaagaaacaacgatcgggagtgctctgggacactccttcaccgcccgaggtcgagcgcgcggtcctggatgacgggatctaccgaatcatgcaacgcggcctcttaggacgcagtcaagtaggcgtcggagtattccaggagaacgtctttcataccatgtggcacgtcactcgcggcgccgttctaatgtaccaaggaaaacgcttggagccctcatgggctagtgttaagaaagacctcatttcatacggtggtggatggagactccaaggcagttggaacacaggcgaagaggtccaggtgatcgcagtagaaccgggcaagaaccccaaaaacgtccagacagcgccaggaacctttaagaccccagagggggaaatcggcgccatagccttagactttaagccggggacaagtgggtccccaatagtaaatcgggaaggcaaaatcgtcggcctctatggaaatggtgtcgtaacaacaagcggtacgtacgtttcggcgattgcacaagcaaaagccagccaggaaggaccgctccctgaaatagaagacgaggtcttccggaagcgcaacttgactatcatggacctccacccgggctcagggaaaaccagacggtacctgccggccatcgtcagggaagccataaagcgcaagctgagaacgctaatattggctccgacccgcgttgtggcaagcgagatggctgaagccctgaaaggaatgcctatacggtaccaaaccactgcagtaaagtcggaacatacagggaaggaaatagtagatctaatgtgtcacgcaacattcaccatgcgactactcagtccggtacgtgtccccaactacaacatgataatcatggatgaagcgcacttcaccgatccaagcagtatcgcagcacgcgggtacatcagtacccgagtcgggatgggagaggcggccgcgatttttatgacggcgacgccaccgggatcggttgaggcatttccgcagagcaatgcagtgatccaagatgaggaacgcgatatcccagaaaggagctggaatagcgggtacgaatggataacagatttcccaggtaaaactgtctggttcgtacctagcataaagtcggggaacgacatagccaattgcctcaggaagaacggaaagcgggtcatacagttaagccgcaaaaccttcgacactgaatatcagaagacaaagaacaacgattgggattatgtagtgacgacggacatatcagagatgggcgccaactttagggcggacagagttatagacccgcgacggtgcctaaaaccagtgatccttaaggacggaccagagcgagtaattctagcgggacctatgccagtgacggtagccagcgctgcgcagagacgaggtagaattggcaggaatcacaataaagaaggggaccaatacatctatatgggacaaccgctaaacaatgacgaagaccacgcacactggaccgaggccaaaatgctcctcgacaacattaacacacctgagggaataatacccgcactattcgagcccgaaagagagaagtccgcggccatcgacggtgaatataggctacgaggtgaagctcgcaaaacgtttgtagagctaatgcggaggggagacttacctgtctggttaagttacaaagtggcgtccgagggatttcaatacagtgaccgacgctggtgcttcgacggagaaagaaataaccaggtgctagaagaaaatatggacgtagaaatctggaccaaagaaggcgaaagaaagaaactgaggccaagatggctcgatgcgcgaacttatagcgacccgctcgctctcagagagtttaaagagtttgcagcaggcagaaggtcagtcagcggagacctcatactagagatcggaaaattgccccaacacctaacccagcgggcccaaaatgccttggacaacctcgtaatgttgcataatagcgaacagggcggtcgagcgtacagacacgcaatggaagaactgccggacaccatcgagaccctaatgctcctcgcactcatagcggtactaacgggtggcgtaaccctattcttcctcagcggaagagggctaggcaaaacgtcgataggcttactatgcgtcatggcgtcgagtgtactactatggatggcaagcgtcgaaccacattggatcgcagccagcatcatactggagtttttcctcatggtactcctcattccggaaccggacaggcaaagaacaccacaggacaaccaactagcctatgtcgtcatcggtcttctcttcatgattctaacggtcgccgccaatgaaatgggactcctagagaccacgaaaaaggatttaggaataggacacgcagcggtggggaatcaccaccatgcagcaatgctcgacgtcgacctgcaccccgccagcgcgtggacattatacgcagtcgcaacaacgatcatcaccccaatgatgcggcacactatagaaaacaccaccgcaaacatcagcctcaccgcaatagcaaatcaagcagcaatcttgatgggcctggataagggatggcccatcagcaagatggatattggagtacccctgcttgctttaggatgttacagtcaagtgaacccgctgacattaacggccgcagtcctgatgctcgtagcgcactacgcgataataggaccgggacttcaggcaaaggcaaccagagaagctcaaaaacgcacagccgcagggattatgaaaaatcccaccgtagatggcatagtagccatagacttggaccccgtcgtatacgacgctaaattcgaaaagcagctggggcaaattatgcttctcatcctttgcacatcacaaatattgctgatgcgcaccacctgggcactgtgtgaatccataaccctagccacaggaccactaaccacgctttgggagggaagtccaggaaaattctggaatacgacgatcgcggtgtcaatggctaatatattccgcggaagctacctagcgggagcagggctagcgttttccctcatgaagagtctcggaggaggacgccggggcacgggcgcacaaggcgaaacgcttggcgaaaaatggaaaagacaactgaaccagctaagcaaatcagagttcaacacctacaagagatcgggcatcatggaggtcgaccgcagcgaggcaaaagaggggctaaaaagaggggagacaacaaaacatgccgtttcgcgaggaaccgcgaaactacgctggtttgtcgaaaggaacctcgtgaaaccggagggcaaagtgattgacctaggctgtggacgaggaggctggtcttattactgcgcaggcctaaagaaagtcactgaggtcaaaggatatacgaagggaggaccaggccacgaagaaccaataccaatggccacatacggctggaatctggtaaaactccactccggcaaggacgtcttcttcataccacccgaaaagtgtgataccctcctctgcgacattggagaaagctcaccgaatccaacaatagaagaaggaagaactctaagagtgctaaagatggtggaaccatggctacgcggcaaccagttctgtatcaaaattctgaatccatacatgcctagcgttgtagagacactagagcaaatgcaacggaagcacgggggtatgctagtgcggaacccactatcccgcaacagtacccacgaaatgtactgggttagctgcggaacaggaaacatcgtatcagcagtaaacatgacatcccgaatgctcttaaatcggttcacaatggcccatcgtaagcccacatacgaacgcgacgtcgacctgggagcaggaacgagacacgtagcagtcgagccggaagtagcaaacttagacatcataggacaacggatcgagaatataaaacacgaacataagtcaacatggcattacgatgaggacaatccgtataagacatgggcgtaccacggcagctacgaagtgaagccgtcaggtagcgcgagttcgatggtaaacggagtcgtaaagctgctgaccaaaccatgggacgtcatcccaatggtaacacagatcgccatgactgacaccacaccatttggacagcagagagtgttcaaagagaaagtagataccaggacgcccaaagcgaagcgcggcaccgcgcaaatcatggaggtgactgcaaaatggttatggggctttctctcccgcaacaaaaagccgaggatctgtacaagagaagagttcacgagaaaagtgcgctctaacgcggcaatcggagccgtttttgtagacgaaaaccagtggaactcggctaaagaagccgtcgaggacgagcgcttctgggatttggtccatcgagagagagaactacataagcaaggaaagtgcgctacctgtgtgtacaacatgatggggaagagagagaaaaagctcggtgagttcgggaaagctaagggcagccgggccatctggtacatgtggctaggagcaagattcctagaatttgaagcccttggatttatgaacgaagaccactggtttagtagagaaaactcactcagcggggtggaaggggaagggttacacaaactcggttatatcctgcgggacatctcaaaaatacccgggggcaacatgtacgccgacgacaccgcaggatgggacacacgaatcactgaagacgacctgcaaaacgaggcgagaattaccgacataatggaacctgagcatgcccttctggccaagagcatcttcaagctaacctatcaaaacaaagtggtaagagttcaaagaccagccaaaaacgggaccgtcatggatgtcatttcgcggagagatcagaggggatcaggtcaagtgggcacatacggtctaaacacgtttacgaacatggaggcacagctcatcaggcaaatggaatctgaaggaatcttcagcccgagtgaactagagaccccaaacctcgccgaacgagtcctagactggctggaaaaatatggggtagaaagactcaaacgaatggccataagcggggacgactgcgtcgttaaacccatcgacgacagattcgccacagccttaaccgcattaaacgacatgggcaaagtgcgtaaggacataccccagtgggaaccgagcaagggatggaatgactggcagcaagttcccttttgctctcatcactttcaccaactaataatgaaagacggacgcgaaatagtagtaccctgcaggaatcaagacgaactcgtaggcagggcccgtgtgtcacaaggggctgggtggagcttgcgcgagaccgcatgccttggtaagagctacgcacagatgtggcaactgatgtacttccataggagggacctaaggctagccgcgaatgcgatatgctccgcagtaccagttgactggatcccaacgagtagaaccacctggtcaatacatgcccaccatcagtggatgacgactgaagacatgctcagtgtatggaaccgtgtctggatcgaggaaaacccgtggatggaggacaagacacacatatcgtcgtggggagatgttccatatctaggcaagagggaagaccaatggtgcgggtcgctcatcggcctaactgcgagagccacgtgggcaacgaacatacaagtcgcaatcaatcaggtgagaagacttatcggcaacgaaaattatctggactacatgacgtcgatgaagagatttaagaacgagtccgatcctgaaggagcactctggtga

SEQ ID NO: 24515 - RNA, 9879 nt, synthetic construct
  misc_feature 1..9879: note = derived and/or modified CDS sequence (opt11) from DENV-1__JF937618__SS-prME
  source 1..9879: mol_type = other RNA
agcgtgacaatgctgctcatgctgatgcccaccgccctggccttccatctcaccaccaggggcggggagccccatatgatcgtaagcaagcaagagcgggggaagagcctgctgtttaagaccagtgccggggtgaatatgtgcaccctcattgccatggacctgggcgagctgtgcgaggacaccatgacctacaagtgcccccgcatcaccgagaccgagcccgacgacgtggactgctggtgcaatgccaccgacacctgggtgacgtacgggacctgcagccagacgggagagcaccggcgagacaagcggtcagtagccctcgcgccacatgttggcctggggctggagacccggaccgagacctggatgtcttccgagggcgcttggaagcagatccagcgggtcgaaacttgggccctccgccaccccgggtttaccgttattgccctgttcctggcccatgcgatcggtacctccatcacacagaaggggatcatcttcattctcctgatgttggtgacgcccagtatggccatgcggtgcgtcggcattggcagccgggacttcgtggaagggctgtccggcgcaacctgggtggacgtcgtgctggagcacgggagctgcgtgaccactatggccaaagacaagcccacgctggatatcgagctcctgaagactgaggtcaccaatccagccatcctgcggaagctatgtatcgaggcgaagatctccaataccacaaccgactcgcgttgcccgacccagggcgaggctaccctggtcgaggagcaggacgccaacttcgtgtgccggcgcacgttcgtcgaccgtggctgggggaacggctgcgggctgtttggcaaggggtccctcatcacgtgcgccaagttcaagtgcgtgaccaagcttgagggcaagatcgtgcaatacgagaacctgaagtacagcgtcatcgtgaccgtgcacacgggcgaccagcaccaggtcggtaacgagtccaccgaacacggcaccacagccaccatcacgccccaggcgcccaccaccgaaatccagctcacagactacggggcattgacgctggactgcagcccccggactggcctggacttcaacgagatggttctgctgactatgaaggaaaagtcctggctcgtccacaagcagtggtttctggacctgcccctcccctggactagcggggcgagcacgtcccaggagacctggaaccggcaggacctgctggtgaccttcaagaccgcccacgccaagaagcaagaggtggtcgtgctgggcagccaggaaggcgcgatgcacacggcgctcaccggggccactgagatccagaccagtggcacaaccaccatcttcgccgggcacctgaagtgcagactcaagatggacaagctgaccctgaaaggcatgagctatgtgatgtgcacggggtccttcaagttagagaaggaggtcgccgagacccagcacggcaccgtgctggtccagattaagtacgagggaaccgacgcgccctgtaaaatccccttcagcacccaggacgagaagggggtcacccaaaacggccggctgatcaccgccaacccgatcgtgaccgacaaggagaagcccgtgaacatcgaggccgagccgcccttcggcgagtcctacatcgtcattggcgccggcgagaaggcgcttaagctctcatggttcaagaaggggtcctcgattggcaagatgtttgaggccacggctcgtggggcgcggcgcatggccatccttggcgacaccgcgtgggacttcgggtccatcggcggcgtgttcaccagcgtggggaagctggtccaccagatctttggcacggcctacggggtactcttcagtggcgtgtcgtggacaatgaagatcgggataggagtcctgttaacctggctcggactgaactcaaggagcacctcgctgagtatgacctgcatcgccgttggactcgtcacgctctatttaggcgtaatggtgcaggccgactccgggtgcgtgatcaactggaagggccgggagctcaagtgcggatcggggattttcgtcaccaacgaagtgcacacctggactgaacagtataagttccaagccgacagcccgaagagactgtctgcggcaatcggcaaagcctgggaggagggcgtgtgcggcatccggagcgcgacccgcctggagaacatcatgtggaaacaaatctccaacgagctcaatcacatcctgctggagaatgacatgaaattcacggtcgtggtgggggatgtcgccggcatcctcgcgcagggcaaaaagatgatccggccccagcccatggagtataagtacagctggaagtcctggggcaaggcaaagatcatcggcgccgacgtccagaacaccaccttcataatcgacgggcccaacacgcctgagtgccccgatgaccagcgcgcgtggaacatctgggaggtggaggactacggcttcggcatcttcacgacaaacatctggctgaagctacgggacagctacacccaggtctgcgatcatcgcctcatgtccgctgccataaaggacagcaaggccgtgcatgccgatatgggctattggatcgaatccgagaagaacgagacctggaaactggcccgggcgagctttatcgaagtaaagacatgtatctggcccaagtcccatacactgtggagcaacggcgtcctcgaatccgaaatgatcatccccaagatatacgggggccctatcagccagcacaattaccgacccgggtatttcacccaaactgccggcccgtggcacctggggaagcttgaactagacttcgacctgtgcgagggcacgactgtggtggtcgacgagcactgcggcaaccggggcccgtcactgcgcaccaccacggtgactggcaagatcatacacgaatggtgctgccgcagctgtaccctgccgcccctccgcttccgcggggaggacggctgctggtacgggatggagatccgccccgtgaaggagaaggaggagaacctggtcaagtccatggtgtccgccggcagcggcgaggtggactcctttagcctcgggctgctatgcatctccatcatgatcgaggaagtcatgcgcagccgctggagtcggaagatgcttatgaccggcactctggccgttttcctgctcctgatcatggggcagctgacctggaacgacttaatacgtttatgcatcatggtgggcgccaacgcgagcgaccgcatggggatgggcaccacctacctggccctcatggcaacgttcaagatgcggccgatgttcgccgtggggctgctgttccgccggctcacctccagagaagtgctgctcctcaccatcgggctgagcttagtcgcctccgtcgagctccccaacagtctggaggagctgggcgacgggttagcgatgggcattatgattctgaaactgcttaccgacttccaatcccaccagctgtgggcaaccctgctcagcctgaccttcatcaaaaccaccttctcccttcactacgcctggaagacaatggccatggtgctcagcatcgtctccctgttcccactttgtctctcaaccacctcccagaagaccacctggctgcccgtgctgctaggcagcctggggtgtaagccgctgaccatgttcctaatcgcagagaacaagatctggggccggcgctcctggcctcttaacgaggggataatggccgtgggcatcgtcagcatactgcttagctccctgcttaagaacgacgtgcccctcgccgggcccctcatcgcgggcggcatgttgatcgcttgctacgtcataagcgggtcctccgcggacctctccctggaaaaggcggccgaggttagctgggaggaggaggcagagcactccggtgccagccacaacatcctggtggaagtgcaggacgacgggacgatgaagatcaaggacgaggagcgggacgacaccctcaccatcttgctgaaggcaacgctgctggccgtctccggtgtgtatccgctgagcatccccgccaccctctttgtttggtacttctggcagaagaagaagcagcgctccggggtcctgtgggacacgcccagccctcccgaggtagagcgggccgtgctggacgacggcatctaccgcatcatgcagcggggcctgctcgggcgcagccaagttggcgtgggggtgttccaggagaacgttttccacactatgtggcacgtaacgcggggcgccgtgctgatgtaccagggaaagcgcctagagcccagttgggcgtccgtcaagaaggacctcataagctacggcggtgggtggcgactgcagggcagctggaacaccggggaggaggtccaggtgatcgccgtcgagcccggcaagaacccacgcaacgtgcagaccacccccgggactttcaagactcccgagggcgaggtgggcgccatcgccctggacttcaagccggggaccagcgggtcccccatcgtaaacagagaagggaagatagtgggcctctacggaaacggggtggtcaccacgtctggcacctacgtgagcgcgatcgcgcaggccaaggcctcccaggaggggcctctgcccgagatcgaggacgaggttttccgcaagcggaacctgaccatcatggatctccaccctggcagcgggaagacccgcaggtacctaccggccatcgtccgcgaggcgatcaaacgcaagctgaggacgctcattctggccccaacccgcgtggtggcctccgagatggccgaggccctgaagggaatgcccatccggtaccagaccaccgcggtcaagagcgagcacacgggcaaagagatcgtggacctcatgtgccatgccacattcaccatgcgcctgttaagccccgtgcgggtccccaactacaacatgatcatcatggacgaggcccacttcaccgacccgtcttccatcgccgcccgtggatacatctcaacgcgggtgggcatgggtgaggccgccgccatcttcatgaccgccacgccaccaggctccgtggaggccttccctcaaagcaacgcggtcatacaggatgaagagcgtgatatacccgagcggtcctggaacagcgggtatgaatggatcaccgacttccccggcaagacggtgtggtttgtacccagtatcaaaagcgggaacgacatcgccaactgtctccgcaagaacgggaagcgtgtaatccagctgtcccgcaagaccttcgacaccgagtaccagaaaaccaagaacaatgactgggactatgtggttacgacagacatcagcgagatgggcgccaacttccgggcagacagagtcatcgacccgcgacgctgcctgaagcccgtgatcctcaaggacggacccgagcgggtgatcctggccggccccatgccggtaaccgtggcctccgccgcccagcgcagggggagaatcggccggaaccacaacaaggagggcgaccagtacatatacatgggacagcccctgaataacgatgaggaccacgcccattggaccgaggcaaaaatgctcctggacaacatcaatactcccgagggcatcatccctgcactgtttgagccggagcgggagaaatccgccgcgatcgacggggaataccgcttaagaggagaggctcgcaagaccttcgtcgagcttatgaggcgcggcgacctgcccgtgtggctctcctacaaggtggcgagcgagggcttccagtacagcgatagacgctggtgcttcgacggtgagcggaacaaccaggtcctggaggaaaacatggacgtggagatttggaccaaggaaggggagcggaagaaattgcggccccgctggctcgacgccaggacctattccgaccccctggcgctgcgcgagtttaaagagttcgccgccggccggcgctctgtgtccggggacctcatcctggagatcggcaaactgccgcagcaccttacgcagcgggcgcagaacgccctggacaacctggtcatgctccataacagcgagcagggcgggcgcgcctaccggcatgccatggaggagttacccgacaccatcgagaccctgatgctcctagcattaatagccgtgcttaccgggggggtgacactgttcttcctgtccggccgcgggttgggaaagactagtatcgggctgctgtgcgtcatggcctccagtgtcctcctttggaccgcctccgtggaacctcactggattgccgccagcatcatcctggagttcttcctaatggtacttctgatccccgaaccggaccggcaacgcacgccccaagacaaccagctcgcctacgtggtgatagggttacttttcatgatcctcaccgtcgccgccaacgagatgggcctgctggagacgacaaagaaggacttggggataggccacgtcgccgtggggaaccaccaccacgcggccatgttagacgtagacctgcaccccgcgtccgcctggaccctctacgccgtggcaaccacgatcataaccccgatgatgcgccacaccatcgaaaacaccacggcgaacatcagcctgaccgccatcgcaaatcaggccgcgatcctgatgggcctcgacaagggttggcccatctccaagatggacatcggtgtgccactcttagccctcggctgttacagccaggtcaaccccctcacccttaccgccgctgtgctcatgctagtggcgcattacgctattatcgggccgggactgcaagccaaggccacgcgggaggcccagaagcgcaccgcggccggcatcatgaaaaaccccaccgttgatgggatcgtggccatcgacctcgatccggtggtctacgatgctaagttcgagaagcagctgggccaaatcatgctactcatcctgtgcacctcccagatcctgctcatgcggacgacctgggctctctgcgagtctatcactctggcaactgggccccttacgacattatgggagggatccccggggaagttctggaacaccaccatcgccgtcagcatggccaacattttccgcggctcctacttagccggcgccgggctcgcgttcagcctaatgaagtccctgggcgggggccggcgagggacgggcgcacagggcgaaaccctaggggaaaagtggaagcggcaactgaaccagctatccaagagcgagttcaacacctataagcgtagtggcatcatggaggtagatcggagcgaagccaaggaggggttaaagcgcggcgagaccacgaagcacgccgtcagtagagggaccgcgaagcttcgctggttcgtcgagcggaacctggtgaagcccgagggcaaggtcatcgacctgggctgcgggcgcggcgggtggagctactactgcgccggattaaagaaggtgactgaggtgaaggggtacaccaagggcggccccgggcacgaggagcccatcccgatggccacgtacggctggaacctggtcaaactgcactccgggaaggacgtgttcttcatcccccccgagaagtgcgacacgttactgtgcgacatcggcgagtcatcccccaacccgaccatcgaggaggggcggactctacgcgttctcaagatggtcgaaccctggctgcgtggaaaccaattttgcatcaagatcctgaacccctacatgccctccgtggtagaaaccctcgaacagatgcagcgcaaacacggcggcatgctggtccggaaccctctgtcccgcaatagcacgcacgagatgtactgggtgtcctgtggaactgggaacatcgtgagcgctgtcaacatgacctctcgcatgctcctgaatcggttcacgatggcccatcgcaagcctacgtatgagagggacgtggacctgggagctggcacccgccacgtagccgtcgagcctgaggtggccaacctcgacatcatcgggcagcggatcgagaacatcaagcacgagcacaaaagcacctggcactacgacgaggacaacccttataagacctgggcctatcatggttcctacgaggtgaagcccagcgggtccgcatcaagcatggtcaacggcgtcgttaagctgctgacaaagccctgggacgtaatccccatggtaacccaaatcgcgatgaccgacaccacccccttcgggcagcagagggtgtttaaggagaaggttgatacccggaccccgaaggccaaacgcggcactgcccagatcatggaggtgacagccaagtggctctggggcttcctgtcgcggaacaagaagccccgtatctgcacccgggaggagttcacccgcaaggtccggagcaatgccgcgattggggccgtatttgtggacgagaatcagtggaactccgccaaggaggccgtcgaggacgagcgcttctgggacctggtgcaccgagagcgcgagttgcacaagcagggtaagtgcgcgacctgcgtgtacaacatgatggggaagcgggaaaagaagctgggcgagttcggtaaggccaagggcagccgcgccatctggtacatgtggctgggcgccaggttcttggagtttgaggcgctggggtttatgaacgaggaccattggttctcgcgcgagaacagcttgtccggtgtcgagggggagggcctccacaagctggggtacattctgcgcgatataagcaagatccccggcggcaacatgtacgcggatgacactgcggggtgggataccaggatcaccgaggacgacctccagaacgaggcccgtattactgacatcatggagccggaacacgcgctcttagccaagtccatcttcaagttaacgtaccagaacaaggtggtgcgggtccagcggcccgcgaaaaacggcaccgtgatggacgtaatctcccggcgcgatcagcgggggtccggccaggtcggcacctacgggctgaacaccttcacgaatatggaggctcagctgatccgccagatggagagcgaggggatcttctcccccagcgagctagagacgcccaacctcgccgaacgggtgctggactggctcgagaagtacggggtcgaaaggctgaagcggatggccatcagcggcgacgactgcgtggttaaaccgattgacgacagattcgccaccgcgctgacggccctaaacgacatggggaaggtccggaaggatatcccccaatgggagccgtcaaagggctggaacgactggcaacaggtccccttctgctcccaccactttcaccagctgataatgaaggatggtcgcgagatcgtggtgccgtgccggaaccaggacgagttagtagggcgcgcccgggtgtctcagggcgccgggtggagcctccgcgagacggcctgcttgggcaagtcctacgcacagatgtggcagctgatgtacttccaccggcgcgatctccggctggccgccaacgctatctgcagcgcggtgcccgtggactggatccccacctcccgcaccacctggagcatccacgcccaccaccagtggatgacgactgaggatatgctgtcggtgtggaaccgcgtgtggatcgaggagaatccctggatggaggacaagacccacatcagctcctggggcgacgtgccgtatctcgggaagagggaggaccagtggtgcggtagccttatagggttaaccgccagagccacatgggccacgaatatccaggttgcgatcaaccaggtgcgacgcctcatcggcaacgaaaactacttggactacatgacctccatgaaacggttcaagaacgagtccgaccctgagggggcgctctggtag

SEQ ID NO: 24516 - RNA, 9879 nt, synthetic construct
  misc_feature 1..9879: note = derived and/or modified CDS sequence (opt11) from DENV-1__JF937619__SS-prME
  source 1..9879: mol_type = other RNA
agtgtgaccatgttgctcatgctgatgccaaccgccctggccttccacctcaccacccggggcggtgagccccacatgatagtgagcaagcaggagcggggcaaaagcctactgttcaagaccagcgccggggtgaacatgtgcaccctcattgcgatggacctgggggagctgtgcgaggacaccatgacatacaaatgccctcggatcaccgaggctgagcccgacgatgtagactgctggtgcaacgcgaccgacacgtgggttacctacggcacctgcagccagaccggcgagcaccggcgcgaaaagcggtccgtggccctcgcgccacacgtgggcctgggactggagacgcgaaccgagacctggatgagctccgagggcgcctggaagcagattcagcgggtcgagacctgggccctccgccaccctgggtttacggtcatcgccctgtttctggcgcacgccatcggcaccagcatcacccagaagggaatcatcttcatcctcctgatgctggtgacccccagcatggccatgcggtgcgtcggcatcggctctcgcgacttcgtggaggggctctccggcgccacgtgggtggatgtcgtgttagaacacggtagctgcgttaccaccatggccaaggacaagcccaccctggacattgagctcctgaagacggaagtcacaaatcccgcggtgctgcggaagctatgcatcgaagccaagatctccaacaccactacggacagccgctgcccgacccagggcgaggcgacactggtggaggagcaggatgctaacttcgtctgccggcgcacatttgtggaccggggctgggggaacggctgcgggctgttcgggaaggggtcactcctgacgtgtgccaaattcaagtgcgtgaccaagctggagggcaagatcgttcaatacgagaatctaaaatacagcgtgatcgtgaccgtccacaccggagaccagcaccaggtgggaaacgagtcgacggagcacggcaccacagcaactatcacaccccaggcgcccaccacggagatccaactgacagactacggggcgttgaccctcgactgcagcccccgcacgggcctagatttcaacgagatggtcttactcaccatgaaggagaagtcctggctggtgcataaacagtggttcctggacctccccctgccctggaccagcggggcgagcacctcccaggagacgtggaaccggcaggacctgctcgtgaccttcaagaccgcccacgcgaagaagcaggaggtcgtggtgctaggcagccaggagggcgccatgcacaccgccttaacgggggccaccgagatccagacctctggcaccaccaccatcttcgccgggcacctcaagtgccgcctgaagatggacaagctgaccctcaagggcatgagctacgtcatgtgcaccggttccttcaagctggaaaaagaggtggcggagacgcagcacggcaccgtgctagtccagataaagtacgagggcaccgacgccccctgcaagatccccttcagcacccaggacgaaaaaggggtgacccagaacggccggctgatcaccgccaaccccatcgtgaccgacaaggagaagccggtcaacatcgaggcagagccgcccttcggggagtcctacatcgtgatcggcgcgggcgagaaggcactcaagctgagttggttcaaaaaggggtccagtatcggcaagatgtttgaggccaccgcccgcggggcccggagaatggcgatcctgggggacacggcctgggatttcgggtccatcggcggcgtgttcaccagcgtcgggaagctcgtacaccagatcttcggcacagcctatggggtgctgttctccggggtcagctggaccatgaagatcgggatcggagtgctgctcacgtggctgggtctgaactcccgcagcacctcccttagcatgacctgcatcgccgtggggctcgtcaccctttacctcggtgtgatggtgcaagctgactccgggtgcgtcatcaactggaagggccgggagctgaaatgcgggagcggcatctttgttacgaacgaggtgcacacctggaccgagcagtacaagttccaggcggacagcccgaagcgcctgtccgccgccatcggcaaggcctgggaggagggggtctgcggcatccggagcgccacccgtctcgagaacatcatgtggaagcagatctccaacgagctgaaccacattctgctcgagaatgacatgaagttcaccgtggtcgtcggtgacgtggcgggcattctggtgcaggggaagaagatgatccggccccagcctatggagtataagtatagttggaagtcctggggcaaagccaagatcatcggcgccgacgtccaaaatagcacgttcatcatcgatgggcccaacaccccggagtgccccgacgaccagcgggcctggaacatttgggaggtggaggactacggttttggcatctttaccaccaacatctggctgaagctccgggactcctacacccaggtgtgcgaccatcgcctgatgagcgctgctatcaaggacagcaaggccgtccacgccgacatgggctactggatcgagagcgagaaaaacgagacctggaagttagcgcgggcgtctttcattgaagtgaagacctgcatctggcccaagagccacactctctggtccaacggcgtgctggagagcgagatgatcatcccaaagatccatgggggccctatctcccagcacaattaccggcccgggtacttcacgcagaccgccggcccctggcacctgggtaagctcgagctggacttcgacctgtgcgagggcaccaccgtcgtggtggacgagcactgcggcaaccggggacctagcctccgcacgaccaccgtcaccggcaagatcatccacgagtggtgctgccggtcctgcacgctgccgcccctgcgcttccgcggggaggacggttgctggtacgggatggagatccgccccgtgaaggagaaggaggagaatctcgtaaagtccatggtctcggccggctccggcgaggtggacagcttctccttggggctgttatgtattagcatcatgatcgaggaggtgatgcggtcccgctggagccggaagatgctaatgaccggaaccctggcagtcttcttcctcctaatcatggggcagctgacctggaacgacctcattaggctgtgcatcatggtgggtgccaacgcgtccgatcgcatggggatgggaacgacctacctggccctcatggtgaccttcaaaatgcggcccatgttcgcagtcggcctgctgttccgccggctaaccagccgcgaggtgctgctactcacgatcggtctgtccctggtcgccagcgtggagctccccaactccctggaggagctgggcgacgggctcgctatgggcatcatgattctaaagctcctcaccgatttccagagctatcagttatgggcgaccctgttatctctgaccttcatcaagacgacattcagcctgcactacgcctggaagaccatggccatggtgctctccatcgtcagcctgttccccctatgcctgtccactacgagccaaaagaccacctggctgcccgtgctgctcggatccctggggtgcaagccgctgaccatgttcctcatcgccgagaacaagatatggggccgcaagagctggcccctgaacgaggggatcatggcggtgggcatagtgagcatcctgctctccagcctgctgaagaacgacgtgcccctcgccgggcccctcatcgccggcggcatgctcatcgcctgctacgtgatttcagggagctccgcagatctcagcctggagaaggcggccgaggtctcctgggaggaggaggccgagcacagcggcgcctcccataacatactggtggaggtgcaggacgatgggacgatgaagatcaaggacgaggagcgcgacgacaccctcaccatcctgctgaaagccaccctcttagcggtctcaggcgtgtacccgctgtccatccccgccacccttttcgtctggcacttctggcagaagaagaaacagagaagcggggttctttgggacactcccagcccgcccgaagtggaacgcgcagtgctggacgacggcatctaccggatcatgcagcgcggcctgctcggcaggagccaagtcggtgtgggggtgttccaggagaacgtctttcatacaatgtggcacgtgacccgcggcgccgtgcttatgtaccaggggaagaggctggagccgtcctgggcgagcgtcaagaaggacctaatctcctacggcggagggtggcgcttccagggcagctggaacaccggggaggaagtccaggtcatcgcggtcgagcccggcaaaaaccccaagaacgtgcagacagcccccggaaccttcaagactcccgagggcgaggtgggcgcgatcgctctggacttcaagcccgggacctccggaagccctattgtcaaccgggagggtaagatcgtgggcctgtacggcaatggggtagtaacgactagcggcacctacgtgtccgccatcgcgcaggccaaggccagccaggaggggccgctccccgaaatagaggacgaggtgttccgcaagaggaacctgaccatcatggacctgcacccgggctccgggaagactcgccgctacctcccggcaatcgtccgcgaggcgatcaagcggaagttgcgcaccctgatcctcgccccaacccgcgtggtagccagcgaaatggccgaggccctgaagggcatgcctatccgctatcagaccacggctgtcaagtccgagcacaccggcaaggagatcgtggacctgatgtgccatgccactttcaccatgcgcctcctgagccccgtacgggtcccgaactacaacatgattatcatggatgaagctcactttacggacccttccagcatcgccgcccgcgggtacatatccacccgggtgggcatgggcgaggcggccgccatcttcatgaccgccacgccgcccggcagcatggaggccttcccgcagtcaaacgcggtgatccaagacgaggagcgcgacatccccgagcggagctggaactccgggtacgagtggataacggacttcccgggcaaaaccgtctggttcgtcccaagcattaaggccggcaacgacatcgccaactgcctgcgcaagaacgggaagcgggtgatccagctctcccgcaagacgttcgataccgaataccagaaaaagaagaacaacgactgggactatgtcgtgacgaccgacatcagtgaaatgggcgccaacttccgggcggatcgtgtgatcgacccgcggcgctgcctgaagcccgtcattctgaaagacgggcccgaacgggtgatcctcgccggccccatgccggtcactgtggcctccgccgctcaacgccgggggcgtatcggccggaaccacaacaaggagggcgaccagtacatctacatggggcagcccctgaataacgacgaggaccacgcgcactggaccgaggcaaagatgctcctcgacaacataaacacgcccgagggtataatcccggctctgtttgagccggagcgcgagaagtccgccgccatcgatggggagtaccgcctgcggggcgaggcgcgcaagaccttcgtggagctcatgcggcgcggtgacctgcccgtctggttgtcctacaaggtcgccagcgagggcttccagtacagcgaccggcgctggtgcttcgacggggagcgaaacaaccaggtgctcgaggagaacatggatgtcgagatctggacgaaggagggggagcgcaagaagctgcggccccgctggctggacgcccggacctactccgatcccctagccctgagagagttcaaagagttcgccgcgggccggcgctctgtgtccggggacctcattctcgagatcggaaagttgccgcagcacctgacacagcgggcccagaacgccctcgacaacctggtgatgctgcacaacagcgagcagggcgggcgcgcttaccggcacgcgatggaggagcttcctgacaccatcgagaccctaatgctgctcgcgctgatagccgtcctgaccggcggggtcacactgttcttcctgtccggcaaggggctgggaaaaacctccatcgggctcctatgcgtgatggccagtagcgtcctgctctggatggcttccgtggagccccactggatcgccgccagcatcatactggagttttttctgatggtgctcctaatcccggagccggaccggcagcggacgccccaggataaccagttagcctacgtcgttatcgggctccttttcatgatcttaacagtggccgcgaacgagatgggcctcctggagaccaccaagaaggatctgggaatcgggcacgtcgcggtggagaaccaccaccacgccgccatgctcgacgtagacctgcaccccgcttccgcctggaccttatatgcagtcgcgaccacgatcatcaccccgatgatgcgccacaccatcgagaataccacagcgaacatctcgttgacggccatcgccaaccaggcggcgatcttgatggggctggacaagggctggcccatctccaaaatggacatcggagtgcccttgctagctttaggttgctatagccaggtgaatcccctcacgctgactgccgcggtgctcatgctcgtagcccattacgctatcatcgggccggggctgcaggccaaggctacccgggaggcgcagaagcgcacggccgccggcatcatgaagaatcccaccatcgacgggatcgtagccatcgacctggacccagtcatttacgacgcgaagttcgagaagcagctcggccagatcatgctgctgatcctctgtacctcccagatcctgctgatgcgcacaacgtgggcgctctgcgagagcatcaccctggccaccggaccactgaccacgctctgggaggggtccccgggcaagttctggaacaccaccatcgctgtgagcatggccaacatctttcgggggtcctacctggccggcgcgggcctggccttcagcctcatgaagtccctcgggggcgggagacgagggaccggggctcagggcgagacgttaggcgaaaagtggaagcgccagctcaaccagctgtccaagagcgagtttaacacctacaagcgttccggcatcatggaggtagaccgcagcgaggccaaggaaggcctgaagcgcggggagaccaccaagcacgcggtctcccgaggcacggccaaactccggtggttcgtggagcgcaacctagttaagcccgaggggaaggtaatcgacctgggctgcgggcgcggaggctggagctactactgcgctgggctgaaaaaggtaaccgaggtgaaggggtataccaagggcggccccggacacgaggagccaatcccgatggccacttacgggtggaatctcgtcaagctgcactccggcaaggacgtgttcttcatcccacccgaaaaatgtgatacgctgctgtgcgatatcggggagtcttcccccaacccgaccatagaagagggccgcaccctgcgggtgctgaagatggtcgagccctggctccgcgggaaccagttctgtattaagatcctgaacccctacatgcccagcgtcgtggagacgctggagcagatgcagcggaagcacggcggcatgttagtccgcaaccccctgtctcggaacagcacgcacgagatgtactgggtgtcctgcgggaccgggaacatcgtgagcgccgtcaacatgaccagtcgaatgctgctcaaccgcttcaccatggcccataggaagcccacctacgagcgcgacgtggacctgggggctggcactcggcacgtggccgtcgagcccgaggtggccaacctggacattatcggccagcgcatagagaatatcaagcacgagcataagtcaacctggcactacgacgaggacaacccctacaagacctgggcctaccacgggtcttacgaggtgaagccgagcggctccgcaagcagcatggtcaacggggtggtcaagctcctgaccaagccctgggacgtgatacccatggtgacgcagatcgccatgaccgataccacccccttcggccagcagcgggtattcaaggaaaaggtggacacgcgcaccccgaaggccaagcggggaaccgcccaaatcatggaggtaaccgcccgatggctgtggggcttcctctctcggaacaaaaagcccaggatctgcacgcgggaggagtttacacgcaaggtccggtccaacgcggccataggcgctgtcttcgtggacgagaaccaatggaactccgcgaaggaggcagtcgaggacgacaggttctgggatctggtgcaccgggagcgcgagctgcacaagcaagggaagtgcgcgacctgcgtgtataatatgatgggcaagcgtgagaagaaactcggggagttcggcaaggccaaggggagccgcgccatctggtacatgtggctgggagcccggttcctggagttcgaggccttaggcttcatgaacgaggaccactggttctcccgcgagaattccctgtccggggtcgagggcgaggggctgcataagttaggctacatcctgcgggacatcagcaagatccccgggggcaatatgtacgccgacgacacagccggctgggatacgaggatcaccgaggacgatctgcagaacgaggccaagatcaccgacatcatggagcccgagcacgcgctcctggcgaagtccatcttcaagttaacctaccaaaacaaggtggtgcgggtccagcgccccgccaagaatgggacggtgatggacgtgatcagccgcagagaccagcgcggctccggacaggtcggcacctacggcctcaacacctttacaaatatggaggcccagttaatccggcagatggaatcagagggaatcttcctacctaacgagctcgagacgcccaacctggccggccgcgtactggactggctcgagaagtacggggtggagcggctgaaacgcatggccatttccggcgacgactgcgtcgtgaaaccgatagacgaccggttcgcgaccgccctgaccgcgctcaacgacatggggaaggtcagaaaggacatcccccagtgggagccaagcaagggctggaatgactggcagcaggtccccttctgctcccaccacttccaccagctgatcatgaaggatggccgggagatcgtggtcccgtgccgcaaccaagacgagctggtcgggcgggcccgcgtgagccagggcgccggctggagtttgcgtgagaccgcgtgcctgggaaagtcgtacgcccagatgtggcaactgatgtacttccaccgccgggacttacgcctggccgccaacgcgatctgctctgccgtccccgtcgattgggtgcccacgtcccggaccacctggagcatccacgcccaccaccagtggatgaccactgaggacatgctgtccgtgtggaaccgcgtctggattgaagagaacccgtggatggaagacaaaacccggattagctcttgggaggacgtgccgtacctcgggaagcgcgaggaccagtggtgcggctccctgataggcctcaccgcccgcgccacctgggcgacgaacatccaggtggccatcaaccaggttcgcagactcatcggaaacgagaactattccgactacatgaccagcatgaagcgtttcaagaacgaatccgaacccgagggcgccctgtggtga

SEQ ID NO: 24517 - RNA, 9879 nt, synthetic construct
  misc_feature 1..9879: note = derived and/or modified CDS sequence (opt11) from DENV-1__GU131827__SS-prME
  source 1..9879: mol_type = other RNA
tcggtgactatgctactaatgctgatgccaactgcactggcatttcacttgacaacccggggaggggaaccacacatgatcgtgtcaaaacaagaaaggggaaaaagtctgctgtttaaaacaagcgccggggtaaatatgtgcaccctaatcgcgatggacctaggcgaactttgcgaagacacgatgacctacaagtgccctcgaatcacagagacggaacctgacgacgtagactgctggtgcaacgccaccgacacatgggtaacttacggaacctgctcccagacgggggagcacaggagagacaaaagaagcgtagccttggccccacatgttggcctcggactagagacccgaacagaaacatggatgagcagcgaaggcgcatggaagcaaatccaaagggtggagacctgggctctgagacacccaggatttacagttatcgcactctttcttgcacacgcaatcggcacgagcatcacgcaaaagggaatcattttcatcttactcatgctggtaaccccctcaatggcgatgcggtgcgtcggtattggatcccgggacttcgtggaagggcttagcggcgccacctgggtggatgtcgtactggagcacggaagctgtgtgacgaccatggcgaaggacaaaccaactttagacattgagctcctcaaaactgaggtgacgaatcccgctgtgctccgcaaactttgcatcgaagcgaaaatctccaacacaacgacagactcaagatgcccaactcaaggagaagccaccctagtcgaggagcaggacgccaatttcgtttgtaggcgaactttcgttgatagggggtggggcaatggatgcggtctattcgggaaaggatcattaataacctgcgcaaaattcaaatgcgttacaaaacttgaaggaaagatcgtacagtatgagaacctaaagtattccgtgatcgtcaccgttcacacgggcgatcaacaccaagtcggtaacgaaagcacggagcacggaactacggctacgataacacctcaggcgccaacgacggaaatacaattaacagactacggcgcactaacgctggactgctccccacgcaccggcctcgacttcaacgaaatggttctcttaaccatgaaggagaaatcctggctggttcataaacaatggttcttggaccttccactcccatggactagcggagcgtcgacgtctcaggaaacatggaacaggcaagatctgctagtgacttttaaaacggcccacgcgaagaagcaggaagtcgtcgtcctcggaagtcaagaaggggctatgcacacggcactaacgggtgcaaccgaaatacagacgagcggcaccacgacgatcttcgccggccacctaaaatgccgtctgaagatggacaagctaactttaaaaggtatgagctacgtgatgtgcacaggcagcttcaagctggaaaaagaggtcgcagaaacccagcatggaacggtgctagtccagatcaaatacgaaggcactgatgccccatgcaaaataccattctcgacgcaagacgagaaaggagtgactcaaaatgggcggttaattacagctaaccccatcgtaaccgataaggagaagcctgttaacatagaagcggagccgccattcggtgagtcgtatatcgtcataggggccggcgaaaaagctctgaaactgtcctggtttcgaaaggggtcgagcatagggaaaatgttcgaggcaaccgcacgcggcgctcggcgcatggccatactaggggacaccgcatgggactttgggtcgatcggaggggtcttcaccagtgtaggaaaacttgtacaccaaatattcggaacggcatacggtgtattgttctcaggggtatcttggaccatgaagatagggatcggtgtcctgctcacttggttaggtctaaattcgcggagtacatctctctcgatgacgtgcatagcggtcggcctcgtgacgttatatctaggcgtgatggtacaagcagactccggttgtgctattaattggaaaggacgcgaactaaaatgcgggagtgggatattcgtaacaaacgaagtacacacctggacagagcagtataagttccaggccgacagtccgaagcgcctcagcgccgcaatcgggaaagcatgggaggagggagtgtgtgggatacggtcagccaccagactggaaaacataatgtggaagcagataagcaacgaacttaaccacatccttttagagaacgacatgaaatttacagtcgtcgtcggagatgtcgcgggtatactggcccaaggtaaaaagatgattcggccacagcccatggaatacaagtactcttggaagtcgtggggcaaagcgaaaatcatcggtgccgatgtacagaacacaacgttcataatagacggcccgaatacaccagaatgccccgacgaccagcgggcgtggaacatctgggaagtcgaagattacgggtttggaatcttcaccaccaacatttggcttaaacttcgagacagttacacgcaagtttgcgaccaccggctcatgagtgcggccattaaagactccaaagcagttcatgcggacatgggctactggatagaaagtgaaaagaacgaaacctggaaactagcgcgggccagcttcatagaagtcaaaacctgtatttggccaaaaagccacaccctctggtcgaacggggtgttggaaagcgagatgatcataccaaaaatatacgggggacccatatcccaacacaactaccgtccgggctacttcacacaaaccgcgggaccctggcatctcggaaaattagagctggattttgacctatgtgaaggcaccaccgtggtggtagacgaacactgcgggaacaggggaccatcactcagaacaacaacggtcacgggcaaaataatacatgaatggtgctgccgtagttgcactctacccccactacgattcagaggtgaagatggatgttggtacggaatggaaatccgaccagtaaaggaaaaagaagagaacctcgtaaaaagcatggtatcagctgggagcggcgaagtagacagcttctccctcggtctcctgtgcataagtataatgatcgaagaggtaatgagaagtaggtggagcagaaaaatgctgatgacgggaacactggccgtcttcttcctactcatcatggggcaactaacctggaacgaccttatacgtctctgcataatggttggggcaaatgcaagcgataggatgggaatgggcacgacatacctagcacttatggccacatttaaaatgcggcctatgttcgccgtgggacttctctttagacgcctaacctcacgtgaggtactcctactgaccatcggcctatcgctcgtcgcctctgtcgaactacccaactccctagaagaattaggagacggcctcgcgatgggcataatgatacttaagctactgactgacttccaatcccaccagctctgggctaccctcctatcgctcaccttcataaagacgacgttcagtttacactacgcctggaagacaatggccatggtattgtccattgtgtcattgtttccgttgtgtctgagcactacaagccaaaagacgacgtggttgcctgttctcttaggcagcctcggatgcaaaccgttgacaatgtttctcatagccgaaaacaagatatggggtagacgctcctggccactcaatgagggaattatggcagttggaattgtatcgatcctcctatctagcctactcaagaacgacgtccccctcgccggtcccctcatagcaggcggaatgttgatcgcatgctacgtcatatccggatcatcagcagacctctcactagaaaaggcagcagaagtcagctgggaagaagaagccgagcatagcggagcatcccataacattctggtagaagtgcaagacgatggcacaatgaagataaaagacgaagaacgcgacgacactctgacaatactcctaaaagccaccttactagcagtcagcggggtctaccccctaagcatccccgcaacacttttcgtatggtacttctggcagaagaagaagcagagatcaggagtgctctgggatactcctagcccaccggaggtggaacgcgctgtactagatgacggaatctacagaataatgcaacgtggcctcttgggaagatcgcaagtcggcgtgggagtattccaagaaaacgtcttccataccatgtggcatgtcacgaggggcgcagtcctgatgtaccagggcaaacgactggaaccctcgtgggcttccgtgaagaaggacctgatcagctacggaggtggctggcgactacagggctcgtggaacaccggggaagaggtgcaggtcattgccgtagaaccggggaaaaacccgaaaaacgttcaaacggcacccgggaccttcaaaaccccagaaggcgaagtcggagcaatagctctcgatttcaagccgggaacgagcggcagccccatcgtgaaccgagaagggaaaatagtaggcctatacggcaacggggtggtaacaacgagcggaacttacgtaagtgccatagcccaggccaaggcgagtcaagaagggccgttgccagagatcgaggacgaggtctttagaaagcgcaacctgacaataatggacctgcaccccgggagtggaaagaccaggaggtacctacccgctatcgtgagggaagcgataaagcgcaagttgagaaccctcatcctagcacctacacgggtggtcgcatccgaaatggcggaagcactcaaaggtatgcctatacgataccagacaacggcagtaaagtcggagcataccgggaaggaaatagtcgacttaatgtgtcacgccactttcacaatgaggctactcagccccgtacgggtacccaactacaacatgattatcatggacgaggcacacttcacagacccgtccagcatagcagcaaggggatacatatcgaccagagtaggaatgggggaagctgccgctatattcatgacggcaaccccgcccgggagcgttgaagcgtttccacagtctaacgcagtaatccaagatgaggagcgagacatcccagaacggtcctggaactccggatacgagtggatcacagatttcccaggcaaaacagtatggtttgtcccaagcattaaaagcggtaacgacatagccaactgtttacgcaaaaacgggaaaagagtaatacaactgtcgagaaagaccttcgatacggaataccagaagaccaaaaataatgactgggactacgtagtcactacagacatttcagagatgggagccaacttccgagcagaccgtgtcatagacccaagacgatgccttaagccggttatcctaaaagacggacccgaacgcgtcatcctggcggggccgatgccagtgaccgtagcctcggcagcccagcgacgtggccgcatagggaggaaccacaacaaggagggagaccaatacatatacatggggcaaccgttaaataatgacgaggaccatgcgcactggacagaagcaaagatgctcctggacaacataaacactcccgaaggaattgtcccagctctattcgagccggagcgcgagaaaagcgcggcaatcgatggagaataccgcctacgcggcgaagcccgcaagacgttcgtcgagctcatgcggagaggggacctaccagtttggttgtcatacaaagtcgcgtctgaaggcttccaatacagcgatagacggtggtgtttcgacggtgaaaggaacaaccaagtactggaagaaaatatggacgtagagatatggacaaaggaaggagagcgcaagaaacttcggccgagatggctcgacgcccggacatatagcgacccgttagcactaagagagttcaaggagttcgcagccgggagaagatcagtctcaggggatctgatactggaaatcggcaagctaccccagcacctgacacagcgggcacagaacgcgctcgacaacttggtcatgctccacaactcagaacaaggcggtagggcgtatagacacgcgatggaagaactgccagatacaatagaaaccctcatgctcctggctctcatcgcggtgctgactggtggagtaacgctattcttcctctccggacgaggcctagggaagacatccatcggtctactctgtgtgatggccagctcggtactcctgtggatggcgagtgtagaaccccactggatagcggcgtccataatactcgagttcttccttatggttctgctcatacctgaacccgaccggcaacgtacaccgcaagacaaccagctggcatatgtggtaatagggctacttttcatgatcctaacagtagcagcaaatgagatgggactacttgagacaacaaagaaagatctggggataggacatgtggccgtagaaaaccaccaccacgcagcaatgctcgacgtggatctacacccggcgagcgcctggaccctctacgcagttgctacaacaatcataacgcctatgatgagacacacgatagaaaacacgacggcgaacatcagtctgaccgccatagccaaccaagcggcgatccttatgggcctggacaaagggtggcccatatccaagatggacatcggcgtcccgttgctcgcattagggtgctactcgcaagtcaacccactaacgctgacggcagcagtgttaatgttggtcgcgcactacgccataataggcccaggcttacaggcaaaggcaaccagagaggcgcagaaaaggaccgcggcaggaatcatgaaaaaccctacggtagacggcatcgtggcgatagaccttgaccccgtcgtatacgatgcaaaattcgagaaacaattggggcaaataatgctactaatattatgcactagccaaatcctactcatgaggacaacctgggctctctgtgaatcaattacgctggccacgggccccctaacgaccttatgggagggctcacccggtaaattctggaacaccaccatcgcggtaagtatggccaacatattccggggcagctatctcgcgggggcaggactggcattcagcctaatgaaaagtttagggggtggaaggaggggaaccggcgcacaaggagagacactgggagaaaagtggaaacgtcaactaaaccaactaagcaagtccgagttcaacacatacaaaagatcgggcataatggaagtagacaggtcggaggctaaagaaggcttgaaacgaggggaaacgacgaaacacgcagtgtctcgcgggacggcgaaactgcgatggttcgtagaacgaaaccttgttaagccggagggaaaagtcattgacctaggctgtggccgaggaggctggtcctattactgtgccggcctgaagaaagtcacagaagtaaaaggttacacaaaaggtggccccgggcacgaggagccaatcccgatggctacctacggatggaatcttgtaaaactacattcaggcaaagatgtgttctttatacccccagaaaagtgcgacacccttctatgcgacatcggtgagagctccccaaaccctaccatagaggaaggcagaacgttaagggtcttaaagatggtcgaaccgtggctacgtggaaatcaattttgcatcaaaatactcaacccctacatgccgagcgtggtggaaacactcgaacaaatgcaaaggaaacacggaggaatgctcgtgcgcaaccccctatcccgcaacagtacccatgagatgtactgggtctcatgtggcaccggcaacatcgtttcggccgtaaacatgacgtctagaatgctgctgaacaggtttacaatggcgcaccgcaaaccaacctacgaacgagatgtagacctcggggccggcacacgccacgtggcggtcgagccggaagtagctaacctagacatcataggccaacggatcgagaatataaaacacgaacacaagagtacctggcactacgatgaagataacccatacaaaacctgggcttaccacggatcatatgaagtaaagccatccggaagcgcgtcgagtatggtgaacggcgtggtgaagttactaaccaaaccctgggacgtgatcccaatggtcacgcagatcgccatgaccgacaccacaccttttggacaacagagggtcttcaaggaaaaagtggacacgcgtactcccaaggccaaaagaggcacggcccaaatcatggaagtaaccgcaaagtggctttggggcttcttgagtagaaataagaagcccagaatatgcacgcgcgaggaatttacccgcaaagtcagaagtaacgccgcaattggagcagtatttgtcgatgaaaaccaatggaacagtgccaaagaggcagttgaggacgaaaggttctgggacctagtccacagggaaagagaacttcataaacaaggcaagtgcgcgacctgcgtatataacatgatgggtaaacgagaaaagaaacttggcgagttcggaaaagcaaaagggtcgcgcgcaatctggtacatgtggctcggcgctcgattcctagagttcgaagcgctgggcttcatgaacgaagatcactggttctcacgggaaaattcactaagcggggtagagggagaggggctacataaacttggatacattcttcgcgacatttcaaaaatccccggaggcaacatgtacgctgacgacacagctggctgggatacccggatcaccgaagacgatctacagaatgaagcaagaataactgatataatggaacccgagcatgcgctactagccaagagcattttcaaactaacatatcagaacaaggtagtgcgggtgcaacggccggcaaagaacgggaccgtgatggacgtcataagcagacgagatcaacgcggctccggacaggtgggaacatatggcctgaacactttcaccaacatggaggcacaactcatacgacagatggagagcgagggcatcttcagccccagtgaactagaaactcccaacttagcagaaagggtccttgactggttagaaaaatacggagttgaacgactgaaacgcatggccatctcaggtgacgactgtgtcgtaaaaccaatcgatgatagattcgccacagcgctgacagcgctcaatgatatgggcaaagtccgcaaagatattccacaatgggagccgagcaaggggtggaacgactggcagcaggtcccattctgctcacatcactttcaccaactaattatgaaagacggccgagaaatcgtagtgccgtgccgcaaccaggacgagctggtcggtcgcgccagggtgtcacaaggggcaggatggtcattaagggagaccgcgtgtttaggaaaatcctacgcacagatgtggcaacttatgtactttcatcggagggacctcagactagccgcaaacgcgatctgcagcgctgtcccggtggattggatacccacgagccgcacgacatggagcattcacgcacaccaccagtggatgaccacagaagacatgttgtcagtttggaaccgagtgtggatagaggagaacccgtggatggaggacaagacacacataagcagttggggcgacgtaccctacctaggcaaacgagaggaccagtggtgcggttcccttatcggcctcaccgcccgagctacttgggccacgaacatccaggtagcaattaaccaagtacggcgacttatagggaacgaaaactacctcgactacatgacctctatgaagcgatttaaaaatgaatcggaccccgaaggagcgttatggtaa

SEQ ID NO: 24518 - RNA, 9879 nt, synthetic construct
  misc_feature 1..9879: note = derived and/or modified CDS sequence (opt11) from DENV-1__GU131831__SS-prME
  source 1..9879: mol_type = other RNA
tcggtgaccatgctgctgatgctgatgcctaccgctctggccttccacctcaccacccgcggcggggaaccccacatgattgtgtcgaagcaggagcgtggcaagagcctgctgttcaagaccagcgccggggtgaacatgtgcaccctcatcgccatggacctcggcgaactgtgcgaggacacgatgacctacaagtgccctcggatcaccgaaaccgaacccgacgatgtagactgctggtgcaacgccacggatacctgggtgacctacgggacctgcagccaaacgggcgagcaccggcgggataagcggtcggtggccctcgcgccccacgtgggcctggggttggagacgcgcaccgagacctggatgtcttccgaaggcgcgtggaaacagatccagagagtcgagacgtgggccctccggcatcccgggttcaccgtgatcgccctgtttctcgcccacgcgatcggcacgagcatcacccagaaggggattatcttcatccttctgatgctggtgacgccctccatggcgatgcggtgtgtcggcataggcagccgcgacttcgtggaggggctctccggggcgacctgggtggatgtcgtgctggagcacgggtcttgcgtgaccaccatggcgaaagacaagcccacgctagacatcgagctcctgaagaccgaggtcaccaatcccgccgtgctgcggaagctctgcatcgaggccaagatttccaacaccacgaccgacagccgatgcccgacacagggtgaggccaccctggtggaggagcaggacgccaacttcgtctgccggcgcaccttcgtggaccggggctggggcaacggctgcgggctgttcggcaaagggtccctcatcacgtgcgcgaagttcaagtgcgtgaccaagctagagggaaagatcgtgcagtatgagaatctgaagtacagcgtgatcgtgactgtccacacgggcgaccagcaccaggtcggaaacgagtccaccgagcacggcaccactgcaaccataacaccccaggcgcccaccaccgagatccagctcacggactacggtgccctaaccttagactgcagtccccgcaccggcctcgacttcaacgagatggtcctgctgacgatgaaggagaagtcgtggttggtgcacaagcagtggttcctggaccttcccctcccctggacctctggcgccagcacgagtcaagaaacgtggaaccggcaggacctactggtgaccttcaagaccgcccacgccaaaaagcaagaggtcgtagtgctcggatcccaagagggcgcgatgcacacggccctgaccggggccaccgagatccaaacctccggcacgaccaccatctttgctgggcaccttaagtgccgcctcaagatggacaagctgaccctgaagggcatcagctacgtcatgtgcacggggtccttcaagctcgaaaaggagctggccgagacccagcacggcaccgtgctggtgcagatcaagtacgaaggcaccgacgcgccctgcaagatccccttcagcacgcaggatgagaagggggtcacccagaatggccgtctaatcactgccaatccgatagtcaccgacaaggagaagcccgtgaacatcgaggccgagccaccctttggcgagtcttacattgtcataggggccggcgagaaggcactcaagctaagctggttcaagaagggctcctccatcggcaagatgttcgaggcaacggccagaggggcacggcgcatggccatcctgggagacactgcgtgggacttcgggtcgattggcggcgtgttcacatctgtagggaaacttgtccaccagatctttggcaccgcctacggggtgctgttctccggggtgagctggacgatgaagatcgggatcggcgtcctgcttacatggctgggcttgaactcccgctctacctccctcagcatgacctgcatcgccgtggggctggtgacgctctacttgggcgtgatggtgcaagctgactcggggtgcgtgattaactggaagggccgggagctgaagtgtgggagcggcatcttcgtcaccaacgaggtgcacacctggacggagcagtacaaattccaggccgacagcccgaagcgcctgtccgcggccatcggcaaggcctgggaggagggggtgtgtgggatccggagcgccactcgccttgagaacatcatgtggaagcagatctccaacgaactgaaccacatcctgctcgagaacgacatgaagttcacggtagtggtgggggacgtcgccggcatcttggcgcagggaaagaagatgatcagaccacaaccaatggaatacaagtactcatggaagtcatggggaaaagctaagatcatcggcgccgacgtgcagaacaccaccttcattatcgacggaccaaacaccccagagtgcccggacgaccaacgcgcctggaatatctgggaggtggaagactacggtttcggcatcttcacgaccaacatctggctgaaactccgggactcgtacacccaagtctgcgaccatcgcctgatgtccgccgccatcaaggacagcaaggccgtgcatgcagacatgggatactggatcgagtccgagaagaatgagacctggaagctggcccgggcgagcttcatcgaggtgaagacgtgtatctggcccaagtcccacacactctggtctaacggcgtcctggagtccgagatgatcatcccgaaaatctacggagggccgatctcacagcacaactaccgccccggatacttcacccagaccgccggaccctggcacctagggaagctcgagctggacttcgacctgtgcgagggcacgacagtggtggtcgacgagcactgcggcaatcgcgggccgtccctccgcactaccacggtgaccggcaagatcatccacgagtggtgttgtcggagctgcaccctgccgcccctgcggtttcgcggggaggacggctgctggtatgggatggagattcgccccgtgaaggagaaggaggagaacctcgtcaagtccatggtgagcgctggcagcggcgaggtcgactccttcagcctggggctgctctgcatctccatcatgatcgaggaggtcatgcggagccgctggtccaggaaaatgcttatgaccggcacgctggccgtgttctttctcctgatcatggggcagctgacctggaacgatttgattcgcctgtgcatcatggtgggggccaacgctagcgaccgcatggggatgggcaccacctaccttgccctcatggccaccttcaagatgaggcccatgttcgccgtggggctgctgttccgtcggctcacctcccgcgaggtgctattattgaccattgggttaagcctggtggccagcgtcgagctccccaacagcctggaggagctgggggacgggcttgcgatgggcatcatgatcctgaaactgctcactgacttccagtcccatcagctgtgggccacgctgctgagcctgaccttcatcaagacgacgttttcccttcactacgcctggaagacaatggccatgatccttagcatcgtgtccctgttccccttgtgtctctcgaccacttcccagaagaccacctggctgcccgtcctgctcgggtccttggggtgcaagcctctcaccatgttcttaatcgctgaaaacaagatctggggccggcgctcctggcccctgaatgagggaatcatggccgtgggtatcgtgtctatcctgctcagctcactgctgaagaacgatgttcccctggccgggcccctgatcgccggcggcatgctgattgcctgctatgtgatctccgggtccagcgcggacctatccttagagaaggctgccgaagtgagctgggaggaggaggccgaacactccggcgcaagccacaacatcctggtcgaggtgcaggatgacgggaccatgaagatcaaggacgaggagcgggacgacaccctgacaatcctgctgaaggcgacgctcctggctgtctccggagtctacccgctcagcatcccagccaccctgttcgtatggtatttctggcagaaaaagaagcagaggtccggcgtgttgtgggacacccccagcccgcctgaggtcgagagagccgttctggacgacggcatctacagaatcatgcagcgggggttgctggggcggagccaggtgggcgtcggggtgttccaggagaacgtgtttcacaccatgtggcacgtcacgcggggagctgtcctgatgtatcaagggaagcgtctggaacccagctgggcctccgtgaagaaggacctgatcagttacggcggcgggtggcgtcttcagggctcctggaataccggggaggaggtccaggtaatcgccgtggagcctggcaagaatcccaagaacgtccagaccgcccccgggaccttcaagaccccagagggcgaggtgggcgccatcgccctggatttcaagcccgggacgtccggctcccccattgtgaacagggagggcaagatcgtcggattatacggtaacggggtggtgacaaccagcggcacttacgtcagcgcgatcgcccaggccaaggcatcccaggagggtccactgcccgagatcgaggacgaggtgttcagaaagcgcaatctgactatcatggatctccaccctggcagcgggaagacccggcggtaccttccggcgatcgtgcgggaggccatcaagagaaagctgcgaaccctcatcttagcccccacgcgggtggtagccagcgagatggccgaggccctgaagggcatgcccatccgctaccagaccaccgccgtaaagagcgaacacaccggcaaggaaatcgtcgacctcatgtgccacgccacgttcacaatgcggctgctgtcccccgttcgtgtgccgaactacaacatgatcatcatggacgaagcacactttaccgatccgagcagcatcgccgcgcgggggtacatcagcacccgcgtcggcatgggggaagccgccgccattttcatgacggccacgccacccggatccgtggaggctttcccacagtccaacgccgtgatccaggacgaggagcgggacatccctgagcgctcctggaacagcgggtacgagtggatcaccgacttcccgggcaagaccgtctggtttgtgccgtccattaagagtggcaacgacatcgctaactgcctccggaaaaacgggaagcgcgtaatccagctgtcgaggaaaacgttcgacaccgagtaccagaagacgaagaataatgactgggattacgtcgtgacaaccgacatcagcgagatgggcgccaacttcagggcggaccgggtgatcgacccacgccggtgcctgaagcccgtcattcttaaggacggccccgagcgcgtgatactggccggccccatgccggtgacagtagcttccgcggctcaacggcgcggtcggatcggccgcaaccacaataaggagggcgaccagtacatctacatggggcagcccctgaacaacgatgaggaccacgcgcactggaccgaagccaagatgctcctggacaacatcaacacacccgagggcatcataccagcactgttcgagccggagagagagaagagtgccgccatcgacggcgagtaccgtctgcgaggagaggcgcggaagacgttcgtggagctgatgcgccgtggggacctgcccgtctggctttcctacaaggtggccagcgagggcttccaatacagcgaccgccgttggtgcttcgacggcgaacgcaacaatcaggtgctagaggagaatatggacgtcgagatttggaccaaggagggggagaggaagaaacttcggccccgatggctagacgcccgcacgtactccgaccccctggccctgcgcgagttcaaagagttcgcagcgggcaggcggagcgtgtccggtgatctcattctggaaatcggtaaactgccgcagcacctcacccaacgcgcccaaaacgccctggacaatctagtgatgctccacaattccgagcagggagggcgggcctaccgccacgcgatggaggagctgcccgacacgatcgagaccctgatgctcctggcgctgatcgccgtcctaaccggcggcgtgaccctattcttcctctccggccgggggctaggcaagactagcatcggcctcctgtgcgtcatggcctctagcgtcctcctgtggatggcatccgttgagccccactggatagcggctagcatcatcctggagttctttttaatggttctgctgatacccgagccggaccgccagcggacgccccaggacaatcagctcgcgtacgtagtgattggactgctgtttatgatactaacggtagcggcaaacgagatgggcctgctggagactaccaagaaggaccttggcatcggccacgtcgctgtggaaaaccaccaccacgccgcaatgttagatgtagacctgcaccccgcctccgcctggacgctctacgcggtcgccaccactatcatcaccccgatgatgcggcacacgatcgagaacacaaccgcaaacatcagcctgaccgccatcgcgaaccaggcggccatcctaatggggctcgacaagggctggcccatctccaagatggacattggcgtgcccctactggccctcgggtgctacagccaggtgaaccccctgaccctgaccgccgctgtcttaatgctggttgcccactacgccatcatcggccctgggctgcaggctaaggcaacccgtgaggcgcaaaagcggaccgccgccggcatcatgaaaaacccgacggttgacgggatcgtcgccattgatctcgaccccgttgtgtacgacgccaagtttgagaagcagctgggccagataatgttgctcattctgtgcacctcccagatccttctcatgcgcacaacctgggcgctctgcgagagcatcacactggccaccggcccgctcaccaccctgtgggagggatcaccgggcaaattttggaatacgacaatagccgtcagcatggccaatatcttccgggggtcgtatctagccggcgcgggactcgccttctctctgatgaagtccctaggtggagggcgcagggggaccggagctcagggcgagactctaggcgagaagtggaagcgccagctgaaccagctgtctaaaagcgagttcaacacgtacaagcggtccgggatcatggaggttgacaggagcgaggccaaggagggcctcaagcgcggggagaccaccaagcacgcggtgtccagaggcaccgccaagttacgttggttcgtagagcgcaacctggtaaaacccgagggcaaggtgatcgacttgggctgcggacgcgggggctggtcgtactactgtgccgggctcaagaaggtcacggaggtgaagggctacaccaagggcggcccgggtcacgaggagcccatccccatggccacctacggatggaatcttgtaaagctgcactctggaaaggacgtctttttcattcctcccgagaagtgcgacaccctcctatgcgacataggggagagcagccccaacccgaccattgaggaaggccgcaccctgcgggtgctcaagatggtggagccctggttacgcgggaatcagttctgcatcaagatcttaaacccctacatgcccagtgtcgtggaaaccctcgagcagatgcagcggaagcacggcgggatgctggtgcgcaacccgctgtcgcggaacagcacgcatgagatgtactgggtctcctgcgggaccggcaacatcgtgtctgccgtgaacatgacgtcccgcatgctccttaaccgattcaccatggcgcaccggaagcccacgtacgagcgtgacgtcgacctgggggccggcacccggcacgtggccgtggagcccgaggtggcaaacctcgatatcatcggccagcggatcgagaacatcaagcacgagcataagagcacgtggcactacgacgaagacaacccatacaagacctgggcctaccacgggtcttacgaggtgaaaccgtctggctccgctagcagcatggtgaacggggtggtgaagttactgaccaagccttgggacgtaatccccatggttacccagatagcaatgactgataccacccctttcggccagcagagagtgttcaaggagaaggtcgacacccgcaccccgaaggccaagcgtggtaccgcccagatcatggaagtgaccgcgaagtggctctggggcttcctgtcgcgcaacaagaagccccggatctgcacccgcgaggagtttacgcggaaggtgcgcagcaacgcggctatcggagccgtctttgtggacgagaaccagtggaacagtgctaaggaagcggtggaggacgagcggttctgggatctggtccacagagaaagggagctccacaagcaggggaagtgcgcgacttgcgtgtacaacatgatgggcaagcgcgagaagaagttgggggagttcggcaaggccaaggggagccgggctatatggtacatgtggctgggtgcccgctttctcgagttcgaagcgttggggttcatgaacgaggaccactggttctcccgggagaacagcctgtcgggagtggagggcgaggggctccacaagctaggctacatcctgcgcgacatcagcaagatacctggagggaacatgtacgccgatgacaccgccggctgggacacgagaatcacggaggacgacctccagaacgaggcccgcatcaccgacataatggagccggagcacgccctgcttgcgaagtccatctttaagctcacctaccagaataaggtcgtgcgggtgcaacggcccgccaaaaacgggaccgtaatggacgtgatcagcaggcgggaccaacgcggctccggccaggtggggacatacggcctgaacacctttaccaacatggaggcccagctcatcagacaaatggagagcgaagggatcttttcccccagcgagctcgagacacccaacctggccgagagggtcttggactggctggagaagtacggcgtggagcggctaaaacgcatggcgatctccggagacgactgcgtggtcaagccgatcgacgaccggttcgcgacggccctgacggccctcaacgacatgggcaaggtgcgcaaagacatcccccagtgggagcccagcaaggggtggaacgactggcagcaggtcccgttctgctcccaccacttccaccagctgatcatgaaagacggccgcgagatcgtcgtcccgtgccgcaaccaggatgagttagtgggccgggcccgcgtaagccagggggctggctggagcctcagggagactgcatgcctgggtaagtcatacgcgcagatgtggcaactgatgtactttcataggcgggacctccgcctggccgccaacgcgatctgcagcgcagtacccgtggactggatccccacatcccgcactacctggagcatccacgcccaccaccagtggatgaccaccgaggacatgctgtcggtttggaaccgcgtgtggatcgaggagaacccctggatggaggacaagactcacatcagctcctggggcgacgtgccataccttgggaagcgcgaggaccaatggtgtggctccctgatcgggctgaccgccagagccacttgggcgaccaacatccaggtcgccattaaccaggtgcgccggctcatcgggaacgagaattatctggactacatgacctctatgaagaggttcaagaacgagtcagaccccgagggcgcgctgtggtga

SEQ ID NO: 24519 - RNA, 9879 nt, synthetic construct
  misc_feature 1..9879: note = derived and/or modified CDS sequence (opt11) from DENV-1__EU482789__SS-prME
  source 1..9879: mol_type = other RNA
tccgtgaccatgctgctcatgctaatgcccacagccctggccttccatctaaccaccagaggaggggaaccccacatgatagtgactaaacaggagcggggtaagtcgctcctgttcaagacctctgcgggggtaaatatgtgcaccctcattgctatggacttgggtgaactgtgtgaggacaccatgacctataagtgccctagaatcaccgaagcggagcccgatgacgtcgactgctggtgtaatgcgacggacacttgggtcacgtacggcacatgtagccagacgggcgagcaccggcgcgataaacggagcgtggccctcgcaccccatgtgggcttagggctggagacccgaaccgagacctggatgagttcggagggcgcctggaagcagatccagcgggtagagacctgggccctccgccaccccggcttcacagttatcgccctattcctggcacacgcaatcgggacctccatcacccagaagggaatcatcttcatattactgatgctggttacgccaagtatggcaatgcggtgcgtcggtataggctcacgagacttcgtcgaggggctgtcgggcgccacctgggtggatgtcgtgctggaacatggctcctgcgtgacaaccatggccaaagacaagccgacgttggacatcgagctcctgaagaccgaggtcaccaaccccgccgtgctacggaaactctgtatcgaggctaagatatccaacactacgaccgactcacgctgccctactcagggggaggccaccctgatggaggagcaagacgcgaactttgtgtgtcggaggacgttcgtcgaccggggctgggggaatggctgcgggctgtttggtaaggggagcctcataacgtgcgccaagttcaaatgcgtcaccaagatggagggcaaaatcgtgcagtacgagaacctcaagtacagtgtcatcgttactgtgcacacgggagaccagcaccaggtggggaacgaatctaccgagcacggcaccacggctactatcacgccgcaggcccctacctccgaaatccagctgaccgactacggagccctaactctggactgtagcccacgaactggcctggacttcaacgagatggtgttactaacgatgaaggaaaagagctggctggtccacaagcagtggttcctcgaccttcctctaccctggacaagcggagcatctaccagtcaggagacatggaaccgacaggacttgctggtgaccttcaagaccgcccacgcaaagaagcaggaggttgtcgtgctcggcagccaagagggcgctatgcataccgccctaacgggagccaccgaaatccaaacctccggcaccactacaatcttcgcggggcacctgaagtgcagactgaagatggacaaactcaccctcaagggcatgagctacgtgatgtgcacagggtccttcaagctagagaaggaagtcgcggagacgcaacacgggactgtcctcgtgcagataaaatacgagggcaccgacgccccctgcaagattccctttagcacacaggatgaaaagggggtgacccagaacgggcggttgatcaccgcgaatccgatcgtgaccgacaaagagaaacccgtaaacatagaggccgagccacccttcggggagagttacatcgtaatcggcgcaggcgagaaggccctcaagctgagctggttcaagaagggttccagcatcggcaagatgttcgaggccaccgcccgcggtgcccgccgcatggcgatactcggtgacacggcatgggacttcggatcaatcggcggggttttcaccagcgtggggaagctggtccatcagatcttcggcactgcttatggggtcctgttctcaggcgtaagttggaccatgaagataggcataggcgtcctccttacctggctaggcctgaactcgcgctcaacctccttaagcatgacttgcatcgctgtagggctggtgaccctctatcttggcgtcatggtgcaagccgactccgggtgcgtgatcaactggaagggccgggagcttaaatgcggaagcggaattttcgtcaccaacgaggtgcacacttggaccgagcagtacaagttccaggcggactcaccgaaacgcctctcagctgccatcggcaaggcctgggaggagggtgtctgcggcattcggagcgccacacgcctggaaaacatcatgtggaagcagatctccaacgagctgaaccatatcctcttagagaatgacatgaagttcactgtcgtggtaggggacgtggtggggatcctggcgcaggggaagaagatgatccggccccaacctatggagcacaagtatagctggaaaagctggggcaaggccaagatcattggcgccgacgtgcagaacactaccttcatcatagatgggcccaacacccccgagtgcccagacgaccagcgcgcgtggaacatctgggaggtagaggactacggtttcgggatcttcaccacaaacatctggctcaagctgcgtgactcctacacgcaagtatgtgaccatcgcctgatgtctgccgccatcaaggacagcaaggcggtgcacgccgatatgggatactggattgagtccgaaaagaatgagacctggaagctcgctcgggcgagcttcatcgaggtcaagacctgcatttggcccaagtcccatacactgtggtcgaatggggtactggagtcggagatgatcatccccaagatctacggcggccccatcagccaacataattatcgccccggatacttcacccaaacagccggcccgtggcacctcgggaagctggagctggactttgacttatgtgagggcactacggttgtcgtggatgaacactgcggcaaccgggggcccagcttgcgaaccaccaccgtgacagggaagatcattcacgagtggtgctgccgtagctgcaccctgccgccattgcgcttcaagggggaggacggctgctggtacggcatggagatccgtcccgtgaaagagaaggaggagaacctggttaagtccatggtgagcgccggtagcggagaggttgatagcttcagcctggggctcctgtgcatatcgatcatgatcgaggaggtgatgcgcagccggtggtcccgcaagatgctgatgaccggaaccctagcagtcttcctgctcctgatcatggggcagctcacgtggaatgacttgatccggctctgcataatggtaggcgccaacgcgagcgaccgcatgggcatgggcacgacatatttggcgttgatggccaccttcaagatgcgccctatgttcgccgtggggctcctgttccgaagactgacgtcacgggaggtgctcctgctgactatcgggctttcccttgttgcttcagtggaattacccaactcactcgaagaactcggagacggtctggcaatgggcataatgatcctaaagctgcttaccgacttccaatcccatcagctctgggcaaccctgcttagcttaacgttcatcaagacaaccctctccttgcattatgcatggaaaaccatggctatggtcctcagcattgtatccctgtttcccctgtgtctctcgacaacgtcccagaagaccacatggttaccagtgttgctaggtagcctggggtgcaaaccgctgacaatgtttctcatcgcggagaacaagatatggggtcgcaagtcctggcccctgaacgaggggatcatggctgttggggttgtcagcattctgctctcctccctgcttaaaaacgatgtccccctcgcagggccgcttatcgccggcggcatgctaatcgcatgctatgtgatctcgggttcctcagccgacctatccttagagaaggccgccgaggttagctgggaggaggaggccgagcatagtggcgccagccacaacattctggtcgaggtacaggatgacggaacgatgaagatcaaggatgaagaacgggatgacacactcaccatcctgctaaaggctaccctcctggccgtgtccggcgtctacccgttgagcatccccgccaccctcttcgtctggtacttttggcagaagaagaagcagcgctctggggtactgtgggacacccctagcccacccgaagtcgagcgggccgtactggatgatggcatctatcgtattatgcagcgcggcctgctcgggcgctcccaggttggtgtcggggtgttccaagagaacgtgttccataccatgtggcacgtcacccggggagcggtactgatgtatcagggcaagcggctagagcccagctgggcgtccgtgaagaaagacctaataagctatggcggtggctggcggttacagggtagttggaacacgggggaagaggtccaagtaatcgccgtcgagccaggcaagaaccccaagaatgtccagaccgcccccggcaccttcaagacgccggagggcgaagtcggcgctatcgccctcgacttcaagcctggcacgagcggctcccccatagtaaaccgcgaggggaagatcgtcgggctttacggaaacggggttgtaaccacctctggcacatacgtgtcggccattgcccaggcaaaggcatcccaggagggaccgctgccggagatcgaggacgaggtctttagaaagcgtaacctgacgataatggaccttcaccccggcagcggtaagactcggaggtacctaccggccatcgtgcgggaggccatcaagcgcaaacttagaaccctcatactagcccccacgcgagtagtcgcttcggagatggccgaagcgctgaagggcatgcccatcaggtaccagacaaccgccgtcaagagtgaacacacgggtaaggagatcgtcgatttgatgtgccatgccaccttcacgatgcggctgctgtcccccgtgcgtgtgccgaactacaacatgatcattatggacgaggcccatttcacagaccccagctctatcgcagcgagagggtacatttctacccgcgttgggatgggagaggccgccgccatctttatgaccgctaccccgccaggaagcgtggaggctttcccgcaatcaaacgccgtaatacaagacgaggaacgggatatacccgagcgatcctggaacagcgggtatgagtggattacagatttccccggcaaaacagtttggttcgtgccttctatcaagtcaggtaatgatatcgcaaactgtctcagaaagaacggaaagcgcgtgatccagctgtccagaaagaccttcgacacggaataccagaaaacaaagaacaacgactgggactacgtcgtcaccactgacatttccgaaatgggggctaatttccgtgccgacagagtgatcgatccccgccggtgcctgaagccagtcatactcaaagatgggccagaacgcgtcatcctggccggcccgatgccggtcacggtcgcgtccgcggcccagaggaggggccggatcggccgcaaccacaacaaagagggcgaccagtacatttacatgggccagcccctgaacaacgacgaagaccatgcgcactggaccgaggcaaagatgctcctggacaacatcaacacgcctgagggcatcatccctgccctcttcgagcctgaacgagagaagtccgcagccattgacggggaatatcgcttgagaggcgaggccagaaagacattcgttgaactgatgcgccgcggggacctgccagtctggttatcgtacaaggtagccagcgagggctttcagtactccgaccgccggtggtgcttcgacggtgagcggaacaaccaggttctagaggagaacatggacgtcgaaatctggacaaaggagggtgagcggaagaagttgcgcccacggtggctcgacgcccgaacctactcggaccccctggccttgcgggagttcaaggaatttgccgcgggcagaaggagcgtgtccggggatctcatactagagatcggcaagttgccacagcacctcacacagcgggctcagaacgctctggacaacttggtcatgcttcacaactccgagcagggcggacgggcctaccggcacgcgatggaggaactgcccgacacaatagagacgctgatgctacttgcactgatcgctgtgcttacaggtggagtgaccctattctttctctccggccgcgggctcgggaagacgagcatcggactgctgtgcgtgatggcttccagcgtcttgttgtggatggccagtgtggagccccactggatcgcagccagcatcatcctggagttcttcctcatggtgcttctgatcccggagcctgaccgccagcggacgccccaagataaccagctcgcctacgtcgtgattggcctgctgtttatgatcctcacagtagccgccaatgaaatgggactgctggaaaccaccaagaaggacctcgggattgggcatgtagccgttgagaaccaccaccatgccacgatgctagacgtcgacctgcaccctgcctccgcttggacactctatgccgttgcgaccaccatcatcaccccgatgatgaggcacaccattgagaacacaaccgccaatatcagcctgaccgccatcgcaaatcaggccgcgatactcatggggctcgacaagggttggcccatctccaagatggacatcggcgtgcccttgctggcactcggctgctacagccaggtaaaccccctgacgctgaccgccgcggtcctcatgctggtggcgcattatgcaatcatcgggccagggctgcaagctaaggccacccgggaggctcagaaacgcacagctgcgggaatcatgaagaatcccactgtggacgggatcgtcgccattgacttggaccccgtggtgtacgacgccaagttcgagaaacaactgggacagattatgcttctcatcctgtgcacctcccagatcctgctcatgcgcaccacatgggctttatgtgagagcattacgctggcaactggcccccttaccactctgtgggaggggagcccgggcaagttttggaacacgacgatcgctgtcagcatggcgaatatattccgtgggtcctacctggcaggggccggcctagcatttagcctgatgaagtccttgggtcgcggcaggcgcggcaccggcgcccagggggagaccctcggagagaaatggaagagacagctgaaccagctgtccaagagcgagttcaacatctacaagcgctctggcattatggaggtggaccgaagcgaggcaaaagagggtctcaagcgaggcgagactacacggcacgccgtgtcacgggggaccgcaaagctgcggtggttcgtggagcgcaaccttgtgaaacccgagggcaaggttatcgacctggggtgcggccggggcggatggagctactactgtgccggcttgaagaaagtcaccgaggtcaaagggtacaccaaaggcggtccaggccacgaggagcctatcccaatggccacctacggatggaatctggtgaagctgcactccgggaaggacgtcttctttacgccgcccgaaaagtgtgacaccttactgtgcgacatcggggagagctcgccgaaccctacgattgaagaggggaggacccttcgggtgctgaagatggtagagccatggctccgcggcaatcagttctgtatcaagatactgaacccgtacatgcctagcgtggtagagacactcgaacagatgcagcgcaaacacggaggcatgctggtgagaaacccactgagtcggaatagtacccacgaaatgtactgggtgtcctgcggcaccggaaatattgttagcgccgtgaacatgacgtcccgcatgctcctgaaccggtttaccatggcccaccggaagcctacatacgagcgcgatgttgacttaggcgcggggacacggcatgtggccgtggagcccgaggtcgccaatctcgacatcataggacagcgaattgagaatatcaagcatgaacacaagtcgacgtggcattacgatgaggacaacccatataaaacctgggcatatcacggcagttatgaggtgaagccgagtgggtccgcgagctccatggtcaacggcgtagtgaagctgctaaccaagccctgggatgtcatccccatggtgacacagattgcaatgacggacaccacccccttcgggcaacagcgtgtattcaaggaaaaagtcgacacacgcacgccgaaggcaaagcggggcactgcgcaaatcatggaagttacagcccgctggctctgggggttcctgtcccggaacaaaaagccccgtatctgcacgagagaggagttcacgcgtaaggtgcggagtaacgccgcgatcggcgccgtctttgtggacgagaaccagtggaactctgccaaggaagcggtggaggatgagcgcttctgggatctggtgcagaaagagcgggagctccacaagcaaggcaagtgcgcgacctgcgtgtataatatgatgggcaagcgcgagaagaagctgggcgaatttggaaaggcaaagggcagccgggctatctggtatatgtggctaggggcgagattcctcgagttcgaggctctggggtttatgaacgaagatcactggttttctcgggagaacagcctgtccggtgttgagggggagggcctccacaaacttgggtacatcctgcgagacatctctaagattcccggcgggaatatgtatgctgacgacaccgccggctgggacactcggataacggaggacgacctccaaaatgaggcgaaaatcaccgacatcatggagccggagcacgccctgctggctacctccatctttaagctcacataccagaacaaagtcgtgcgggtgcagaggcccgccaagtcaggcacggtaatggacgtgatctcccgacgcgaccagcgcgggtcaggccaggtggggacgtatggcctgaatacttttaccaacatggaggcgcagctaatccggcagatggaatcggagggaatcttcctacccagtgagctggaaacgcccaacctcgccgagcgggtactcgactggctggagaagtacggggtggagcgcctgaagcggatggccatctccggagatgactgtgtggtcaagcccatcgacgatcgctttgccaccgcgctaaccgcgctaaacgacatggggaaggtgcggaaggacatcccacagtgggaacccagcaagggttggaacgactggcaacaagtgcccttctgctcccaccactttcaccagcttatcatgaaggatggtcgcgagatcgtcgtgccgtgccgtaaccaggacgaacttgtgggccgggccagggtctcacaaggcgccggatggagcttgcgcgaaacggcctgcttgggtaagtcatacgcgcagatgtggcagctcatgtattttcaccggagggatttaagactggccgctaacgccatctgtagcgcagtgcccgtggactgggtccccacctcccgcaccacctggagtatacacgcccaccaccagtggatgactacggaggacatgctgtccgtttggaacagagtttggatagaggagaatccctggatggaagataagacccatgtcagctcctggggtgacgtgccgtacttgggcaagcgtgaggatcagtggtgcgggagcctgatcggactcacggcccgcgccacctgggcatctaacatacaggtggcgatcaatcaggtccggcgcctgattggcaatgaaaactacctggattacatgaccagcatgaagcgtttcaagaacgaaggggacccagagggcgccctgtggtga

SEQ ID NO: 24520 - RNA, 9879 nt, synthetic construct
  misc_feature 1..9879: note = derived and/or modified CDS sequence (opt11) from DENV-1__EU482790__SS-prME
  source 1..9879: mol_type = other RNA
agcgtgaccatgctgctgatgctgatgcccaccgccctggccttccacctcacgacccggggaggcgagccccacatgatcgtgagcaagcaagagcggggcaagtctctcctttttaagacgtccgcgggagtaaacatgtgcactttgattgcaatggacctgggcgagttctgcgaggatacgatgacctataagtgccctagaatcaccgaggccgagcctgacgacgtggactgctggtgcaacgccacagacacatgggtgacctacgggacctgcagccagacaggcgaacataggcgggataagcgctccgtagccctcgcgccccacgtggggctcggcctggagacgcgcaccgagacctggatgagcagtgagggcgcatggaaacagatccagcgggtcgagacgtgggccttgcgccaccctgggttcacggtgattgccctcttcctggcccacgcgatcgggaccagcatcacccagaaggggattatctttatcctgctcatgctggtgaccccctccatggcgatgcggtgcgttggcatcggttctcgtgacttcgtggagggtctgtcgggggcaacttgggtggacgtcgtgctcgaacacgggagttgcgtgacgaccatggccaaggacaagcccaccctggacatcgagctgcttaaaacggaggtcaccaatcccgcggtgcttcggaagctgtgcatcgaggccaagatctctaacaccaccacggacagccgctgcccaacccaaggggaggccaccttagtggaggagcaggacgccaacttcgtctgccggcggacattcgtggaccggggttgggggaacggctgcgggctgttcggcaaggggagcctgatcacgtgcgctaagttcaagtgcgtgacaaagctcgagggtaaaatcgtccagtatgagaacttaaagtacagcgtgatcgtgacggtccatacaggcgaccaacatcaggtgggaaatgagagcacggagcacggaaccaccgcgaccattacaccccaggctccttccacagagatacagcttacagattatggggcactgaccctggactgcagcccccggaccgggctggacttcaacgagatggtcctactgacgatgaaagagaaaagttggctggtgcacaagcagtggttcttggaccttccgctgccctggaccagcggttcaagcacctcccaggagacctggaaccggcaggacctcctggtgacctttaaaaccgcccatgccaagaagcaggaagtcgtggtgctaggctcccaggagggcgcgatgcacaccgccctcaccggggccacagagatccaaacctccggtaccactacgatcttcgccggccatctgaagtgcaggctgaaaatggataaacttactttgaagggcatgagctacgtcatgtgcaccggatcctttaagctggaaaaggaggtagccgagacccagcacggcacggtgcttgtccagatcaagtatgagggtaccgacgtgccctgcaagatcccattcagcacccaggacgagaagggggtgacccagaacggccggctgattacggcgaacccaatcgtcaccgacaaggagaagccggtgaacatcgaggccgagccaccctttggagagagttacatcgtgatcggcgccggcgaaaaggccctgaaactgtcttggttcaagaagggttccagcatcgggaagatgttcgaggcgaccgcccgcggagctagacgcatggccatactcggcgacacggcctgggacttcgggtccataggtggcgtcttcacgtcggtggggaagctcgtccaccagatattcggcactgcgtacggggtactattttccggcgtcagctggaccatgaagattgggatcggggtgctcctgacctggctgggcctcaactcccgcagcacgagcctctcgatgacctgcatagccgtcgggttagttaccttgtacctgggcgtgatggtgcaggccgatagcgggtgcgtgatcaactggaagggacgcgagctgaagtgcgggtcaggaatatttgtaaccaacgaggtccacacgtggacagagcaatacaaattccaggccgactcaccgaagaggctgtccgccgcgatcggcaaggcttgggaggagggggtatgcggcatcaggtcggccaccagactggagaacatcatgtggaagcaaatctccaacgagctgaaccacatcctcctggaaaacgacatgaaattaacagtcgtggtgggggacgtggccgggatcttggcccagggcaagaaaatgatacgcccacagccgatggagtacaaatacagctggaaatcttggggaaaggcaaagatcatcggtgcagacgtccagaacactaccttcattatcgatgggcccaacaccccggaatgtcccgatgaccagcgcgcctggaacatctgggaggttgaggactacggcttcgggattttcacaaccaatatctggctgaagctgcgggacagctacacccaggtgtgtgaccaccgactcatgtccgcggcgatcaaggacagcaaggctgtccacgcagacatggggtactggatcgagtccgagaagaacgagacctggaaactggcgcgggcctcgttcattgaggtgaagacatgcatatggcccaagtcccacactctgtggagcaatggcgtcctcgagtccgagatgattatccccaagatctatgggggacccatcagccagcacaactaccgccccgggtacttcacgcagaccgcggggccctggcaccttggtaaactggaattggacttcgacctatgtgagggcacgacggtcgtggttgacgaacactgcggcaacagagggccgtccctgagaacgaccaccgtgaccggcaagatcatccacgaatggtgttgccgcagctgcacgctgccgcccctccgctttaaaggggaggatggctgttggtacgggatggagatccggcccgtgaaggagaaggaggaaaacctggtcaagtcaatggtctccgcaggctcaggcgaggtggactctttcagcctaggtctgctctgcatatccatcatgatcgaggaagtgatgcgctcccggtggtcccgcaagatgctaatgaccggcactctggccgtattcttcctgctcataatggggcagctgacttggaatgacctaatcagactctgcatcatggtgggagccaacgcgagcgaccgcatgggcatgggaacgacatatctggcgctgatggccacctttaaaatgaggccgatgttcgcggtggggctgctgtttcggaggctgacctcccgggaggtcctcctgctaacaatagggctaagcctggtggcctccgtcgagctgcccaactctcttgaggagctgggtgacgggctggccatggggataatgatcctcaagctgctgaccgacttccagtctcaccagctctgggctactctgctttccctcacctttatcaagacgaccttcagtcttcactacgcttggaagaccatggccatggtgctgagcatcgtatccctcttcccattatgcctgagcaccacgagccagaagaccacctggctccccgtcctgctcggcagcctgggttgcaagccgttgaccatgttcctgatcgccgagaacaagatctggggccgaaagagctggcctctcaacgaggggatcatggcagtgggcatcgtgtccattctgctcagctctctactgaagaacgatgtaccactggcagggcccctcatcgcgggcggcatgctgatcgcctgttatgtaatctctgggtccagcgccgacctgtccctcgaaaaggcggcagaagtgagttgggaggaggaggccgagcattccggcgccagccacaacatcctggtcgaggtgcaggacgacggcacgatgaagatcaaggacgaggagcgggacgacaccctgaccatcctcctgaaggccactctgctcgcggtgtccggcgtctatccactaagtatccccgccaccctgttcgtctggtatttctggcagaagaagaagcagcggtccggtgttctctgggacactccgagccctcccgaggtcgagcgggccgtgctggacgacggcatctatcgcatcatgcagaggggcctgctggggaggtcccaggtgggcgtcggcgtgttccaggagaacgtgttccacaccatgtggcacgtcacgcggggcgctgtgctcatgtatcaaggcaagcgcctggaaccctcgtgggcctcggtgaagaaggacctgattagctacggaggcgggtggaggctccagggctcctggaacaccggggaggaagtccaggtgatagccgtggagccaggcaagaaccccaaaaacgtccaaacggccccgggtaccttcaaaaccagtgagggcgaggtgggcgctatagctctcgatttcaagcccgggaccagcggctcccccatcgtaaaccgtgaggggaagattgtgggcctgtacggcaacggggtggtgacgaccagcggcacctacgtatcggccatcgcccaggccaaggccagccaggaagggcctctgccggagatcgaggacgaagtattccgcaagcgcaacctgaccatcatggacctgcatcccggctcagggaagactcggcgctatctccccgccatcgtgcgcgaggcgatcaagcgcaagctccggaccttgatcctcgccccgactcgcgtcgtggcatcagaaatggcagaggcgctaaaaggcatgcccatccgctatcagacgactgcggtcaagtccgagcacactggcaaggagatcgtcgacctgatgtgccacgccacattcaccatgcggctcctgagccctgtgcgcgtgcccaactacaatatgatcatcatggacgaggcacatttcacagacccgtccagcatcgctgcccggggctacatatctacccgcgtcggcatgggcgaggctgccgctatcttcatgaccgccaccccgcccggctcggtggaagccttcccccagtccaacgcggtgatacaggacgaggagcgggatattccagagcgaagctggaatagtgggtatgagtggatcacggacttccccggcaagaccgtctggttcgtgcctagcatcaagtccggcaatgacatcgccaattgtctgaggaaaaacgggaagcgcgtgattcagttaagccggaagacgttcgacaccgagtaccaaaagacgaagaataacgactgggactacgtcgtgaccaccgacattagcgagatgggcgccaatttccgcgcagaccgggtgatcgaccccaggcggtgtctaaagcctgtcattctgaaggacgggcccgagcgggtgatcctcgcgggccccatgcccgtcaccgtggcgtcagccgcccaacggcgcgggcggatcggtcgtaaccacaacaaggagggggatcaatacatatacatgggccaaccgctgaacaatgatgaggaccacgcccattggacggaggcgaagatgctactcgacaacatcaacaccccagaggggatcatccccgcccttttcgagcccgagcgagaaaagtccgctgccatcgatggggaataccgcctccgtggtgaggcccgtaaaaccttcgtagaactcatgcgccgcggggatctgcctgtctggctgtcctacaaggtagcgagcgagggtttccagtactccgaccgccggtggtgcttcgacggcgagcgcaacaaccaggtgctagaagagaacatggacgtggagatctggaccaaggagggggagagaaagaagctgcgccccaggtggcttgatgccaggacgtatagcgaccccctcgccctgcgggagttcaaggagttcgccgcgggccgccgttctgtcagcggggaccttatcctcgagataggcaagctgcctcagcacctgacgcaacgcgcgcagaacgccctggacaacctggtgatgctgcacaattccgagcagggtgggcgggcatacagacacgcaatggaggagctccccgatacgattgagaccttaatgctgctcgctctaatcgctgtcctgacgggcggggtgaccctcttcttcttaagcggtcggggtcttggcaagacctccatcggattgctgtgcgtgatggccagcagtgttctgctctggatggcctcggtggagccacactggatcgccgcctccatcatcctggagttcttcttaatggtgttactgatccctgagcctgatcgccagcgaacgccgcaagacaatcaactggcctacgtggtgatcgggctcctgttcatgatcctgaccgtggcagccaacgagatgggcctactcgagacaaccaagaaggacctcgggatcggccacgttgcagtggagaaccaccatcacgcagccatgttggacgtggacctgcaccccgccagcgcctggaccctgtatgcagtcgcgaccacgatcatcacccccatgatgcggcacactatcgagaataccacagctaacatctccctcaccgccatcgccaaccaggccgcaatactgatggggctggacaagggctggccgatcagcaagatggacatcggcgtgcccctcctggccttggggtgctactcccaggtgaacccacttaccctgaccgccgccgtcctgatgctcgtggcgcactacgccatcatcggccccgggctgcaggccaaagccacgcgtgaggcccagaagcgcacagcagccggaatcatgaaaaaccctactgtggacggtatcgtcgccatagacctggacccggtagtctacgacgccaagttcgagaagcaactcggacagatcatgctgctgattctctgcacctcgcagatcctgctgatgcgcacgacctgggccctctgcgagtctataaccctggcgaccggccccctgacgaccctctgggagggatcacccggcaagttctggaacaccaccatcgcagtaagcatggccaacatcttcaggggttcctacctggccggcgccggcctggcgttcagccttatgaagtccctagggggcgggcgcagggggacgggggcccaaggagagaccctgggcgaaaagtggaagcggcagctcaaccagctctctaagtccgagttcaacacctacaagcggagcgggatcatggaggtggaccgctctgaagccaaggaaggcctgaagcgcggggagaccacgaagcacgctgtgtcgcgcggcaccgcgaagctccggtggttcgtcgagcgcaacctggtgaagccggaggggaaggtaatcgacctcggttgcgggagaggtggttggtcctactactgcgcggggcttaagaaggtcacggaggtgaaggggtacaccaagggcggccccggccacgaggagcccatccccatggccacctacgggtggaacctcgtgaagctgtacagcggcaaggacgtcttctttatcccacccgagaagtgcgacacccttctttgcgacatcggggagtcctcccccaaccccactatcgaggagggccgcactctacgtgtcctgaagatggtggaaccatggttacgcgggaaccagttctgtatcaaaatcctgaacccctacatgccctccgtcgtggagacactcgagcagatgcagcggaagcacggcggcatgttagtgcgtaatcccctaagccggaactcgacccacgaaatgtactgggttagctgcggaaccggcaatatcgtgtccgccgtgaacatgacctcacgcatgctgctcaaccggttcacgatggcccaccgaaaaccgacgtacgagcgcgacgtcgacttaggggcgggcaccagacacgtggccgtggagcccgaggtccccaaccttgacatcatcggccagcgtatcgaaaacataaagcacgagcacaagtccacctggcactacgacgaggacaacccctataagacatgggcgtaccacgggagctacgaggtgaagccgagcggctccgccagcagcatggtgaacggcgtagtgaagctcttgacgaaaccctgggacgtcatcccgatggtgacccagatcgccatgactgacacgacgcccttcggccagcagagggtgttcaaagagaaggtggacaccagaactcccaaggcgaaacgcgggaccgctcagatcatggaagttacggccaagtggttatggggcttcttaagccgcaacaaaaagccacgaatctgtacccgcgaggagttcacccgaaaggtgcggtccaacgccgccatcggcgcggtcttcgtggacgagaaccaatggaactccgccaaggaagccgtggaggacgagcgattctgggacctggtccaccgcgagcgggagctgcacaagcaggggaaatgcgccacatgcgtgtacaacatgatggggaagcgagaaaagaagctcggagagttcggcaaggcgaaggggagtcgcgccatctggtacatgtggctgggcgcccggtttctggagttcgaggccctcggcttcatgaacgaggaccactggttcagccgagagaactccctgagcggggtggagggcgagggactgcacaagctgggctacattctgcgcgatatctccaagatccccgggggcaatatgtatgccgacgacaccgcgggctgggacacacggatcacggaggatgacttgcagaatgaggccaagatcaccgacatcatggagccggagcatgccctcctggccaagagtatcttcaagctgacctaccagaacaaggtcgtgcgcgtgcagcggcctgcaaagaacgggaccgttatggacgtgatatcccgccgagatcagcggggcagcggccaagtgggcacctacggcctcaacacctttacgaacatggaggctcagttaatccgccagatggagtctgaggggatcttcagcccctccgagttggaaaccccaaacctcgccggccgggtgttagactggcttgaaaagcatggggtggaacgcctaaagaggatggccatatcaggagacgattgcgtggtcaaaccgatcgacgaccgctttgccacggccctgacggcgctgaacgacatggggaaggtgcgtaaggacataccccagtgggagcccagcaagggctggaacgattggcagcaggtccccttctgctcccaccactttcatcagctcataatgaaagacggccgtgaaatcgtcgtgccttgccggaaccaggacgagctggtggggcgcgcccgggtctctcagggagcggggtggtcccttcgggagacggcctgcctcggaaagagctatgcccagatgtggcagctgatgtacttccacaggcgcgaccttcggctcgcggctaacgccatctgctccgccgtgcccgtggactgggtccccacaagccgcactacctggtccatccacgcgcaccaccagtggatgaccaccgaggacatgctgtctgtgtggaaccgggtctggattgaggagaacccctggatggaggacaagacgcacatctccagctggggcgatgtcccgtaccttggcaagcgcgaggaccagtggtgcggctccctcatcgggcttaccgctcgggccacgtgggctaccaatatccaggtggccattaatcaggtgcgcagacttatcggcaatgaaaactatctcgactacatgaccagcatgaagcgattcaagaatgaatccgacccggagggcgcgctgtggtaa

SEQ ID NO: 24521 - RNA, 9879 nt, synthetic construct
  misc_feature 1..9879: note = derived and/or modified CDS sequence (opt11) from DENV-1__EU482791__SS-prME
  source 1..9879: mol_type = other RNA
tcagtgaccatgttgctaatgctgatgcccacggccctggctttccatctcaccactcgcggcggggagccccacatgatcgtgactaaacaggagagaggcaaaagcctgcttttcaagacaagcgctggggtgaatatgtgcacactcatcgctatggacctgggagagctgtgcgaggacaccatgacctacaagtgtccacgtatcacagaggccgagcccgatgacgtcgactgctggtgtaatgctaccgatacgtgggtcacgtacgggacgtgcagccaaacgggggagcaccggagggacaagcggagcgtggccctcgcgccccacgtgggcctggggctggagacccgcaccgagacctggatgtctagcgagggcgcctggaagcagatccagagagtggagacgtgggccctccgccaccctgggttcaccgtgatagccctgttcctggcgcatgccatcggcacttccatcacccagaaagggattatatttatcctcctgatgctggtgacgccctccatggccatgcggtgtgtcggtatcggcagcagagactttgtagaggggctcagcggcgccacatgggtagacgtggtgctggagcacgggtcctgcgtgaccactatggcgaaggataagcctacgctggatatagagctactgaaaaccgaggtcactaaccccgcggtattgaggaagctgtgcatcgaggccaagatctccaacaccacgacagactcccggtgccccacccagggcgaggccaccctgatggaggagcaggatgctaacttcgtgtgccggcggacattcgtcgaccggggttgggggaatggctgcggactgttcggcaaaggttcattgatcacctgtgccaagttcaaatgcgttacaaagttagagggcaagatcgtgcagtacgagaaccttaagtactcagtcatcgtgacagtgcacactggcgaccagcaccaggtcggtaacgagtcaacggagcacggcaccaccgctacaattacacctcaagcccccacctccgagatacagcttacggactatggggccctgaccctggactgctcaccccggacggggctcgattttaacgagatggtgctcctgaccatgaaagaaaagtcctggctagtccacaaacagtggttcctggacctgcctctcccatggactagcggtgcgagcaccagccaggaaacatggaatcggcaggacctactggttaccttcaagaccgcccacgcgaagaagcaggaagtggtcgtgctcggcagtcaggaaggtgccatgcacaccgcgctaacaggcgccaccgagatacagacctcgggcaccacgaccatcttcgcggggcacctgaaatgccgtctcaaaatggacaagctgaccctgaaaggcatgagctacgttatgtgcactgggagtttcaagctcgagaaagaagtagcggagacgcagcatggtaccgtgctggtgcaaataaagtacgagggcaccgacgccccctgcaagatacccttctccacccaggacgagaaaggcgtaactcagaacggccgcttgatcaccgcaaatccgatcgtgaccgacaaagagaagcccgtgaacatagaggccgagccgcccttcggggagagctacattgtcatcggcgcgggcgaaaaggcactgaaactaagctggttcaagaagggctcaagcatcggcaaaatgttcgaggccaccgccagaggggctcggagaatggcgatccttggcgataccgcgtgggactttgggtccattggcggcgtgtttactagcgtggggaagttagtccaccagatcttcggcaccgcctacggggttctcttctccggagtgagctggaccatgaagatcgggatcggcgtactgctgacatggttaggcctgaacagcagaagcacctctcttagcatgacatgcattgccgtggggttggtgacactatacctgggcgtgatggtgcaggccgactcggggtgcgttatcaactggaaaggcagggagctcaagtgtgggagcggcatattcgtcacgaacgaggtgcacacctggaccgagcagtataagtttcaggcggatagcccaaagcgcctgtccgcagcgataggcaaggcctgggaagagggggtatgcggcatacggtcggccacccggctggagaatataatgtggaagcaaatatcaaacgagctcaatcacatcctgctggagaacgggatgaagttcacagtcgtcgttggcgatgtcgtcgggatcctggcgcagggaaagaaaatgatcagaccccagcccatggagcacaagtactcgtggaagtcctggggcaaggccaaaatcataggagcggacgtgcagaacactacgtttatcatcgacggaccaaacaccccggagtgcccggacgaccagcgcgcttggaatatatgggaagtcgaggactacgggtttggcatcttcaccactaacatctggctgaagctgagagacagttacacccaggtgtgcgatcacaggctcatgtctgcggccatcaaggacagcaaggccgtacacgccgacatgggctactggattgaatccgagaagaatgaaacatggaagctggcccgggcgagcttcatagaggtgaaaacctgcatctggcccaaatcccacactctgtggagcaacggggtgctggagtccgagatgatcattccaaaaatctacggcgggccgatcagccagcacaactatcgccccggctacttcactcagacggccgggccctggcacctaggaaaactggagctcgactttgatctgtgtgaaggaactactgtggttgttgacgagcactgcgggaaccgtggaccctccctgcgcaccaccaccgtgaccgggaagataatccacgagtggtgctgtcggtcctgcaccctgcctcccctccgcttcaagggcgaggacgggtgctggtacggcatggagattaggcccgtcaaggaaaaggaggagaatctggtgaagtccatggtgagcgcgggtagcggcgaggtcgattctttcagcctcggcctgctgtgcacatcgatcatgatagaggaggtgatgcgctcgcggtggtcacgcaagatgctcatgaccgggacgctggctgttttcctgctccttataatgggacagttgacctggaacgacctcatccggctgtgcataatggtaggtgccaatgcgagtgatcgcatgggcatgggcaccacctatctagcgctcatggctactttcaagatgcggccaatgttcgccgtggggctgctattccggcgcctcacctcccgggaagtgctgctcctgaccatcgggctgagcctggttgccagcgtggagcttccaaacagcctggaggagctgggggacggcctcgcgatgggcatcatgatcttgaaactgctcaccgacttccagtcccaccagctgtgggccacgttactcagcctaaccttcattaagactacattgtctctccactacgcctggaaaactatggcgatggtcctgtcgatcgtttccctgttccccctctgcctgagcacaaccagccagaaaaccacgtggctgcccgtcttactggggagccttgggtgcaaaccactcaccatgttcttgatcgcggaaaacaagatatggggtcgcaaatcctggcccctgaatgagggcatcatggccgtcggggtggtcagcatcctcctgagcagcctgttgaagaacgacgtccccctggccgggccgttgattgccggcggaatgctcatcgcctgctacgtaatttcaggttccagcgcggacctgagtctagagaaggccgccgaggtcagctgggaggaggaggccgagcactccggggccagccacaacattctcgtagaagtacaggatgacggcactatgaagataaaagacgaggagcgcgatgacaccctgaccatcctgctcaaggcgacgctgctggccgtctccggtgtctatccgttgagcatccccgccacgctgttcgtgtggtacttctggcaaaagaaaaaacaacgctccggggttctgtgggacacccctagccctcccgaggtcgagcgggccgtgttagacgacgggatctaccgaataatgcagcggggtctattggggcgctcccaagttggcgtgggcgtgttccaggagaacgtgtttcacaccatgtggcatgtaactcgcggggccgtgctcatgtaccagggcaagcgcctcgagccctcgtgggcgtccgtgaagaaagaccttattagctatggagggggctggaggctacagggatcctggaataccggcgaggaggtccaggtgatcgccgtggaaccgggaaaaaaccccaaaaatgtacagacagcacccggcacctttaagacgccagagggcgaggtgggggccatcgccttagacttcaagcccgggacctccgggagccccatcgtgaatcgggagggcaagatcgtcggcctatacggaaatggggtggtcaccacctcagggacgtacgtaagcgctatcgcacaggccaaggcgtctcaggagggcccgctgcccgagatcgaggatgaggtgttcaggaagaggaacctcaccatcatggatttgcaccccggcagcggcaaaactcgtcggtacctccctgccatcgtgcgggaggccatcaagcgcaaactcagaaccctgatcctggcgcccacgagagttgttgccagcgagatggcagaggctctcaagggaatgcccatccgctaccagaccacagctgtcaagagcgagcacaccgggaaggaaatcgtcgacctgatgtgtcacgccacgtttaccatgcggttactctccccagtgagggttcccaactacaacatgatcatcatggatgaggcccatttcaccgaccccagctccatcgccgccagagggtacataagcacccgcgtaggtatgggagaggcagcggccattttcatgacggcaacaccgcccgggtccgtggaggcgttcccgcagagcaatgccgtgattcaggatgaggagcgggatatacccgagcgctcctggaattctggatacgaatggatcaccgacttccccggcaaaaccgtctggtttgtaccctcgatcaagagcgggaacgacatagcgaactgcctgcggaagaacggaaagcgtgtgatccagctgtccagaaagacgtttgataccgagtaccagaaaaccaaaaataatgactgggactatgtcgtgactacggacatcagcgagatgggcgccaacttccgcgcagatagggtgatcgatccgcgccggtgcctaaaaccagtcatactgaaagacggccctgaacgtgtaatcctggccgggcctatgccggtcaccgtggcctccgcagcccagaggaggggccggatcggaaggaaccacaataaggaaggagatcagtacatctacatgggccaacccttgaataacgacgaggaccacgcgcactggaccgaagctaagatgctgctggataatatcaacactcccgaggggatcatcccagcattattcgagccagagcgggagaagtcagccgccatagacggagaatatcggttgcgcggggaggcgcggaagacgttcgtggagctgatgagacggggagacctcccggtctggttgtcctacaaggtggctagtgaaggcttccagtacagcgaccgccggtggtgcttcgacggagagcgcaacaatcaggtgctggaggagaacatggacgttgagatctggaccaaggagggggagcgtaaaaagttacgcccgcggtggctggacgcccgcacctactccgaccccctggccctccgggagttcaaagagttcgccgcggggcgacggagtgtgtcaggcgacctgatcctggagatcggcaagctcccgcagcacctgacgcagcgcgcccagaatgccttggacaacctcgtcatgctgcacaatagcgagcagggcgggagagcctaccgccatgccatggaggagctccccgacacgattgagaccttgatgctgctggctctcatcgccgtactcaccgggggggtgacgctgttctttctctccgggcggggcctgggcaaaaccagcatagggctactctgcgtgatggcatccagcgtactcctgtggatggcctccgtggagccccactggatcgccgcaagtatcatcctcgagttcttcctgatggttctgctcatccccgagcctgatcgccaaaggacgccccaggacaatcagttggcctacgtggttatcggacttctcttcatgattctcaccgtagcggccaatgagatggggctgctagagaccaccaagaaggacctagggatagggcacgtcgctgtcgaaaaccatcaccacgcaacgatgctggacgttgacctccatcccgcctccgcctggaccctgtacgccgtagcgaccacaatcatcacaccgatgatgcgccataccatagaaaatactacagccaacatcagcctgacggcgatcgctaaccaggccgcgatacttatgggcctggataagggatggcctatctccaagatggacatcggtgtgccactgttagccttgggttgctacagccaggtgaacccacttactcttacagctgccgtcttgatgctggtcgcgcattacgctatcatcggcccgggcctccaagccaaagccaccagggaggcccagaagcgtactgcagcagggatcatgaagaatcccaccgtggacggcatcgtcgccatagatctggaccctgtggtgtatgacgccaagttcgagaagcagctggggcagattatgctcctgatcctgtgcacctcccagatcctcctgatgcgcaccacgtgggctctgtgcgagagcattaccctcgccaccggacccctgaccactctgtgggagggaagcccggggaaattctggaacactaccatcgccgtaagtatggctaatatcttccgcgggtcctacttggctggcgccgggctggcattcagcttgatgaaatccttggggggtggacgtcgggggacaggagcccaaggcgagacgctgggggagaagtggaaacgccagctgaaccagctctccaagagcgagttcaacatttacaaacgctccgggatcatggaggtggatcgcagcgaggctaaggaagggctgaagcgaggcgagaccacgcgccacgctgtgtcccggggaacagccaagctgcgttggtttgtcgagcggaaccttgtcaagcctgagggcaaggtgatcgacctaggctgcgggcgcggcggatggagctactactgcgcaggcctcaagaaggtaaccgaggtgaaggggtacactaaaggaggcccagggcacgaggagccaattcccatggccacctacggctggaatctggtgaaactccactccgggaaggacgtgtttttcactccgcccgagaagtgcgacacactgctatgcgacatcggcgaaagctccccaaacccgaccatcgaggaagggaggacgttgcgcgtgctgaaaatggtcgagccctggctacgcggcaaccagttctgcatcaagatcctcaatccctacatgcccagcgtggtggagactttagagcagatgcagcgtaagcacggtggaatgctcgttcggaacccgctcagtcgcaacagcacccacgagatgtattgggtctcctgtggcactgggaacatcgtgagcgcagtgaacatgacgtctcgtatgttgttaaaccgcttcaccatggcacatcgcaaaccgacctatgagcgggacgtcgacctgggggctggcacccgacacgtggcagtggaaccggaggtcgccaatctcgacatcatcggacaacggatcgagaacattaagcacgaacacaagagcacctggcactacgacgaagacaatccctataagacctgggcctaccacggctcgtacgaggtgaaaccgtctgggtccgctagcagcatggtcaacggcgtggtaaagctgctcaccaagccctgggacgtcatccccatggtgacgcagatcgcgatgaccgacacgacccccttcgggcagcaacgcgtatttaaggagaaagtcgacacgcggaccccgaaagccaaacgcggcacggcccagatcatggaagtcaccgcgcggtggttatggggcttcctctcccgcaacaagaagcccagaatctgtacgcgcgaggaatttacccgaaaggtcaggagcaatgccgcgatcggggctgtcttcgtggacgagaaccagtggaattcggcgaaggaggccgtggaagacgagcggttttgggacctcgtccagaaggagcgtgagctgcacaagcagggcaagtgcgcgacctgcgtgtacaacatgatggggaagagagagaaaaagctgggcgaatttgggaaagccaagggcagccgcgccatctggtacatgtggctcggggcgcggttcttagaattcgaagcgctcgggttcatgaacgaggaccattggttctcccgcgagaatagcctcagcggggtcgagggggaaggcttgcataaattggggtacatcctacgggacatctcgaaaatacccggcggcaacatgtacgcggacgacactgctgggtgggacacgcgaataaccgaggacgacctgcagaatgaggcaaaaatcacagatattatggagccggagcacgcacttctcgccacatcaatcttcaagttaacataccaaaacaaggtcgtgcgggtgcagcgcccggcaaaaaacggcacagtcatggacgtgatcagccgcagagaccagcgcggcagcggccaggtgggcacctacgggctaaacacctttacgaacatggaagcccagctcatcagacagatggagagtgagggtattttcctgcccagcgagttggagacccccaacctcgccgagcgcgtactggactggctagagaagtatggggtagaacggttaaagcgcatggccatcagcggggacgattgcgttgttaagccgattgacgaccgcttcgccaccgcgcttaccgccttgaacgacatggggaaggtgcgcaaggacatcccgcagtgggaaccatccaagggctggaatgactggcagcaggtgcccttctgttcccaccatttccaccaattgatcatgaaggacggaagagagatcgtcgtgccgtgcagaaaccaggatgagctggtcgggcgggcgcgcgtctcccaaggagcagggtggtctctccgggagaccgcgtgtctcggcaaaagctacgcccaaatgtggcagctgatgtacttccaccgccgggatctgcgcttagccgcaaacgccatatgctccgcggtgcccgtggactgggtccccaccagccgcaccacctggtccatccatgcgcatcaccaatggatgacgaccgaggacatgctgagcgtttggaacagagtgtggattgaagagaacccctggatggaggacaagacccacgtctccagctggggcgacgtgccgtacctaggcaagcgggaggaccaatggtgtggctcacttatcgggctaaccgcccgagccacctgggcctccaacatccaggtggcgattaaccaggtccgccggctaataggcaatgagaactacctcgattacatgacatccatgaagcgcttcaaaaatgagggcgacccggagggtgcactgtggtga

SEQ ID NO: 24522 - RNA, 9879 nt, synthetic construct
  misc_feature 1..9879: note = derived and/or modified CDS sequence (opt11) from DENV-1__EU482792__SS-prME
  source 1..9879: mol_type = other RNA
agcgtgaccatgttactcatgctgatgcccacggccctagcctttcacctcaccacccggggcggggagccccacatgatcgtgaccaagcaggagcgggggaagtcactgttgttcaagacctcagccggggtgaacatgtgcacactcatcgccatggatctgggcgagctgtgcgaagacaccatgacctacaagtgccctcggatcacggagaccgagcccgacgacgtggactgctggtgtaacgccaccgacacctgggtgacctatgggacgtgctcgcagaccggggaacatcggcgcgacaagcggagcgtggccctcgcgccccacgtcggcctggggcttgaaacccgcacggagacgtggatgtccagcgaaggcgcctggaagcagatccagagagtggaaacctgggccctccgccacccagggttcaccgtaatcgcccttttcctagcccacgcgatcggtacctctatcacacagaaaggaatcatcttcatactcctgatgctggttacccccagcatggccatgcggtgcgtcggcataggcagccgcgatttcgtagagggtctcagcggagcaacttgggtggacgtggtgctggagcacgggtcctgcgtgaccacaatggccaaggataagcctactctggacatcgagctcctgaagaccgaggtcactaatcccgctgtcctgcggaagttatgcatcgaggcgaaaataagcaacacgacgaccgactctcgctgccctacccagggtgaggctacgctgatggaggagcaagacgccaatttcgtgtgccgaaggacctttgtcgatcggggctgggggaacgggtgcggtctattcggcaaagggagcctcataacgtgcgccaagttcaagtgcgtgacgaagctggagggcaagatcgtgcagtatgagaacttgaagtactcagtcattgtgacggtccacaccggcgaccagcaccaggtcggtaacgaaagcaccgagcacggcaccaccgccacaatcacgccccaggcacccacctcggagatacagctcaccgactacggagcactgactctcgactgcagcccacgcacaggactggattttaacgagatggtgttgctaaccatgaaggagaagtcctggctcgtccataagcagtggtttctggacctaccgctcccctggacctcgggggccagcacgtcccaagaaacctggaaccgacaggacctgctggtgaccttcaagaccgcccatgccaaaaagcaggaagtggttgtgctgggaagccaagagggagcgatgcacactgcactgacgggggccaccgagatccagacctcggggacgaccaccatcttcgccggtcacctgaagtgcagactcaagatggacaagctgacccttaagggcatgagctacgtgatgtgcacggggtcctttaagcttgagaaggaggtcgcggagacccagcacggtaccgtactggtgcaaatcaagtatgaaggcaccgacgcgccttgcaagatccccttcagtacgcaagacgagaagggggtgacccaaaacggcaggctgatcaccgccaacccgatcgtgaccgacaaggagaaacccgtcaacatcgaggccgagcctcccttcggtgagtcctacatcgtcataggcgccggtgagaaggcgctgaagctcagctggttcaagaaagggtccagcatcggcaagatgttcgaggccacggcccgcggggctcgtcgcatggccatcctgggcgataccgcgtgggacttcggcagtatcggcggggtgttcaccagcgtggggaagctagtccaccagatcttcggcaccgcctatggggtcttattctccggggtgtcatggacaatgaagatcgggatcggcgtgctgcttacctggttaggcctgaactcccgcagtacgtccctgtcgatgacctgtattgccgtagggctcgtaaccctatacctgggcgtcatggtgcaggccgactccgggtgtgtgatcaactggaaaggtcgggagcttaagtgcgggtccgggatcttcgtcactaacgaagtgcatacctggactgagcaatataagttccaagctgacagcccgaagcgactgtccgcggccatagggaaggcctgggaagagggggtctgcggcatccggagcgcaacacgtctcgagaacatcatgtggaagcagatctcaaatgaactcaaccacatcctcctggaaaacgatatgaaattcacggttgtcgtgggagacgtcgtgggcatattagcccagggtaaaaagatgatccggccacagccaatggagcacaagtactcatggaagtcctgggggaaggcgaagatcatcggagctgatgtgcaaaacaccactttcattatcgatgggcccaataccccggagtgcccagacgaccagcgcgcctggaacatctgggaggtcgaggactatggcttcgggatatttacgaccaacatctggctgaagttacgggacagctacacccaggtgtgcgaccaccggctcatgtccgccgcgatcaaggatagcaaggcggtgcatgccgatatgggctattggattgagtccgagaagaacgagacgtggaagctggcccgagccagtttcatcgaggttaagacgtgtatatggcctaagtcccacaccctttggagcaacggcgtgctcgaatctgagatgataatcccgaagatctatgggggcccgattagccaacacaactacagacccggctactttacccagaccgcggggccctggcacctcggaaaactggagctcgactttgacttgtgcgaggggaccactgtggtcgtggacgagcactgtggcaaccgggggccgtccctacgcaccaccaccgttacgggcaagatcatccacgagtggtgttgccggagctgcaccctgccgcccctccgcttcaagggcgaagacgggtgttggtacggtatggaaatccgtcccgtcaaggagaaggaggagaacctggtgaagtccatggtgagcgcaggatctggagaggtagatagtttcagcctcggtctgctttgcatctcaatcatgatcgaggaggtgatgcgcagccgctggtcccgcaagatgctcatgacaggcaccctggccgtattcctgctactgatcatggggcagctgacttggaacgacctgatccgattgtgcatcatggttggcgccaatgccagcgacaggatggggatgggcacaacttacctggcgctcatggccacgttcaagatgcgcccgatgttcgcagtaggcctgctgtttcgtcgattaacctcaagagaggtactgctgctcaccatcggtcttagcctggttgcctccgtggagctaccaaattcgctagaggagctgggcgatggcctagccatgggcatcatgatcctgaagctgctcacggatttccagtcacaccagctgtgggcgacgctgctcagcctgaccttcataaagacaactctgagcttgcactatgcttggaagactatggccatggttctgtcaatcgtgtccctgttccccttgtgtctatccactacctcccagaagaccacgtggctgcccgtgctcctgggcagcttgggatgcaaacccctcaccatgtttctgatcgcggagaataagatttggggccgcaaatcgtggcccctgaacgaggggattatggcagtcggggtagtgtccatattattgagctccctactcaagaacgacgtgccactggccgggcccctaatcgcgggcggaatgctcattgcatgttacgtaatcagcgggtccagcgccgatctatcactcgagaaggcggccgaggtgagctgggaagaggaagccgagcactccggcgccagccacaatatcctcgtcgaggtgcaggacgacggcactatgaaaattaaggatgaggagcgggatgacaccctgactatcctgttaaaggcgacgctgctggcggtgtccggcgtctacccgctcagcatccccgccacccttttcgtatggtatttctggcagaagaagaaacaacggtccggggtgctgtgggacactcccagcccccccgaggtcgagcgggccgtgctggatgacggcatttaccgcattatgcagcggggtttgttagggcgctcccaagtgggcgtcggtgtgttccaagagaacgtgtttcacaccatgtggcacgtcaccaggggcgcggtgctgatgtaccaggggaagcgcctcgaacccagctgggcttccgttaaaaaggacctgatcagctacggaggcgggtggcggttgcagggctcctggaacacaggtgaagaagtccaggtgatcgcggtggagccaggaaagaaccccaagaacgtacaaaccgctcccgggaccttcaagacacccgagggcgaagtgggagctatcgccctcgacttcaagcccgggaccagcgggtcccccatcgtcaatcgcgaggggaagatcgtaggcctgtacgggaacggggtggtgactacgagcggcacttacgtcagcgccatagcccaggccaaggcatctcaggaggggccgctacccgaaatagaggacgaggtgttccggaaaagaaatttgaccataatggacctgcatcccggcagcgggaagacccgacgctacctgccggccatcgtgcgtgaggcgattaagcgcaagctcaggacattaatactggccccgacgcgcgtcgtggcctccgagatggccgaggctctaaagggaatgcccatccgctaccagacgacggcagtcaagagcgagcacactggtaaggagatcgtcgacttaatgtgtcatgccacgttcaccatgcggttgctctcgcccgtacgcgtgccgaactataacatgataataatggacgaggcccacttcacagatccctcgtcgatagccgcccgggggtacatcagcactcgagtgggtatgggggaagcggccgctatcttcatgacggccacgccgcccggctccgtggaggctttcccgcagagcaacgctgtgatccaggacgaggagcgggacatccccgagaggtcatggaacagcgggtatgagtggatcaccgactttcccgggaagacggtctggttcgtgccctccatcaagagtgggaatgacatagccaactgcctgcgcaagaacgggaagcgcgtgatccagctgtcccggaagacgttcgacactgagtaccagaagaccaagaacaacgactgggactacgtcgtgaccacggacataagcgagatgggcgccaacttccgcgccgaccgggtaatcgacccgcgcagatgccttaagcccgtgatcctaaaggatgggcccgaacgcgtgatccttgcggggcctatgccggtgaccgtggctagtgccgcacagcggcgcggaagaatcggtcgcaaccacaacaaggagggcgatcagtacatatatatgggacaacctctcaacaacgacgaggatcacgcccactggaccgaggcgaagatgctgctggataatatcaacacaccagagggcatcattcccgcgctcttcgagccggagcgggagaaatccgccgccatcgacggggagtatcgcttacgaggagaggcccgtaagacgttcgtggagctaatgcgccggggagacctccccgtgtggctgtcctacaaggttgcaagcgagggattccagtacagcgaccgccgttggtgcttcgacggtgagcgcaacaatcaagtgcttgaggagaacatggacgtcgagatctggaccaaggagggggagcggaaaaagctccggcccagatggctggacgcccgcacttactccgacccccttgccctgcgggagttcaaggagttcgctgccggccgccggtccgtcagcggggacttgattctagagatcggcaagttgccacagcatcttacacagcgtgcgcaaaacgcgcttgacaatctcgtgatgctgcacaacagcgagcagggcgggcgggcctaccgccacgccatggaagagctgccggatacgatcgaaacgttgatgctgctagccctaatcgccgtcctgaccggcggtgtgaccctgtttttcctttccggcagagggttgggaaagactagcattggccttctctgtgtcatggcttcgagcgtcctgctgtggatggcgtccgtggaaccccactggatcgcggcgagcatcatcctcgagttcttcctaatggtgctcctcatccccgagccggaccgccagcggactccccaggacaatcagctagcctacgtcgtgatcgggctccttttcatgatcctgacggtggcagcgaacgagatgggcttgctcgagaccacaaagaaggacctggggataggccacgttgccgtggaaaatcaccatcacgcaacgatgctggacgttgacctccaccccgcctccgcctggacattgtacgccgtagccaccaccatcatcacgccgatgatgcgccataccatcgaaaataccaccgcgaacatcagcctcaccgccatcgcgaaccaagccgccatcctcatggggttagacaaagggtggccgatctctaagatggacatcggcgtgcccctgctcgcgctgggatgttactctcaagtgaaccccttaaccctcaccgccgccgtcctaatgctggtggcccactatgctatcataggccctggcctccaggcgaaggccactcgggaggcccaaaagcgcacggcggcggggatcatgaagaaccccacggtggacgggatcgtcgccatagatctggacccagtggtgtacgatgccaaattcgagaagcagctgggccagatcatgctcctgatcctatgtacatcacagatactcctgatgcgcaccacgtgggctctgtgcgagtccatcaccttggccacgggccccctgaccacgctgtgggaggggagcccgggcaagttctggaacaccaccatcgccgtgtctatggccaacatcttccgggggagttatctcgccggcgctggccttgcgttcagcctgatgaaatcgcttgggggcgggcgccgcggcacaggggcgcagggcgaaacactgggggagaagtggaagcgccagttgaaccaactctccaagagcgagttcaacatctataagcggtcggggatcatggaggtggatcgttctgaggccaaggagggcctgaaaaggggtgagaccacccgccacgccgtgtcgcgaggcaccgccaaactacgatggttcgttgagcgcaatttagtgaagccggaaggcaaggtgatcgatctcggatgtggccgcgggggctggagctactattgcgcggggctgaagaaagtcacggaggtcaagggctacaccaaaggcgggcccggccacgaggagcccatcccgatggccacctacgggtggaatctggtgaaactccactccgggaaggacgtcttctttacaccacccgagaagtgcgacaccctgctgtgcgacatcggggaatcctctcccaacccgacaatcgaagagggccgcacactgagagtgctgaagatggtggagccctggctgcggggaaatcagttttgtattaagatactcaacccctacatgcccagtgtcgtggagactcttgagcagatgcagcgcaagtacggcggcatgcttgttcggaaccccctctcccgcaactctacccacgagatgtactgggtcagctgcgggacgggaaatatcgtgagcgccgtgaacatgacctcccggatgctgctgaacagattcaccatggcccaccgcaagccgacctacgaaagagatgttgacctcggggccggcacgagacacgtggccgtggagccagaggtcgccaacctggacattattggtcaacggatcgagaacatcaagcacgagcacaagtcgacttggcactacgatgaagacaatccttacaagacctgggcctaccacggatcctacgaagtgaaacctagcggctccgcctcgagcatggtcaatggagtcgtgaagctgctcactaaaccttgggacgtcattcccatggttacccagatcgcaatgaccgatacaacgcccttcgggcagcaacgcgtttttaaggagaaagtcgacacgcggacccccaaggcgaaacgtgggaccgcacagatcatggaagtaaccgccagatggctgtggggatttctgtccagaaataagaaaccgcggatatgcacgcgcgaggagtttacccgtaaggttcgcagcaacgccgcaatcggcgctgtcttcgtggacgagaaccagtggaactccgccaaggaagccgtggaggacgaaagattctgggatttagtccagaaggagcgcgagctgcacaagcagggaaagtgcgccacctgcgtgtacaacatgatgggtaagcgggagaagaaactcggggaattcggaaaggcaaaaggcagccgagccatctggtacatgtggctcggagccagatttctggagttcgaggcattgggcttcatgaacgaggaccattggttctccagagaaaacagcctctccggagttgagggcgaggggttgcacaagctgggctacatactcagggacatatccaaaatccccggaggcaacatgtatgccgacgacaccgcgggctgggacacccgcatcaccgaagatgacctgcagaacgaagccaagatcacagacattatggagccggagcacgccctgctcgccacctcgatctttaagctcacgtaccagaacaaggttgtgcgcgttcagcgccccgccaagaacggaaccgtaatggacgtgatctcacgccgggatcagcgaggctccggccaggtgggcacatacggcctgaataccttcacgaatatggaggcgcaactcatccggcagatggagagtgagggtatattcctcccctccgagctagagacccccaacctcgctgagcgagtcctggactggctggaaaagtatggcgtggaacgacttaagcgcatggccatatctggggatgactgtgttgtcaagccgatagacgatcggttcgctaccgccctgaccgcgctcaacgacatgggtaaagtgcgcaaggatatcccacagtgggagccgtccaaggggtggaacgattggcaacaggttcccttctgcagccaccattttcaccagctcatcatgaaggacggtcgtgaaatcgtggtgccgtgccgcaaccaagacgaactggtgggccgagcacgggtttcccagggggccggctggtcgctacgggagacggcctgcctcggcaagagttatgcccagatgtggcagctgatgtacttccatcgcagggacttgcgcctggcggccaacgcaatctgctctgccgtgcccgtggactgggtccccaccagtcgcaccacctggtccatccacgcgcaccaccagtggatgacgaccgaggatatgctgagcgtctggaaccgcgtgtggatcgaagaaaacccctggatggaagacaagacccacgtctccagctggggggacgtgccttacctggggaagcgggaggaccagtggtgcggctcgctgattggcctaacagcccgcgcaacttgggccagcaacatccaggtggcgatcaaccaggtccgtcggttgattgggaacgagaattacctagactacatgacttccatgaagagattcaagaacgagggcgacccagagggggcgctgtggtga

SEQ ID NO: 24523 - RNA, 9879 nt, synthetic construct
  misc_feature 1..9879: note = derived and/or modified CDS sequence (opt11) from DENV-1__EU482707__SS-prME
  source 1..9879: mol_type = other RNA
agcgtgaccatgctgctgatgttaatgcccaccgccctggctttccatctcaccacacgcggcggggagccccacatgatcgtgtccaaacaggagcgggggaagagccttctgttcaaaacgagcgcgggggtgaacatgtgcaccttgattgcaatggacctgggcgagctgtgcgaggacacgatgacctataagtgcccccggattacagaggccgagcccgacgatgtggactgctggtgcaacgctaccgacacctgggttacttacgggacctgcagccagaccggcgagcaccggcgggacaagcggtccgtggccctcgcgccccatgtgggcttggggttagagacgagaaccgagacctggatgagctccgagggcgcctggaaacagattcaacgagtcgagacctgggccctgcgccacccagggttcacggtgatcgccttattcctggcgcacgctattggcaccagcatcacccaaaagggcatcatcttcatccttctgatgctggttaccccttccatggccatgaggtgcgtcggcatcggcagccgcgatttcgtggagggactttccggcgccacgtgggtggacgtcgtgttagagcacggcagttgcgtgaccaccatggctaaggacaagcccaccctggacatcgagctactgaagaccgaagtcaccaaccccgcagtgctgcggaaactctgcatcgaggccaagatctcgaacacaacgacggactcccgctgcccgacccagggggaggccacattggtcgaggagcaggacgccaacttcgtctgcaggcggaccttcgtggaccggggctgggggaacgggtgcgggctgtttggcaagggtagcttgattacctgcgccaagttcaagtgcgtgaccaagctggagggcaagatcgtacagtacgagaacttgaagtacagcgtgatcgtgaccgtccataccggggaccagcatcaggtggggaacgagtctacggagcacgggacaaccgcgaccataacgccccaggcacccacgacagagatccagcttacagactacggtgccctgacactggattgcagcccgcgcacgggcttagacttcaacgagatggtccttttaaccatgaaagagaagtcctggctcgtgcacaagcaatggttcctggacctgcccctcccctggacctctggtgcatccacctcccaggagacgtggaaccggcaggacctcctggtgacctttaagaccgcccacgcgaaaaagcaggaggtggtggtgttaggcagccaggagggtgccatgcacaccgccctgactggagccacagagatccagacctcgggaaccacgaccatcttcgccgggcacttgaaatgccgcttgaagatggacaagctgaccctgaagggtatgagctatgtcatgtgtactggttccttcaaactcgagaaggaggtggcggagactcagcacggaacggtgctggtccagatcaaatacgagggcaccgacgccccgtgcaagatcccattcagcacccaggacgagaagggggtgacgcagaacggccggctaataacagccaacccgatcgtcaccgacaaggagaagcccgtcaacatcgaggccgagcctcccttcggggagtcctatatagtgatcggcgcgggcgaaaaggccctgaagctcagctggttcaagaaggggtccagcatcggcaagatgttcgaggccacagcccgcggtgcccggaggatggcgatcctgggggatacggcgtgggacttcgggtccatcggcggcgtgttcaccagcgtagggaagctggttcatcagatcttcggcacagcctacggggtcctattttccggggtctcatggaccatgaagatcggtatcggcgtgctgctgacttggctcggcctgaactcccgctcaacatccctgtccatgacatgcatcgctgtcggactcgtcaccctgtacctgggcgtgatggtccaggccgactccgggtgcgtcatcaactggaaggggagggagctcaagtgcggaagcggcatcttcgtgacgaacgaggtgcacacctggaccgagcagtacaagttccaggcggacagtcctaagcgcctttccgccgccatcggtaaggcctgggaggagggggtctgtggcatacggagcgcgacacgcctggagaacatcatgtggaagcagatctctaacgaactaaaccatatcctgctggagaacgatatgaagctcaccgtggtggtcggggacgtggcgggcattctggggcagggcaagaagatgatccggccacagcctatggagtacaagtactcctggaagagctggggcaaggccaagatcatcggggccgacgcgcagaacacgaccttcatcatcgacggacccaacaccccggagtgtcccgatgaccagcgcgcgtggaacatctgggaagttgaggattacgggttcggaatctttaccacaaatatctggctgaagctccgggacagctacacacaggtctgcgaccaccgcttgatgtccgccgctatcaaggatagcaaggccgtacacgccgacatgggctactggatcgaaagtgagaagaacgagacctggaagctggcgcgggccagcttcatagaggtgaaaacctgtatctggcccaaaagtcacacactatggagcaacggggtcctggagtcagagatgatcatccccaaaatctacggtgggccgatttctcagcacaactaccgcccaggttatttcacacagaccgcaggcccctggcacttggggaagctcgagctggacttcgacctgtgcgagggtaccacggtggtggtcgatgagcactgcggtaaccgaggcccatccctccgaaccaccaccgtgacagggaagataatccacgagtggtgctgccggagctgcaccctgccgcccctgcgcttccggggcgaagacgggtgctggtacggcatggagataaggcccgtgaaagaaaaggaggaaaacctcgttaagtccatggtgagcgccgggagcggggaggtagactccttctcgctgggcctgctgtgcatatccattatgatcgaggaggtcatgcggagccgctggtcccggaagatgctgatgaccgggactctggccgtgttcttcctcctgatcatgggccagctgacgtggaatgacctaatccgactgtgcatcatggtgggggcgaacgccagcgaccgcatgggcatgggaaccacctatctggccctcatggccaccttcaagatgcggccgatgttcgcggtggggctgctcttccgccggctcacgtcccgagaggtgctgctgctcacgataggtctgtcattggtggcttcggtcgagctccccaacagcctggaagagctgggggacggcctcgccatgggcataatgatactaaagctgctgactgacttccagtcacaccagctgtgggcgaccctgctcagcctgacattcatcaagaccacctttagtctgcactacgcgtggaagaccatggcgatggttttgagcatcgtctccctgttccccctgtgcctaagcacgacgagtcagaagaccacgtggctgcccgtgctgctcgggagcctgggctgcaagccgctgactatgttcctcatcgccgagaacaaaatatgggggcggaagtcctggcccctcaacgagggcatcatggccgtggggatcgtcagcatcttactcagttccctgctcaaaaacgacgtgcccctcgcgggtcccctgatcgccggtgggatgttaatcgcgtgctacgtgattagcggatctagcgctgatctctctttggaaaaggccgccgaggtcagctgggaggaggaggctgagcactccggggcgtctcacaacatcctggtcgaggtgcaggacgacggcaccatgaagatcaaggacgaagagcgcgatgacaccctcaccatcctgctgaaggctacactcttagccgtctccggggtgtacccactgagcatacccgccaccctcttcgtttggtacttctggcagaagaagaaacagcggtccggcgtcctgtgggacacccccagcccgcctgaggtggagcgagccgtgctggacgacggaatctataggataatgcaacgggggttgctcggtcggtcccaggtcggggtgggggtgttccaggagaacgtcttccataccatgtggcacgttacccgcggggcagtgctgatgtaccagggcaagcggctggagcctagctgggcctcagtcaagaaggacctcataagctacggcgggggttggcgcctgcgcgggtcgtggaacacgggcgaggaggtccaggtaatcgccgtcgagcccgggaagaatccgaagaacgtgcaaaccgcccccggcacctttaaaacccccgagggcgaggtgggggccatcgcgctggacttcaagcccggcacaagcgggtcacccatcgtcaacagagagggcaagatagtgggcctctacggtaacggagtggtaaccaccagcggcacctacgtcagcgccatcgctcaggccaaggcgtcccaggaagggccgctgcccgagatcgaggacgaggtctttcgaaagcgaaacctgacgattatggacctgcaccccgggtccggcaagacccgacgctacctacctgcaatcgtccgggaggccatcaagcgcaagctgcgcactctcatcctggccccgaccagggtggtggcctccgagatggccgaagccctgaaagggatgcccatccgctaccagacgaccgccgtcaagagtgagcacaccgggaaggagatcgtggacctcatgtgccacgcaaccttcacgatgcggctgctgtcccccgtgcgcgtcccgaactacaatatgatcatcatggatgaagcgcacttcaccgatccctcttcgatagcggcccggggatacatcagcacccgcgtggggatgggcgaggccgcggccatcttcatgaccgcgacgccgcccggttccgtggaggcttttcctcagagcaacgccgttatccaggacgaggagcgggacatccccgagagatcttggaacagcggctacgagtggattaccgactttcccggcaaaaccgtgtggttcgtgcccagcattaagagcgggaacgacatcgccaactgtctccggaagaacgggaagcgcgtcatccagctgtcccggaagaccttcgacacggagtatcagaagaccaagaacaacgactgggactacgtggtgaccaccgacatcagcgagatgggggccaacttccgcgccgaccgggtcatcgacccgcggcggtgtctgaagcccgtcatcctcaaggacggccccgagcgcgtgattttggctgggcccatgccggtgacggttgcctccgccgcgcagcggcgtggccggatcgggcgaaaccacaacaaggagggggaccagtacatttatatgggccagcccctgaacaacgacgaagatcacgcccactggacagaggccaagatgctcctggacaacatcaacacccccgaggggatcatccccgccctgttcgagcccgagcgcgagaagtccgcggcggtagacggcgagtaccggctccgcggagaggcccggaagaccttcgtggaactgatgagacggggcgacctgcccgtgtggctctcctacaaagtagccagcgagggttttcagtacagtgatcgtcggtggtgcttcgacggggagcgcaacaaccaggtgcttgaggagaatatggacgtggagatctggacgaaagagggcgagcggaagaagctgagaccccggtggttagacgcacgcacttactccgaccccctggccctccgggagttcaaagagttcgctgccgggcgcagatcagtctccggcgacttaatcctggagatcggcaagctgccgcagcacctcacgcagagggctcagaacgccctggacaacctggtaatgctccacaattctgaacagggcgggcgggcgtaccgccacgccatggaggagctgcccgacaccatagagacgctgatgctcctggccctgatcgccgtgcttacggggggcgtcaccttattcttcctgtccgggcggggcttgggaaagactagcatcgggctgctgtgcgtgatggcctccagcgtgttactgtggatggcgtccgtcgagccccattggatcgccgccagcatcatcctggagttcttcctcatggttctgctgatccccgagccggaccgccagcggacgccccaggacaaccagctcgcttacgtggtgataggcctactgtttatgattctcacggtggccgcgaacgaaatgggtctactggaaactaccaagaaggacctaggcatcgggcacgtggccgtggagaaccaccaccacgcagcgatgctggacgtggacctgcatcccgccagcgcgtggaccctttacgctgtggcaacgaccatcatcaccccgatgatgcgccacaccattgagaacacaaccgctaacatctcgttgaccgccattgcaaatcaagcagccatcctgatggggctcgacaaagggtggcccatctccaagatggacatcggggtcccactactggctctgggctgctacagccaggtgaaccccctgactctgaccgcggccgtgctcatgctggtcgcccattatgccatcatcgggccgggcctgcaggccaaggcgacccgcgaggcccagaagcggaccgccgccgggataatgaagaatcccaccgtggacggcatcgtggccatagacctcgaccccgtagtctacgatgcgaagttcgagaagcaactgggacaaatcatgctgctcatcctttgcacgtcccagatccttctgatgagaaccacctgggccctgtgcgaaagcatcaccctggccacggggcctttgaccacgctgtgggagggcagtccggggaagttctggaacaccacaatcgccgtgagcatggccaatatcttcagaggctcctacctggcgggcgccgggctcgcattcagcttaatgaagtctctgggtgggggtcgccggggtaccggcgcccagggcgaaacactcggggagaagtggaaacgccagctgaaccagctgtccaaatcggagttcaacacgtacaaacggtctggcattatggaggtcgaccgcagcgaggcgaaggaagggctcaagcggggcgagacgaccaagcatgccgtgtcccgcggtaccgccaagctcaggtggtttgtagaacgcaatctggtcaagcccgaagggaaggtgatcgacctgggttgtggtcggggaggttggtcgtactattgtgccgggctcaaaaaggtgaccgaagtcaaggggtacacgaagggcggccccggtcacgaggagccaatccccatggccacctacggctggaacttagtgaagctgcactccgggaaggacgtgttcttcatcccgcccgagaagtgtgacacactcctgtgcgacatcggcgaaagcagtcccaatccaaccatcgaggaagggcgaacgctccgggttctcaagatggtggagccctggctgcgcggcaaccagttctgcattaagattctgaacccctatatgcccagcgtggtcgaagcgctcgagcagatgcagcggaagcacggcggcatgctggttcgcaacccgctgtccaggaacagcacccacgagatgtactgggtgtcctgcggtaccgggaacattgtcagcgctgtaaacatgaccagccgcatgctcttaaaccgcttcaccatggcccaccggaagcccacctacgagcgcgacgtggacctgggcaccggcacacgacacgtcgccgtggaacccgaggtggcaaacctcgacatcatcggccagcgaatcgaaaacatcaaacacgagcacaaaagcacctggcactatgacgaggacaacccctacaaaacgtgggcgtaccacggctcctatgaggtaaagccgagcggttccgccagcagtatggtcaatggcgtggtgaagctgctcacgaagccgtgggacgtgatccccatggtcacccagatcgccatgaccgacacgacccccttcgggcagcagagagtgtttaaggagaaagtggacacccgcaccccgaaggccaagcggggtacggcccaaatcatggaggtcaccgctcgctggttgtggggctttctgtcgcggaacaagaagccccgcatctgcacccgggaggaattcacccgcaaagtccgtagcaacgccgccatcggggcagtgttcgtcgacgagaaccagtggaactctgcgaaagaggccgtggaggacgagcgcttctgggacctggtccaccgggagcgcgagttgcacaagcagggcaagtgcgccacgtgcgtctataatatgatggggaagagggagaagaagttaggggagttcgggaaagccaagggcagcagagccatctggtacatgtggctgggcgcgcggttcctcgagttcgaggccctgggatttatgaacgaagaccattggttctcaagagaaaacagtctgtccggcgtggagggggaaggtctccacaaactggggtacatcctgcgggatatctctaagattcccggcggcaacatgtacgccgacgacaccgccgggtgggacacccgcatcaccgaggacgacctccaaaatgaggcgaagatcacagacatcatggagccggagcacgcgctgctggccaaagccatcttcaagctcacctatcagaacaaggtggtccgcgtgcagcggcccgccaagaacggcaccgtgatggacgtcatcagccgccgggaccaacgcgggagcggccaggtgggcacctacgggctgaacacgttcaccaacatggaggcacagttaatccgtcagatggagtccgagggcatctttagcccctccgagctcgagacccccaacctggcggagcgtgccctggactggctcgagaagtacggggtggagcggctgaagcgcatggcaatctcgggcgacgactgcgtcgtgaaaccgatcgacgaccggttcgcgaccgcccttacggcactcaacgacatggggaaagtccgcaaggacatccctcagtgggagccctccaagggatggaatgattggcagcaggtccccttctgcagccaccacttccaccagctgatcatgaaggacggccgggagatcgtggtgccgtgccgcaaccaggacgagctggttggacgggcccgcgtgtcccagggagccgggtggagcctcagggagaccgcatgcctgggcaagagctacgcgcagatgtggcagctgatgtacttccaccgccgggacctccggctggccgccaacgccatctgctccgccgtccccgtagactgggtgcccacgtcacggactacatggtccatccacgcgcaccaccagtggatgaccaccgaagacatgcttagcgtgtggaaccgcgtctggatcgaggagaacccctggatggaggacaagacccacatctccagctgggaggacgtgccgtacctggggaagcgcgaggaccagtggtgtggctccctgatcggcctgacggcccgggccacctgggccaccaatatccaggtggctatcaaccaggtccgccggctcattgggaacgagaactacctggattatatgaccagcatgaagcgcttcaagaacgagtccgaccccgagggagcattgtggtga

SEQ ID NO: 24524 - RNA, 9879 nt, synthetic construct
  misc_feature 1..9879: note = derived and/or modified CDS sequence (opt11) from DENV-1__EU482708__SS-prME
  source 1..9879: mol_type = other RNA
agcgtgactatgctgctcatgttaatgcccactgccctggcgttccacttaaccaccagaggtggggagccacacatgatcgtgagtaagcaagagcggggcaagagcctcctgttcaagacctccgctggggtgaacatgtgcactctcatagccatggacctgggcgagttgtgcgaagatactatgacttacaagtgcccgcggatcaccgagaccgagcccgacgacgtcgactgttggtgcaacgccacggacacctgggtgacctacgggacctgcagccagacgggagagcaccggcgtgacaaacggtccgtcgccctcgcgccccacgtgggcctgggactcgagacccgcaccgagacctggatgagctccgagggggcctggaaacagatccaacgggtggagacgtgggccctccggcaccccgggttcacagtgatcgccctgttcttggcccacgcgatcggcacctctataactcagaaggggatcatctttatcctcttaatgctggtcacaccctccatggccatgcggtgcgtcggcatcggtagccgcgactttgtggaggggctctccggcgccacctgggtggacgtcgtgctggagcacgggagctgcgtgaccaccatggccaaggacaagcccacgctggatatcgagctgctgaagactgaggtcaccaatccggccgttctgcggaagctctgcattgaagcgaagatctccaacacaacgaccgacagccgctgtccgacccaaggtgaggccaccctggtggaggagcaagacgccaacttcgtctgcaggagaacgttcgttgaccggggctgggggaatggctgtgggctgttcggcaagggatctctcatcacttgcgcgaagttcaagtgcgtcaccaaactggagggcaagatcgtccaatacgagaatctgaaatacagcgtgatcgtaaccgtccacactggcgatcagcaccaggtggggaacgagtccaccgaacatggcacgactgccacgatcacgccccaggcgcccaccacagagatacagctcacagactacggggccctaactctggactgcagcccccgcaccggactcgacttcaacgagatggttctgctgaccatgaaggagaaatcctggctggtgcataagcagtggtttctggacctgccactcccctggacctccggggccagcacgtcccaggagacctggaacagacaggacttactggtgaccttcaagaccgcccacgcaaagaagcaggaggtggtcgttctcggcagccaggaaggcgcgatgcacacggccctcaccggggccaccgagatccagacatccggtacaaccaccatattcgctgggcacctgaagtgccgcctcaagatggacaagctcaccctgaagggcatgtcgtacgtcatgtgcacggggagtttcaagctggagaaagaggtggccgaaacccagcacggcaccgtgctggtccaaatcaagtacgaaggcactgacgcgccctgcaaaatcccgttcagcacgcaggatgagaagggggtgacccagaacggccggctgatcacggcaaatccaatcgtgacggacaaggaaaagcccgtcaacatcgaagccgagccgcccttcggggagtcctacattgtgataggggccggcgagaaagcgctgaagctaagctggtttaagaaggggtcctcgatcggcaagatgttcgaggccactgctcgcggagcccggcgcatggccatcctaggcgacacagcgtgggacttcgggtcaataggcggggtgttcaccagcgtagggaagctggtgcaccagatcttcggcacagcctatggggtcctgttctccggcgtaagctggacgatgaagatcggcatcggtgtgctgctgacctggttaggcctgaactcccgcagcacctccttgagcatgacctgcatcgccgtgggccttgtcaccctgtacctgggcgtgatggtgcaggccgactctgggtgtgtcatcaactggaagggccgggagctcaagtgcgggtctggcatcttcgtgacgaatgaggtgcacacctggacagagcagtacaaattccaggccgacagcccgaagcgcctttccgcggcgataggtaaggcctgggaggagggggtctgtggaatccggagcgccaccaggctggagaacatcatgtggaagcagatatccaacgaattaaaccacatactcctggagaatgacatgaagtttacggtagttgtcggggatgtcgccggcatcctcgcccaggggaagaagatgattcggccccagccaatggagtacaagtatagttggaagagctggggcaaggccaagattatcggcgccgatgtgcagaataccacctttatcatcgacggccccaacaccccggagtgccccgacgaccagcgcgcttggaatatctgggaggtcgaggactacggcttcgggatcttcacgaccaacatttggctgaagctgcgcgactcatacacacaggtttgcgatcaccgcctcatgtccgcggcaatcaaggactccaaggccgtgcacgccgacatgggctactggatcgagtccgagaaaaatgagacatggaagttagcgcgggctagcttcattgaggtcaagacgtgtatctggcccaaatcccacaccctgtggtccaacggcgtgctcgagtccgagatgatcatccccaagatctacggaggaccgatcagccagcacaactaccgccccggatactttacgcaaaccgctggcccctggcacctggggaagctggagcttgacttcgacttgtgtgagggcacgaccgtggtcgtggacgagcactgcggcaaccgtggtccctccctgagaaccaccacggtgaccggcaagattatccacgaatggtgctgccggagttgtactctgccgcccctccgcttccgaggggaagacggctgttggtacgggatggagatccgccccgtcaaggagaaagaggagaatctggtgaagtccatggtgtctgccggctcgggcgaggtcgattcattctcactcgggctgctgtgcatctccataatgattgaggaagtcatgcggagccgctggtcccggaagatgctcatgacgggaactcttgcggtgttcttcctgttgatcatggggcagctgacctggaacgacctgatccggctctgcatcatggtcggcgccaacgccagcgacagaatggggatgggaaccacctacctggccctgatggccacgttcaagatgaggccgatgtttgccgtcggcttactgttccgccggctgacctccagggaggtactcctgctgaccatcgggctcagcttggtggcctccgtcgaactacccaacagcctcgaggagctgggggacgggctggcgatgggcataatgatcctcaaactgttaaccgacttccaatcccatcagctttgggcgacgctcttgagcctcaccttcatcaagaccactttcagcctgcactacgcctggaaaacgatggccatggtcctgagcatcgtatcactcttccccctgtgtctgagcacgacctcccaaaagaccacgtggctccccgtgctgctgggttcactcggatgcaagccgctgaccatgttcctgatcgcggagaacaagatatggggccggcgcagttggcccctgaacgaggggatcatggccgtcggcatcgtcagcatactgcttagctccctcctgaaaaacgacgtgccgctggccgggccgctcatcgccggcggcatgttaatcgcctgctacgtcatcagcgggagctccgcagacctgtcgttagagaaggccgccgaggtgagctgggaggaggaagccgagcactccggcgccagccataacatcctggtggaggtccaggacgatgggaccatgaagatcaaggacgaggagcgggacgacaccctgaccatattgctaaaagcaacgctgctcgcggtctctggcgtgtaccctcttagcatccccgccaccctgttcgtctggtacttctggcagaaaaagaagcaacgctccggggtgctctgggatacccccagcccgccggaggtggagcgtgctgtactggacgacggcatctaccgtatcatgcagcggggcctcttggggcgctcccaggttggcgtgggggtcttccaggagaacgtttttcacacgatgtggcacgtgacaaggggggccgttctcatgtaccaagggaaacgcctggagccctcgtgggcgtccgtgaagaaggacctgatctcgtacggcggcggctggcggctccagggttcctggaacaccggggaggaagtgcaggtcatcgcggtggagcccggaaagaaccccaagaacgtccagaccgcccccgggacattcaagacgcccgagggggaggtcggcgccatagccctggacttcaaaccaggtaccagcgggtcccccattgtaaaccgagaggggaaaatcgtgggcctctacggcaatggggtcgtgaccacaagcggcacgtacgtgtccgcgattgcccaggccaaagcatcccaggaagggccgctcccagaaatagaggacgaggtcttccggaagcgcaatctgaccataatggacctgcaccccgggagcggaaagaccagacgctacctccctgcgatcgtgcgggaggcaatcaagcggaagctgcgcaccctgatcctcgctcccacgcgggtggtcgcctccgagatggccgaagcgctgaagggcatgcccatccgctaccagaccaccgctgtcaagagcgagcacaccggaaaggagatcgtggacctgatgtgtcacgccacgttcaccatgcggctcctgtccccagtacgcgtgccaaactacaacatgatcatcatggacgaggcgcacttcaccgacccgagctccatcgccgcgcgagggtacatcagcacgcgcgtcggcatgggggaggccgccgctattttcatgacggccacgccgcctggctccgtcgaggccttcccgcaaagcaatgccgtgatccaggacgaggagcgggacatccccgagcggtcctggaacagcgggtacgagtggatcacagacttccccggcaagaccgtgtggttcgtacccagtataaagagcggcaacgacatcgccaactgtctgcggaagaacgggaagagggtgatccagctctcccgcaagacgttcgacaccgagtaccagaagaccaaaaacaatgactgggactacgtggtcacgacggacatcagcgagatgggcgcgaacttccgcgccgaccgagtgatcgacccccgccggtgcctgaagcccgtgatccttaaggacgggcccgagcgcgttatcctcgccggccccatgcccgtgacggtagcctccgccgcccagcggcgtgggcggatcggccgcaaccacaacaaggaaggtgaccagtatatctacatggggcagccgctgaacaatgatgaggaccacgcgcactggaccgaggccaagatgctgctcgacaacatcaatacacccgagggtatcatccccgctctgttcgagccggagcgagagaagtccgccgccatcgacggggagtaccggctgcgcggggaggctcgtaagacgttcgttgagctcatgcgccgcggggacctgcccgtttggttatcctacaaggtcgctagcgaaggcttccagtatagcgaccgccggtggtgcttcgacggcgagcgcaacaaccaggttctcgaggagaacatggatgttgagatctggaccaaggaaggcgagcgaaaaaaactgagaccccggtggctggacgcccgcacctacagcgaccctctggccctgcgggagttcaaggaattcgcggcgggcaggcggagcgtttccggggacctgatcagcgagataggcaagctcccacagcacctcactcagcgcgcccagaacgccctggacaacctcgtgatgctgcacaactccgagcagggcgggcgggcctaccgacatgcgatggaggagctacctgacacgattgaaaccctcatgctgctcgccctcatcgccgtgctgacgggcggggtcaccctgttcttcctcagcggccgggggctgggcaaaacctccatcggcctgctctgcgtgatggccagctccgtgctcctatggatggccagcgtcgagccacactggatcgcggcatctatcatcttggaattcttcctgatggtgctgctcatccccgagccggaccgccagcggacgccccaggacaaccagctggcctacgtggtaatcggactcctcttcatgatcctcacggtggccgccaacgaaatggggctgctcgagactactaaaaaggacctggggatcggccatgtggcggtcgagaaccaccaccacgccgccatgctcgacgttgacctccaccccgccagcgcttggacgctgtacgcggtggccaccacaatcatcaccccgatgatgcgccacacaatcgagaataccacagcgaatatttccctgaccgccatcgccaaccaagcggccatcctcatggggctggacaagggctggcccatcagcaagatggacatcggcgttcccctgcttgcgctggggtgctattcccaggtgaatccgctcacgttaaccgccgcggtgttgatgctggtcgcacactatgccatcatcggcccggggctccaggccaaggccacccgcgaggcgcagaagcggacggccgcgggcataatgaagaaccccacggtggatggcatcgtggccatagatttagacccagtagtctacgatgccaagttcgagaagcagctgggccaaatcatgctattaatcctgtgcaccagccagatcctcctgatgcgcaccacctgggcgctgtgcgagtccatcacgctcgccacaggccccctgaccaccctatgggaggggagccctggaaagttctggaacaccaccatcgccgtgtccatggcgaacatttttcgggggagctacctcgccggggccggcctggcattcagcctgatgaagtccctcgggggcgggagacggggcacaggggcccagggcgagactctgggcgagaagtggaagcgccagctgaaccagctctctaagtccgaattcaacacgtacaagagaagcgggataatggaggtcgaccgctcggaggccaaggagggcttgaagcgcggggagactaccaagcacgcggtgagccgtggcaccgccaagttacggtggttcgtcgagcgcaacctcgtcaagcccgagggcaaggtgattgacctggggtgcggccgtggcgggtggtcctactactgtgccgggctgaagaaggtgacagaggtcaaggggtacacgaagggcgggcccggccacgaagagcccatcccgatggcaacctacggttggaacctggtgaagctacacagcggcaaggacgtgttcttcatcccgccggagaagtgcgacactctactgtgcgacatcggggaatccagccccaacccgacgatcgaggagggccggaccctccgagtactgaagatggtggaaccttggctgcgggggaaccagttctgcattaaaatcctcaacccctacatgccctccgtggtcgaaaccctggagcagatgcagaggaagcacggcggcatgctggtgcgcaaccctctcagccggaactccacccacgagatgtactgggtgtcttgcgggactggaaacatcgtcagcgcagtgaacatgacaagccgcatgctactcaaccgcttcactatggcgcaccggaagcccacctatgagcgcgacgtggacctcggggcgggtacccggcacgttgccgtggagcccgaggtggccaacttagacatcatcggccagaggatcgagaatatcaagcacgagcacaagtccacttggcattatgacgaggataatccttacaagacttgggcctatcatgggagctacgaggtcaagccgtccggcagcgcgagctccatggtgaacggggttgttaagctgctcactaagccctgggacgtaatccccatggtcacccagattgccatgactgacaccacccccttcggccagcaacgggtgttcaaggagaaagtggacacccgcacccctaaggccaagcgtgggaccgcccagatcatggaggtaaccgccaagtggctgtggggcttcctgagccggaacaagaagccccggatttgcactcgggaggaattcacacggaaggtgcgctccaacgcggccatcggcgccgtgttcgtcgacgagaaccagtggaacagtgccaaagaggcggtcgaagatgagcggttctgggacctcgtgcaccgggaacgggaactccacaagcaggggaaatgcgcgacgtgcgtatacaatatgatgggcaagagagagaagaagctgggggagttcggcaaggccaagggctccagggccatctggtacatgtggttaggcgcccgcttcctggagttcgaggcgctgggcttcatgaacgaggaccattggttcagccgggaaaactccctcagcggggtggagggggaagggctgcacaagctgggctacatcctccgcgacatctccaagatacctgggggcaacatgtacgccgatgacaccgcaggctgggacacccggatcacggaggacgacctgcagaacgaggcacgcatcaccgacatcatggagccggagcacgctctgctggcccgtagcatcttcaagcttacctaccagaacaaggtggtccgggtgcagagacccgccaagaacgggaccgtcatggacgtcatctcccggcgcgaccagcggggctccgggcaggtgggcacgtacggcctgaacacctttacaaacatggaggcgcagctcatccgccagatggagtccgaagggatcttcagcccctccgaactggagacccccaatctggccgaacgggtgcttgactggttagagaagtacggtgtcgagcgcctgaagcggatggcaatcagcggggatgactgcgtggtcaagccgatcgacgatcgctttgcgacggccctcaccgccttaaatgacatgggcaaggtgcggaaggacataccccaatgggagccctccaaggggtggaatgactggcaacaggtgcccttctgcagccaccatttccaccagctaatcatgaaggatgggcgcgagatcgtcgtaccatgtcggaaccaggacgagctcgtgggccgcgctcgggtgagccagggggccggctggtccttaagggagaccgcgtgcctgggcaagagctacgctcagatgtggcagctcatgtacttccaccggagagacctgaggctggccgccaatgcgatctgttccgccgtccccgtggactggatacccacaagccgcacaacctggtcaatccacgctcaccatcagtggatgacgaccgaggacatgctcagcgtgtggaaccgcgtctggatcgaggagaatccctggatggaggacaaaacgcacatatcctcgtggggcgacgtgccttacctggggaagagagaggaccagtggtgcggctccttgatcggcctcaccgcccgcgccacttgggcgactaacatccaggtggccatcaaccaagtacggcgcctgatcgggaacgaaaactacctggactacatgaccagcatgaaacggtttaagaacgagtccgaccccgaaggcgccctctggtga

SEQ ID NO: 24525 - RNA, 9879 nt, synthetic construct
  misc_feature 1..9879: note = derived and/or modified CDS sequence (opt11) from DENV-1__EU482709__SS-prME
  source 1..9879: mol_type = other RNA
agcgtgaccatgctgctgatgctcgtccccaccgcattggctttccacctcaccacccgaggtggggagccccacatgatcgtgagtaagcaagagcggggcaagagcctgctgttcaagacgagtgccggggtgaatatgtgcaccctgatcgccatggacttaggcgagctctgcgaggacactatgacctacaagtgcccccggattaccgagaccgagcccgatgacgtggactgctggtgcaacgccacggacacctgggtgacttatgggacctgcagccaaaccggcgagcaccggcgggacaagcggtccgtggccctcgcgccccacgtcggtctggggctggagacccgcaccgagacttggatgagctccgaaggagcctggaagcagatccaacgggtcgagacgtgggccctccggcaccccgggtttaccgtgatcgccctgttcctggcccacgcgatcggcacaagcattacgcagaagggtatcattttcatcttactgatgctggtcacgccctccatggccatgcggtgtgtgggcatcggaagccgagacttcgtggaggggctctccggagccacctgggtggacgtagtgctggaacacggttcatgcgtaaccacaatggccaaggataagcccacgctggacattgagctactgaagacggaggtgactaaccccgccgtgctgcgcaaactctgcatcgaggcgaaaatctccaacacaacgaccgacagccgctgtcccacccagggggaagccaccttagtcgaggagcaagacgccaacttcgtgtgccggcgcacgttcgtggaccggggctggggcaacggctgcggactgttcggcaaggggagtctaatcacgtgcgcgaagttcaaatgcgtgacgaaacttgagggcaagattgtccagtacgagaacctgaagtactctgtgatcgtcaccgtgcacacgggggaccagcaccaggtcgggaacgagtccacagagcacgggaccaccgctaccataacgccccaggcccccaccaccgagatccaactcaccgactacggggcactgaccctggactgcagcccccgcaccggcctcgactttaacgagatggtgctgctgaccatgaaggaaaagtcctggctcgtgcacaagcagtggtttctggatctgcccctcccctggaccagcggggcgtcaacaagtcaggagacctggaaccggcaagacctattagtgacgttcaagaccgcccatgccaaaaagcaagaagtggttgtcttgggatctcaggaaggcgcgatgcacacggctctgaccggggcaaccgagatccagacctccggtacaaccacaatcttcgccgggcacctgaagtgccgcctcaaaatggataagttaactctgaaaggcatgagctacgtaatgtgcactgggtccttcaaactcgagaaggaggtggcagagacccagcacggcactgttctggtgcagataaagtacgagggcaccgacgcgccctgcaagatacccttcagcacccaggacgagaagggggtcacccagaacggccggctgatcaccgccaacccgatcgtcaccgataaggagaagcccgttaacatagaggccgaaccgcccttcggagagtcctacatcgtgatcggcgccggcgagaaggcgttaaagctcagctggttcaaaaagggttccagcatcggaaagatgtttgaggcgacggcccgcggggcccggcgcatggccatattgggcgacaccgcgtgggacttcgggagtatcggcggcgtcttcaccagcgtggggaagctggtgcaccagatcttcggcaccgcctacggggtattgttctccggcgtgagctggacaatgaagatcgggatcggcgtgctgctgacatggctcggcctgaactcccgcagcaccagcctgagcatgacctgcatcgccgtcggtctggtgacgctgtacctgggcgtcatggtacaagcagactccggatgtgtgatcaactggaagggccgggagctcaaatgcgggagcggaatcttcgtgaccaacgaggtccacacctggaccgagcagtataagttccaggctgacagcccgaagcggctgtccgcggccatcggcaaggcttgggaggagggggtctgtggaatccggagcgctacacgcctggaaaacatcatgtggaagcagatctccaacgagctcaaccacatcctgctggagaacgatatgaagttcactgtggtcgtgggggacgtggctggtatactcgcgcaggggaagaagatgatccggcctcaacccatggagtacaagtacagctggaagtcctggggcaaagccaagatcatcggcgccgacgtccaaaacacgaccttcataatcgatgggccgaacaccccggagtgccctgacgaccagcgggcctggaacatctgggaggtggaggactacgggttcggaatcttcacgacaaacatctggctgaagctgagggatagctacacccaggtgtgcgatcacagactcatgtccgccgccatcaaggacagcaaggccgtccacgccgacatggggtattggatcgagtccgaaaagaacgaaacctggaagctggcccgggcgagcttcatagaggtgaagacgtgcatttggcccaagtcccataccctttggagcaacggcgtgctcgagtccgaaatgatcatccccaagatctacgggggccctatcagccagcataactacagacccgggtactttacccagactgccggcccctggcatctgggtaaactggaactcgacttcgacctgtgcgagggcacgaccgttgtcgtcgatgagcactgcggcaacagagggccgtccctgagaaccaccacggtaaccggcaagattatacacgaatggtgttgcagaagctgcacccttccacccctccgtttccggggcgaagacggatgttggtacgggatggagatcagacccgtgaaggagaaggaggagaacctggtcaagtccatggtaagcgccggcagcggcgaggtggactctttcagtctcgggctactgtgcatctccatcatgatcgaagaggtgatgcggagccgctggtcccggaaaatgcttatgaccggtacactagcggtcttctttctgctcatcatggggcagctgacttggaacgatctgatccgcctctgcatcatggtgggcgccaacgcaagcgaccggatggggatgggcaccacttacctggctctgatggcgactttcaagatgcggccgatgttcgccgtcggcctcctgttccgccgtttaacctcccgcgaagtcctcctacttaccatcgggctcagcttagtggcctccgtcgagctgcccaactccctcgaggaactgggcgacggtctggctatggggataatgatcctgaagctgttaaccgacttccagtcccatcagctctgggccacgctgctgtcattaaccttcatcaagacgaccttttccttgcactacgcctggaagacgatggccatggtgctgagcatcgtgtccctcttccccctgtgcctgtccaccacttcccagaagactacgtggctccccgtgctgttaggcagcctcgggtgcaagccacttaccatgttcttgatcgcggagaacaagatctggggccgacgctcgtggccgctcaacgagggtatcatggccgtgggcatcgtgagcatcctgctcagcagcctcctaaagaacgacgtccctctagctgggcccctcattgccggagggatgctgatagcctgttacgtgatcagcggatccagtgcggacctgtccctcgaaaaggccgccgaggtgagctgggaggaagaggcagagcactccggcgccagccacaacatcctggttgaggtccaagatgacgggaccatgaagatcaaggacgaggagcgggacgacactctgaccattttactgaaggcgacgctgctcgccgtgtccggcgtttacccgttgagcatccccgccacgctgttcgtctggtatttctggcagaagaagaagcagaggtccggggtgctctgggacacccccagcccgccagaagtcgagcgggccgtgctggacgacgggatctaccgtatcatgcagcgtgggctgctggggcgctcccaagtgggtgtcggtgtattccaggagaacgtgttccacaccatgtggcacgtcacacggggcgccgtgctcatgtaccaggggaaacgcctagagcccagctgggcgtccgtgaagaaggacctgatatcgtacggcggcgggtggcggctccagggctcctggaacactggggaggaagtacaggtgatcgccgtagagcccggcaagaaccccaagaacgtccagaccgcccccgggaccttcaagactcccgagggcgaggtgggcgccattgctctggacttcaagcccgggaccagcggctccccaattgtgaaccgcgaggggaaaatcgtaggcctgtacggtaacggcgtggtgaccaccagcggcacttacgtcagcgcgatcgcgcaagccaaggcctcccaggaggggccgctgcccgaaattgaggatgaggtgtttcggaagcgcaacctgaccatcatggacctgcaccccggcagcgggaagacccggcgctacctcccagcgatagtgcgagaggccataaagcggaaactgcgcaccctgatacttgcccccacgcgggtcgtggcctccgagatggccgaggcgctgaagggcatgcccatccgataccagaccaccgccgtcaagagcgagcacaccggcaaggagatagtcgacctgatgtgccacgccacgttcactatgcggttgctctcccccgtgcgcgtgccgaactacaacatgatcatcatggacgaggcccatttcaccgaccccagttccattgctgcgcgcgggtacatctccacccgtgtaggcatgggggaggccgccgccatatttatgacggcaacgccgcccggctccgtggaggcgttcccgcagagcaacgcggtgattcaggacgaggagcgggacatccccgagcgttcctggaatagcggctacgagtggatcaccgattttcccggcaagaccgtctggttcgtcccctcaatcaagtcgggcaacgacatcgccaactgcctgcggaagaacgggaagagagttatccaactctcccggaagacgttcgacactgagtaccagaagaccaagaacaatgattgggactacgtcgtcaccacggacatctccgaaatgggagctaacttccgcgcggaccgggtgatcgacccgcgtcggtgcttgaaacccgtcatcctgaaagacgggccggagcgcgtaatcctcgctgggcccatgccggtcaccgttgcctccgcggcccagcggcgtgggcggatcggcaggaatcacaacaaggaaggcgaccagtacatctatatgggacagcctctgaacaacgacgaggaccacgcgcactggaccgaagccaagatgctgctcgacaacatcaacacccccgagggcatcatccccgcccttttcgagccggagcgcgagaagagtgccgctatagacggagagtaccggctgcgcggggaggcgcggaagacgttcgtggaactcatgcgcagaggggatctgcccgtctggctgtcctacaaagtggcctctgaaggcttccagtactccgaccgccggtggtgcttcgatggcgagcgaaataaccaggtgctcgaagagaatatggacgtcgagatttggacaaaggagggggagcggaagaagctgcgcccccggtggctggacgcccgcacctactccgacccactcgccctgcgggagttcaaggagttcgcagcgggccgccggagcgtgtccggggatctgatcttggagatcgggaagctgccgcagcacctgacccaacgcgcccagaacgcgttggacaatctggtgatgcttcacaactctgaacaaggcgggcgggcctaccgccacgcgatggaggagctcccagacacgatcgagaccctgatgctgcttgccttaatcgctgtcctgactggcggggtgaccctctttttcctctccggccgggggctgggcaagactagcatcggtctcctgtgcgtgatggcctccagcgtcttgctctggatggcatccgtggagccccactggatcgcggccagcataatcctggagttcttcctgatggtgctactcatccccgagccggatcgccagcgaacgccccaggacaaccagctggcctacgtcgtgatcgggctcctgttcatgatcttgaccgtggccgccaatgagatgggcttgctggagaccaccaagaaggacctgggtatcgggcacgtcgctgtggagaaccaccatcacgccgccatgctcgacgtggacctgcaccccgcgtccgcctggactctgtatgccgtcgccacaaccattatcacgccaatgatgagacacacgatcgagaacaccacagctaacatcagcctcaccgccatcgccaaccaagcggccatccttatggggctcgacaagggttggcccatatccaagatggacatcggcgtgcctctcctggccctggggtgctacagccaggtgaaccccctcacgctgaccgccgccgtcctgatgctcgtagcccactacgcgatcatcggcccggggcttcaggccaaggccactcgcgaggcgcagaagcggaccgccgcaggcatcatgaaaaacccaacggttgatgggatcgtcgccatcgacctggaccccgtggtgtatgacgccaagtttgagaaacagctcggccagatcatgctgctgatcctctgtacctcccaaatcctgctgatgcgcaccacctgggctctctgcgagagcatcacgctggctaccggccccctgaccaccctctgggaggggtccccgggcaagttttggaacacgactatagccgtgagcatggcgaatatcttccgggggtcctacctggccggcgctggcctggcctttagcctcatgaagtccctcgggggaggtcgcagagggaccggggcccagggcgagacactgggcgagaagtggaagcgccaactcaaccagctgtccaagagcgagttcaatacgtacaagcggtccgggattatggaagtggaccgcagcgaagcgaaggagggcctgaagagaggggaaacaaccaagcacgcggtgtcccgcggcacagccaagttgcggtggttcgtcgagcgtaacctggtcaagccagaggggaaggtgatcgacctgggctgcggccgcgggggctggagctactactgcgccgggctgaagaaggtcacggaggtgaaaggctacactaagggcggtcccggtcacgaggagcccatccctatggccacctacgggtggaacctcgttaagttacactccggcaaggacgtctttttcataccacccgagaaatgcgacaccctgctctgcgacattggcgagagctcccccaacccgacaatcgaggagggcagaaccctgcgggtgctaaagatggtggagccttggctccgcgggaaccagttctgcatcaagatcctgaatccctacatgccctcggtggtggagaccctggagcagatgcagcggaagcacggcgggatgctcgtgagaaacccgttatcccgcaacagcacacacgagatgtactgggtctcctgcgggacaggcaacatcgtatccgccgtcaacatgacgtcccgcatgctgctcaaccgcttcaccatggcgcataggaagcccacctacgagcgcgacgtagacttaggggctggcacccgtcacgtggccgtggagcccgaggtcgcgaacctggacattatcggtcagcgcatcgagaacatcaagcacgagcataagagcacctggcattacgacgaggacaacccctacaagacctgggcctaccacgggtcctacgaagtgaagccatctggctctgcgtcgagcatggtcaacggggtggtgaaactcctgaccaagccgtgggacgttatccccatggtgacccagatcgcgatgacggacacgacgcccttcggccaacagcgggtgttcaaagaaaaggtcgatacccgcacgccgaaggccaagcggggtacggcacaaatcatggaggttacagcgaagtggctgtggggatttctttcccgcaacaagaagccgcggatctgcacccgcgaggaatttacgcggaaggtgagaagcaacgcggccatcggcgcggtcttcgtggacgaaaaccagtggaactccgccaaggaggcggtggaggacgagcggttctgggacctggtccaccgcgagcgggagctacacaagcaggggaagtgcgcgacctgcgtgtataacatgatgggaaagcgagagaagaagctcggtgagtttggcaaggccaaaggcagccgggccatctggtacatgtggctgggggcccgctttctggagttcgaggcgctcgggttcatgaacgaggaccactggttttccagagagaactccctgtccggcgtcgagggcgagggtctgcacaagctcggctatatcctgcgtgacatcagcaaaatccccggagggaacatgtacgccgacgataccgccggttgggacacccggatcacggaggacgacttgcagaacgaggcccgcatcaccgacatcatggagccggagcacgcgctcctggcaaagtccatctttaaacttacctatcagaacaaagtcgtccgcgtgcagcggcccgccaaaaacgggaccgtcatggacgtgatcagccgccgggaccagcgcggctccggccaagtggggacgtacggccttaacaccttcaccaacatggaggcccagctgatccggcagatggagagcgaggggatcttttccccgagcgagctggagacccccaacctcgctgagcgcgtcctggactggctcgagaagtacggcgtggagcgtctcaagcgcatggccatctccggggacgactgcgtggtcaagcctattgacgaccggttcgcgacggccctgaccgcactaaacgacatgggcaaggtgagaaaggatatcccccagtgggagcctagcaaggggtggaatgactggcagcaagtgcccttttgctcacaccactttcaccagctcatcatgaaggacggccgggagatcgtcgtgccttgcagaaaccaggatgagctggtgggacgggcccgcgtctctcagggggccggctggtctctgcgggagaccgcgtgccttgggaagtcttatgcccagatgtggcaactgatgtacttccaccgccgggacctgcgcctcgccgcaaacgcgatctgctcagccgtgcccgtggactggatccccacctcccggacgacctggagcatccacgcccaccaccaatggatgaccaccgaggacatgctgtccgtctggaacagggtgtggattgaggaaaatccttggatggaggacaaaacgcacatcagctcctggggcgacgtcccttacctgggtaaacgagaggaccagtggtgcggaagcctcatcggcctcaccgcccgggcgacctgggcgaccaatatccaggtcgccatcaaccaggtgcgccggctgattggcaacgagaactatctcgactacatgaccagtatgaagcgcttcaaaaacgagtccgatcccgagggagcgctgtggtag

SEQ ID NO: 24526 - RNA, 9879 nt, synthetic construct
  misc_feature 1..9879: note = derived and/or modified CDS sequence (opt11) from DENV-1__EU482710__SS-prME
  source 1..9879: mol_type = other RNA
tccgtgaccatgctgctcatgctgatgcccaccgccctcgccttccacctcactacccggggcggggagccccatatgatcgtcaccaagcaggaacggggtaaaagcctgctgtttaaaacttcagccggggtcaacatgtgcactctaatcgccatggaccttggcgagctgtgtgaggacaccatgacctacaagtgccctcggatcaccgaggccgaacccgatgacgttgactgctggtgcaacgccaccgacacctgggtgacctacgggacctgctcgcagacgggcgagcatcggcgcgacaagcggtccgtcgccctcgcaccccacgtaggcctggggctggagacccgcaccgagacctggatgagtagcgagggcgcctggaagcagatccagcgggtcgaaacgtgggccctccgacaccccgggttcacagtgatcgcactgttcctggcacatgccataggcacatccatcacccagaagggcatcatcttcatactcttgatgctggtgacgcccagcatggccatgcggtgcgtcggcatcggctcccgcgacttcgtcgaaggactcagcggcgccacctgggtggacgtcgtcctggagcacgggtcctgcgtgactaccatggccaaagacaagcccacgctcgacatcgagctcttgaagaccgaggttaccaaccccgcggtgctgcggaagctctgcatcgaggcgaagatctcgaataccacaaccgactcccgctgcccgacccagggcgaggccaccctgatggaggagcaggacgcaaatttcgtttgcaggcgcacgttcgtcgaccggggctgggggaacggctgcgggctcttcggcaagggaagcttaatcacgtgcgccaagttcaagtgcgtgaccaagctggaaggcaagatcgtacagtacgagaacctgaagtactcggtaatagtgaccgtgcacacgggagatcagcaccaggtagggaacgagagcaccgagcacggcaccaccgcgaccatcacgccccaggcccccacgtccgagatccagctgaccgactacggggccctgacattagattgcagtccgcgcacgggcctcgacttcaacgagatggtgctgttaaccatgaaggagaagtcctggctagtccacaagcagtggttcctggacctgccgctcccgtggactagcggggccagcacctcgcaggagacgtggaaccggcaagacctgctagtgacctttaagacggcccacgcgaagaaacaggaggttgtcgtgcttggcagtcaggagggcgccatgcacaccgctctgacaggtgccaccgagatccagacctccggcaccacgaccatcttcgccgggcatctgaagtgccgcctcaagatggataagctgaccctgaagggcatgagctacgtgatgtgcaccgggtccttcaagctagagaaggaggtcgcggagacacagcacggcaccgtgctggtgcagattaagtacgagggaaccgacgccccctgcaagatccccttcagcacccaggacgagaagggggtcacgcaaaacggccggctgatcaccgccaacccgatcgtaaccgacaaggagaaacccgttaacatcgaggctgagccgcccttcggggagtcctacatcgtgattggcgcgggcgaaaaggcccttaaactcagctggtttaagaaggggtccagcattggcaagatgttcgaagcgaccgcgcgtggtgcccggcgcatggcgatcctgggtgacactgcttgggacttcgggagtgtgggcggcgtgttcacaagcgtcgggaagctggtgcaccagatctttggtaccgcctatggggtgctgttctccggcgtcagctggaccatgaagatcgggatcggcgttctgctgacgtggcttggccttaactcccgcagcacctccctcagcatgacctgcatcgccgtgggactcgtcaccctatacctcggcgtgatggtacaggcggactccgggtgtgttataaactggaagggacgggagctcaagtgcgggtcgggcatatttgtgaccaatgaggtgcacacctggaccgagcagtataagttccaggcggacagcccgaagcgcctgtccgcagccataggcaaggcctgggaggagggggtctgtggcatccggagcgccacccgcctggagaacataatgtggaagcagatctcaaacgaactcaaccacatcctgctggagaacgacatgaagtttaccgtggtggtgggggacgtggtaggcatcctggcgcaggggaagaagatgatccggccccagccgatggagcacaagcacagctggaagagctgggggaaagccaagatcatcggcgccgacgtccagaatacgaccttcatcatcgacggacccaacaccccggagtgccccgacgaccaacgcgcctggaacatctgggaggtggaggactacggttttgggatcttcaccacgaacatatggctgaagctgcgggacagctacacccaggtgtgcgaccaccgccttatgtcggcggcaatcaaggactccaaggccgtgcacgccgatatgggctactggatcgagtccgaaaagaacgagacctggaagctagcccgggcgagctttattgaggtgaagacgtgtatttggcccaagtcgcacacgctctggagcaacggggtgcttgagtccgagatgattatccccaagatttacgggggcccgatcagccagcacaaccaccgccctggatacttcacacagaccgccggcccctggcacttaggcaagctcgagttagacttcgacctgtgcgaggggaccacggtcgtggtggacgagcactgtggaaacagggggccgtccttgcgcaccaccaccgtcacgggcaagatcatccacgagtggtgctgccggtcatgcaccctgccgcccctccgcttcaagggggaggacggctgctggtacgggatggaaatccgtcccgtgaaggagaaggaggagaacctggtgaagtccatggtcagcgccggctcgggcgaagtggactccttcagcctcgggttgctgtgcatctccattatgatagaggaggtaatgcgcagccggtggagccggaaaatgctcatgactggcaccctggccgtcttcctcctgctgataatggggcagctaacgtggaacgacctcatccggctgtgcatcatggtgggcgctaacgcgtccgaccgcatgggcatgggcaccacatacctggccctcatggccaccttcaagatgcgcccgatgttcgccgtaggcctgctgtttcggcgcctcacatcccgcgaggtccttctgcttacgatcggactttcactggtggcctccgttgagctccccaacagcctggaagagctgggcgacgggctcgcgatgggcattatgatcctgaagttgctcactgacttccagtcccaccaactgtgggccaccctgctctcactaacattcatcaaaacaaccctgtccctccattacgcgtggaagaccatggccatggtgttaagcatcgtgtccctgttccctctctgcctgagcacgacctcccagaagaccacatggctgccagttttacttggcagcctgggctgtaaaccactcactatgttccttatcaccgagaataagatctggggacgcaagtcttggcccctgaacgaggggatcatggcggtgggcgtggtcagcatcctcctgagctccttactcaagaacgacgtgcccttggccgggcccctaattgccggcggcatgctcatcgcctgctatgtgatcagcgggtccagcgcagacctctccctggaaaaagcggctgaggtcagctgggaagaggaggccgagcactccggcgccagccacaatatccttgtggaagttcaagacgatgggaccatgaagataaaagacgaagagagggacgatacactgacaatcctgctcaaggccacgctcctggcagtcagtggcgtgtacccgctctctatccccgccaccctctttgtgtggtacttctggcagaagaagaaacagcgctccggggtgctttgggacaccccatcaccgccagaagtcgagcgggcagtgttggacgacggcatctacaggatcatgcagaggggcctcctggggcgctcacaggtcggcgtgggagtcttccaggagaatgtctttcacacaatgtggcacgttacgcggggggccgtgctgatgtaccaagggaaacgcctcgaaccaagctgggcgtccgtcaagaaggatctgatctcctacggcggcgggtggcggctccagggctcctggaataccggggaggaggtccaggtgatcgcggtcgagcccggcaaaaaccccaagaacgtgcagaccgcccctgggaccttcaagacgcccgaaggcgaggtgggggccatcgcgctcgacttcaagcccggcaccagcggcagcccgatagtcaaccgggaagggaagatcgtaggcctgtacggcaacggggtggttaccacctctggcacgtacgtgagcgccatcgcgcaagccaaggcatcccaggagggcccccttcctgagatcgaggacgaggttttccggaagaggaaccttaccatcatggacctgcaccccggcagcgggaaaacccggcgctaccttcccgccatagtccgcgaggctatcaagcgtaagctccggaccctgatcctggcccccacgcgcgtggtggcctccgagatggccgaagccctcaagggcatgcccatccgctaccagacgaccgcggtcaagagcgaacacaccggcaaggagatagtggacctgatgtgccacgctacgttcaccatgcggctgctttcccccgttagggtccctaactataacatgatcatcatggacgaggcccactttaccgacccctcttccatcgccgccagggggtacatctcgaccagagtgggcatgggagaggcggcagctattttcatgacggcaacgccgcccggctccgtggaggccttcccgcagagcaacgccgtcatccaggatgaggagcgagacatccccgagcgctcctggaacagcgggtacgaatggatcacggacttccccggcaagaccgtgtggttcgtgccctccatcaagagcggcaacgacatcgcgaactgcttacggaagaacgggaagcgggtcatccagctgtcccggaagacgttcgacacggagtaccagaagaccaagaacaacgactgggattacgttgtgaccacggatatcagtgagatgggcgccaacttccgcgccgaccgggtcatcgaccctcgccgatgcctaaagcccgtgatcctgaaggacgggcccgagcgcgtcatcctggcggggcccatgccggtcaccgtggcctccgccgcacagcggcgcgggcggatcggccgcaaccacaacaaggaaggtgaccaatacatttacatggggcaacccctcaacaacgacgaggaccatgcccactggaccgaggcgaagatgctgctggacaacatcaatacccctgagggcataatccccgccctcttcgagccggagcgggagaagtccgcagccatcgacggggaataccgcctgcgcggcgaggcccggaagacgttcgtcgagctcatgcgccgtggggacctccccgtgtggctgtcctacaaggtggcgagcgagggcttccagtacagcgaccgccgctggtgcttcgacggcgagcgcaacaaccaggtcttggaagagaacatggacgtggagatttggacaaaggagggggaacggaagaagctccgcccgcggtggctggacgcccgcacctactccgaccccctggcgctccgggagttcaaggagttcgctgcgggccgccggagcgtgagcggcgacctgatctccgaaattgggaaactgccgcagcacctcacccagcgagcccagaacgccctggacaacctggtcatgctccacaactccgagcagggcgggcgggcctatcgccacgccatggaggagcttccagacacaatcgagaccctgatgctcctggcgctgatcgcggtgctcaccggcggggtgacccttttctttctgtctggccgggggctcggcaagacctccatcggtctgctgtgcgtcatggccagctccgtgctcctgtggatggcgagcgtggagccccactggatcgccgcctccatcatcctggaattcttcctcatggtcctcttgatccccgagccggaccgccagcggacgccccaggacaaccagctcgcctacgtggtgatcggcctgctattcatgatcctcacagtagccgccaacgagatgggcctgttggagacaaccaagaaagacctcggcatcggtcacgtcgccgtggagaaccaccaccacgcaacgatgttagacgtcgacctacaccccgcttcagcctggaccctctacgccgtggccaccaccatcatcacgccgatgatgcgccataccatcgagaacaccaccgcgaacatctccctgacagccatcgctaatcaggcggctattctgatgggactcgataagggctggcccatcagcaagatggatatcggcgtgcccctgctagcgctcgggtgctattcccaggtcaatcctctcaccctgactgccgccgtactgatgctcgtggcccactacgcgataatcggcccggggctgcaggccaaggccactcgggaggcccaaaagagaacggcagcgggcatcatgaagaaccccaccgtcgacgggatcatcgcaatagacctcgatcccgtggtgtacgacgccaaattcgagaagcaactgggtcagatcatgctgctcatcttatgcaccagccagattctgttgatgcgcaccacgtgggccctgtgcgagtccatcaccctggccaccggcccactcaccacgctgtgggaggggagcccgggcaagttctggaacactaccatagcggtctccatggccaacatctttcgggggagctacctggctggggccggcctcgccttcagcctgatgaagagtctcgggggcgggcggcgtgggaccggggcgcagggcgagacgctcggcgagaagtggaaacggcagctgaaccagctaagcaagtccgaattcaacatctataagcggagcgggatcatggaggtggacagatccgaggccaaggagggcttgaagcgcggggagaccacccgccacgcggtgagccggggtaccgcgaaactgcgctggttcgtcgagcgcaacctggtgaaacctgaggggaaggtgatagacttaggctgcggaagagggggctggtcctactattgcgcggggctcaagaaggtcacggaggtaaagggttataccaaagggggccccggccacgaggagcccattcccatggccacttacgggtggaatctggtaaagctacacagcggcaaggacgtcttctttacaccgcctgagaagtgcgacacgctcctgtgcgacataggggagtcatctccaaatccgactattgaagagggccgtaccttacgagtactcaagatggtggaaccgtggctccgggggaaccagttctgtataaagatcctgaacccctatatgccctcagttgtggagacactcgagcagatgcagcgcaagcacggcggcatgctggtgcggaaccccctgagtcgcaattccacccacgagatgtactgggttagctgcggtacgggcaacatcgtttcagccgtgaacatgaccagccggatgctcctgaacagattcaccatggcccaccgcaagccaacctacgagagggatgtcgacctgggggcgggcacgcgccacgtcgcggtggagccagaagtcgccaatttggatatcatcgggcagaggatagagaacatcaagcacgagcataagtccacctggcactacgatgaggataatccctataagacctgggcctaccacgggagctacgaggtgaagccatccggcagcgcaagctccatggtcaacggggtggtgaagctactgaccaagccctgggacgtcatccccatggtgacgcagattgcaatgacggacaccacccccttcggccaacagcgagtattcaaggagaaggtggacacgcggaccccgaaggcgaagcgtggaaccgcccagattatggaggtgaccgcccggtggctatggggctttctgagccgcaacaagaagccccggatatgcacgagggaagagttcactcggaaggtccgctccaacgcagccataggcgcggtctttgtggacgagaaccagtggaacagcgccaaggaggccgtggaggacgagcggttttgggatctggtccagaaggagcgcgagctccacaaacaagggaagtgcgcaacctgcgtgtacaacatgatgggcaaacgggagaagaaactgggtgagttcggcaaggcgaaggggtcccgcgccatatggtatatgtggctgggcgcccggttcctcgaatttgaggccctgggcttcatgaatgaagaccactggtttagccgagagaactccctgagcggggtagagggcgaggggcttcacaagctgggctatattctgcgggacatctccaagatccccgggggcaacatgtatgccgacgacactgcaggctgggacactcgcatcaccgaggacgacttacagaacgaggccaagatcaccgacatcatggagcccgagcacgcgctgctagccaccagcattttcaagctcacctaccagaataaggtcgttcgggtgcagcgccccgccaagaacgggaccgtaatggacgtgatctctcgccgagaccagcgcggcagcggtcaggtcggcacctacggcctaaataccttcacgaatatggaggcgcaattaatccgccagatggagagcgagggaattttcctcccctctgagttggagaccccgaatctcgcggagcgcgtactcgactggctggagaagtacggcgtggagaggctcaaacgcatggccatctcaggggacgactgcgtagtcaagccgatcgacgaccggttcgctaccgccctcaccgcgctcaacgacatgggcaaggtgcggaaggacatcccccagtgggaacccagcaaggggtggaacgattggcagcaggtccccttctgctcccaccacttccaccagctgattatgaaagacggccgggagatcgtcgtgccgtgccgcaaccaggacgagctcgtgggccgggcacgcgtctctcagggagccgggtggagccttcgggagacggcttgccttggcaagtcctacgcccagatgtggcagttgatgtattttcaccgccgggacctgcgattagcggccaacgcgatctgtagcgccgtgcccgtggattgggtccccacctcccggacgacctggagcatccatgctcaccaccaatggatgacgaccgaggacatgctctccgtttggaacagagtgtggatcgaggagaacccctggatggaagataaaacgcacgtctcctcctggggcgatgtgccttacctgggaaagcgggaggaccagtggtgcggcagcctgatcggcctcacggcccgcgccacatgggcctccaacatccaggtggccatcaatcaggtcagacggctcatcggtaacgagaactacttggactacatgacgagcatgaagcgcttcaagaacgagggagaccccgagggagcgctctggtga

SEQ ID NO: 24527 - RNA, 9879 nt, synthetic construct
  misc_feature 1..9879: note = derived and/or modified CDS sequence (opt11) from DENV-1__EU482712__SS-prME
  source 1..9879: mol_type = other RNA
agcgtgactatgctgctcatgttgatgcccaccgcgcttgccttccacctcacgactcggggcggcgagcctcacatgatcgtgtccaagcaggaacgggggaagtctctgctgtttaagaccagcgcgggagtgaacatgtgcaccctcatcgcgatggacctgggagagttctgcgaggacacgatgacctataaatgcccgagaattaccgaggctgagccggacgacgtggactgctggtgcaacgcgaccgacacgtgggtgacgtacggtacatgtagccaaaccggcgagcacagacgtgacaaacggtctgtagccctggcacctcacgtgggcctcggactggagacgcgcaccgagacctggatgagctccgagggcgcttggaagcagatccagcgggtagagacctgggccctgcgccacccagggtttacggtgattgccctctttcttgcgcacgccattggcacgagcatcacgcagaagggaatcatctttatattactcatgcttgtcaccccctccatggccatgcgttgcgtcggcataggaagccgcgactttgtggaggggctgtccggcgccacgtgggtggacgtcgtgctcgagcacggcagctgtgtgaccaccatggcgaaggacaagcccaccctggacatcgagttactcaagacggaagtcaccaaccccgcagtgctgcggaagttatgcattgaggccaagatatccaacactaccaccgactctagatgcccgactcaaggggaggccactctcgtcgaggagcaagatgccaacttcgtgtgccggcgcaccttcgtggaccggggctgggggaatggctgcgggctgttcggaaaagggtccctgatcacgtgtgccaagttcaagtgcgttaccaaactcgagggcaagaccgtccagtacgagaacttaaaatacagcgtgatcgtgaccgtccacaccggcgaccagcatcaggtcgggaacgagtctaccgagcacggcacgaccgcaaccatcacaccgcaggcccccagcaccgagatccaactgaccgactatggggccttgaccctggactgcagcccccggaccggcctggacttcaatgagatggttctcctgaccatgaaggagaaatcctggcttgtgcataagcagtggttcctcgatctgccgctgccctggaccagtggggccagcacaagccaggaaacgtggaatcggaaggacctcttggttaccttcaagaccgcacacgcgaagaagcaggaggtcgtggtcctgggctcccaggagggggccatgcacaccgcgttgacgggggccacagagatccagaccagcggcaccactaccatcttcgccgggcacctgaagtgcagactgaaaatggacaaactgaccctgaagggcatgtcctacgtcatgtgcacagggtccttcaaactggagaaggaggtggcggaaacgcagcacggcaccgtgctcgtccagattaagtacgagggcacagacgccccctgcaagatccccttctccacacaggacgaaaagggggtgactcagaatggccggctgatcaccgccaaccccatcgttaccgacaaggagaagcctgtcaatattgaggctgaaccgcctttcggggagagctacatcgtgatcggagcgggcgagaaggccctgaagctgagttggttcaagaaggggagttccattggtaagatgttcgaggcaaccgctcgcggggcccggcgcatggctatccttggcgacacggcttgggacttcggaagcatcggcggcgtgttcacctccgttgggaagctggtgcaccaaatctttggcacggcttatggtgtgttgttctcaggcgtatcttggaccatgaaaatcgggatcggcgtcctgctgacgtggctgggactcaacagccgttccaccagcctgtccatgacctgtatcgccgtgggactggtcacactctacctgggcgtgatggtgcaggccgactcagggtgtgtcataaactggaagggccgcgagctgaaatgcggaagcggaatcttcgtgacaaacgaggtgcacacctggaccgagcagtacaaatttcaggcggactccccgaagcgcctcagcgcagccatcggcaaggcctgggaggaaggggtatgcggcatccggtccgcaacgcgcctggagaacatcatgtggaagcagataagcaacgagctgaaccacatcctcctcgagaacgacatgaagttcaccgtggttgtgggggacgtggcgggcattctggcccaggggaaaaagatgatccggcctcagcccatggagtacaagtactcatggaagtcatggggcaaggccaagatcatcggcgcggacgtgcagaacacgacatttatcatcgacgggcccaacacgccggagtgtcccgacgaccagcgcgcatggaacatatgggaggtcgaggactacggtttcgggatattcaccacgaatatctggctcaagctgcgggactcctacacccaggtctgcgaccaccgcttaatgagcgcagccatcaaggactcgaaggccgtacacgccgacatgggctattggatagaatccgagaaaaatgagacctggaagctcgcgcgggcctcgtttatcgaagtgaaaacctgcatctggcccaagtcgcacacgctctggtccaacggggtgctggagagcgagatgatcatccctaagaactatgggggtccgatctcccagcacaactaccgcccagggtatttcacgcagaccgctgggccgtggcacctcgggaagctggagctcgacttcgacctctgtgaaggcaccacggtcgtcgtggatgagcattgcggcaaccggggtccgtctctccgcaccactaccgtgacgggcaagatcattcacgagtggtgttgcagatcctgtaccctaccgcccctgcgcttcaaaggagaggacggatgctggtacgggatggagatccgacccgtcaaagagaaggaggagaacctggtcaagagcatggtcagcgcaggctccggagaggtggactcattcagcctggggctgctatgcatctccataatgattgaggaggtgatgcgctcccgctggagccgcaagatgctgatgaccggcaccctagccgtgctgtttctgctcatcatggggcagctaacgtggaatgatctgatacgcctctgtatcatggtcggcgccaacgcctccgatcgcatggggatgggcaccacctatttggccctgatggccaccttcaaaatgcgcccgatgttcgcggtgggcctcctgttccggcgcctgacgtctcgagaagtcctcctgctaactatcgggctctctctggtcgcgtcagtggagctgcccaactccctggaagagctgggcgatggcctggccatgggtatcatgatcttgaagctgctgaccgatttccagagccaccagctctgggccaccctgctgtccctcacgttcatcaagaccaccttctcactgcactacgcctggaagaccatggcgatggtcttaagcatagtgagtcttttccccctgtgcctgtccacgaccagccagaagaccacctggctcccggtcctgctgggatccctagggtgtaagccgctgactatgttcctgatcgccgagaacaaaatctggggccggaagagctggcccttgaacgaggggatcatggccgtcggtatcgtgagcatcttactgtcctcactcctgaagaacgacgtgcccctggccgggccactgatcgcgggcggcatgctgatcgcgtgctacgtcatctccgggtcaagtgctgacctgagcctcgagaaggccgccgaagtgtcatgggaggaggaagccgagcatagcggcgcgtcccataacatcctggtggaggtccaggacgacgggactatgaagataaaggacgaggaacgggacgacactttgacaatcctgctaaaggccaccctgctcgctgtgagcggagtgtaccccctatccatcccagccactctgttcgtctggtacttttggcagaaaaagaaacagagaagcggggtgctctgggacacccccagcccgcccgaggtggaacgggcggtcttagacgacggaatctaccgcattatgcagcggggccttctggggcgcagccaagtgggcgtaggcgtcttccaggaaaacgtgttccacaccatgtggcacgtgacccggggagctgtcctcatgtaccaggggaagcgcctggagccttcctgggctagcgtaaaaaaggacctaatctcctacggcggcggatggagactccagggcagctggaacactggggaggaggtgcaggtcatcgccgtggaacccggcaaaaatccgaagaacgtgcagacggcgcccgggaccttcaagacatccgagggcgaagtaggcgccatagcgctggacttcaagcccgggacgtcagggagccccatcgtcaaccgcgaagggaagatcgtgggcctgtacggcaacggggtcgtgaccacgagtggcacctacgtgagtgctatcgcccaggccaaggcgtcccaagagggccccctccctgagatcgaggacgaggtcttccggaagcgcaacttgacgatcatggatctacaccccggcagcggcaagacccggcgctacctccccgccatcgtgcgggaagcgattaagcgcaagctgcggacactaatcctcgccccaacccgcgtggtcgcctccgagatggcggaggccttaaagggcatgccgatccgataccaaactaccgcagtcaagagcgaacacaccggcaaggagatcgtggacctgatgtgccacgccacgttcactatgcggctcctctcacccgtccgcgtgccaaactacaacatgatcatcatggacgaagcacacttcacggacccgagctccattgcggcgcgggggtacatctccacccgcgtgggcatgggagaagccgccgccatcttcatgaccgcgacgccgcccggatccgtcgaagcgttcccacaatctaacgccgtgatacaggatgaagagcgagacatccccgaacgctcatggaactctggatacgagtggatcacggacttccccggcaagacagtgtggttcgtcccctccatcaagtctggcaacgacatcgccaactgcctacggaaaaacgggaagcgcgtgatccagctctcccggaaaaccttcgatacagagtaccagaagaccaagaacaacgactgggactatgtggtcacgaccgatatcagcgagatgggcgctaatttcagggcagacagggtgatcgatccccgcagatgcctgaagccggtgatcctcaaggacgggcccgaacgcgtcatcctcgcgggccccatgcccgtgacggtcgcctcagccgcccagcggaggggccggatcggccgcaaccacaacaaggagggcgaccagtacatttacatggggcagcctctgaacaatgatgaggaccacgctcactggaccgaggccaagatgctgctcgacaacatcaatacccccgagggcatcatacccgccctcttcgagcccgagagggagaagtccgccgcaatcgacggggagtatcgtctgcgcggagaggcccggaagaccttcgtggagctcatgcgccgcggggacctacccgtgtggctcagctacaaggtcgcctcagagggcttccagtacagcgaccgtcggtggtgcttcgacggcgagcgcaacaaccaggtacttgaagagaacatggacgtggagatctggacgaaggagggggagcggaaaaagctgcgcccccggtggcttgacgcacgcacctactccgaccccctggccctacgggagttcaaggagtttgcggccggcagacggagtgtctccggtgacctgattctcgagataggtaagctgccccagcacctcacccagagggctcagaacgccttggataacctggtgatgctgcacaacagcgaacagggcggacgggcttatcgacacgcaatggaggagctccccgacactattgagaccctaatgctgttagccctgatcgccgtcttaacagggggtgtaacactcttcttcctgtccggccgggggctgggaaagactagcatcggccttctgtgcgtgatggctagcagcgtactgctctggatggcttccgtcgagccccactggattgccgcctccatcattctggagttctttctcatggtgctcctgattcccgagcccgaccgccagcggaccccgcaggacaaccagttagcctatgtggtaattgggctgctgttcatgatcctgaccgtggccgccaacgagatgggactcctagagacaactaaaaaggacttagggattggtcatgtggcagtcgagaaccaccaccacgccgcaatgttagacgtggacctgcacccagcctccgcgtggaccttgtacgcggtagcaacgaccatcatcaccccgatgatgagacacaccatcgagaacaccactgccaatatcagcctcaccgccatcgccaaccaggccgccatattaatgggcctggacaagggctggcctatctccaagatggacatcggcgtccccctcttggccctggggtgctacagccaggttaaccccctcaccctgacggctgcagtgcttatgctcgtcgcccattacgcgatcataggccccgggctgcaggcaaaagcgactcgggaggcccagaagcgcaccgccgctgggatcatgaagaacccgaccgtagacgggatcgtagccatagacctggaccctgttgtttacgacgcgaaattcgagaaacagctcggccaaatcatgctgctgatcctctgcacctcccagatcctactgatgcgtaccacctgggccctctgcgagtcaatcaccctagccacaggccccctgaccaccctctgggaggggagccccggcaaattctggaacaccacgatcgccgttagcatggccaacatcttcagagggagctacctggcgggcgctggcctagccttctccctcatgaagtccctcgggggcggccgccgggggaccggggcccagggcgaaacgttaggcgagaagtggaagcgtcaactcaaccaactctccaagagcgagttcaacacctacaagcggtctgggatcatggaggtggaccgaagcgaggcgaaagaaggcctgaagcgcggggagacgaccaagcatgcggtatccagaggtaccgccaagctccggtggttcgttgagcgcaacctggtcaagccggaagggaaggtgatcgacctggggtgtggacgaggagggtggagctattattgcgcagggctgaaaaaggtgaccgaggtgaaggggtatacgaagggcgggcccggccacgaggagccgatccctatggccacctacgggtggaacctcgtaaagctgcactccggcaaggatgtgtttttcatcccgccagagaagtgcgacaccctgctctgcgacatcggggagtccagccccaacccgaccatcgaggaggggcgcacgctgcgggtcctgaaaatggttgagccgtggctccgcggaaaccagttctgcataaagatcttaaacccctacatgccctcagtggtcgagacgctggagcaaatgcagagaaagcacggaggcatgctcgtgcgcaacccattgtctcgtaacagcacccacgagatgtactgggtgtcctgcggtaccggcaacattgtcagcgcggttaacatgacctccaggatgctgctcaaccggttcacgatggcgcaccgcaagccgacgtacgagcgagatgtggaccttggggcaggcacccgtcacgtcgcggtggaaccggaggtggccaatctggacatcatcggccagcgcatcgaaaatatcaagcacgagcacaagtcaacctggcattatgacgaggacaacccctataagacgtgggcgtaccacgggtcatacgaggttaagcccagcggctcagcctcgtcgatggtgaacggggtcgtcaaactcttaaccaagccctgggacgtgatccctatggtcactcagatcgctatgaccgacacgactcccttcgggcaacagcgtgtgttcaaggagaaggtggacacccggacccccaaggccaagcgggggacggctcagatcatggaggtcaccgcgaagtggttgtggggctttctctcgcgcaacaaaaagccacggatatgcactcgcgaggagtttacccgcaaggtccgctctaacgccgccattggcgctgtcttcgtcgatgagaaccagtggaacagtgcgaaagaggccgtggaagacgaacgattctgggacctggtgcaccgcgagcgagaactacacaagcagggtaagtgcgccacttgtgtatacaatatgatgggtaagcgcgagaagaagctcggggagttcggcaaggccaaggggagccgggcaatctggtacatgtggctgggcgcgcgcttcctcgaattcgaggcgcttggcttcatgaacgaggaccactggttctcccgagagaattctctgtccggggtggagggggagggtcttcacaaattgggatatattctccgggacataagcaagataccagggggcaatatgtacgcagacgataccgccggctgggacacccgtatcaccgaggatgacctgcagaacgaggccaagattacggacattatggagcccgagcacgcactcttagccaaaagtatcttcaagctgacctaccagaataaggtggttcgcgtgcagcgcccggctaagaacggcaccgtgatggacgtcatcagccgtcgcgaccaacggggcagcggccaggtaggcacctatggcctcaacaccttcaccaacatggaggctcagctgatccgccaaatggagtcagaagggatcttctcccccagcgagttagaaaccccaaacctcgccgggcgggtgctggattggctggagaagcacggggtcgagcgcctcaagcgtatggcgatctccggcgacgattgcgttgtcaagcccatcgacgaccgcttcgccactgccttgactgcactgaacgacatgggcaaggtcaggaaggacatcccgcagtgggagccaagcaaaggctggaacgattggcagcaggtgcccttctgctcccaccattttcatcagctcattatgaaggacggccgcgagatcgtggtcccctgccggaaccaggacgagctggtagggcgcgcccgggtctcccaaggcgctgggtggagtttgcgcgagaccgcctgcctgggcaagtcctatgcgcagatgtggcagcttatgtacttccaccggcgtgatctccggttggccgccaacgccatttgtagcgccgtgcctgtcgattgggtgcccaccagccgcaccacatggtcaatccacgcccaccaccaatggatgacaaccgaggacatgctgagtgtctggaatcgtgtgtggatcgaggagaacccgtggatggaggacaagacgcacataagctcatggggcgacgtgccctacctgggcaagcgagaggaccagtggtgcggcagtctcatcgggctgacggcccgggcgacctgggccacgaatatccaggtcgccattaatcaggtgcgacgcctgatcggcaatgagaactaccttgactacatgacatccatgaagcggttcaaaaacgagagcgacccggaaggagccctgtggtga

SEQ ID NO: 24528 - RNA, 9879 nt, synthetic construct
  misc_feature 1..9879: note = derived and/or modified CDS sequence (opt11) from DENV-1__EU249490__SS-prME
  source 1..9879: mol_type = other RNA
agcgtgaccatgctgctcatgctgatgcctaccgccttggctttccacctgacgacccgcggcggggagcctcacatgattgtgtcaaagcaggagaggggcaagtcgctgctgttcaagacctccgcgggggtgaatatgtgcacgctcatcgccatggacctgggagagttctgcgaggacacgatgacctacaagtgcccgcgcatcaccgaggcggagcccgacgacgtggactgctggtgcaacgccactgatacatgggtgacctatgggacctgtagccagaccggcgagcaccgccgcgacaagcgttccgtggccctggcgccccacgttggactcgggctggagacgcgcacggagacttggatgagctccgagggcgcctggaaacagatacaacgggtcgagacctgggccctacgccaccccggtttcactgtgatagcattattcctggcgcacgccataggcaccagcatcacccaaaaggggatcatttttatcctgctcatgctggtgaccccctccatggccatgcgctgcgtcggcatcggcagccgcgactttgtagaggggctgtccggagcgacgtgggtggacgtcgtgctcgagcacgggagctgcgtgaccaccatggctaaggacaagcccacccttgacatcgagctgctcaagacggaggtcaccaaccccgcggtgttgcggaagctgtgcatcgaggccaagatctccaacactacaacggacagccgatgcccgacccagggcgaggccaccctcgtcgaggaacaagacgccaatttcgtctgcagacgcacatttgtagaccgggggtgggggaacggctgcgggctgttcggcaaaggatccctgatcacgtgcgccaagttcaagtgcgtcacaaagctagagggcaagaccgtacagtacgagaacctgaagtactcggtgattgtgaccgtacacacgggtgaccaacaccaggttggcaatgagtccacagagcacggcacgaccgcgaccatcaccccccaagcccccagcactgagatccagctgacagactatggggcactaaccctggactgctctccccgcacgggcctggacttcaacgagatggtcctcctgaccatgaaggagaagtcctggctggtccacaagcaatggttccttgatcttccactgccctggaccagcggggcctccaccagccaagagacgtggaaccggaaagatctcctggtgaccttcaagaccgcgcacgcgaagaagcaggaggtcgtggtgctgggtagtcaggagggcgccatgcataccgccctcacgggggccaccgagatccaaaccagcgggaccacgactatctttgccggtcacctgaagtgccgcctgaagatggacaaactcaccctgaagggtatgagttatgtcatgtgcaccgggtcgttcaagctggagaaggaggtggcggaaacgcagcacggcactgtgctcgttcaaattaagtacgaaggcaccgacgcgccctgcaagatccccttctccacccaggacgagaagggggtgacgcagaacggccggctgatcacggccaacccgatcgtgacagataaggagaagcccgtcaacatcgaggccgagccgccattcggggagagctacatcgttatcggggctggtgagaaagcccttaagctgtcttggttcaagaaaggaagctctattggcaagatgtttgaggccacagcacgaggggcccggcgtatggccatcttaggcgacaccgcgtgggacttcgggagcatagggggcgtcttcaccagtgtcggcaaactggtgcaccagatctttggcaccgcctacggggtgctgttttcaggcgtctcctggaccatgaaaatcggcatcggcgtgctcctgacctggctgggtctcaacagccgctctactagcctctccatgacatgcatcgccgtggggctggtgaccctttatctgggtgtgatggtgcaggctgacagcgggtgtgtcatcaactggaagggccgggagctcaaatgcggtagcggcatattcgtcacgaacgaagttcacacttggaccgagcaatacaaattccaagcggacagcccgaagcggctcagcgcagccatcggcaaggcctgggaggagggggtgtgtggcatccgatcggccacccgcctggaaaacatcatgtggaaacagatcagcaacgagctgaaccacatcctgctggagaacgacatgaagtttaccgttgtggtcggggacgtggcaggcatcctggcacaggggaagaagatgatacggccccagccgatggaatataaatactcctggaagagttggggtaaagctaagatcatcggcgccgacgtgcagaacacaacgttcatcatcgacgggcccaacacgccggagtgccccgacgaccagagggcgtggaacatatgggaggtcgaggactacggcttcgggatcttcaccacgaacatctggctcaaactgcgggactcctacacccaagtgtgcgaccaccgcctgatgtcggccgcaatcaaggattccaaggctgtccacgcagacatgggctactggatcgagagcgagaagaacgagacgtggaagctcgcccgggcctcattcatcgaggtcaagacttgcatctggcccaagagccatacgctgtggagcaacggcgtactggagagcgaaatgataatccccaagatctatggtggcccgatatcccagcataactaccgccccgggtatttcacgcagaccgccggtccttggcacctggggaagctggagctcgacttcgacctctgtgagggcacaaccgtggtcgtggacgaacactgcggaaaccgggggccctcgttaaggaccaccacggtgactggcaagattatccacgagtggtgctgccggagctgcacactacctcccctgcgcttcaagggggaggacggctgctggtacgggatggagatccgccctgtaaaggagaaggaggaaaacctggtcaaatccatggtaagtgccggatccggcgaggtcgacagcttctccctggggctcctgtgcatcagcatcatgatcgaggaggtgatgcggtcccgctggtcgcgcaagatgctgatgaccggcaccctcgccgtgttcttcttactgattatgggtcagctcacgtggaacgacctcatccggctgtgtattatggtcggcgcgaatgccagtgatcgaatgggcatgggcaccacttacctcgccctgatggccactttcaagatgcgcccgatgttcgcagtcggactcctgttcaggcgcctgacgagcagggaggtgctgctcctgacgatcgggctgagccttgtcgcgagcgttgagctgccaaattctctcgaggagttgggcgacggactggcaatgggtatcatgatcctcaaattactgaccgacttccagagccaccagctgtgggcaaccttactctccttgacgttcataaagaccacctttagcctgcactacgcatggaagaccatggcgatggtcttgtccatcgtgagcttgtttcccttgtgcctgtctacaacttcacagaagaccacctggttgcccgtgttgctgggctccttggggtgcaaaccactcaccatgttccttatcgccgagaacaagatttggggccgaaaaagctggcccctaaacgagggcatcatggccgtcggaatcgttagcatcttattatcctcactgctcaaaaacgacgtgcccctagccgggcccctgatagcaggcggcatgctcatcgcgtgctacgtcatctcgggtagctccgccgacttgagcctggagaaggccgccgaggtgtcctgggaggaggaggccgagcacagcggtgcgtcccacaacatcctcgtcgaggtccaagacgacgggacgatgaagatcaaggacgaggaacgggacgacaccctgacaattctgctcaaggccactctgctggccgtgtcgggcgtatacccgctctccattcccgccacgctattcgtgtggtacttctggcagaaaaaaaaacaacgcagcggagtcttatgggataccccctcaccgccggaggtggagcgagcggtgctagacgatggcatctaccgcatcatgcagcggggcctactggggcggagccaggtgggcgtgggggtcttccaagagaacgtgttccacaccatgtggcacgtcaccaggggtgcggtcctcatgtaccaagggaaacgcctcgagccctcctgggcctccgtgaaaaaagaccttatctcctacgggggcggttggcggctgcagggcagctggaacacgggggaggaggtgcaggtcatcgccgtggagcccggcaaaaaccccaaaaacgtacagaccgcccccgggactttcaagacctcagagggcgaggtaggcgcaatcgcgctcgacttcaagcccgggacgagcgggagcccgatcgtgaaccgggagggtaagattgtcggcctgtatggcaacggggtcgtgaccacgagcggcacctacgttagcgccatagcccaggccaaggcttcccaagagggcccccttccggaaatcgaagacgaggtcttccggaagaggaacctcacgataatggacttacaccctggcagcgggaagacccggcgctatttgcctgccatcgtgcgggaggccatcaaacgcaagctcagaaccctgatcctagcccctacacgcgtggtcgccagcgaaatggccgaggccctcaagggcatgcccatcagataccagacgaccgccgtcaagagcgaacatactggcaaggagatcgtggacctgatgtgccacgccactttcacgatgcgtcttctctcccccgtccgcgtgcccaactacaacatgatcatcatggacgaagcccatttcaccgacccgagctcaatcgctgcacgtgggtatattagcacccgcgtgggcatgggggaggccgccgcaatcttcatgaccgccacgccgcccggttccgtcgaggccttcccccagagcaacgccgtgatccaggacgaggagagggacatcccggaacgttcatggaacagcggatacgagtggatcaccgactttccgggcaaaaccgtgtggttcgtccccagcataaagagcgggaacgacatagcaaactgcctgcggaagaacgggaagcgcgtaatccagctgtcccgacgcaccttcgacacggaataccaaaagaccaagaataacgattgggactacgttgtcaccacagacatcagtgagatgggtgcgaacttccgggccgatagagtcatcgaccccaggcgctgtctcaagccggtgattttaaaggacgggcccgagcgggttatattagctggccccatgcccgtgacggtagcctccgcggcgcagcggcgggggaggatcggccggaaccacaacaaagaaggcgaccagtacatctacatggggcagccgctaaacaacgatgaggaccacgcccactggaccgaagcgaagatgcttctggataacataaacacccccgagggcatcatccccgccttattcgagcctgagcgcgagaagtctgccgcgatcgacggggagtaccgcctgcgtggtgaggcccggaaaaccttcgtggagctaatgcggcgcggagaccttccagtgtggctgtcctataaggttgcttccgagggcttccagtatagcgatcggcgctggtgctttgacggcgagcggaataaccaggtgctcgaagagaacatggacgtagaaatctggacgaaggagggtgagaggaagaagctccggccccgttggctggacgcgcggacctactcggaccccctagcgctcagggagttcaaggagttcgcggccggccggaggagcgtgtccggggatctgatcttagagatcggcaagctcccacagcaccttacccagcgggcccagaacgcccttgataacctcgtgatgctgcataattcggagcagggggggcgcgcgtatcgccatgctatggaagagctgccagataccatcgagactctcatgttactggccttaatcgcggtgttaacgggcggtgtaaccctgttcttcctgtccggccgcgggttaggcaaaaccagcatcggcctgctctgtgttatggcctccagcgcgctgctgtggatggcctccgtggagccccactggatcgccgcctcgatcatcctcgagttcttcctgatggtgctgctcatccccgagcccgaccggcagcgcaccccgcaagacaatcagctggcctatgtggtgatcgggctcctcttcatgattttgacagtcgcggccaatgagatgggtttactcgagacaaccaagaaggacctggggatcggccacgtggcagtggagaaccaccaccacgcagccatgctggacgtcgacctccatcctgcgtccgcctggaccctgtacgctgtggccacgaccatcattactcccatgatgcggcacaccatcgaaaacacgaccgccaacatcagccttacggcgatcgccaaccaggctgcgatcttaatggggttagacaagggctggccaatctccaaaatggacattggagtgccgctgcttgcgttagggtgctacagtcaggtcaacccactgaccttgacggccgctgtgttaatgctggtggcccactacgccataatcggtccggggctgcaggcgaaggccacccgcgaggcccaaaaacgcaccgcggccggcatcatgaagaacccaacggtggacggcatcgtggcgatcgacctcgaccccgtggtctacgacgccaaattcgagaagcagctgggccaaataatgctcctgatcctgtgtacgtcccaaatcttactaatgcggacaacctgggccctgtgcgagagtatcaccctcgccacgggcccgctgaccaccctctgggagggatccccgggcaagttctggaacaccacgatagccgtatctatggcgaacatcttcagggggagctacttggctggcgccggcctggccttctccctgatgaagtccctcggtggcgggcgacgaggtactggggcgcagggtgagacgctgggcgagaaatggaagagacagctaaaccagttgtccaaatcagagttcaacacatataagcgctccggtatcatggaagtggatcggagcgaggcgaaagagggcctgaagcgcggcgaaacgacaaagcacgctgtctcgcggggcaccgccaagctccgttggttcgtggaacgtaacctcgtgaaaccggaggggaaggtcatcgatctcgggtgcggccgcgggggctggagctattactgtgccggactgaagaaggtgacagaggtgaagggatacactaaaggtgggcccggccatgaggagccgatccccatggcgacctacgggtggaacctggtcaagttgcactccggcaaggacgtcttcttcatcccgcccgagaagtgcgacaccctgctgtgtgatatcggcgaaagctcccccaaccccaccatcgaggaaggccgtacgctccgcgtgctgaagatggtcgagccgtggcttcgggggaatcaattctgcatcaagatcctcaacccctacatgcccagcgtggtagaaacactggagcagatgcaacgcaagcacgggggcatgctggttcggaatcctctatcccgcaactcgacccacgagatgtactgggtgtcctgcgggacgggcaacatcgtgtctgccgtcaacatgacctcccggatgctgctgaaccgcttcacgatggcccaccgcaagccgacctacgagcgcgacgtggatctcggggccggcacccgccatgtggcagtcgagcccgaggtggcgaacctcgacattatcggtcagcgaattgagaacatcaagcacgagcacaaatctacttggcactacgatgaggataacccctacaagacctgggcgtatcacgggtcctacgaggtgaagcccagcggcagcgcctccagcatggtcaacggggtggtgaaattgcttaccaagccgtgggacgtgatcccgatggtgacccagatcgccatgaccgacactaccccattcggccaacagcgcgttttcaaggagaaggttgatacccggacccctaaggccaagcgcgggacggcgcagatcatggaagtgaccgccaagtggctgtggggctttctaagccggaacaaaaaaccgaggatctgcacccgggaggagttcacccgaaaggtccggagcaacgccgccatcggcgcggtgttcgtggacgagaatcagtggaattcggcgaaggaggccgtcgaagacgaacgtttttgggacctcgtgcaccgggagcgcgagttacacaagcaggggaagtgtgcgacctgcgtgtacaacatgatgggcaaacgggagaaaaagttgggggaattcggcaaagctaagggctcccgcgctatctggtacatgtggctgggcgcccggttcttggagttcgaggcactgggcttcatgaacgaggaccactggttctcccgcgagaattcactctccggtgtcgagggcgaggggctgcacaaattgggctacatcttaagagacatctcgaagatccccgggggtaacatgtacgccgacgacaccgccggctgggacactcgcatcaccgaggacgacctgcaaaatgaggccaagatcacggacatcatggagcccgagcacgctctgctcgccaagtccatcttcaagctaacctaccagaacaaggtggtccgggtccagcgcccggccaaaaacgggaccgtgatggacgtgatcagccgccgtgatcagcgcgggtcggggcaggtcggcacgtacggcctaaatacgttcaccaatatggaggcccaactgatccggcagatggaaagcgaaggtattttttcccccagcgaactggaaaccccgaacctggcgggccgcgtgttagactggctggagaaacacggggttgagcggctgaagcgcatggccatctctggcgacgactgcgtggtcaagcccattgacgaccggttcgccaccgccctaaccgccctgaatgacatggggaaggtgcgcaaagatatcccgcagtgggagccgtcaaaggggtggaatgactggcagcaggtccccttctgtagccatcacttccaccagctgatcatgaaggacggccgggagattgtggtgccctgtcgcaaccaggacgagctcgtcggccgggcccgcgtgagtcagggcgcaggctggtctctgcgggagaccgcctgcctggggaaatcctatgcccagatgtggcagctcatgtacttccatcgcagggacctgcgattggcggccaacgctatctgtagcgccgttccggtcgactgggtgcccaccagtcggaccacttggagcatccacgcccaccaccagtggatgaccactgaggacatgctcagtgtatggaaccgcgtctggatagaggagaacccctggatggaggacaagacacatattagctcctggggcgacgttccttacctgggcaagcgggaggaccagtggtgcggtagccttatcgggctcactgcgcgcgctacctgggccaccaacatccaggtcgccatcaatcaggtccgccgactcatcggcaacgagaactatctggactatatgacctccatgaagcgcttcaaaaacgaatcggaccctgagggggccctctggtaa

SEQ ID NO: 24529 - RNA, 9879 nt, synthetic construct
  misc_feature 1..9879: note = derived and/or modified CDS sequence (opt11) from DENV-1__EU249491__SS-prME
  source 1..9879: mol_type = other RNA
tcagtgacgatgctgctcatgcttatgcccaccgcactggccttccacctcaccacccgaggaggggaaccccacatgattgtgagcaagcaggagagaggcaagtcgctgctgtttaagaccagcgcaggggtgaacatgtgcaccctcatcgccatggacctgggcgagttgtgcgaggacacgatgacctacaagtgtccccgtatcactgaggccgagcccgacgacgtggactgctggtgcaacgccaccgatacgtgggtgacctacgggacctgcagccagacaggcgaacaccgacgcgacaagcggagtgtggccctcgcgccacacgtgggcctggggctcgagacacgcaccgagacctggatgagctccgagggcgcctggaagcagatccagcgagtggagacctgggccctcagacaccccgggtttacggtgatcgctttattcctggcgcacgccatcggcacgagtatcactcagaaggggatcatctttatcctactcatgctggtgaccccctccatggccatgcggtgcgtcggcatcggtagccgcgacttcgtggaggggctatcaggcgccacgtgggtggacgtggttctagagcacggcagctgcgttaccaccatggccaaggacaagcccacgctggacatcgagctcctgaagacggaggtcaccaatcccgctgtgttgcggaagctctgcatcgaggccaagatatccaacaccaccacggacagccgctgtccgacccagggcgaggcgaccctggtggaggagcaggacgccaatttcgtctgccggcgcactttcgtggatcggggctgggggaacgggtgcgggttattcggcaaggggtccctcatcacgtgcgcaaagttcaagtgcgtgaccaagttagagggcaagatcgtccagtacgagaacctgaagtattctgtcatcgtaaccgtccataccggcgaccagcaccaggtgggcaatgagtccacggagcacggcaccacagcgaccatcacgccccaggccccaacgaccgagattcagctcacggactacggggccttgaccctggactgcagcccccgcacgggcctcgacttcaacgagatggtcctgctgaccatgaaggagaaatcctggctcgtgcataagcagtggttcctggacctgcctctcccatggaccagcggcgccagcacttcccaggagacctggaacagacaggacctgttagtgaccttcaaaaccgcccacgcgaagaagcaggaggtcgtggtgctcggcagccaggagggcgccatgcacaccgccctgactggggccaccgaaatccagacctcaggaactacgaccatcttcgcggggcacctgaaatgcagactcaagatggacaagctaaccctgaaaggcatgagctacgtcatgtgcacagggtcctttaaacttgagaaggaggtggcggagacgcagcacggcaccgtcctggtccagatcaagtatgaaggcacggacgccccctgcaagatccccttcagcacccaggatgagaagggggtgacgcagaacgggcggctcatcaccgccaaccccatcgtgaccgacaaggagaaacccgtcaacatcgaggccgagccgcccttcggggagtcctacatagtgatcggagcgggcgagaaggccctgaagttgagctggttcaagaaggggtcctcaatcggcaaaatgttcgaggccactgctcgcggggcgcggcgcatggcgatcctgggcgacacggcctgggactttgggtccatcggcggagtgttcactagcgtcggaaagctggtgcaccagatatttggcaccgcctacggggtcttgttcagtggcgtcagctggaccatgaagatcgggatcggcgtactgctgacgtggctcggcctgaactcccgcagcaccagtctgtctatgacctgcattgcggtggggctcgtcaccttgtacctaggtgccatggtgcaagcagactccgggtgcgtgataaactggaagggccgggagctcaaatgcgggagcggcatcttcgtcacgaacgaggtgcacacttggaccgaacagtacaagttccaggccgacagcccgaagagactgtccgccgccatcggcaaggcctgggaggagggggtgtgcggcatccggagcgcgacccgcttagagaacatcatgtggaagcaaatctccaacgaactcaatcacatcctgctggagaacgacatgaagctcaccgtcgtcgtgggggacgtcgccggcatcctgggacagggtaagaagatgatccggccccaacccatggagtacaaatatagctggaagtcctgggggaaggccaagatcataggagccgacgcgcaaaatacgaccttcatcatcgacggcccaaacaccccggaatgccccgacgaccaacgggcttggaacatatgggaggtggaagactacgggttcggcatctttaccactaacatctggctgaagctacgggacagctacacccaagtgtgcgaccaccgcctgatgtccgccgccatcaaggacagcaaggccgtccacgcggacatgggttactggattgagtccgagaagaacgagacctggaagctggcccgggcctcgttcatcgaggtgaaaacctgcatttggcccaagtcccacacattgtggagcaacggggtgctggagtcggagatgattatccccaagatctacggcgggccgatctcacagcacaattaccgccccggctatttcacccagactgccgggccctggcacttaggaaagctcgagctggacttcgacctgtgcgagggcaccacggtagtggtcgacgagcactgcgggaaccggggcccatccctccgcacgaccaccgtcacggggaagattatacacgagtggtgctgccggagctgcaccctgccacccctgcgcttccggggcgaggatgggtgctggtacggcatggagatcaggccagttaaggagaaggaggagaacctcgtgaagtccatggtcagtgcaggcagcggggaggtggactccttctcactgggcctgctctgcatctccatcatgatcgaagaagtcatgcgtagccgctggtcccggaaaatgctgatgaccggtaccctggctgtctttttcctactgatcatgggccaactgacgtggaacgacctcatccgcctgtgcatcatggtgggtgccaacgctagcgaccgtatgggcatggggacgacctatctcgccctcatggccaccttcaaaatgcggcccatgtttgcggtggggctgttgttccgacggttaacgtctcgcgaggtgctgcttttaaccataggcctgtccctggtggcctcggtggaactccccaactctctggaggagcttggggacggactcgccatgggaataatgatcctgaagctgctcaccgatttccagtcccaccagctatgggccaccctgctcagcttaacgttcatcaagacaactttctccctgcactacgcgtggaaaaccatggccatggtgctctctatcgtgtccctgttcccgctttgcctctccacgacctcccagaaaaccacttggctgccggttctgctcgggagcttaggatgtaagccgcttactatgttcctcatcgctgagaacaagatctgggggcggaaatcctggcccctgaatgagggaattatggccgtcgggatcgtcagcatccttctcagctccctgctgaagaacgacgttcccctcgcaggacccctgatcgcgggcgggatgctgattgcctgttatgtgatctccggctccagcgccgacctatccctagaaaaggccgccgaggtgagctgggaggaggaggctgagcacagtggggccagccacaacatcctagtcgaagtacaggacgacgggaccatgaaaatcaaagacgaggaacgcgacgacaccctgaccattctgcttaaagccacccttctggccgtgtccggggtctacccgctgagcatccccgccaccctcttcgtgtggtacttctggcagaaaaagaagcagcggtcgggggtgctgtgggacaccccctccccgcccgaggtcgagcgcgcggtactggacgacgggatctaccggatcatgcaacgcggtctgctcggccgcagccaggtgggggtcggcgtgttccaggagaacgtgttccataccatgtggcatgtcacccgcggggccgttctgatgtaccagggcaaacggttagagccgtcatgggcatccgtaaagaaggacctcatcagctacggcgggggctggcgcttgcgggggtcctggaacacgggcgaggaggtccaggtgatcgcggtagagcccgggaagaatcccaaaaacgtccagacagcccccggcaccttcaaaacccccgagggcgaggtgggggcgattgccctggactttaagcccggcacgagtgggtctcccatcgtgaaccgagagggcaagattgtcggcctctacggtaacggcgtcgtgaccaccagcgggacctacgtctctgccatcgcccaagcgaaggcctcccaggagggccccctgccagagatcgaggacgaagtgttccggaagcgcaacctgaccataatggacctccaccccggcagcggcaagacccggcgctacctgccggccatcgttagggaagccatcaagcgaaaacttcgcacactcattctggcccccacccgggtagtggcgagtgagatggccgaggcgctgaagggcatgcccatccgctatcagaccaccgcagtcaagagcgagcacaccgggaaggagatcgtcgacctcatgtgccacgccaccttcacgatgcggctgctgtcccccgtacgtgtgccgaactacaacatgatcatcatggacgaggcgcactttactgaccccagttccatcgccgcccggggctacatcagcacccgcgtcgggatgggcgaagccgccgcgatcttcatgaccgccacaccgcccgggtccgttgaggcattcccacagtcaaacgctgtgatccaagacgaggagcgggatatacccgagcgctcctggaacagcggctacgagtggatcacagacttccccgggaagaccgtctggttcgtgccctccataaaaagcgggaacgacatcgcgaactgcctccggaagaacggcaagcgcgtgatccaactatcccgtaagaccttcgacacggaataccagaagaccaagaacaacgactgggactacgttgtcaccacggacatcagcgagatgggcgccaacttccgcgcagaccgggtgattgacccgcgccggtgcctgaagccggtcatcctcaaggacggaccagagcgcgtgatcctggccgggcccatgcctgtgacggtagcctccgcggcccagcggcgtggccggattggtcgcaatcacaacaaggagggggaccagtatatctacatgggccagccactgaacaacgacgaagaccacgctcactggaccgaggccaaaatgctgttagacaacatcaacacccccgaggggatcattcccgctttgttcgagccggagcgcgaaaagtccgcggccgtcgatggcgagtaccgtctgcgaggagaggccagaaagaccttcgtggagctgatgcgccggggcgacctgcccgtgtggctctcctacaaggtagcctcggagggattccagtatagcgaccgtcggtggtgcttcgatggggagcgcaacaaccaggtgctggaggagaacatggatgtggaaatatggacgaaagagggtgagcggaagaagttgaggccccggtggctcgacgcacgcacctactccgaccccctggcgttgcgggagttcaaggagttcgccgccggtcgccgtagcgtgtccggtgacctcatcctggagatcggaaagctgccgcagcacctcacccagcgcgcgcagaatgcgctggacaacctggtcatgctccacaatagcgagcagggcgggagagcgtatcgccacgcgatggaggaactacccgacaccatcgaaacgttaatgctcctggccctgatcgctgtgctcaccgggggcgtgaccctgttcttcctctccgggcggggcctcggcaagaccagcattgggttactgtgcgtcatggcgagtagcgtgctcctgtggatggcttccgtggagccacattggatcgccgccagcatcatcctggagttcttcctcatggtcctgttgatccccgagccggaccgccagcggacgccgcaggacaaccaactcgcctacgtcgtaattggcctactcttcatgatattaaccgtcgcggccaatgagatggggctgttagagaccaccaaaaaggatctcggcatcgggcacgtggccgtcgagaaccaccaccacgccgccatgctagacgtcgatctgcaccccgccagcgcgtggaccctatacgccgtggccacgaccatcatcacccctatgatgcgccacaccatcgagaacacgaccgccaacattagcctgaccgctattgccaaccaggccgcgatactgatgggcctcgacaagggttggcccatctccaagatggacatcggggtgcccctgctggcgctggggtgctatagccaagtcaaccccctgaccctgacggccgccgtactcatgctggtggcccactacgctatcatcggaccaggcctgcaggcgaaggccactcgcgaggctcagaagcggaccgctgccgggatcatgaagaaccccacggtcgacggcatcgtggcgatcgacctagaccccgtggtttacgacgctaagtttgagaaacagttgggccagataatgctgctcatcctgtgcacgtcccaaatccttctaatgcggaccacctgggccctgtgcgagagcataacgctggcaacggggccgctcaccacgttatgggagggctccccaggtaagttctggaacaccacgatcgctgtgagcatggcgaacatctttcgtggcagctacctggcgggcgcagggctcgccttcagcctgatgaagtccctgggcgggggccgccgggggaccggcgcgcagggtgagaccctcggagagaagtggaagcggcagctgaaccaactgtcgaaaagcgagtttaatacctacaagcggtccggcatcatggaggtggaccgctctgaggccaaggaagggctcaaacggggcgagactaccaagcacgccgtttccagggggaccgccaaactcaggtggtttgtggagcgcaacctggtgaagcccgagggcaaggtcatcgacttagggtgcgggcgaggcgggtggagctactactgcgccgggcttaagaaggtgaccgaggtgaagggctatacgaaagggggacccgggcacgaggagcccatcccaatggccacgtatggctggaacctggtgaagctacactccggcaaggacgtgttcttcatcccgcccgagaagtgcgacaccctcctgtgtgacatcggcgaatcgtcccccaatccaaccatcgaagaggggcgcaccctacgggtgcttaagatggtcgagccttggttgcgaggtaaccagttctgcatcaagatcctgaacccgtacatgcccagcgtggttgagaccttagagcagatgcagcggaagcatggcgggatgctggtacgcaacccgctgtccaggaacagcacccacgagatgtactgggtgtcctgcggcaccggtaatatcgtgtctgccgtaaacatgacctcgcgcatgctcctgaaccggttcactatggcccaccggaagcccacatacgagcgcgacgtggacttgggcaccggcacccgacacgtggccgtcgaacccgaggtggccaacctcgacatcatcggccagcgcatcgagaacatcaagcatgagcacaagtcaacgtggcactacgacgaggataacccctacaagacttgggcgtaccacggctcctacgaggtgaagccgagcggatccgccagcagcatggtaaacggcgtggtcaagctgctgaccaagccctgggatgtgatcccgatggtgacccagatcgcgatgacggacacaacccccttcgggcagcaacgggtctttaaggagaaagtggatacacgcacgccgaaggccaagcggggaacggcccaaataatggaggtgacggcgcgctggctctggggcttcctgtcccggaataagaagccacgcatctgcacccgggaggaatttacgcgcaaggtccgaagcaacgccgccatcggggctgtgtttgtggacgagaaccagtggaactcagcgaaggaggccgtcgaggacgaacgcttctgggacctggtgcaccgggaacgcgaactccacaagcagggcaagtgcgcgacatgcgtgtacaacatgatggggaagagggagaagaagctgggcgagttcgggaaagccaaaggatctcgcgcaatctggtatatgtggctgggcgcgcggttcctcgagttcgaggccctggggttcatgaacgaagatcactggttctcccgcgagaacagcctgtccggcgtcgaaggggagggcttgcacaaactggggtacatcctgcgcgacatcagcaagatcccaggcggcaacatgtacgccgacgacaccgccgggtgggatacccgcatcaccgaggacgacctccagaatgaggcgaagatcaccgacatcatggagccagaacacgcactgttagccaaggccatcttcaagctaacctaccagaacaaagtggtgcgcgtccagcgtccggccaaaaacggcaccgtgatggacgtgatctcccgtcgggaccaacgcgggtctggccaggtaggcacctacgggttaaacaccttcaccaacatggaggcccagcttatccggcagatggagtccgagggcatcttctcaccaagcgagctcgaaacccccaacctggctgagcgcgcgctggactggctcgagaagtacggggttgagcggctgaagcgcatggccatcagcggcgatgactgcgtggtcaagccgatcgacgaccggttcgccacggccctgaccgcgctcaatgacatggggaaggttcgcaaagacatcccacagtgggagccctccaagggctggaatgactggcagcaggtccccttctgcagccatcatttccaccagctgatcatgaaggatggcagggagatcgtggtgccgtgccgcaaccaggacgagctcgtcgggcgggctcgcgtttcgcagggggcggggtggtcgctcagagagaccgcgtgtctgggcaagtcatacgcgcagatgtggcagctgatgtacttccaccgccgggacctccgcctagcagccaacgccatctgctccgctgttcccgtggactgggtccccactagccggacgacctggtccatccacgcgcaccaccaatggatgaccaccgaggacatgctgtcggtgtggaaccgcgtgtggatcgaagaaaacccctggatggaagacaagacgcacatctcctcatgggaggacgtcccgtatctcgggaagcgcgaggaccagtggtgcgggtcccttattggtctgaccgcgcgcgcgacctgggccaccaatatccaggtggccatcaaccaggtacgcagactcatcgggaacgagaattacctggattacatgaccagcatgaaacgcttcaagaacgagagtgatccggagggcgcgctgtggtaa

SEQ ID NO: 24530 - RNA, 9879 nt, synthetic construct
  misc_feature 1..9879: note = derived and/or modified CDS sequence (opt11) from DENV-1__EU249492__SS-prME
  source 1..9879: mol_type = other RNA
agcgtgaccatgctgcttatgctgatgcccaccgccttagccttccacttaaccactcgcggcggggagccccacatgattgtgagcaagcaagagcggggcaagagcctgctgttcaagacaagcgccggtgtgaacatgtgcaccttgatcgccatggacctgggcgagttctgtgaggacacgatgacctacaagtgccctcgcattaccgaggccgagcccgacgacgtggactgctggtgcaacgcaaccgacacctgggtcacctacgggacgtgcagtcaaaccggcgaacatagacgcgacaagagatccgtggccctggcgccccatgtcggcctcgggctggagacgaggaccgagacctggatgtcttccgagggcgcctggaagcagatccagcgggtcgagacctgggccctgcgccaccccgggtttacggtgatcgctctctttctggcgcacgccatcggcaccagcataacacagaaggggatcatcttcattttactgatgcttgtgaccccatctatggccatgcggtgcgttggcatcggtagccgcgacttcgtggaagggctctcgggagccacgtgggtagatgtggtgctcgagcacgggtcatgtgtgaccaccatggccaaggataagcccaccctggacatcgagctgctcaagacggaggtcacaaaccccgcggtgctgcggaaactgtgcatcgaggccaagatcagtaacaccaccactgactcgcgctgcccgacccagggcgaagcaactctggtggaggagcaagacgccaatttcgtctgtcggcgcacattcgttgaccggggctgggggaacggctgtgggttgttcggcaaggggtcgttgatcacgtgcgccaagttcaagtgtgttaccaaactcgagggcaagatcgtccagtacgagaacctgaagtacagcgtgatcgtgaccgtccataccggcgatcagcaccaggtgggcaacgagagtacggagcacggcaccaccgctaccataactccccaggctcccagcacggagatccagcttacggactacggcgccctcaccctggattgctccccccggaccggcctagacttcaacgagatggtcctcctgacgatgaaggagaagtcctggctggtgcacaagcagtggttcctggacctgccgctgccctggacgagcggcgcctccaccagccaagagacctggaaccgacaggacctcctcgtgaccttcaaaaccgcccacgcgaagaagcaagaggtcgtggtgttaggctcccaagagggcgccatgcacacggccctcaccggggccacggagatacagaccagcggcaccaccactatcttcgctgggcacctgaagtgccgcctgaagatggataagttaaccttgaagggcatgagttacgtcatgtgtaccgggagctttaagctggagaaggaggtggcggagacccagcacggtactgtgctcgtacagattaagtacgagggcaccgacgccccctgcaagatcccctttagtacccaggacgagaaaggggtgacccaaaacggcagattgatcacggccaatccgatcgtgaccgataaggagaagcccgtcaacatcgaggccgaaccgcccttcggggagagctacattgtgatcggcgcgggcgagaaagccctgaagttgtcctggttcaaaaaagggagttccataggtaagatgttcgaggccaccgcccgcggggcccggcgcatggcgatcctcggagacaccgcctgggacttcgggagcatagggggcgtattcacgtccgtagggaagctggtgcaccaaatcttcggcaccgcctacggggtgctgttcagcggcgtgtcatggaccatgaagatcgggatcggagtactcctaacctggctgggcctgaattcccgctccacaagcctgtcaatgacctgcatagccgtggggctggttaccctctacctcggcgtgatggtgcaagccgattcagggtgcgtaatcaactggaagggccgggaactgaagtgtgggagtggcatcttcgtgaccaacgaggtgcacacttggaccgagcagtataagttccaggcggacagcccgaagcgcctcagcgctgccatcggcaaggcctgggaggagggggtctgcggcataagatccgcaacccgcctggaaaacatcatgtggaagcaaatctccaacgagctgaaccacattctcctggagaacgacatgaagctaacggtggtggtcggggacgtggcgggcatactcgcccagggaaaaaaaatgatcaggccgcaacccatggagtataagtactcctggaagtcctggggcaaggccaagatcataggagccgatgtgcaaaacactacgttcatcatcgatgggcccaacaccccggagtgccccgatgaccagcgcgcgtggaatatatgggaggtcgaggactacggcttcgggatcttcacgaccaacatctggctgaagctgcgtgactcctacacgcagatgtgcgaccaccgcctcatgagtgccgcaatcaaggactccaaagccgtgcacgccgacatgggctactggatcgagagcgagaagaacgagacctggaagctcgcgcgggcctccttcatcgaggtgaagacctgcatctggcccaagagccacaccctgtggtcgaacggcgtcctcgagagcgagatgatcatccccaagatatacgggggcccgatctcccagcacaactaccgccctgggtacttcacgcagaccgccggaccttggcatctggggaagttggagctcgacttcgacctgtgcgaggggaccaccgtggtggttgacgagcactgcggcaaccgggggccgagtctgcgcacgaccaccgtcaccggcaaaattatccacgaatggtgctgccggtcctgcacattaccgcccctgcgctttaagggggaggatggttgttggtacgggatggagatccggcctgtgaaggaaaaggaggagaacctggtcaagtcgatggtgagcgccggctccggcgaggtagacagcttctccctcggtctgctttgcatcagcatcatgatcgaggaagtcatgcgctcccggtggtcgcgcaagatgctcatgaccggcaccctcgccgtgtttttcctgctcatcatggggcagctgacctggaacgatctaatcagactctgcatcatggtgggcgcgaacgcctcggaccgcatgggaatgggcacaacctacctggctctgatggccacattcaagatgaggccgatgttcgctgtcggtctcctgtttaggcgcctgaccagccgggaggtcctactgctgactatcgggctgtccctggtggcgagcgtcgaactgcccaactccctcgaggaactgggagacgggctggccatgggcatcatgatcctcaagctgctgaccgactttcagagccaccagctctgggcaaccctgctgtcgatgaccttcatccgcacgaccttcagcctccattacgcctggaagacgatggcgatggtcctgtcgatcgtcagcctgtttcctctctgcttatccaccacgagccagaagaccacctggctgcccgtgctcctgggctccctgggatgtaagccactcaccatgttcctgatcgccgagaacaagatctggggccgcaagagctggcccctgaacgagggcatcatggccgtgggcatcgtgagcatcttactgtccagcctgctcaagaacgacgtgcccctggccggacccctgatcgccggcggcatgctcatagcgtgctacgtgatctccgggagctccgccgatcttagcctggagaaggccgccgaggtatcctgggaggaggaggcggagcacagcggcgcgtcccacaacatcctcgtggaggtgcaggatgacgggacgatgaaaatcaaggacgaggagcgcgacgacaccctgaccatcctgctcaaggccaccctgctggccgtcagcggcgtgtatccgctctccatccccgccacactgttcgtgtggtacttctggcagaagaagaagcagcggagcggcgtgctgtgggacacgcccagcccgcctgaggttcagcgtgccgtgcttgatgatggtatctaccgaatcatgcagcgcggactgcttgggaggagccaggtcggcgtgggggtgttccaggagaacgtcttccacaccatgtggcacgtgacccgcggcgcggtgctgatgtaccaggggaaacggctcgagccgtcatgggccagtgtcaagaaggacctgatctcctacggtggaggttggcgcctccaggggagctggaacacgggggaggaggtccaggtaatcgccgtcgaacctggcaagaaccccaagaacgtgcagacggcccccggaacctttaagacatccgagggcgaggtgggcgccatagcgctcgacttcaagccagggaccagcggcagccccatagtcaaccgggaggggaagatcgtgggcctgtatggcaacggggtggtcacgacttctggcacatacgtgagcgcaatcgcccaggccaaggcgagccaggaagggccactgccggagatcgaggacgaggtgttccgcaagcggaatctcaccatcatggacctgcacccgggctctggcaaaactcgtcggtacctgcccgcgatagtccgcgaggctataaagcggaagctccgcaccctgatcctggctcctacccgagtggtggcctccgagatggcggaggccctcaagggcatgccgatccggtaccagactacggccgtcaagagcgaacacacgggcaaggaaatcgtggacctgatgtgccacgccacattcaccatgcgcttactctcgcccgtgagagtcccgaactacaacatgatcatcatggatgaggcccacttcacggatccgtcatccatcgcggcccgcgggtacatcagcacacgggtgggtatgggggaggccgccgccattttcatgacagcgacgccgcccggctccgtggaggctttcccccagagcaacgccgtcatccaggacgaggagcgcgacatcccggagcggtcctggaacagcgggtacgagtggatcacggacttccccggaaagaccgtgtggttcgtgccctccattaagagcgggaacgacatcgccaactgccttcgaaagaatgggaagcgggtcatccagctctcccgcaaaactttcgataccgagtatcagaagactaagaacaacgactgggattacgtagtaaccactgacatcagcgagatgggagcgaatttccgggccgaccgcgtgatcgatccccggcgctgcctcaagccggtcatcctgaaggatgggcccgagcgggtgatcctggccgggcctatgccagtcacagtggccagtgcggcgcagcgccgggggagaatcggcagaaaccataacaaggagggcgaccagtacatctacatggggcagccgctcaataacgacgaggaccatgcgcactggacggaagcaaagatgctgctggacaacatcaacacccccgagggcatcattcccgctcttttcgaacccgagcgcgagaagtccgcagcgatcgatggcgagtaccgcctaagaggggaggctcgcaagacctttgtcgaactgatgcggaggggggacttgccggtatggctcagctacaaggtggcctccgagggcttccagtacagcgaccggcgctggtgcttcgatggcgagcggaataaccaggtcctggaggagaacatggacgtggagatctggacaaaggagggggagagaaagaagttacggccgcgctggcttgacgcccggacgtactccgaccccctcgctctgcgcgaattcaaggagtttgcggccggaaggcgctcagtgtccggggacctaatcctggagatcggcaagctccctcaacatctgactcagcgtgcacaaaacgccctggacaacctcgtcatgttacacaatagcgagcagggcggccgcgcctaccggcacgccatggaggagttaccggacaccatagaaaccctcatgctgcttgccctcatagccgttttaacgggcggggtaacgctgttcttcctctccggtcgcggcctgggcaagaccagcatcggccttctatgcgtcatggcgtccagtgtcctgctttggatggcgagtgtggagccccattggatcgctgcctctataattctcgagttcttcttaatggtcctgctcatcccggagcccgaccggcagcgcacccctcaggacaaccagctggcatacgtggtgatcgggctcctgttcatgatcctgaccgtcgccgcgaatgaaatgggtctgctcgagacgaccaaaaaggacctgggaatcggccatgtggccgtagagaatcaccaccacgccgccatgttggacgtcgacctccaccccgcctccgcatggacactatatgcggtggcgacgacgattatcacccccatgatgcggcacacgatcgagaacaccacggccaacatcagcctgaccgccatcgcgaaccaggccgccatcctcatggggctggacaaaggctggccaatttccaagatggacattggcgtgcccctgctagccctggggtgctatagccaggtcaaccccctgaccctcaccgcggcggttctgatgctggtggcccattacgccatcatcggccccggcctccaggccaaggcgacgcgcgaggcacaaaagcgcaccgctgcaggaatcatgaagaacccaaccgtcgacgggatcgtggccatcgacctggaccccgtggtctacgacgcgaagttcgagaagcagctgggtcagataatgctcctgatcctgtgcacctctcagatcctcctgatgcgcaccacctgggccctgtgcgaaagtatcaccctcgccaccggccctctgacgaccctgtgggaggggtcccccggcaaattctggaacaccacgatcgccgtgagcatggccaacatcttccgcggaagctatctcgcgggcgccggcctggccttctccctgatgaagtctctcgggggctcccggcgcgggacgggcgcccagggggaaaccctgggagagaaatggaagcgacagctcaaccagctcagcaaatccgaattcaacacctacaagcgcagcggcatcatggaagtggaccggtccgaggcgaaagaggggttgaagcgcggcgagactacgaagcacgccgtcagcagggggaccgccaagctgcgctggtttgtggagcggaacctcgtgaagccagaaggcaaggtcatcgacttggggtgcggccggggggggtggtcctattactgcgccggcctgaagaaggtgacggaggtaaaggggtacaccaagggcggtcccggccacgaggagcccatcccgatggccacttacggctggaacctagtcaaactccacagcggaaaggacgttttcttcattccgccggagaagtgcgacacccttctctgtgacatcggcgagtccagcccaaaccccactatagaggaggggagaactcttcgcgtgctaaaaatggtagaaccgtggctgcggggcaaccagttctgcatcaaaatcctcaatccctacatgccctccgtagtggagacgctggagcagatgcagcgaaagcacgggggcatgctggtccggaacccactcagccgcaactctacccacgagatgtactgggtgtcttgcggcacaggtaacatcgtttccgcagtcaacatgaccagccggatgttattaaaccgcttcacgatggctcaccgcaagccgacatacgagcgtgacgttgacctcggtgccggtacccgccacgtggccgtcgagcccgaagtggcgaatttggatattattggccagcggatcgagaacatcaagcacgagcataagtccacctggcactacgacgaggacaacccctacaagacctgggcttaccacggctcctatgaggtgaagccgagcgggagcgcgagctcaatggtcaacggcgtggtaaagttacttacgaagccgtgggacgttatccccatggtgacccagatcgccatgaccgacaccacgcctttcggtcagcaacgcgtcttcaaggagaaggtggacacccgcaccccaaaggccaagcgtggcacggcccagatcatggaggtgacggcgaagtggctgtgggggttcctgagccgaaacaagaagccgagaatctgcacccgggaggagttcacacgcaaggttcggtccaacgccgccatcggtgccgtatttgttgacgaaaatcagtggaactctgcgaaagaggccgtcgaggacgagcgcttctgggacttagtacaccgggagagggagctacacaagcagggcaagtgcgcgacctgcgtgtacaacatgatggggaagcgcgagaagaagcttggcgagttcggaaaagccaagggttcccgcgccatatggtatatgtggctcggggcccggttcttagagttcgaggccctaggtttcatgaacgaggatcactggttcagccgagagaactccctcagcggcgtcgagggggagggcctgcacaagctagggtacatcctccgggacatctccaagatccccggcggaaacatgtacgccgacgacacggccggctgggacacccgcatcaccgaggacgacctgcagaacgaggccaagatcacagacatcatggagcccgagcacgcgctgctcgccaagagcatcttcaagctgacgtaccaaaacaaggtggtgcgggtccagcgcccggccaagaatggcaccgtgatggacgtgatctcccgccgggaccagcgcgggagcggacaggtagggacctacggcctgaacacgtttactaacatggaggcccagctcatccggcagatggagagcgagggcatcttctcacccagtgaacttgacaccccgaacctggccgggagagtgctcgactggctggagaagcacggcgtcgagcggctgaagcgcatggcgatcagcggggacgactgtgtcgtaaagccgatcgatgacaggttcgccaccgccctcaccgcccttaatgacatgggcaaggtgcgcaaggatatcccccagtgggagccgagcaagggctggaatgactggcagcaggttccattctgctcccatcacttccaccagctgatcatgaaggacggccgggagatcgtggtcccctgccgaaaccaagacgagctcgtcggccgggcccgtgtatcgcaaggggcgggctggtccctgcgggagacggcctgcctgggcaagagctacgcccagatgtggcagctcatgtacttccacaggcgggacctacgactggcggcaaacgccatttgctccgccgtgccggtcgactgggtaccaaccagccggaccacctggtccatccatgcccaccaccagtggatgacgacggaggacatgctcagcgtatggaacagagtctggattgaggagaacccgtggatggaggacaagacccacatctccagttggggcgacgtgccctaccttgggaagcgggaggaccagtggtgcggctccctgatcggcctcaccgcccgcgcgacatgggctacaaacatccaggtggccataaatcaggttcgccggctgctggggaacgagaactacctcgactacatgaccagcatgaagcgtttcaaaaatgagagcggcccggagggggcgctgtggtga

SEQ ID NO: 24531 - RNA, 9879 nt, synthetic construct
  misc_feature 1..9879: note = derived and/or modified CDS sequence (opt11) from DENV-1__EU249493__SS-prME
  source 1..9879: mol_type = other RNA
agcgtaacaatgttgctcatgctgatgcccaccgcgctggccttccacctcaccacgcggggcggagagccccacatgattgttagcaagcaggagagaggcaagagcctcctgttcaaaacgagcgccggggtgaacatgtgtaccctaattgcaatggacttgggcgagttttgcgaggacacgatgacttacaagtgcccgcgcatcaccgaggccgagcccgacgacgttgactgttggtgcaatgctaccgatacgtgggttacctatgggacttgcagccagaccggcgagcaccggagagataagcgctccgtagccctcgcgccccacgtaggcttgggattagaaacacgtaccgagacgtggatgtcctccgagggggcctggaagcaaatccagcgggtggagacgtgggcgttacgccaccccgggttcaccgtgatcgccctcttcttggcgcacgccattggcacgagcattacccagaaggggatcattttcatcctgctcatgcttgtaaccccctccatggcgatgcgttgcgtcggcatcggctctcgcgacttcgtagaggggctgtcgggcgccacttgggtggacgtcgtcctcgagcatgggtcgtgcgtgaccacgatggccaaagataagcccacgttagacattgagctgctcaaaacggaggtcacgaaccccgccgtgctgcggaaactgtgcattgaggccaaaatctcaaataccaccacggacagccgttgcccgacccagggcgaggcaaccctcgtggaagagcaggacgccaacttcgtgtgtaggcgtaccttcgtggatcggggctggggaaacggctgcggtctgtttgggaaggggtcgctgatcacatgcgccaagttcaaatgcgttaccaagctagagggcaagaccgtccagtacgaaaacctgaagtacagcgtgatcgttacggtccacaccggcgatcagcaccaggtggggaacgaatccaccgagcacggcactaccgcaacgatcacgccccaagctcccagcaccgagatccagcttaccgactacggtgccctcaccctggactgcagccccaggacggggctggactttaacgagatggtcctcctaaccatgaaggagaagtcgtggctggtgcataagcagtggttcctcgatttaccactgccttggaccagcggggcatccactagccaggaaacatggaaccggaaggacctcctggttacgttcaagaccgcccacgcaaagaagcaggaagtagtggtgttgggctcccaggaaggcgccatgcacaccgccctcacgggtgccaccgagatccagacgagcggcaccacaaccatattcgctgggcacctgaagtgtaggctgaaaatggataagctcaccctgaaggggatgagttacgtcatgtgcaccggcagcttcaagctggaaaaggaggttgccgagacgcagcatggtaccgtgctcgtgcagatcaagtatgagggaaccgacgccccctgcaaaatccccttctccacccaggacgagaagggggtgacgcagaacggccggctcattactgccaacccaatcgtgacagacaaagagaagccagtcaacatcgaggcagagccgccgtttggggagtcgtacatcgtgattggcgcaggcgagaaagcccttaaactgtcctggttcaagaaaggcagctccatcggcaagatgtttgaggcgaccgccaggggtgcccggcggatggcgatcctcggtgacacggcttgggactttgggagtattggcggggtgttcacctccgtcggtaagctggtgcaccaaatcttcggcacggcgtacggagtgctgtttagcggcgtctcctggaccatgaagatagggatcggtgtcctcctgacgtggctaggcctcaacagccgctccaccagcctgagtatgacatgtattgccgtggggctcgtaaccttgtacttgggggtgatggtgcaggccgattctgggtgcgtgatcaactggaagggacgggagctaaaatgtgggagcgggatattcgtgactaacgaggtgcatacctggaccgagcagtataaattccaggcggatagtccgaaacgcctctctgccgccataggcaaggcatgggaggaaggggtctgtggcatccggtccgccacacgcctggagaacatcatgtggaagcagataagcaacgaactgaaccacatcctcctggagaatgacatgaagttcaccgtggtggttggtgacgtggccggcatcctggcccaagggaagaaaatgatccggccccagcccatggagtacaagtactcctggaagtcctggggcaaagccaagatcattggggcggacgttcagaacacgacctttatcatagacgggcccaacacacctgagtgccccgacgaccagagagcatggaacatctgggaggtagaggactatgggttcggaatcttcaccacgaacatctggctcaaactgcgggactcctacacgcaggtttgcgaccaccgccttatgagcgcggccatcaaagactccaaagcggtccacgctgacatgggctactggatcgagtccgagaaaaacgaaacctggaagctcgcccgggcctctttcatcgaggtcaagacctgcatctggccaaaaagtcacacgctgtggtccaacggagtcctagagtcggagatgattatacccaagatctatggaggtccgatatcccagcacaactaccgccccgggtactttacacagaccgccggcccttggcacttagggaagctggagctggacttcgacctctgcgaagggactacggttgtagtcgatgagcattgcggtaaccgggggccttcattgcgcaccaccaccgtgactggcaagatcattcatgagtggtgctgccgttcctgcacactgccgcccttaaggttcaagggggaggatggctgctggtacgggatggagatccggcctgtcaaggagaaagaggagaacctggttaaatccatggtgagcgccggttcaggagaggtcgacagcttcagcctgggtctcctgtgcatatctatcatgatagaagaggtgatgagatcgcggtggtcgcgcaagatgctgatgactggcacccttgcagtgtttttcctgttgataatggggcagcttacgtggaacgacttgatccgtctgtgcataatggtcggtgcgaacgctagcgaccgcatggggatgggcaccacttacctcgccctgatggcaaccttcaagatgcgtcccatgttcgccgtggggctcctgttccgccgcctgacgtccagggaggtactgctcctgacgatagggctgtccctcgttgcgagcgtggagctgcccaactcccttgaggagctcggcgatggactggccatgggcatcatgattctgaagctccttaccgacttccagtctcaccaactgtgggccaccttactcagtctgacgttcatcaagaccaccttttctctccactacgcctggaagactatggcgatggtcctgtcgatcgtgtcgctgttcccgctgtgtctgagtacgacgagccagaaaacaacctggctgcctgtgctcctgggctccctgggatgcaaaccgttaaccatgttcctcatagctgaaaacaagatctgggggagaaagagctggcctctgaacgaggggatcatggcggtgggcattgttagtatcctcctgagctcactgctgaagaatgacgtacctctggcagggcccctgatcgccggcggcatgctcatcgcctgctatgtcatatccggttcgtccgcagacctgagcctggagaaggcggccgaggtgtcgtgggaggaggaagccgaacacagcggcgcctcgcacaacatcctggtggaggtccaggatgacgggactatgaagatcaaggatgaggaaagggacgacaccttaacaatcctgctcaaagccaccctgcttgcggtcagcggcgtgtacccgctctctatcccagcaacgttgttcgtctggtacttctggcagaagaagaaacagcgcagcggggtgctgtgggacacgcccagcccgcccgaagtcgagagggccgtgctagacgacggcatctacagaatcatgcaacgggggctactcggcaggagtcaggtgggcgtgggcgtcttccaggagaacgtattccacaccatgtggcatgtgactcggggggcggtcttaatgtaccaggggaagcgactggagccatcctgggccagcgttaagaaggacctaatcagttacggcggcgggtggcggctgcaggggtcttggaacactggggaagaggttcaggtcatcgcagtggagcctggcaaaaacccaaagaatgtgcagaccgcccccgggacctttaagacctccgagggtgaagttggagccatcgcgctggacttcaagcctggtacgagcggcagcccgatcgttaaccgcgaggggaagatagtgggtctgtacgggaacggggtggtgaccacgtcaggcacctacgtgagcgccatcgctcaggccaaggcgtcccaagaggggcctctgccagagatcgaagacgaggtattccgtaagcgcaacctcaccatcatggatctgcaccccggaagcggaaagacaaggcgttacttgcccgctatcgtgcgggaggcgatcaagaggaaactcaggaccctgattctggccccgacaagagtagtcgcctccgagatggccgaggccctcaagggcatgcccatccgctaccagacgaccgccgtcaagtcagaacacacgggtaaggagatcgtggacctgatgtgccacgccaccttcacgatgcgattgctctcccccgtgagagttcccaactacaacatgattatcatggacgaggcccatttcaccgaccctagcagtattgccgcccgggggtacatcagcacccgcgttggcatgggggaggcagccgccatctttatgaccgcgactcccccgggttcggttgaagcgtttccccaaagcaacgccgttatccaggatgaggagcgggatatcccggagcgctcctggaacagcggctacgagtggatcaccgacttccccggaaagaccgtgtggttcgtcccctccatcaagagcggcaacgatatagctaattgcctacggaagaatgggaagcgcgtgatccagttgtcccgaaagacttttgatacggagtaccagaagaccaagaataacgactgggattacgtcgtgaccacagatataagcgagatgggagcgaattttcgggccgaccgggtcatcgacccccggcggtgcctcaagccggttatcctgaaggatgggcccgagcgcgttatcttagccggtcctatgcccgtaacggtcgcctccgccgctcagcgacgagggcggatcggccgcaaccacaacaaggagggagaccagtacatctacatggggcaaccgctcaacaacgacgaggaccacgcacactggaccgaggcaaagatgttgcttgacaacatcaacacccccgagggcatcatccccgccctttttgaacccgaacgtgagaagtccgcggcgatcgacggggaatacagattacgcggcgaagcccggaaaaccttcgtggaactcatgcgccgcggggatttgcccgtgtggctgagctacaaggtcgcgtccgagggcttccagtatagcgaccgccggtggtgcttcgacggcgagcgcaacaaccaggtgctggaggagaatatggacgtagagatctggacgaaagagggtgaacggaagaagttgaggccccgatggttggacgcgcgcacctactccgaccccctggccttgcgggagttcaaggaattcgcggccggacgacggtctgtctccggggacttgatactggagattggcaagcttcctcagcacctaacccagcgcgcccaaaacgctctggataacctcgtaatgctgcacaacagcgagcagggggggcgggcctacaggcacgccatggaggagctgccggatacaattgaaacgttaatgctgctggcccttatcgccgtgctgaccggaggggtgaccctgtttttcctctccggcagagggctcggtaaaacaagcataggccttctctgcgtaatggctagcagcgtactgctgtggatggcgagtgtcgagcctcactggatcgcagccagtatcatcctcgagttcttcctgatggtgttactcatccccgagcctgaccgccagcgaaccccgcaggacaaccaactggcttacgttgtgattgggttactatttatgatcttaactgtcgccgcgaacgaaatgggattactcgaaaccaccaagaaggaccttgggatcggccacgttgccgtcgaaaaccaccaccacgctgccatgctggacgtggacctccaccccgcctccgcatggaccctctacgccgtggccacgacaatcatcacaccaatgatgcggcacaccatcgagaacacgaccgccaacatcagcctgactgcgattgcgaatcaggccgctatactcatggggctggacaagggctggccgatatccaagatggacatcggcgtcccgctgctcgccttagggtgctatagccaagtaaaccctctaacgctgacggctgccgtacttatgttagtcgcccactacgccataatcggcccagggttacaggccaaggcgacccgtgaggcacagaagcgcaccgcggcgggcattatgaagaacccgaccgtggacggtatcgtggccatagatctggaccccgtcgtgtacgatgcgaagttcgaaaagcagctaggccagatcatgctactgatactgtgcacgtcacaaatattgctgatgcgcacaacatgggccttgtgtgaatcaattaccctcgcaacgggaccgctcaccaccttatgggagggcagccctggcaaattctggaacaccacgatcgcagtgtctatggcaaatattttcagggggagctaccttgcgggcgccggactagctttcagcctaatgaagtccttggggggcgggagacggggcactggggcccagggcgagactctgggcgagaagtggaagcgccagctgaaccagttatccaagagcgagttcaacacctacaagcggtctgggattatggaggtcgatcgctcggaggcgaaggagggactgaagcgcggggagacgactaagcacgcggtatcccgcggtaccgccaagctgcgatggttcgtcgagcgtaacttggtcaagcctgaagggaaagttatcgatttaggctgcggcaggggcgggtggagctactactgcgccgggctcaaaaaggtgaccgaagttaaaggttacactaagggcgggccaggccacgaggagccaatccctatggccacgtacgggtggaatctggtgaagctacactccggcaaggacgtatttttcatccctcccgaaaagtgcgataccctgctgtgcgatatcggggagtcatcccccaaccccacgattgaggaaggccgaacgctccgggtcttgaagatggtagagccgtggctgcgcgggaaccagttctgcattaagattctaaacccctacatgcccagcgtggtggaaacgctggaacagatgcagcggaaacacggtggaatgttggtccggaatcccttgtccaggaacagcactcacgagatgtattgggtgagctgcgggaccggtaacatcgtctcggcggtgaacatgacatcccgtatgcttctcaatcggttcaccatggcccatagaaagccaacctacgaacgagacgttgatctcggggcgggcaccaggcacgtcgccgtggagccggaggtggccaacctggacatcatcgggcagcgcattgagaacatcaagcatgaacataagagcacttggcattacgacgaggataacccatataagacatgggcgtaccacggctcgtacgaggtgaagcccagcggatcggcctcctctatggtgaatggggtcgttaaactactcaccaagccatgggacgtcatccccatggtcacgcagatagccatgactgacacgaccccattcggccaacaacgggtctttaaagagaaagtcgatacgcgtacccccaaagccaagcgggggacggcgcagatcatggaggtcaccgcgaagtggctgtgggggtttctctcccggaacaagaagccgagaatctgtacgcgcgaagagttcacccggaaagtgcggagcaacgccgccatcggtgctgtgttcgtcgacgaaaaccaatggaactccgcgaaagaggccgtggaagacgagcggttttgggacctggtgcaccgcgagcgggagctgcacaagcaggggaagtgcgccacgtgcgtctataacatgatgggcaagagagagaagaaactgggagagttcggaaaagccaaaggctcacgcgccatctggtacatgtggctaggcgcgcgcttcctggagttcgaggccctgggcttcatgaacgaggaccattggttctctcgggagaacagcctctccggggtggagggcgagggcttacataagctaggatacatccttcgcgacatcagcaagatccccgggggcaacatgtacgccgacgacaccgcaggatgggacacccggatcaccgaggacgacctacagaatgaggccaagatcacggacataatggagccagagcatgcgctactcgccaagagtatcttcaagctgacctaccagaacaaggtggtccgtgtccagagaccggccaagaacggcaccgtcatggatgtgatcagccgaagagatcagcgtggctctggacaggtgggcacctatggcctgaatacgttcaccaatatggaggcccaactaatccgccagatggagagcgagggaatcttctccccgtctgagctggagacccccaacctggcgggccgggtgctcgactggctggagaagcacggcgtcgagcgcttgaagcggatggcgataagcggtgatgactgcgtggtcaagcccattgacgatagattcgctaccgccctcacggccctgaacgacatggggaaagttcgcaaagatatcccacagtgggagcccagcaaaggctggaatgactggcagcaggtccccttctgcagccaccactttcatcaactcattatgaaggacgggcgcgagatcgtggtcccgtgccggaaccaggacgagctagtgggtcgcgccagggtgtcccagggagcgggttggagcctgcgcgacacggcctgcttagggaagtcctatgcacagatgtggcagctcatgtactttcaccggcgcgacctccgcctggccgctaatgccatctgttcagccgtcccagtggactgggtgcccacctcccgcaccacgtggtcgatacacgcccaccaccagtggatgaccacggaggacatgctctccgtttggaaccgtgtatggattgaagagaacccgtggatggaagacaagacccacataagctcgtggggcgacgttccctacctgggcaagcgcgaggaccagtggtgtggcagcttaatcgggctaacagcccgtgcaacctgggccaccaacatccaggtcgccatcaatcaggtgcgccgcctgatcggaaatgaaaactaccttgactacatgacctcaatgaaaaggttcaagaatgagtccgacccggagggggccctctggtga

SEQ ID NO: 24532 - RNA, 9879 nt, synthetic construct
  misc_feature 1..9879: note = derived and/or modified CDS sequence (opt11) from DENV-1__EU249494__SS-prME
  source 1..9879: mol_type = other RNA
tctgtgaccatgctgcttatgctgatgcccaccgctctagcgttccacctgaccaccagaggcggcgagccccatatgatcgttactaagcaggagcggggaaaatcgctgctgtttaagacaagcgctggtgtgaacatgtgcactttgatcgccatggacctgggcgagctgtgcgaagacaccatgacttacaagtgcccccggataaccgaggcggagccagacgacgtggactgctggtgcaacgcaaccgatacctgggtcacctacgggacctgcagccagacgggcgagcatcgtcgtgacaagcggagcgttgcgcttgcaccccacgtgggactgggtctcgaaactaggacggagacttggatgtcaagcgagggcgcatggaagcagatccagcgggtggaaacttgggccctccgacatcccggattcaccgtgattgctttgttcctggcgcacgccatcggaacttccatcacccagaagggtatcatctttatcttactgatgctggtgactccttccatggcgatgcgatgtgtcggcatcggaagtcgcgacttcgtagagggactgtcaggagccacatgggtggacgtcgttctggagcacgggtcctgtgtgacaactatggctaaggataaaccaactctggacatcgagctcctgaagaccgaggtcacaaaccccgccgttctgcggaagctatgcatagaggcaaagataagcaacaccacaacagactcccgctgtccgacacagggcgaggccactttgatggaggaacaggacgcaaacttcgtgtgccggcgcacattcgtcgatagaggctggggtaacggatgcgggctcttcggaaagggctcgctcatcacgtgcgccaaatttaagtgtgttactaagctggagggtaagatcgtgcagtacgaaaacctgaagtattccgtcatcgtgaccgtgcacacaggcgatcagcatcaggtcgggaacgagagcaccgaacacggcaccactgctacgatcacgccacaggcacccaccagcgagatccagttaacagactatggggcccttacgctggactgcagtccacgcacggggctagatttcaacgagatggtgctgctcaccatgaaggaaaagtcctggctcgtacacaagcaatggttcctggacttaccgcttccctggaccagcggggccagcaccagtcaggagacgtggaaccggcaagacctgctggtgacctttaagactgcacacgcgaagaagcaggaagttgtcgtgctcggctcacaggagggtgccatgcacaccgccctgacaggggccacggagatccaaactagcggcacgacaacgatctttgccggtcatcttaagtgccgcctcaaaatggataagttgaccttaaagggcatgagctatgtgatgtgtaccggttccttcaaactcgagaaggaggtcgcggagacgcagcacggcaccgtgctggttcagatcaaatatgagggcaccgacgccccgtgcaagatcccctttagcacacaggacgaaaagggggtcacgcagaacggcagactgatcaccgccaatccgattgtgacagacaaggagaagcccgtgaacatcgaggcggagccgcccttcggggagtcctacatcgtcatcggcgcaggcgagaaggccctgaagctttcgtggtttaagaagggatccagtattggcaaaatgttcgaggccacggcacgaggggcacggaggatggcgatacttggcgacacggcctgggatttcgggtccatcggcggtgtatttaccagcgtggggaaactggtccatcaaatatttggaactgcctatggggtcttattctccggtgtgagctggaccatgaagatcgggatcggagtcctgctgacttggctcggcctgaactcacgcagcacatcgctgagcatgacctgcatcgccgttgggctcgtgaccctgtacttgggcgcaatggtccaggccgattccggttgcgtgatcaattggaagggccgtgagcttaagtgcggatcaggcatcttcgtgacgaacgaggtccacacctggaccgagcagtataagttccaggcagacagcccgaaacgcctgtctgccgcgatcggcaaggcctgggaagagggggtgtgcggtatacggtcagccacccgcctggagaacatcatgtggaagcagatttcgaacgagctcaatcatatcttactcgagaacgacatgaagtttaccgtggtcgtcggggacgtggttggcatcctagcccagggtaagaagatgatcagaccacaaccgatggagcacaaatacagctggaagtcctggggaaaggcaaagattatcggagccgacgtgcagaacacgaccttcatcattgacgggcccaacaccccggagtgccccgacgatcaacgcgcgtggaatatctgggaggtggaggactacggctttgggatcttcaccacaaatatctggcttaagctgcgggatagctatacccaggtttgcgaccatcgcctcatgagtgcggccataaaggacagtaaggccgtgcacgctgacatgggctactggatcgagtccgagaagaacgagacctggaagctggcgagagctagcttcattgaggtcaaaacctgcatctggcccaaatcccacacgctatggagcaacggagtcctcgagtccgagatgatcatccccaagatctatggaggccctatctctcagcacaactaccgcccggggtatttcacacagaccgcaggcccttggcatttagggaagctggagctcgacttcgacctgtgcgagggcaccaccgtagtggtcgacgagcactgcgggaaccgcggtccgagtcttcgcaccactacagtgactggcaagataatccacgagtggtgttgtcggagctgcaccctacctcccctccggttcaagggggaagatggctgctggtacgggatggaaatcagacccgtgaaagagaaggaagagaatttggtaaaaagcatggtaagcgccgggagcggcgaagtagactccttcagcttggggctgttgtgcatctccattatgatcgaggaggtgatgagaagccggtggtctcgcaagatgctcatgacgggaaccctggccgtgttcttactactcatcatgggccagctgacgtggaatgatctcatccggctgtgcattatggtgggtgcgaatgcttccgatcgcatggggatgggcaccacctacctggcactcatggccacctttaagatgcgtccgatgtttgccgtgggactgttattccggcgcctcacgagtcgggaggtgctattactcactatcggtctgagcctggtagcgtccgtcgagctccctaactctctggaggaattaggcgacgggttggcgatgggcatcatgattctaaagctgctcaccgactttcagagtcaccagctatgggccacactcctcagcctgacgttcatcaagaccaccctgtcactccattacgcctggaaaaccatggcaatggtgctgtccatcgtttccctgtttcccctctgcctttcaactaccagtcagaagacgacatggctgcctgtactcctgggcagcctagggtgcaagcctctcaccatgttcttaattgctgaaaacaagatttggggccgcaaaagttggcccctcaacgaaggaatcatggccgtcggtgtcgtaagtatcctcttgagcagcctgctcaaaaacgacgtgccattagctgggccactgattgccggcggcatgctcatcgcatgctacgtcatctcgggttcaagcgctgacctctccctcgagaaagcagccgaggtgagctgggaagaggaggccgaacattccggcgccagccacaacattctcgtggaggtccaggatgacgggaccatgaagatcaaggacgaggagagagatgacactctgaccatcctcctcaaggccacccttctggccgtttccggcgtctacccactcagcatcccggcaacgctgttcgtctggtacttctggcagaagaagaagcagcgctccggggttctttgggacaccccgagcccgcccgaggtagaacgggccgtcctagacgacggcatctaccgcataatgcagcggggactcctcgggcgctcccaggtgggcgtgggagtattccaggagaatgtgttccataccatgtggcacgtgacgcggggcgcggtcctcatgtaccaggggaagcgcctcgagcccagttgggcgtccgttaagaaggacctgatcagctacggcggcgggtggcggctgcagggcagttggaatacgggggaggaggttcaggtcatagccgtggaacccggcaagaatccaaagaacgtgcagaccgctcccggtacctttaagacccccgaaggggaggtaggcgccatcgcccttgacttcaagcccggcacgagcggctcccccatcgttaaccgagaggggaaaatagtcggactgtacggcaatggggtcgtgaccacgtccggaacctacgtgagcgctattgcgcaggccaaagcgtcgcaggaggggccgctacccgagatcgaggacgaggtcttcaggaagaggaacctcacgatcatggacttgcacccagggagcggcaagacaaggcgctaccttcctgccatcgtgcgggaggccataaagcgcaagctccgtacgctgatcctcgcgcccactcgcgtggtagcgtccgaaatggcagaggcattaaagggaatgcccatccgctatcaaaccactgctgtcaagtccgaacacaccggaaaagagatagtggacttaatgtgccatgcaacgttcacgatgcggttactctcccccgtccgcgtgccgaactacaatatgatcatcatggacgaggcccacttcactgaccctagctccatagcggccagagggtacatcagcacccgcgtcggcatgggggaagccgcggccatcttcatgaccgctacgccaccaggctctgtcgaggcgttccctcagagcaacgcagtgatccaggacgaggagagagatattcctgagcggtcctggaacagcgggtatgagtggatcaccgactttccgggcaagaccgtctggttcgtaccgtccatcaagagcggcaacgatatagcgaattgccttcgaaagaacgggaagcgcgtgatccagctcagccggaagaccttcgacacggagtaccagaaaaccaaaaataacgattgggactacgtcgtaacaacagatatatcggagatgggcgcgaacttccgtgccgaccgagtgatcgaccctcgccgatgcctcaaaccggtgatcctgaaggacgggcccgagcgagtcatcctggccggcccaatgcctgtgacggtcgcctccgccgcgcagaggcgagggcggatcggtcggaaccacaataaggagggcgaccagtacatttacatggggcaacccctaaacaacgacgaggatcacgcccactggaccgaagccaagatgctgctggacaacatcaacaccccagagggcattatccccgcactcttcgaaccggagcgcgagaagtccgccgcgatcgacggggagtatcgcctacggggcgaggcccggaagaccttcgttgagctgatgcgccgaggagatctccccgtgtggttgtcttataaggtagccagcgaagggtttcagtatagcgatagacggtggtgcttcgacggagaaaggaacaaccaggtgctggaggaaaacatggacgtggagatctggacgaaggaaggagagcggaagaagctccgcccccggtggcttgacgcccgcacgtattccgaccccctggctcttcgggagttcaaggaatttgcagctggccgtcgaagcgtgtccggggacctgatcctggagatcggaaagctcccccaacatcttacccaaagggcacaaaacgcgttggacaacctggtgatgctgcataactcagagcaaggtggcagggcgtatcgccatgccatggaggagctgccagacaccattgagacgctaatgttgctggcccttatcgcggtcctgaccggcggggtcaccctattcttcttgtctgggcgggggctgggcaagacgagcatcgggctgctctgtgtcatggcctccagcgtgctgctttggatggcgagcgtggagccccattggattgcagcctccatcatactcgagttttttttaatggtcctgctcatccccgagccggaccgccagcggacgccccaggacaaccaactagcctacgtcgtcataggcctcctcttcatgatcctgacggttgcagcgaacgagatgggcctgctagagaccaccaagaaagacctgggaataggacacgtggccgttgagaaccaccaccacgccaccatgttagatgtggacttacaccccgcttccgcctggacgctgtacgctgtggccaccaccatcatcacccccatgatgcgccacacgatcgagaataccaccgcgaacatcagcttgaccgcgattgccaaccaagccgccattctcatggggctggacaagggctggccgatctccaagatggacatcggagtaccactgctcgccttggggtgctactcacaggtgaaccccctcacgctgacggcagcggtgctgatgctggtggcgcactacgccatcataggcccggggctacaagcaaaggccactcgggaggcacagaagcgcacagccgccgggattatgaaaaatcccacggtggacgggatcgtggcgatagatctggacccagtcgtctacgacgccaagttcgagaagcagctaggccagatcatgctattgatcttgtgcacgtctcaaatcctccttatgcgaaccacctgggcgctgtgtgaaagcatcacgctggctacgggacccctgaccacgctttgggaggggtcccccggcaagttctggaacacaacaatcgccgtgagcatggccaacatcttcagagggagctatcttgccggcgctgggctggcctttagcctgatgaagagtttgggtggcgggcgccggggaaccggcgcccagggggagaccctgggggaaaagtggaaacgccaactgaaccaactctccaagtcggagttcaacatctacaagagaagcgggatcatggaggtcgaccgcagcgaggccaaggagggcttaaagaggggagagacgacccgccacgcggtttcccggggcaccgcgaagctgagatggttcgtggagcggaaccttgtcaagcccgaggggaaagtaatagacctaggttgtggccgcggtggctggagttactattgcgccgggttaaagaaagtgaccgaggtgaagggctacacgaagggcggtccgggccacgaggagcccatcccgatggccacatatgggtggaatttagtgaaactacattccggcaaagatgtgttcttcacgccgcccgagaagtgtgacacattgctgtgcgacattggggagagttccccgaatccgacgatcgaggagggccggaccctccgcgtcctgaaaatggtcgagccctggctgagaggaaatcaattctgtattaaaattctcaacccatatatgcccagcgtggttgagaccttggagcagatgcagcgcaagcacggcggaatgctggtgcggaacccgctctccaggaatagcacccacgagatgtactgggtgtcctgcgggaccggcaacatcgttagcgccgtcaacatgacatcgcgtatgcttcttaaccgcttcaccatggcgcacaggaagcctacctacgagcgggacgtggacttaggggccggaacacgccacgtcgccgtagagcccgaagtagccaacttggacattatcggccagcggatcgagaacatcaagcacgagcacaaatcgacctggcactacgatgaggacaatccctacaagacatgggcctatcacgggtcctatgaagtcaaaccgagcggcagcgcgagctccatggtgaacggtgtcgtgaagctcctgaccaagccctgggacgtgatccccatggtcacccaaattgccatgacagacaccaccccgttcggacagcagcgagtgttcaaggaaaaggtcgatacccggacgccgaaggccaagcgcgggactgcacaaattatggaagtgaccgcccgttggctgtggggcttcctgtcccgcaataagaagccccggatctgcacccgcgaggagttcacgcgcaaggtgcgatccaacgctgccatcggcgccgtgttcgtcgatgagaaccagtggaactccgccaaggaggcggtggaggacgagcggttctgggaccttgtccagaaagagcgtgagctgcataagcaggggaagtgtgcaacatgtgtctataatatgatgggaaagagagaaaagaagttaggagagttcgggaaggctaaggggagccgcgccatctggtacatgtggttgggcgcccggttcttagagttcgaagcgctgggcttcatgaacgaggaccactggttctcccgcgagaatagcttgagtggggtggagggcgaaggactgcacaaactgggatatattctgcgggacatatctaaaatacctgggggcaacatgtatgcggacgacaccgccggctgggacacacgtatcacggaggacgatctgcagaatgaggccaagatcaccgatatcatggaaccggaacatgcgttactggcgactagcatctttaagttgacctatcaaaacaaggtcgttcgggtgcaaaggccggccaagaacggcacggtgatggatgtgattagccgccgggatcagcggggcagtggccaggtgggcacctacggtctgaacaccttcaccaacatggaggcacagctaatccggcaaatggagagtgaggggatcttctcccccagcgaactggagatccccaacctggcggagcgggtattggattggctggagaagtacggcgtagagcgactcaagcgcatggccatctcaggggacgattgcgtcgtgaagccgattgacgacagatttgcgacggccttgaccgcgctgaatgatatggggaaggtacgaaaggacgtgcctcagtgggaacccagcaagggatggaacgactggcagcaagtccccttttgcagtcaccactttcaccagttaatcatgaaggacgggcgcgagatcgtcgttccgtgtcggaaccaggacgagctcgttggccgggcccgcgtcagccaaggggccggctggagcctgcgggagacagcgtgcctgggtaagtcctacgcccaaatgtggcagctcatgtatttccaccgccgggatctgcgcctggccgccaacgcgatatgttccgctgtgcccgtagactgggtccccacgtcccgaacgacctggagcattcacgcccaccaccaatggatgacgaccgaggacatgctatcagtgtggaaccgtgtttggattgaggagaacccttggatggaggataagacgcacgttagctcctggggcgacgtgccctacctgggtaagcgagaagatcagtggtgcggcagcctgattggcctgaccgcccgcgctacctgggccagcaatatccaggtggccattaaccaggtccgacgccttatcggaaatgaaaattatctagactgcatgaccagcatgaagcgattcaaaaacgagggcgatcccgagggagccctctggtga

SEQ ID NO: 24533 - RNA, 9879 nt, synthetic construct
  misc_feature 1..9879: note = derived and/or modified CDS sequence (opt11) from DENV-1__EU249495__SS-prME
  source 1..9879: mol_type = other RNA
tccgtgactatgctgctaatgctaatgccaacagcgctagcattccatctcacaaccagaggaggtgaaccccatatgatagtcactaaacaagaaagaggtaaaagcctactatttaaaaccactgccggagtgaacatgtgcactttaatcgcaatggatctcggagaactatgcgaagacacaatgacgtacaagtgtccaaggataacggaagctgaacccgatgacgtcgactgttggtgcaacgcaaccgacacctgggtcacgtacggaacctgctcgcaaacaggggaacaccgacgagataaacggtcagtagcactcgctccccatgtagggctgggccttgaaacacgaacagaaacatggatgtcaagcgaaggggcctggaagcaaatacaaagggtggagacctgggccctacgccacccaggatttaccgtgatagcattattcttagcccatgccatcggaacatctataacccaaaaagggatcatattcatcctgctaatgctagtaacccctagtatggcaatgcgatgcgtaggcatcgggagccgcgacttcgtcgaaggactctctggcgccacatgggtagacgtagtactcgaacacggtagttgcgtaacgactatggcgaaagacaaaccgaccctcgacatcgagctactcaaaacggaagtaaccaacccggccgtcctccggaaactgtgcatcgaggcaaaaataagcaacacgacgacagattctcgctgtccaacacaaggtgaggcgacacttatggaggagcaagatgcaaactttgtatgccgtcgcaccttcgtagacaggggatggggcaacggatgcgggctattcggcaagggcagcttgataacatgcgccaagttcaagtgcgtaacaaagctcgaggggaaaatcgtccaatatgaaaacttaaagtatagcgttatcgtcacggttcataccggtgaccaacaccaagttggtaatgaaagcacagaacacgggacgacggccacgataacgccgcaagcgcctacctcagaaatccaacttaccgactacggcgctctgaccttagactgctcgccacgaactgggctagactttaacgaaatggttctcctaacaatgaaagagaagtcttggctcgtccataaacaatggttcctggacctccctctcccttggacaagcggagcgtcgactagccaagagacctggaaccgacaagatctcctcgtcacatttaaaaccgcccatgcgaagaaacaagaagtcgtggtcctgggctcacaagagggcgcaatgcacaccgccctcacaggcgcaacagaaatacaaaccagcggcacaacgaccatcttcgctggacacctaaagtgccggctcaagatggacaaactcacattgaagggcatgtcctatgtgatgtgcacggggtccttcaagctcgaaaaggaagtagcagagacccaacacgggaccgtgctcgtgcaaatcaagtatgagggcaccgacgctccctgcaaaatccctttctcaacccaagacgaaaaaggcgtaattcagaatggaaggctgatcaccgccaacccgatcgtgacggacaaggagaaaccagtaaatattgaggcggagccaccgttcggtgaatcgtatatagtaataggcgtgggagagaaagctcttaaactaagttggttcaagaaaggcagcagcattgggaagatgttcgaagctacggcgcggggcgcgagacgcatggcgatcctaggagatacggcatgggattttggtagcataggtggggtgttcactagcgtcggcaaattggtgcaccagatattcggaaccgcatacggcgtgctattctccggcgtaagctggaccatgaaaatagggataggagtactattgacctggctcggattgaacagcaggagtactagcttaagtatgacgtgcatcgcagtagggctggttaccctatacctgggtgtcatggttcaagctgacagcggctgcgtaatcaactggaagggccgcgaacttaaatgtggcagtggcatcttcgtaaccaacgaggtccacacatggacagaacagtacaaattccaggcggattcacccaaacgcttgtcagccgccatcggcaaggcttgggaggagggcgtctgtgggatacgcagcgcaaccagattggaaaacataatgtggaaacaaatcagcaatgaattaaatcatatactactagagaatgatatgaagtttaccgtcgtagtgggggatgtggtaggcatcctggcacagggaaagaagatgataagaccgcaacccatggagcataagtactcatggaaatcatggggcaaagcgaaaataataggggccgatgtgcagaatacgacatttataatcgacggcccaaacacgcccgagtgcccagacgaccaacgggcttggaacatatgggaagtggaagactatggttttggaattttcaccacaaatatatggctaaagctaagagactcgtacactcaggcttgcgaccaccgtctgatgtccgcggccataaaggacagcaaagcggtacacgcagatatggggtattggatagagtccgagaaaaatgagacatggaaattagcgcgggcgagcttcatagaggtaaagacctgcatctggccaaagtcacacacactgtggagtaacggagtgttggaaagcgaaatggtaatccccaaaatctacggcgggcccatcagccagcacaactacaggccagggtattttacgcaaacggcagggccctggcacctcggaaaactcgaactggacttcgacctttgcgaagggaccacagtagtggtcgacgagcactgcgggaaccgcggcccatccctacggacaacgacagtaacagggaaaataatacatgaatggtgctgcaggtcctgcactctcccaccactacggttcaagggagaagacggatgttggtacggaatggaaatccgacccgtaaaagaaaaggaagagaaccttgtcaaaagtatggtgagcgcgggcagcggagaagtagatagcttttctctggggctcctctgcatcagcatcatgatagaagaagtaatgcgttccaggtggagtaggaaaatgctaatgaccggaacactcgcggtatttctccttctcatcatgggccaactaacgtggaacgacctaatacggttgtgcattatggttggcgcaaatgcgtcagataggatggggatggggacaacatacctagcgctaatggcgacgttcaagatgcgccccatgtttgcggtgggcctcttgttcaggcgattgacgtcgcgggaggtccttctcctcactataggactcagtctagtcgctagcgtggaacttcccaactcactggaagaactcggggacgggttagctatggggataatgatcctaaaacttctaaccgacttccaatcccaccagttatgggcaacgctcctctcgctgacattcataaagacgacactgagtttgcactacgcatggaaaaccatggccatggttctaagcattgtttcactcttcccgctatgcttatctaccacctcgcaaaagactacctggcttcccgtactgttaggctcccttggctgcaaaccgttaacaatgttcctgatcgcagaaaacaaaatctggggcaggaaatcttggcctctaaacgaaggaataatggccgtcggggtggtgtcaatactcctcagcagcctcctcaaaaacgacgtgcccctagcaggacccctaatagcgggaggaatgctcatcgcgtgttacgtaatcagtggatcctcagccgacctaagcctggaaaaagccgcagaagtttcttgggaagaagaagcagaacacagcggagcatcgcacaatatattggtagaagtccaggacgacggcaccatgaagataaaagatgaagaacgagacgacacgctgaccatcctgttaaaggcaaccctcctagcagtctctggagtatacccccttagtatccccgcgaccctctttgtgtggtacttttggcagaagaagaaacaacgatcaggtgtactatgggacacccccagcccaccggaagtagaaagggccgtccttgacgacgggatatacagaataatgcaacgcggcctcctaggaaggtctcaggtgggagtaggggtgttccaggaaaacgttttccacaccatgtggcacgtcacccgcggggcagtactgatgtaccagggaaaaagactagagccatcgtgggcctcagtcaagaaagacttaatatcctatggcggtggctggaggctacaaggctcttggaacacaggagaggaagtccaggtgatagctgtcgaacccggcaaaaaccccaaaaacgtccagacagcacctgggacctttaaaactccagaaggggaggtgggtgcgatcgccctcgatttcaaacccggcaccagcggctccccaatagttaacagagaaggcaagatagtaggcctttacggcaatggcgtcgtgacaacatcgggcacctacgtctctgccattgcgcaagcgaaagccagtcaagagggaccgctccctgagatagaagacgaggtattccgaaaacgaaacctaaccattatggacctacatccaggaagcggaaaaacaagacgatacttacccgccatagtgagggaagcaattaagcgcaagctcaggacactcatactagcgcccacgcgtgtagtcgcatccgagatggcggaggcgctcaagggcatgccgataagatatcagaccaccgctgtaaaaagcgagcatacgggcaaggaaatcgtcgacctcatgtgccatgccacattcaccatgcgactactatcgccagtccgagtcccgaactacaacatgatcatcatggacgaggcccactttacagacccgtcatcaatcgctgcacgcggctatatatcaaccagagttggaatgggggaggccgctgcaatcttcatgacagcgacgcctccggggagtgtggaggcttttccacagagtaacgcagtcattcaagatgaggaacgagatatcccagaaaggagctggaactcgggatacgagtggattactgacttcccgggcaaaactgtctggtttgtcccgagcataaagtcaggtaacgacatcgccaactgtttacggaagaacgggaaaagggtcatacaactcagccgaaaaaccttcgatacggaatatcagaaaaccaaaaacaacgactgggactacgtagtcaccactgatatcagtgaaatgggcgccaactttcgagccgacagagtgatcgacccccgtcggtgcctaaaaccagtaatattgaaagacgggccggagagagtcatacttgcgggaccgatgcccgtaaccgtagcatccgcggcccaacgtcgcgggcgaattggccgcaatcacaacaaagagggagaccagtacatatacatgggccagcccctaaacaacgacgaagaccatgctcactggaccgaggcgaaaatgctcctggataatatcaacacgcccgaggggataatccccgcactctttgaaccggagcgcgaaaaatccgcagctatcgacggcgagtacaggctgcgcggcgaggcgaggaaaacatttgtcgagctaatgcgccggggagacctgcccgtctggttgagttacaaagtagccagcgaaggatttcaatacagcgacagaaggtggtgcttcgacggagaaagaaacaaccaggtactcgaggaaaatatggacgtagagatatggacaaaagagggggaacgaaagaaactccgaccacgctggcttgacgcgcgaacatacagcgacccgttggccctgcgagaatttaaagagttcgccgcgggccgacgcagcgtaagcggcgacctaatactagaaattgggaagctgccacaacatctcacgcaacgcgcacagaatgccctggacaacctagtgatgttgcacaactccgaacaaggtggaagggcatataggcatgccatggaggaattacccgatacgattgaaactttaatgctattggcattaatagcagtgctgaccgggggagtcacactattcttcttatcaggacgaggtctggggaaaacatccatcggactgctatgcgtcatggctagctcagtccttctatggatggccagtgtcgaaccccactggatagcggcgagtatcatactagagttcttcctaatggtactcctcatccccgaacccgaccgccaaaggacgccacaagataatcaacttgcgtatgtggtaatcggcctactgttcatgatcttaaccgtcgccgccaacgagatggggctcctcgaaacgacgaaaaaggacctgggaatcggacacgttgctgtggaaaatcaccatcatgccacaatgctagacgtagacctacacccagcctctgcgtggaccctgtacgcagtggcgacaacgataatcacacccatgatgaggcataccatcgagaacactacagccaacatttcgctgacggcgatcgcgaaccaggccgcgatcctgatgggacttgacaaaggatggccaatctccaagatggacataggcgtaccattgctggcccttggatgctattcgcaagtcaacccgctgacgctaacagccgcagtgctcatgcttgtggctcactatgctatcatagggcccggtctgcaagccaaggcgacacgcgaggcccagaaaaggacggccgcgggcatcatgaaaaaccccactgtggatggaatagtagctatagaccttgaccccgtcgtctacgacgccaagtttgaaaaacaactgggacagatcatgctccttatattatgtacgagccaaattctcttgatgcgaacaacatgggcgctctgcgaaagcataaccttggctacagggccgctcacgacgttatgggaaggcagtccaggcaaattctggaatacaacaatagccgtcagcatggccaacatctttagaggatcatacctggccggagcggggttggccttctccctgatgaagtctttaggaggcgggaggcgaggaaccggcgcccaaggagagacactaggcgaaaaatggaagcgacaactaaaccagctatcaaagtcagagttcaacatatacaaacgatccggaatcatggaagtagaccgctccgaagcaaaagaaggactaaagagaggggaaacgacccgccacgcagtctcgcgcggcacagcaaagctacgttggttcgtagaaaggaacttagtgaagcccgaggggaaggtgatagacttaggatgcggtcggggagggtggtcgtattattgcgcagggctgaaaaaggtgaccgaggtcaagggctacaccaaaggcgggccaggacacgaagaaccaatacctatggcaacatacggatggaacctagtgaaactccattcgggcaaagatgtcttctttacccctcccgagaaatgtgacactctattatgcgatattggagaaagcagcccaaacccaaccatagaagagggcagaaccctgagggtgctgaaaatggtggaaccatggcttcgcggaaaccaattctgcatcaagatcctaaacccatacatgccaagtgtcgttgagacattggagcagatgcaacgcaaacacggcggcatgctagtacgtaaccccctaagcagaaacagcacccatgaaatgtactgggtgtcatgcggcacaggaaacatcgttagcgcagtcaatatgacatcacgcatgttacttaatagattcactatggcccaccgtaaaccaacctacgaacgagatgtcgatttgggagcaggcactcggcatgtagccgtagaaccggaggtcgcgaatttggatataatcggccagcgaatagaaaacataaaacatgaacacaaatccacttggcactacgacgaggacaacccgtacaagacctgggcgtaccacggctcatacgaggtcaagccctcaggctcagcgtccagtatggtcaacggcgtcgttaagttactcacgaagccgtgggacgtaatcccgatggtgacccagatagcgatgaccgatacgacaccattcggacagcaaagggtgtttaaagaaaaggtggacacacgaaccccgaaagccaaacgaggaacagcgcaaatcatggaagttacagcccgctggctatggggatttctaagccgaaacaagaaaccgcgaatctgcaccagggaagaatttacacgcaaagtaagatcaaacgcggccataggcgccgtcttcgtcgatgagaaccaatggaacagcgccaaagaagcggtcgaagacgaacgcttctgggacctagtacaaaaagaacgcgaacttcacaaacaaggaaagtgcgccacatgtgtgtacaacatgatgggcaaaagggagaagaaactgggcgagttcggcaaagcaaaagggagccgtgcaatatggtacatgtggctgggcgcccgctttcttgaatttgaagccttaggatttatgaacgaagaccactggttttcacgagagaactcgctttccggcgtggagggtgagggcctgcacaaactcgggtatatactcagggacatcagcaagatccccggcgggaacatgtacgccgacgacacagcaggatgggacacccgcatcacagaagacgatctccaaaacgaggcgaagatcaccgacattatggagcctgaacatgcactactagcaacgagcattttcaaacttacctaccaaaacaaagtggtccgtgtccaacgacctgccaaaaatggcacagtgatggacgtaataagccgccgtgaccagaggggtagcggacaggtaggaacctacggactaaatacatttaccaacatggaagcacagctaatacgacaaatggaatcagaggggattttcctgccgagcgaacttgagacaccgaatctggcagaaagggtgctcgactggttagagaagcacggggtcgagcggctcaaacgcatggccataagcggagacgactgtgtcgtcaaacccatagacgaccgtttcgcgacggctctcactgcgctgaacgacatggggaaggtacggaaagacatcccacaatgggagccatcgaaaggatggaacgactggcagcaagtcccgttctgttcgcatcacttccaccaacttataatgaaagacggtcgcgaaatagtggtaccctgccgaaaccaggacgagctggtaggccgggctagggtctcacaaggcgcgggctggtccctcagagaaaccgcgtgccttggcaagtcgtacgcgcaaatgtggcaactaatgtatttccacagaagagacctacgtctagccgcgaacgccatctgtagcgcagttccagtcgactgggttcccacttccaggaccacgtggtcaatccacgcacatcaccaatggatgacaacagaggatatgttgtcggtatggaaccgcgtatggatcgaggaaaacccctggatggaagacaaaacccacgtaagctcttggggagacgttccctacctaggaaaaagagaggaccaatggtgcgggtccttaataggcttaacagcacgtgccacatgggccagcaatatccaagtagcaataaaccaggtaagaagattaatcggcaacgaaaattacttagactacatgacgtccatgaaaaggttcaagaacgaaggggacccggagggcgccttgtggtaa

SEQ ID NO: 24534 - RNA, 9879 nt, synthetic construct
  misc_feature 1..9879: note = derived and/or modified CDS sequence (opt11) from DENV-1__EU482794__SS-prME
  source 1..9879: mol_type = other RNA
agcgtgacaatgttattaatgctgatgcctaccgccctggcattccatctaaccacccggggcggtgagccccacatgatcgtgacgaagcaggagcggggcaagagcctgctgttcaagaccagcgcgggggtgaacatgtgcactctaattgccatggacctgggcgagctgtgcgaggacaccatgacctacaaatgcccccggatcacagaggccgagcccgacgacgtggactgctggtgtaacgcgaccgatacctgggtcacctacgggacctgttcacagacgggcgaacatcggcgggacaagcggagcgtggccctggcgccccatgtaggactggggctagagacccgcaccgagacctggatgtcgagcgagggtgcctggaagcagatccagcgtgtcgaaacgtgggcgctccgccaccccgggtttacggtgatcgccctgtttcttgctcacgccataggcacctccattacacagaagggaatcattttcatcctcttaatgctggtgacgcccagcatggccatgcggtgcgtaggcatcggctcccgcgatttcgtggaggggttgtcgggggccacgtgggtggacgtggttcttgagcacggctcctgcgtgaccaccatggccaaggataagccaacgctggacatcgagctactaaagaccgaggtaaccaaccccgcggtgctgcggaagctctgcatcgaggccaaaatcagcaacaccactaccgactcacgctgccccacccaaggcgaggctaccctgatggaggagcaagatgcaaacttcgtttgccggcgcacgttcgtcgacaggggctgggggaacggctgcgggctatttgggaaggggagtttgatcacgtgcgccaaatttaagtgcgtgaccaagctggagggtaaaatcgtgcagtacgagaaccttaagtactccgtcatcgtcactgtgcatacgggcgaccagcaccaggtcgggaatgagtcgacggagcacgggaccaccgccaccattacgccccaggcacccacttccgagatccagctcaccgactacggcgcgctgactctggactgcagcccacgaaccgggctcgacttcaacgagatggtattacttaccatgaaagagaagtcctggctcgtccacaaacagtggttcctggatctaccgctcccctggacgtccggggcatctacctcccaggagacttggaatcgtcaggacttgctggtgaccttcaagaccgcgcacgcgaagaaacaggaggttgtcgtgctcggcagccaggagggcgccatgcacacggccctcacaggggccacggagatccagacgtccggaaccaccacaatcttcgccgggcacctgaagtgccgcctcaagatggataagctgaccctgaagggcatgagctacgtcatgtgcaccggttcatttaagctggagaaagaggtcgcggaaacgcaacatggcacagtgctcgtgcaaatcaaatacgagggcaccgacgccccctgcaagatccccttttccacacaggacgagaaaggagttacgcagaacgggcggctgatcacggccaatcctatagttaccgacaaagagaaacccgtgaacatcgaggccgagccgcccttcggggagtcatacatcgtcataggagcgggcgagaaagccctgaagctcagctggttcaagaaggggtcctcgatcggcaagatgttcgaagccacagcccggggggcccggaggatggcgattctgggggatacggcatgggacttcgggtccgtcggcggcgtgttcaccagcgtcggtaagctagtccaccagatcttcggcactgcctacggggtcctgttctctggcgtctcatggaccatgaaaatcgggatcggtgtgctgctgacgtggcttggcctaaattctcgcagcacgtcgctgagcatgacctgcatcgccgtgggcctcgtcactttgtacctgggcgtcatggtccaggccgactccgggtgcgtcatcaattggaagggtcgggagctcaagtgcgggagcggcatcttcgtgacgaacgaggtacacacctggacagaacagtacaagtttcaggcggattctccgaaacgcctgtccgccgccatcggcaaggcgtgggaagagggggtctgcgggatccgaagcgctacccgcctggagaacatcatgtggaaacagatctccaacgagctcaaccacattctgctggagaacgacatgaagttcaccgtggtcgtcggtgacgtggtgggcatcctcgcgcaggggaagaaaatgatccgtccccagcccatggaacacaaatacagctggaagtcctggggcaaggccaagatcatcggtgccgacgtacagaacacgaccttcatcattgacgggcccaacaccccggagtgcccagatgatcagcgagcatggaacatatgggaggtggaggactacggcttcgggatcttcacaacgaacatatggctgaagctacgggacagctacacccaggtgtgcgaccaccgcttgatgtccgcggccatcaaggacagcaaggcagtccacgccgacatgggatactggattgagtccgaaaaaaacgaaacctggaagctggcccgggcgtcatttatcgaggttaaaacttgtatctggcccaagtcccatacgctgtggagcaacggagtactcgagtcagagatgatcatccccaagatctatggtggcccgataagccagcacaactacagacccgggtacttcacgcagaccgctggtccctggcacctagggaagctggagctcgacttcgacctgtgcgagggcactacggtagtggtcgacgagcattgcggcaacagggggccgtccctgcggaccaccaccgtaacgggcaagattatccacgagtggtgctgccgctcgtgcacattgccgcctctccgcttcaagggggaggatggatgctggtacggcatggagatccggcccgtgaaggagaaagaggagaacctggtcaagtccatggtgagcgctggcagcggcgaagtggactctttcagcttagggcttctgtgtatctccatcatgatagaagaggtaatgcgctcaaggtggtcccgtaaaatgctcatgacgggcaccctggctgtgttcctgctcttaattatgggtcagctgacttggaacgacctcatccggctgtgcataatggtgggcgcgaacgctagcgaccgcatggggatgggcaccacgtatctggctctcatggccaccttcaagatgcgcccgatgttcgccgtggggcttctgttccggcgcttaacgtcccgagaggtcttgctgctcaccatcgggctgtccttagtagcctccgtcgagcttcccaacagcttagaggagcttggcgacgggttagcaatgggcatcatgatcctgaagctattaaccgacttccagtcccaccaactgtgggcaaccctactcagcctgacgttcattaagacaactctgtccctgcactacgcatggaagaccatggccatggtgttgtccattgcgtccctgttcccgctgtgcttaagcacaacctcccagaagaccacctggctgccagttctcttaggtagcctgggctgtaaacctctcacgatgttcctgatcaccgagacgaagatctgggggcgtaagtcctggcctctcaatgagggcataatggccgtcggcgtggttagcatcctgctaagctccctgctcaagaacgacgtccccttggccgggcccctgatcgccggcggcatgctcattgcctgctatgtgatcagcgggtccagcgcagacctgtcccttgagaaagccgctgaggtgtcatgggaggaggaggccgagcactccggcgcctctcacaacatcctcgtagtggtgcaagacgacgggaccatgaagatcaaggatgaggagcgggacgacaccttaacgattctgctcaaggcaaccctgttggccgtctctggcgtgtaccccctcagcatcccagccaccctgttcgtgtggtacttctggcagaagaagaagcaacgatctggggtcctgtgggatacccccagcccgcccgaggtggaacgggccgtgcttgatgacgggatctaccgcatcatgcagcgcggcctcctgggcaggtcccaggtcggcgtcggggttttccaggagaacgtcttccacacgatgtggcacgtgacgcggggcgcggtactgatgtaccaggggaagcgccttgagcccagctgggcttccgtcaaaaaggacttaatttcctacggcggcgggtggagattgcaagggtcatggaacaccggggaggaggtacaggtcatcgctgtcgagcccgggaagaaccccaagaatgtgcagaccgccccaggcacgtttaaaacgccagagggagaggttggagccatcgccctggacttcaagccagggacaagcggatctccgatcgtcaaccgcgagggaaagatcgtgggcctctacggcaacggggtggtgaccacgtctggcacctacgttagcgcgatcgctcaagccaaggccagtcaggaagggcctctacccgaaatcgaggacgaggttttccggaagcgcaatctcaccatcatggatctgcaccccgggtcggggaagacccggcgctacctgccggcgatcgtccgagaggccatcaagcgaaaactacggacgctgatcctggcgccgacgcgcgtggttgcctcagagatggccgaagcgctgaaaggcatgcccatacgataccagaccaccgccgtcaagagcgaacatacaggcaaggagatagtggacttaatgtgtcacgccaccttcaccatgcggctgctctcccccgtgcgcgtcccaaactacaatatgattatcatggatgaagcccattttacggaccccagctccatcgccgcgcgggggtatatcagcacgagagtgggcatgggggaggccgccgccatattcatgacagccacgccgccaggatccgtggaggcttttccccagagtaacgccgtcatacaggatgaggaacgggacattcccgaaagatcctggaacagcgggtacgagtggatcaccgatttccccggcaagacggtgtggttcgtgccctccatcaagtcaggcaacgacatcgccaactgtctgcggaagaacgggaagcgcgtcatacagctgagccggaagacgttcgatacggagtaccagaagacgaagaacaacgattgggactacgtggtgactaccgacatctccgagatgggcgcaaacttccgcgcggaccgggtcatcgacccacgccggtgcctcaaacccgtgatcctgaaggacgggcccgaacgtgtcatcctggccggccctatgcctgtgactgtggccagcgcagctcagcgcagggggcggataggacgtaactataacaaggaaggagaccagtacatctatatggggcagccactcaacaacgacgaggaccacgcacactggaccgaggccaagatgctgctggacaatatcaatacgcctgagggcatcatacctgcgcttttcgaaccggaacgggagaagagtgccgccatcgacggggagtaccgcctgcgcggcgaggcgcggaagaccttcgtcgagctgatgcgccgcggcgatctccccgtgtggctatcctataaggtggcgagcgagggattccagtatagcgatcgccggtggtgtttcgatggcgagcgcaacaaccaggtcctggaggagaatatggatgtagaaatatggaccaaggagggggagcgcaaaaaactccggccccggtggttagacgcccgcacctattccgacccgctggccctcagagagtttaaggaattcgcagcgggccgccgttccgtgagcggggacctgatcctggagattggtaagctcccgcagcaccttacgcagcgtgcccagaacgctcttgacaacctcgtaatgctgcacaacagcgagcagggagggcgggcctaccgacacgcaatggaagagcttcctgacactatcgagaccttgatgctgctggccctcattgccgtcctgaccggcggggtgactctgttcttcctctccggccgggggctgggaaaaaccagcatcggactgctctgcgtcatggcctccagcgtgctgctgtggatggcctccgtggagccccactggatcgcggcgagcatcatcctcgagttcttcctcatggtcctgctcatcccggagcctgatcgccaacggacgccccaggacaaccagttggcctacgtggtcatcggtctattgttcatgatcctgaccgtcgccgctaatgagatgggactgctcgagacaacgaagaaggatctcgggatcggccacgttgctgtggagaaccaccatcacgcaaccatgctggacgtagacctgcaccccgcctccgcctggacgttgtacgccgtcgcgactacgatcataaccccgatgatgcgccacaccatagagaacaccacggccaacatcagcttaaccgccattgcgaaccaagctgcgatcctcatggggctagataagggatggccgatctccaagatggacatcggagtccccctgctcgccctggggtgctatagccaggtcaaccccctgaccctaacagctgccgtattgatgctggtagcccactacgcaatcataggcccggggcttcaggcaaaggccacccgcgaggcccagaagcgcaccgcggccggaatcatgaagaaccctaccgtcgacgggatcgtggctatagacctggaccccgtggtctacgacgccaagttcgagaagcagctgggccagatcatgctgctaatcttgtgtacatcgcagatcctcctcatgcgaactacctgggccctgtgcgaatcgatcacgctcgcgaccggcccattgacgaccctctgggaagggtccccgggtaagttctggaacaccaccatcgcggtgtcaatggcaaacatcttcagggggtcctacctagctggcgccggcctggcattcagcctgatgaagtccctcgggggcgggcggcggggcacgggggcccagggcgagaccttaggcgagaagtggaagcgtcagctgaatcagctctccaagagcgagttcaacatctacaagcggtccgggatcatggaggtagatcgtagcgaggccaaggagggcctgaagcgcggggagacaacaaggcacgccgtctcacggggaacggctaagctgcgctggttcgtggagcggaacctggttaagcccgaggggaaggtcattgacctcggctgcggccgcgggggctggtcttactactgcgccgggttgaagaaagtgactgaggtgaagggatacacaaagggcgggcccggccacgaggagccgatccctatggccacctacgggtggaacctggtcaagctccacagcggaaaggacgtgtttttcacgccgcccgagaagtgcgacaccctgctgtgtgacatcggggagagttcccctaacccgaccatcgaggagggcaggacgctccgcgtgttaaagatggtcgagccttggctccggggcaaccagttctgcatcaagatcctcaacccgtacatgcccagcgtagtggaaaccctggaacagatgcagcgaaagcacggcggcatgctggtccggaacccgctctcccgcaacagcacccacgaaatgtactgggtctcctgcgggaccggaaacatagttagcgccgtcaacatgacctccagaatgctgctgaaccgcttcaccatggcccatcgcaaacccacgtatgagcgagacgtggacctcggggcgggcacacgccacgtggctgtcgagcccgaggtggctaacctggacatcatcggccaacggatcgaaaatattaagcatgaacacaagagtacctggcactacgacgaggataacccctacaagacatgggcataccacgggtcctacgaggtgaagccgagcggttccgcctccagcatggtcaatggggtggtcaagctgctcacaaaaccttgggacgtgatccccatggtgacccaaatcgcgatgactgacaccactcccttcgggcagcagcgcgtcttcaaggagaaggtggacacgcggactccgaaggccaaacgcgggaccgcccagataatggaggtgacggcccggtggctgtggggcttcctgtcgcgaaacaagaagccccggatctgcacgcgggaggaattcacccggaaggtccgtagcaacgccgcgatcggggccgtattcgtggatgagaaccagtggaactccgcaaaggaagctgttgaggacgagaggttctgggacctcgtgcaaaaggagcgcgagctgcacaagcaggggaagtgcgctacctgtgtgtacaatatgatgggcaagcgtgagaagaagctgggggagtttggaaaggctaaggggagccgcgccatctggtacatgtggctcggcgcccggttcctggagttcgaagcgctgggcttcatgaacgaggaccactggttctccagagagaattcgctcagtggtgttgaaggcgaggggttacacaagctgggctacatactccgagacatcagcaagatccccgggggcaacatgtacgcggacgacacggccggctgggacaccagaatcaccgaggacgacctgcaaaacgaggccaaaatcaccgacatcatggagccggaacacgccctgctcgccacgtcgatcttcaagctgacctaccagaacaaggttgtgcgggtccagcgacccgcgaaaaacgggaccgtgatggacgtgattagcagacgggaccaacgagggtctgggcaggttggcacctacggcttgaacacatttacaaatatggaggcacaactcatacggcagatggagagcgaggggatcttcctaccatccgagctggagaccccaaacctcgccgagcgcgtgctggactggctggaaaagtacggagtggagcggctcaagcgcatggcaatctcgggggacgattgtgtagtgaagccgatcgatgaccggttcgccaccgccctgaccgccctgaatgacatgggcaaggtgcgcaaggacataccccagtgggagccctcgaaagggtggaacgattggcagcaggtccccttctgtagccatcacttccaccaactcatcatgaaggacggccgggagatagtagtaccgtgccggaaccaggacgagttggtcggacgggcgcgcgtgtcccagggggccggctggagcctgcgagagacggcatgcctcggtaagagctacgcacagatgtggcaactgatgtatttccacagacgagatctacgcttggccgccaatgccatctgctccgcggtgcccgtcgactgggtgcccacgagccggaccacgtggtccattcacgcccaccaccaatggatgaccacagaggacatgttaagcgtgtggaatcgcgtctggattgaggagaacccctggatggaggacaagacacacgtgtccagttggggcgacgtgccgtaccttgggaagcgggaggatcaatggtgcggatccctcatcggcctgaccgcccgcgcaacgtgggccagcaacattcaggtagcaatcaatcaggtgcgccggctgatcggcaacgagaattatctcgactacatgacatccatgaagcgcttcaagaacgagggcgacccggagggggccctgtggtga

SEQ ID NO: 24535 - RNA, 9879 nt, synthetic construct
  misc_feature 1..9879: note = derived and/or modified CDS sequence (opt11) from DENV-1__EU482795__SS-prME
  source 1..9879: mol_type = other RNA
tctgtgaccatgcttctcatgctgatgcccaccgccctcgccttccatctcacaacccgcggcggggaacctcacatgatcgtcagcaagcaagagcggggcaagagcttactgtttaagacttccgctggcgtgaacatgtgcaccctaattgccatggacctgggcgaattctgcgaggacacgatgacctacaaatgtcccagaatcaccgaggccgagcccgacgacgttgattgctggtgcaatgccacagacacgtgggttacctacgggacctgcagccaaaccggcgagcaccggcgcgacaagcgttcagtagccctggcaccccatgtgggcctggggttagagactaggactgagacctggatgtcctccgaaggcgcctggaagcaaatacaacgtgtcgaaacatgggccctgaggcaccccgggtttacggtgatcgctttattcctggcgcacgcgatcgggaccagcatcacccagaaggggatcatatttatcctgctcatgctggttacaccatccatggcgatgcgctgtgtgggcatcggctcgcgcgacttcgttgagggtctgtccggggccacgtgggtggacgtcgtgctcgaacacgggagctgcgtgaccaccatggccaaagataagcctaccctggatatcgaactgctcaaaaccgaggtgaccaaccccgcagtgctccggaagctgtgcatcgaggccaagattagtaacaccacaactgacagcagatgtccaactcagggtgaggccaccctcgtggaggagcaggacgcgaacttcgtctgccggagaactttcgtggatagaggctgggggaacggctgcgggctgtttggcaaggggtccctgatcacgtgcgccaaattcaagtgcgtcaccaagcttgagggcaagacagtccagtacgagaacctgaagtactcagtgatcgtgactgtacacacaggcgaccagcaccaggtggggaacgaatccaccgagcacggcaccaccgctaccattacacctcaagccccgagcaccgagatccagctcaccgactacggggccctcacactggattgcagtcccagaacgggactggacttcaacgagatggttctcctgacaatgaaggagaagagctggttggtgcacaagcaatggttcctcgacctgccgctaccctggaccagcggagcctccacaagccaggagacttggaatcgtaaggacctgctggtgaccttcaagaccgcccacgcgaaaaagcaggaggtcgtggttctaggctcccaggagggcgcgatgcacaccgcccttacgggggccacggagatccagacgagcggcaccacgaccatcttctccgggcatttaaagtgccgcctgaagatggataagctcacgctgaagggcatgtcttacgtgatgtgcaccgggagcttcaagctggagaaggaggtggccgagacacaacacggcaccgtattagtccagataaagtatgagggaaccgacgcgccgtgcaagatccccttcagcacccaggacgagaagggggtgacccaaaacggccgactgattaccgccaaccccatcgtgaccgacaaggagaagccggtcaacatagaggccgagccgcccttcggtgagtcctacatcgtgataggcgcgggcgagaaggcgctaaagctgagctggttcaagaaggggtcctcaattggcaagatgtttgaggccaccgcccgcggggcgcgacgcatggcaattctcggagacacggcgtgggactttggcagtattggcggggtgttcaccagcgtcgggaagcttgtgcaccagatcttcggcaccgcctatggagtgctattctccggcgtgagctggacgatgaagatcggcatcggcgtgctcttaacgtggctcggcctcaattcccgcagcacctccctgagcatgacctgtatagccgtagggctggtaaccctctacctaggcgttatggtgcaggccgacagcggatgcgtcatcaactggaagggccgggagctgaagtgcggctcgggcatcttcgtgacgaatgaggttcacacttggaccgagcagtacaagttccaagccgacagcccgaagcgtctcagcgcggctatcgggaaagcttgggaggagggcgtctgcggaattcggagcgccacccgcctggagaacatcatgtggaagcagatctccaacgagttgaaccacatcctcctggagaacgacatgaagttcaccgtggtggtgggggacgtcgccggcatcctggcacaagggaagaagatgattcggccccagcccatggagtacaagtacagctggaagtcctggggcaaggctaagatcatcggagccgacgtccagaacacgacctttatcatcgacggacctaacaccccggagtgccccgacgaccagcgcgcatggaacatttgggaggtcgaagactatgggttcgggatattcaccacgaatatctggcttaagttgcgggactcgtatacccaggtgtgcgaccaccgcctgatgtccgcggccattaaggacagcaaagccgtccacgccgacatgggttactggatcgagtccgagaagaacgagacttggaagctcgcccgcgccagctttatagaggtcaagacctgcatctggcccaagtcacataccctgtggagcaacggcgtgctggagtcagaaatgatcattccgaagatctacgggggaccgatcagccagcacaactaccggccaggttacttcacccagaccgccggaccttggcacctgggcaagctagagttggacttcgatctctgtgaaggcaccacggttgtcgtggacgagcactgcggcaaccggggccccagtctgcgtacaacgacggtgacgggcaagatcatacacgagtggtgctgccggtcctgcactttacctccccttcgtttcaagggggaagacggctgctggtatggaatggagattcggcccgtcaaggagaaggaggaaaacctagtcaagagcatggtgtccgccggaagcggggaggtcgattccttcagcctggggttgctgtgcatctccataatgatcgaggaggtgatgcgcagccggtggtctcgcaaaatgctgatgactggcaccctcgcggtattcttcctgctgatcatgggacagctcacgtggaacgacctgatcaggctgtgcatcatggtcggcgctaacgcaagcgaccgaatggggatgggtaccacttatctcgcactgatggccacattcaagatgcgccctatgttcgccgtgggcctactgttccggcgcctgacgtcccgcgaggtgctgctgctcacaatcgggcttagcctcgtcgccagtgtggagcttcccaattcccttgaggaactaggcgacggcctggcgatgggcatcatgatcctgaagctcctgacggactttcagtcccaccagctgtgggccaccctcctgagcctaacgttcatcaagaccaccttctccctccactacgcctggaagaccatggccatggtccttagcatcgtgtccctgctccccctgtgcctgagcacgacctcacagaagacaacctggctccccgtgctgcttggctccttgggttgcaaaccgctgacgatgttccttatcgcggagaataaaatctggggccgaaagagctggcccctcaacgaggggatcatggctgtcggtatcgtgtctatcctgctgagctcgctcctcaagaatgatgtgcccctggccggccccctcatcgccggcggcatgttaatagcctgctacgtcatctcggggtccagcgccgacctgtccctcgagaaggccgccgaggttagctgggaggaggaggctgagcattccggggctagccacaacatcctggtggaggtccaggacgacgggactatgaagattaaggacgaggagcgggatgacaccctgacaatactcctgaaggcgaccctgctcgccgtgtccggcgtgtacccgctcagtatccccgccacgctgttcgtctggtacttctggcagaagaagaagcagcgctccggtgtcctctgggatacccccagcccgcccgaggtggaacgggcggtcctggacgacggcatataccgcatcatgcaacgcggtctgctggggcgctctcaggtcggcgtgggggtcttccaagagaacgtattccacactatgtggcatgtgaccaggggagccgtattgatgtaccaggggaagcgccttgaacccagctgggcgtccgtgaaaaaagacctgatcagctacggcggcggctggcggctccagggatcctggaacacgggggaggaggtgcaagtcatcgcggtggagcccgggaagaaccccaagaacgttcagaccgcccccgggacattcaagaccagcgagggcgaggttggcgccatcgcactggatttcaagcctggtactagcggctcccccatcgtgaaccgcgaggggaagatcgtgggcctgtacggcaacggggtcgtgactaccagtggaacatacgtctccgcgatcgcgcaagccaaggcgagtcaggagggccctctccctgagatcgaggacgaagttttccggaagcgcaacctgacgatcatggatctgcacccgggctcggggaagacccgaaggtacctccccgcgatcgtccgggaagcaatcaagcgcaagctacggacgctgatcctcgctccgacccgcgtggtcgccagcgaaatggccgaggccctgaaaggcatgcccatccgctaccagacgaccgcggtgaagtccgagcacaccggcaaggagatcgtggacctgatgtgccacgccaccttcacgatgagattacttagccccgtccgcgttcccaactacaacatgatcatcatggatgaagcccacttcaccgacccgtccagcatcgccgcacggggatacatctccacccgcgtgggcatgggggaggccgccgccattttcatgacggcgacgcctcccggcagcgtcgaagcgttcccccaatccaacgcggtaatccaggacgaggagagggacatcccggagcgcagctggaactcagggtacgagtggatcaccgacttccccggtaagaccgtttggttcgtccccagcataaaatccggcaatgacatcgcaaactgtctgcgcaagaacggaaagcgcgtgatccagctcagccggaggaccttcgacacggagtatcaaaagacaaagaacaacgactgggattacgtggtcaccaccgacatctccgagatgggggccaacttccgggcagaccgcgtcatcgacccccggcgctgcctgaaaccggtgatcctcaaggacggaccggagagggtcatcctcgcgggccccatgccagtgacggtagcgagtgcagcccagcgccgggggcgcatcggtcggaaccacaacaaggagggcgaccagtacatttacatgggtcagccgctgaacaacgacgaagaccatgctcactggaccgaggccaagatgctgctcgacaacatcaacacccccgagggaataatcccagccctgttcgagcccgagcgcgagaagtcagccgccatcgacggggaataccgcctgaggggcgaggcgcgaaaaactttcgtggagttaatgcggcgcggggacctgccagtatggctgtcttacaaggtagcctcagagggcttccagtattccgaccggcgctggtgcttcgacggcgagaggaacaaccaggtactcgaggagaatatggacgtggaaatctggacaaaggagggggagcgcaagaagctgcgacccagatggctggacgcgcggacgtactctgacccgctcgcgctccgcgagttcaaagagttcgccgcgggacgaagatccgtctcaggggatctcattctcgagattggcaaactgccccagcacctgacccagcgggcccagaacgcattggataacctggtaatgctgcacaactccgagcaaggcggccgcgcttatcggcacgcgatggaggaattaccggacaccatcgaaacgcttatgctgctcgccttgattgccgtgctgacgggaggggtcaccttattcttcctaagcggccgggggctgggcaagacctccataggactcctgtgtgtgatggctagctcagccctcctgtggatggcgagcgtggagccccactggatcgccgcctccatcatccttgagttcttcctgatggtactcctgatacccgagcccgaccggcaacgcaccccgcaggataaccagctagcctacgtggtgatcgggctcttattcatgattcttacggtggccgcgaacgagatgggcctcctggaaaccaccaagaaggatctgggcatcggccacgttgctgtagagaaccaccaccacgcagccatgctcgacgtggacctacacccggccagcgcctggaccctgtacgcagtggccacgaccatcatcacccccatgatgcggcataccatcgagaacacaaccgccaacatctcactcaccgccatcgcgaaccaggctgccatcctgatggggctggacaagggctggccgatcagtaagatggacattggcgtgcccttactggcactggggtgctacagccaggttaaccctctcactctgacggctgccgtccttatgttagtcgcacactacgccatcatcggccccgggctgcaggccaaagcgactcgcgaagcccaaaagcgcaccgccgccggcatcatgaaaaacccgaccgtcgacgggatcgtggccatcgacctggatcccgtcgtctacgacgcaaagtttgagaagcagctcggacagatcatgctgctgattctctgtacgtcccagatactgctgatgcgaactacctgggccctctgcgagtcaatcacgctggccacgggccccctgaccaccctctgggagggcagccccggcaagttctggaataccacgattgccgtgagcatggccaacatctttcgcgggtcctacttggctggagcaggcctcgcattcagcctcatgaagtccttagggggcggccggcgcgggaccggggcccaaggcgaaaccctgggcgagaagtggaaacggcagctgaaccagcttagcaagtccgagttcaacacctacaagcgcagcgggatcatggaggtggaccggtccgaggcgaaggagggcctaaagcgaggggaaacgaccaagcacgcagtgagccgggggaccgccaagctcaggtggttcgtggagcggaacctggtgaagcccgagggtaaggtcatcgacctcggctgtggccgcgggggctggtcctattactgcgccggcctgaagaaggtgaccgaggtgaagggctacacgaagggcgggcccggccacgaagagcccattcccatggccacctacggttggaacctcgtcaagctgcacagcggcaaagacgtgttcttcattccgcccgaaaagtgcgacacattactctgcgatataggggagtcctcaccaaaccccaccatagaggagggccgaacgctgcgcgtgcttaaaatggtcgagccgtggctccgggggaatcaattctgcatcaagatcctgaacccctacatgccctccgtggtagagaccctggaacagatgcagagaaaacatggcggcatgctcgttcggaaccccttgtctcgcaactccacacacgagatgtactgggtgagctgcggcactggcaacattgtgtcggcggtcaatatgacctcaaggatgctgctcaaccgcttcacgatggcccaccgcaagccgacctatgaacgggacgtggatcttggcgccggcacccgccacgtagccgtagagcccgaggtggccaacctggacatcatcggtcagcggatcgagaacatcaagcacgagcacaagtctacctggcattacgacgaagacaacccctacaaaacgtgggcgtaccacgggtcatacgaggtgaaacccagcggcagcgccagctccatggtgaatggggtggtcaaactcttgaccaagccgtgggacgtaatccccatggtgacccaaatcgctatgacggacacgacgcccttcggccagcagcgcgtattcaaggaaaaggtggacacccgaacccccaaggccaagcgcgggacggcacagatcatggaggtcaccgcaaagtggctgtggggcttcctcagccggaataagaaaccacgcatctgcacccgtgaggagttcacccgcaaggttcgttccaatgctgccatcggcgccgttttcgtggacgagaatcagtggaatagcgcgaaagaggcagtcgaggacgagcgcttctgggacctggtgcatagggaacgcgagctgcacaaacaggggaagtgcgcaacgtgcgtgtacaacatgatgggcaagagggagaagaaactcggggagttcggcaaggccaaggggtctcgcgctatctggtacatgtggctcggtgcacggtttctggagttcgaggccctcgggttcatgaacgaggatcactggttcagccgcgagaacagtctgagcggggttgagggcgagggcctgcacaaacttggctacatccttcgagacatctcaaagatccccggtgggaacatgtatgccgacgacaccgcgggttgggacacgagaatcactgaggacgacttgcagaacgaggccaagatcacggacatcatggagcccgagcacgcgctcttagccaagtcgatcttcaagctaacctaccagaacaaggtggtgcgggtccagcgcccggccaagaacgggaccgtaatggacgtcattagccgacgggaccagcgcggatcgggtcaggtcggcacctacggcctgaacacgttcaccaacatggaggcccagctgatacggcagatggagtccgaggggatcttcagcccatctgagctcgagacccccaaccttgccggccgcgtcctggactggctggagaagcacggtgtggagcgacttaagcgcatggcgatcagtggcgacgactgtgtcgtaaaaccgatcgacgaccggttcgccacagccctcacggccctgaacgacatgggcaaggttcgcaaagacatcccgcagtgggagcccagcaagggctggaacgactggcaacaagttcccttctgctcccaccattttcaccaacttatcatgaaggacggcagagaaatcgtggtgccctgcaggaaccaagacgaactggtcgggcgggcccgcgtgagccagggcgcggggtggtccctgagggaaaccgcctgcctcggcaagtcttacgctcagatgtggcagctgatgtatttccaccgccgtgacctgcgcctcgccgcgaacgcgatatgctccgccgtgcccgtcgactgggttcccaccagccggaccacgtggtccatccacgcccaccatcagtggatgaccacagaagacatgctgtcggtctggaaccgcgtctggatcgaggagaacccctggatggaggacaagacccacatctccagctggggcgacgtgccttatctgggcaagcgggaggaccagtggtgcggctccctcatcgggttgacggcccgcgcgacctgggccacgaacatacaggtggctatcaaccaggtccgccgactgatcggcaacgagaactacctcgactacatgaccagcatgaagcgcttcaagaacgagtccgatccggagggagccctgtggtga

SEQ ID NO: 24536 - RNA, 9879 nt, synthetic construct
  misc_feature 1..9879: note = derived and/or modified CDS sequence (opt11) from DENV-1__EU482796__SS-prME
  source 1..9879: mol_type = other RNA
agcgtgactatgctgttgatgctcatgcccacggcgctggcttttcacctgactactcggggaggggagccccacatgattgtgaccaaacaagagcgaggtaagagcctgctgttcaagactagcgccggggtaaatatgtgcaccctcattgcaatggacctcggtgagctatgcgaggacaccatgacctacaaatgcccccgaatcaccgaggccgaaccagacgatgttgactgctggtgcaacgcaacggacacctgggtgacctatgggacctgcagccaaacgggggaacaccggcgagataagcggagcgttgcgctagcgccccacgtgggacttgggctggagactcgcacagagacctggatgtcctctgagggagcctggaagcaaatacagcgggttgagacgtgggcgctcaggcacccaggattcaccgttatcgcactgttcctagcgcacgccatcggaaccagcatcacccagaaagggattatcttcatcttgcttatgctggttacgcccagcatggcgatgcggtgcgtcggcatcggttcccgcgatttcgttgaaggtctcagcggcgctacatgggttgacgtcgtgcttgagcacggctcatgcgttaccaccatggcaaaggacaagcccactctggacatcgagctcctgaagaccgaggtcaccaaccccgccgtactgcggaaactatgcatagaagctaaaataagcaacaccacgacagactcgcgctgccccacccagggcgaggctacactcatggaggagcaggacgctaactttgtgtgccgcagaaccttcgtcgaccggggctgggggaacggctgcgggttattcggaaaggggtcgttaattacgtgcgccaagtttaagtgcgtgaccaagctcgaaggaaagatcgtccagtacgaaaaccttaagtattccgtcatagtgaccgtgcataccggcgaccagcaccaagtaggcaacgaatctacagagcacggcaccaccgctacgatcacgcctcaggcacccacctctgagatccagctgaccgactacggggccctgaccctggactgctctccacgaacaggactcgacttcaacgagatggttctgcttaccatgaaggagaagtcgtggctcgtccacaagcagtggttcctggacctgcctttaccttggaccagcggtgcctccacaagccaagaaacgtggaaccggcaggacctgctcgtgaccttcaagacagcccacgcgaagaagcaggaggtggtcgtgctcggcagccaggagggcgctatgcacacagctctgactggggccacggagatccagacttccggcaccacgaccattttcgcagggcatctgaaatgccgcctgaaaatggacaagctgaccttgaagggaatgagctacgtcatgtgcacaggttcgttcaaacttgagaaggaggtcgcggagacgcagcatggcaccgttctggttcagataaagtacgaaggaaccgacgccccatgcaagatccccttcagtactcaggatgaaaagggtgttacgcaaaatgggcggctgatcaccgccaacccgattgtcaccgacaaggagaagcccgttaatatagaggccgagcctcccttcggcgagtcctacatcgtcattggggctggcgaaaaggctttgaagctctcatggttcaagaaggggtccagcattgggaagatgtttgaggccaccgcccgcggcgcccgacgaatggcaatcctgggcgatacggcctgggatttcggtagtatcggcggagtgttcacatcgattggcaaattagtgcaccagatcttcggcaccgcctacggcgtgctcttttccggagttagctggaccatgaagatcggaatcggcgtgctgctcacgtggttaggcctaaactcccgcagcacctccctgtcaatgacgtgtatagccgtcggactcgtgaccctataccttggagtaatggtccaggcggactccgggtgcgtaattaattggaagggccgggagctcaagtgcgggtccggcatcttcgtgactaacgaggtccacacctggaccgagcaatacaaattccaggcggacagcccgaagcgcttgagcgccgccattgggaaagcctgggaggagggcgtttgcggaatccgttccgctactcgcctggagaacatcatgtggaagcagatctccaatgaactaaaccacatcctactcgaaaatgacatgaagttcaccgtggtcgtcggggacgtcgtcggcatactcgcgcaggggaagaaaatgattcggccccagccaatggagcacaagtacagctggaagtcctggggcaaggccaagatcatcggggccgacgtccagaacacgaccttcattatcgacgggccgaatacccccgagtgccccgacgaccaacgcgcctggaatatttgggaggtggaggattacggcttcgggatattcaccactaacatttggctgaagatgcgggattcttacacccaagtatgcgaccaccgtcttatgtccgcggccatcaaggactccaaagccgttcacgccgacatgggctactggatagagtctgaaaagaacgagacgtggaagctcgcccgggcgagcttcatcgaggtcaagacttgcatctggcctaagtcccacacgctgtggagcaacggtgtcctagagtctgagatgattatcccgaaaatctacgggggcccgatcagccagcacaattaccgccccgggtatttcacgcagacggctggcccctggcaccttgggaaactggagctggactttgacctgtgtgagggaaccaccgtagtggtcgatgagcactgcggcaaccgggggccgagtcttaggaccaccacagtgacgggcaagatcatccacgaatggtgctgcaggagctgcacgctgccacctctgcggttcaagggggaggacggctgctggtacgggatggagatccggcctgtgaaggagaaggaagagaacctagtaaagtcaatggtgagcgcggggagcggggaggttgactcgttcagccttgggttactgtgcatctccataatgatcgaggaggtcatgcgaagtaggtggtcgcgaaagatgttgatgaccggcaccctagccgtgttcctgttgctcattatgggtcagctgacgtggaatgatcttatcagactctgcattatggtgggtgccaatgcgagcgatcggatgggcatgggcacgacctaccttgctctgatggccacgtttaagatgcgccccatgttcgccgttggtctgttgttccgacgcctgacgtcacgcgaggtgttgctgttaactattggtcttagcctggtggcctctgtcgagctgcccaacagcttggaagagttgggcgacggtctggcgatgggcatcatgatcctcaagctgttaaccgactttcagtcccaccaactctgggcaaccttgctgagtctcacgttcattaagaccactctctccctgcactacgcctggaagaccatggctatggtgctcagcatcgtttctctgataccgctttgtcttagcaccacgtcgcagaagacgacctggctgcccgtcctgctcgggagcttggggtgcaagccgctgacgatgtttctcatcgctgaaaacaagatctggggacgaaagtcatggcccctgaacgaagggatcatggctgtaggcgtagtaagcatcctgctcagctccctgctgaagaacgatgtgcccctggccggacccttgatagccggcggcatgctgatcgcctgctacgtcatcagcggatccagtgcggacttatccctggagaaggccgccgaagtatcttgggaggaggaggccgaacactccggcgcgtcacataacatcctggtcgaggtccaggacgacgggacaatgaaaatcaaggacgaggagagggatgataccctcacaatactgctgaaagcgaccctgctagccgtgtccggggtgtacccactgagtatccctgccacactctttgtctggtatttctggcagaaaaagaaacagcggtccggcgtactctgggatacaccctctccgccggaggttgaacgcgccgtactggacgacggcatctaccgcataatgcagcggggcctcctcgggcgctcccaagttggcgtcggggtcttccaagagaacgtgtttcacaccatgtggcatgtgaccagaggtgccgtactgatgtaccaggggaagagactggaaccctcatgggcctccgtaaagaaagacctcatcagctacggtggcgggtggcggcttcagggctcgtggaacaccggggaggaagtgcaggtcatagccgtggagcccggtaagaatcccaaaaacgtgcagaccgcccctgggacctttaaaacgcccgagggcgaggtcggcgccattgcattagatttcaagcccgggacgtctggtagcccgatcgtgaaccgtgaagggaagatcgtaggcttgtacggcaatggggtcgtgacaacctctggtacctacgtatcagcgatcgcccaagccaaagccagtcaggaggggccgttacccgagatcgaggatgaggtattccggaagcgcaacctgacgattatggacctccaccccggcagcgggaagaccagacgatacctgccggcgatcgtccgggaagcgatcaagagaaagctgcggacgctcatccttgcccccactcgagtggtcgcctcagagatggccgaagcactcaagggcatgccaattaggtatcagacgaccgccgtcaagtcggagcatacaggcaaagagatcgttgacctcatgtgccacgctactttcactatgagactgttgtcccccgtccgagttccgaactataacatgatcatcatggatgaggcccacttcacggaccccagcagtattgctgcccgcgggtacatctctaccagggtaggaatgggggaggccgcggcgatctttatgaccgccactccacccggctccgtcgaggcgttcccgcagagcaacgccgtgatacaggacgaggagcgagatatccccgagcgcagctggaactcggggtacgagtggatcactgacttccccggcaagacggtgtggtttgtaccctccataaagtcgggtaacgacatcgcaaactgcctccggaagaacggaaagcgcgtgattcagctttcccggaagacgtttgacacggaataccagaagaccaaaaacaacgactgggactacgtagtaaccacagatatctcagagatgggtgccaacttcagggcggaccgagtcatcgacccacgccggtgcctgaagcccgtcatcctcaaagacgggcccgagcgtgtaatcctggcaggccccatgccggtaacggtagcctccgccgctcaacggcgcgggcggatcggtcgcaaccacaacaaggagggtgatcagtatatctacatgggacagcccctgaacaacgatgaggaccacgctcattggaccgaggccaagatgctcctagacaacatcaacacccccgaggggatcatcccggctctattcgagccggagcgggagaaatccgccgccatcgacggggagtaccggctccgcggcgaggcgagaaagaccttcgtggagctgatgcggcgcggagacctgcccgtgtggctctcctacaaggtcgccagcgagggtttccagtacagcgaccgtagatggtgcttcgacggggagcgcaacaaccaggtgctggaggaaaacatggacgtggaaatttggacgaaagagggagaaaggaagaagctgcgcccgcggtggctcgatgcgcgcacctactcagatccccttgccttgcgggagttcaaggaatttgccgctggtcgccggagcgtgtccggggacctcatcttagagatcggtaaactgccgcagcatctcacccagagagcccagaacgcgctggacaatctggttatgctccacaacagcgagcagggtgggcgggcctaccgccacgcgatggaggaattgcccgataccattgagactctgatgctcctggcactgattgccgtgttgaccggaggggtaaccctgtttttcctgtcaggccgggggctcggcaagacgagcataggcctgctttgtgtaatggcgtccagcgtgttgctgtggatggcctcagtcgagccccactggatcgccgcttctatcatacttgagttcttcttaatggtgctgctcatccccgagccggaccggcagcggacaccccaggacaaccagctcgcttatgtggtcatcgggctgttgtttatgatcctgacggtggccgctaacgaaatggggttgctagaaaccacgaagaaggacctcggaataggacacgtggccgttgagaaccaccatcacgccaccatgctggacgtagatctccatcctgccagtgcttggacattatatgcggtggcgaccactatcatcaccccgatgatgcgccacacgattgagaacaccaccgctaacatctccctgactgcaattgccaatcaggccgcgatcctgatggggctcgacaagggatggcccatctcaaagatggacataggcgtccccctgctagccctcgggtgctacagccaggtgaatcccctgacgctgaccgccgcagtgctcatgctggtcgcgcactacgccatcatcggcccggggctgcaggcgaaggctacgcgggaggcccagaaaagaaccgcagccggcatcatgaagaaccctacggtggacgggatcgttgccatcgacctcgaccccgtcgtgtacgacgccaaattcgagaaacagctaggtcagataatgctgctcatcttgtgcacctcccagatactgctaatgcgcacaacctgggcgctgtgcgagagcatcacgcttgcgaccggccccctcaccacgctgtgggaagggtcgccggggaaattctggaacacgacgatcgcagtaagtatggctaatattttccggggttcttatctggccggtgctggcctcgcgttcagtttgatgaagtcacttggaggcggccgacgggggaccggggcccagggcgagactctcggtgaaaagtggaagcgccagctgaaccagttgtccaagtcggagttcaacatctacaaacgatccgggatcatggaagtggacaggtcagaagcaaaggaaggcctcaaacgcggggagacgactcgtcatgcagtatcccggggcacagcaaagctgaggtggtttgtggagagaaacttagtcaagcccgaggggaaggtgatcgatctcggctgcggccgcgggggctggtcatactattgcgccgggctcaagaaggtgaccgaggtcaagggatacacgaaaggagggcccggccacgaagaacccatcccgatggccacctatggctggaacctggtgaagctccactccggcaaggacgtgttcttcacgccgcccgagaaatgtgacacactcctatgcgacattggtgagtcgtctcccaatccgacgatcgaggaaggccgcactttgagggtcctcaagatggtcgagccctggctgcggggcaaccagttctgcattaagatcctgaatccgtacatgccaagcgtggtcgaaactctcgagcagatgcaacgcaagcacggtggcatgttagtccggaatccgctatcccgcaactcaacccatgagatgtactgggtctcctgcgggaccggcaacatcgtctccgccgtaaacatgacgtcgcggatgctcttgaaccgcttcaccatggcccaccgtaagcccacttacgaaaaggacgtggacttaggggcaggcacccggcacgtcgccgtggaaccagaggtcgccaacctcgacatcatcggccagcgcatcgagaatattaaacacgagcacaaaagcacgtggcattatgacgaggacaacccctataagacttgggcctaccacgggtcctacgaggtcaagccgagcggatccgcgtcaagcatggtgaacggggtcgtgaagctgctgaccaagccctgggacgtaatccccatggtcacccagatcgcaatgactgacaccacccctttcggccaacagcgggtattcaaggagaaggtggacacccgcacgcccaaggccaaacgggggaccgtccagattatggaagtcaccgcaaggtggctttggggtttcctgagtaggaacaagaaaccacgcatctgcacccgtgaggaatttacaagaaaggtccggagcaacgcagccataggcgcggtgttcgtggatgagaaccagtggaactccgccaaggaggccgtggaggatgagcggttctgggacctggtcaagaaggaaagggagctacacaagcaggggaagtgtgccacctgtgtgtacaacatgatgggcaagagagagaagaaactgggggagtttggtaaggcgaaggggagccgggcgatctggtacatgtggctgggcgcccgctttctagagtttgaagccctcggatttatgaacgaagaccattggttttccagggagaacagcttgagcggggtggagggcgaggggctacataagctgggctatatcctacgcgacatctccaagattccgggagggaacatgtatgccgacgacaccgctggctgggacacccggatcaccgaagatgacctgcagaacgaggccaagatcacagacatcatggaaccggaacacgctctgctggctacctccatatttaaactcacctaccagaacaaggtcgtccgcgtgcagcggcccgcgaagaatgggacggtgatggacgtgatctcacgccgcgaccagcggggcagcggccaggtaggcacctacggcttgaacacgttcaccaacatggaagcgcagctgataaggcagatggaatcggaagggatttttctcccgtccgaactggaaacgcctaacttggccgagcgggtcctcgactggttggagaagtacggcgtggagcgcttaaagcgcatggcgatctctggcgacgactgtgtcgtaaaaccgatcgacgaccggttcgccactgccctcacggcgctaaacgatatgggcaaggttcgaaaggacatccctcagtgggagcccagtaaggggtggaacgattggcagcaagtccctttctgcagccatcactttcatcaactcatcatgaaggacgggcgcgagatagtcgtgccgtgtcggaaccaagacgagctggtcggccgcgcacgcgtctcacagggggccgggtggagcctgcgcgaaacagcctgcctgggcaagagctacgcccagatgtggcagctcatgtacttccaccggcgcgatctgcgcttggcagccaacgctatctgctccgcagtgcccgtggactgggtccccactagccgcaccacctggtccatccacgctcaccaccagtggatgacgacggaagacatgctcagcgtatggaatcgcgtgtggatcgaggagaatccctggatggaggataagacccacgtctccagctggggcgatgtgccttacctgggtaaacgcgaggaccaatggtgtggctccctgattggcctcaccgcccgggcaacctgggccagcaatatccaagtagccatcaatcaagtacgccgcctgattgggaacgaaaactatctggactacatgacatccatgaagcgattcaagaacgagggtgaccctgaaggggcgctctggtga

SEQ ID NO: 24537 - RNA, 9879 nt, synthetic construct
  misc_feature 1..9879: note = derived and/or modified CDS sequence (opt11) from DENV-1__EU482797__SS-prME
  source 1..9879: mol_type = other RNA
agcgtgaccatgctgctcatgctgatgcccaccgctcttgccttccacctcacgactcgtggcggggaaccccatatgatagtcagcaagcaggagcggggcaagtctctgctgttcaagacatctgcgggggtgaatatgtgcaccctcatcgctatggacctgggcgagttttgtgaagacacgatgacttataagtgcccgcgcatcaccgaggcggagccagacgacgtggactgctggtgcaacgcgaccgacacgtgggtgacttacgggacctgcagccaaaccggcgagcaccgtagggacaagcggtccgtagccctggcgccccacgttggcctcggcctggagactcgcaccgaaacgtggatgagctccgagggtgcctggaagcagatccaacgggtcgagacttgggccttgaggcacccagggttcacggtcatcgcgttatttctggcgcacgccatcggcaccagcatcacccaaaagggcatcatttttatcctgctgatgcttgtgaccccctccatggccatgcggtgcgtcggcatcggctcccgcgacttcgtggaggggctgtccggcgccacgtgggtggacgtcgtgctcgagcacgggagctgcgttaccaccatggccaaggataagcccacattggacatcgagctgctcaagacggaggtcaccaacccagcggttctgcggaagctgtgcatagaggccaagatctccaataccaccacggacagccgctgcccgacccagggcgaagccaccctcgtggaggagcaagacgcaaatttcgtctgcagacgcaccttcgtggaccggggctgggggaacgggtgcgggctgttcggcaagggttccctgatcacgtgcgccaagttcaagtgcgtcactaagctcgagggcaagaccgtccagtatgagaacctaaagtacagcgtgatcgtgacggtccacacaggcgaccagcatcaggtggggaacgagtccaccgaacacggcaccaccgcgaccatcacgccccaagcgcccagcacagagatccagctgaccgactacggggcactcaccctggactgctcacctcggacgggcctggacttcaacgaaatggttctccttacaatgaaagaaaaatcctggctggtgcataagcagtggtttctcgacctaccgctgccctggacttcaggggcctccaccagtcaggagacgtggaacaggaaggacctcctggtgaccttcaagaccgcccacgctaagaagcaggaggtcgtggtgcttgggtcccaggagggcgccatgcacaccgccctcacgggggccacggagatacagaccagcggcaccacaaccatctttgccgggcacctgaaatgccgcctgaagatggacaagctcacgttgaagggcatgtcctacgtcatgtgcactgggagcttcaagctggagaaagaggtggcggagacgcagcacggtaccgtgctcgtccagatcaagtacgagggcacagacgccccctgcaagatcccctttagtactcaggacgaaaagggcgtgacgcagaacggcagactgatcaccgccaatcctatcgtgaccgacaaggagaagcccgtcaacattgaggccgagccgcccttcggggagagctacatcgtgatcggggcgggcgagaaggccctgaaactgtcctggttcaaaaaggggagctccatcggcaagatgttcgaggccaccgcccgcggggcccggcgcatggcgatcctcggcgacacggcgtgggacttcgggagcataggcggcgtgttcacatccgtcgggaagctggtgcaccagatattcggtaccgcctacggggtgttattcagcggcgtttcctggaccatgaagatcgggatcggcgtgctcctgacctggctgggcctcaatagccgctccacgagcttatccatgacctgcatcgcagtggggcttgtcaccctctaccttggcgtgatggtgcaggccgacagcgggtgtgtcatcaactggaaaggccgagagctgaagtgcgggagcggcatctttgtgacgaacgaagtgcatacctggacagagcagtacaagttccaggcggactccccaaagcgcctcagcgctgcaatcggcaaggcatgggaggagggtgtctgcgggatccggtccgccaccagactggaaaacatcatgtggaagcagatcagcaacgagctgaaccacatcctcctagagaacgacatgaagttcaccgtagtggtcggagacgtggcgggcatcctggcccaggggaagaagatgatcaggccccagcccatggagtacaagtactcctggaaatcctggggcaaggcaaagatcataggcgcagacgtgcaaaacacgaccttcatcatcgacggtcccaacacccccgagtgtcccgacgaccagcgcgcgtggaacatctgggaggtcgaagactacggcttcgggatcttcaccacgaacatctggctcaaactgcgggactcctacacccaggtctgcgaccaccgcctgatgtccgccgccatcaaagactccaaagccgtgcacgccgacatgggctactggattgagtctgagaaaaacgagacctggaaactagcgcgggcctccttcatcgaggtcaagacctgcatatggcccaagagccacacgctgtggtccaacggcgtgctcgagagcgagatgatcatcccgaaaatatacggagggccaatctcccagcacaactacaggcccgggtacttcacccagaccgccggcccctggcacctcgggaagctagagctggacttcgacctctgcgagggcacgacggtggtcgtggacgagcactgcggaaaccgggggccgtcgcttcgcaccactaccgtgaccggaaagattatccacgagtggtgctgtcggtcctgcaccctgccgcccctgcgtttcaaaggggaggacggttgctggtacgggatggagatccggcccgtcaaggagaaggaggagaatttggtcaagagcatggtgagtgccggctccggcgaggtggacagcttttcattaggactcctgtgcatcagcatcatgatagaggaggtgatgcgctcccggtggagccgcaagatgctgatgaccgggaccctcgccgtgtttttcctgctgatcatgggacagctcacgtggaacgacctaatcagattgtgcatcatggtgggcgcgaacgcctccgaccgcatgggaatgggcacaacatacctcgccctgatggccaccttcaagatgcgccctatgtttgctgtggggctcctgttccgccgcctgacgagccgggaggtgctactcctgaccatcgggctgagcctcgtcgcgagcgtggagctgcccaattcactggaggaactgggcgatgggctggccatgggcattatgattctgaagctcctgaccgacttccaatcgcaccaactgtgggccacgctcctgtccctgaccttcatcaaaaccaccttcagcctccactacgcctggaagactatggctatggttttatcgatcgtgtctctgttccccctctgcctttctacgaccagtcagaagaccacgtggctgcccgttctcctggggtccctggggtgcaagccgctcacgatgtttctgatagccgagaataaaatttggggccgcaagagctggcccctgaacgagggtatcatggccgtcggcatcgtcagcatcctcctgtccagcctgctcaagaacgacgtccccctggcggggcccctgatagccggtggcatgctcatcgcgtgctacgtgatttccgggtcatccgccgacctgagcctggagaaggccgcagaggtgagctgggaagaagaggccgagcacagcggcgcgtcccacaatattctcgtggaggtccaggacgacgggaccatgaagataaaggacgaggaacgggacgacaccctgaccatcctcctcaaggccactctgttggccgtgtcaggagtgtacccgctgtccatacccgcgacactgttcgtctggtacttctggcagaagaagaagcaaaggagcggggtgctgtgggacaccccctccccgcccgaagtggagcgggccgtcctcgatgacggcatctaccgcattatgcagcggggcttgctggggcgcagccaagtgggcgtgggcgtcttccaagagaacgtgttccacaccatgtggcacgtaacccgtggagcggtcctgatgtatcaggggaagcggctcgagccctcctgggctagcgtgaagaaggacctgatttcctacggcggagggtggcggctgcagggatcatggaacactggagaggaggtccaggtcatcgccgtggagcccggcaagaaccccaagaatgtgcagacagcccccgggacgttcaagacatccgagggcgaggtcggcgccatcgctttagacttcaagcccgggacgagcggcagccccatcgtgaaccgcgagggaaaaatcgttggtctgtacggcaatggagtcgtgaccacttccggcacttacgttagtgccatcgcccaagccaaggcgtcccaggagggccccctgcccgagatcgaggatgaggtcttcagaaagaggaacctcaccatcatggacctgcaccccggcagcgggaaaacccggcgctacctgcctgccatcgtacgggaggccattaagcgcaagctccggacgctgatccttgcccccacacgcgtagtcgcctcggagatggcggaggccctcaagggcatgcccatccgataccagacgaccgctgtcaaaagcgagcacaccggcaaggagatcgtggacctgatgtgccacgccaccttcacgatgcggctgctcagccccgtccgcgtgcccaattataacatgatcatcatggacgaggcccacttcacggacccgagctccatcgcggccagggggtatatcagcaccagagtgggcatgggggaggccgccgccatcttcatgacggcgacgccgcccggctccgtcgaagccttcccccaatccaatgcggttatccaggacgaggaacgggacatcccggagcgcagttggaacagcgggtacgagtggatcaccgacttccccggcaagaccgtgtggttcgtcccctccatcaagagcggcaacgacatcgccaactgccttcggaagaacgggaaacgcgtgatccagctgtcccggaagaccttcgacacagaataccagaagacgaagaacaacgactgggactacgtggttacaacggacatcagcgagatgggcgcgaatttccgcgccgacagggtgatagacccccgccggtgcctcaagccggtaatactgaaggacgggcccgagagagtcatactggcaggcccgatgcccgtgacggtcgcctccgctgcgcaacggcgcgggcgcataggccgcaaccacaataaggagggcgatcagtacatatacatggggcagccgcttaacaacgacgaggatcacgcccactggaccgaggccaagatgctgctggataatatcaacacccccgaagggatcatccctgcactcttcgaacccgagcgggagaagtccgccgccatcgacggggagtaccgtctgcgcggcgaggctcggaagaccttcgtagagctgatgcgccgcggggacctcccggtgtggctgtcgtacaaggtcgcctccgagggcttccagtactctgaccgcagatggtgcttcgacggcgagcgcaacaaccaggtgctggaggagaacatggacgtggagatttggacgaaggaaggggagcggaagaagttaagaccccgctggcttgacgctcgcacatactccgaccctctggccctccgggagtttaaagagttcgcggccggccgccggagcgtctccggggacctgatcttagagatcggcaagctcccccaacacctgacccagagagcccagaacgccttggacaacttagtcatgctgcacaacagcgaacagggcgggcgggcgtaccgccacgcgatggaggagctgcctgacaccattgagaccctcatgctgctggcactcattgccgtgctgaccggcggggtcacgctgttcttcctctccggccggggcctcggcaagaccagcatcgggctgctctgcgtgatggcatcgagcgtccttctgtggatggcttccgtcgagccccattggatcgccgccagcatcatcctcgagttcttccttatggtgctgctcatccccgagcccgaccgccagcgaaccccacaggacaaccagctggcatacgtggtcatcggactcctcttcatgatcctgacggtggccgcgaacgagatgggcctgttggagaccaccaaaaaggacctgggtataggccacgtggccgttgagaaccaccaccacgccgccatgctggacgtggacctccaccccgcctccgcgtggaccctatacgccgtcgccacgaccatcatcacccccatgatgcgtcacaccatcgagaatacgaccgcgaacatcagcctgaccgccatcgccaaccaggccgcaatcttaatgggtctggacaagggctggccgatctccaaaatggacatcggtgtcccccttctcgccctggggtgctacagccaagtgaacccgctgacccttacggcggccgtgctgatgctggtcgctcactacgcgataatagggccggggttacaggcaaaggcgacaagggaggcgcagaaacgcacagccgccggcatcatgaagaacccgaccgtggacgggatagtggccatcgacctggaccccgtcgtgtacgacgcaaagtttgagaagcagctgggccagatcatgctcttaatcctgtgcacgtcacagatactcctgatgcgaactacctgggcactctgcgaaagcatcacactcgccacgggcccccttactacattgtgggaagggtcccccggtaagttctggaataccacgatcgccgtgagcatggctaacatcttccgggggagctatctcgcgggcgccggccttgccttctccttaatgaagtccctagggggcgggcgccggggcaccggagcccagggcgagacactgggcgagaagtggaagcgccagctgaaccagctctccaagagcgagttcaacacgtacaagcgatctggcatcatggaagtcgatcgaagcgaggcgaaggaggggctgaagcgcggggagacgaccaagcacgccgtgtccaggggcacggcgaagctgcggtggttcgtggagcggaatctcgtcaagcctgagggtaaggtcatcgacctgggatgtggccgcggaggatggagctactactgcgccgggttgaagaaagtaacggaagtcaaggggtataccaagggcgggcccggccacgaagaacccatccccatggctacgtacggctggaacctggtaaagttacattctggcaaggacgttttcttcatcccgcccgagaagtgcgataccctgctctgcgacataggggagagctccccaaaccccaccatcgaggaaggtcggacgctccgggtcctgaagatggtggaaccatggctgcgcgggaaccagttctgcatcaagatccttaatccatacatgccgagcgtagtcgagaccctagagcagatgcagcggaaacacggcggcatgctggtgcgtaaccccctctcccggaacagcacacacgagatgtactgggtatcctgcgggaccggcaatatcgtcagcgcggtcaacatgaccagcaggatgctactgaacagattcactatggcccatcgcaagccgacctacgagcgcgacgtggacctcggggctggcacccggcacgttgccgtggagcccgaagtggccaacctggatatcattggccagcgcatcgagaacatcaaacatgagcacaagagcacctggcactacgacgaggacaacccctataagacgtgggcgtaccacgggtcctacgaggttaagcccagcggcagcgcctccagcatggtcaacggtgttgtgaagctgctcaccaagccgtgggatgtgattcctatggtcacgcaaatcgctatgaccgacacgacgccgttcgggcagcagcgggtgttcaaggagaaagtagacacccgcacccccaaggccaagcgggggaccgcccagataatggaggtcaccgcgaagtggctgtgggggtttctgtcccgcaacaagaagccgagaatttgcacccgggaggagtttacccggaaagtgcgcagcaacgccgcgataggggccgtattcgtcgacgagaaccagtggaactccgcaaaggaggccgtagaggacgagagattctgggatctcgtgcaccgcgagcgtgagctgcacaagcaggggaagtgcgcaacctgcgtctacaacatgatgggcaagcgagaaaagaagctgggggaatttggcaaggccaaagggagccgtgccatctggtacatgtggctcggcgcgcgcttcctggagttcgaggccctgggcttcatgaacgaggaccactggttctccagagagaacagcttaagtggggtggagggtgaggggctgcataagttgggttatatcctccgcgacatcagcaagatccctgggggcaatatgtacgccgacgacacagccggctgggacacgcgcatcacagaagacgacctgcagaacgaggcgaagatcactgacattatggagcccgagcatgcgctgctcgcaaagtccatcttcaagctgacctaccagaacaaggtggtccgcgtccaacggcccgctaagaacgggaccgtgatggacgtcatcagccgccgtgatcagcggggctccggccaggtgggaacctacggcctgaacacgttcaccaacatggaggcacagctcatccgccagatggaaagtgaggggatcttctcccccagcgagctggagacccccaacctggccggccgggtgttagactggctggagaagcacggagtcgagcgccttaaacggatggcgatttccggcgatgactgcgtagtgaagccaatcgacgaccgcttcgctaccgcgctcacggctttaaacgacatggggaaggtccggaaggacgtgccgcaatgggagcccagcaagggctggaatgactggcagcaggtcccattctgcagccaccactttcaccagctgatcatgaaggacgggcgcgagatagtcgtgccctgcaggaaccaggacgagctcgtgggccgagcgcgggtctcccagggcgcggggtggagcctgcgcgagaccgcttgcctgggcaagtcctatgcacagatgtggcagcttatgtacttccaccggcgcgacctgcggctggccgcgaacgcgatctgtagcgccgtgccggtggactgggtccccacctcccgcactacgtggagcatccacgcccaccaccagtggatgaccaccgaagacatgctctccgtgtggaaccgggtatggatagaggagaacccctggatggaagacaagacccacattagctcatggggagacgtcccctacttaggcaagcgcgaggaccagtggtgtggtagcctgatcggcctgacggcccgggcgacctgggctaccaacatccaggtggccatcaaccaggtgcgcaggctgattggtaacgagaactatctggactatatgacctccatgaagcggttcaagaacgaatccgatccggagggggccctctggtga

SEQ ID NO: 24538 - RNA, 9879 nt, synthetic construct
  misc_feature 1..9879: note = derived and/or modified CDS sequence (opt11) from DENV-1__EU482799__SS-prME
  source 1..9879: mol_type = other RNA
agcgtgacgatgctgctcatgctgatgcccaccgctctggccttccatctcaccacccggggcggggaaccgcatatgatcgtgtctaaacaggagaggggaaagagcctgctgttcaagacaagcgccggggtgaacatgtgcaccctcatcgccatggacctaggcgagctgtgcgaggataccatgacctacaagtgcccccgcataaccgagactgaacccgacgacgtcgactgctggtgcaacgccacggacacctgggttacctatgggacctgcagccaaacaggcgagcatcggcgggacaagcggtcagtggccctcgcgccccatgtgggcctcgggctggaaacccgcacagaaacttggatgagctccgaaggcgcctggaagcagatccagcgggtcgagacgtgggccctgcggcatcccgggttcacagtaatcgcgctgtttctggcccacgtgatcgggaccagcatcacccagaaagggataatcttcatcttactgatgctggtcactccctccatggcgatgcggtgcgtgggcattggcagccgcgacttcgtcgaggggctctccggcgcaacttgggtcgacgtcgtgctggagcacgggagctgcgtcaccactatggccaaggacaagcccacgctggacatagagctcctgaaaaccgaggtgaccaaccccgccgtattgcgtaaactctgcatcgaggcgaagatctccaacaccacgaccgacagccgctgcccgacccaaggcgaggcgaccttggtcgaggagcaggatgctaatttcgtgtgtcggcgcactttcgtcgaccgcggctgggggaacggctgtgggctgttcggcaaggggtcgctcatcacgtgcgccaagtttaaatgcgtcacaaagctggagggtaagattgttcagtatgagaaccttaagtacagcgtgatcgtcaccgtgcacacgggcgaccagcatcaggtagggaacgagtccaccgagcacggcactaccgccaccatcacaccccaagcccccaccaccgagatccagcttactgattacggggcgctgacgcttgactgcagcccccgcacaggcctagacttcaatgagatggtgctgcttacgatgaaggaaaaatcctggctcgtgcacaagcagtggttcctggatttgcccctcccctggaccagcggggcctcgacatcccaggagacctggaaccggcaggacctgctggtcactttcaagaccgctcatgccaagaagcaggaggtggtggtcctcggctcgcaggaaggcgccatgcacacagcgttgacgggggccaccgagattcagacatccggcacgaccaccatattcgccggacacctaaagtgccgcctcaagatggacaagctgaccctgaaggggatgagctacgtgatgtgcacggggtccttcaagctcgaaaaggaggtggcagagacccagcacggcaccgtactggtgcagataaagtacgagggcacggacgccccctgcaagatacccttcagcacgcaagacgagaagggggtgacgcagaacgggcggttgatcaccgcgaacccgatcgtcaccgacaaggaaaagcccgtgaacatcgaggccgagccgcccttcggggagtcttatatcattatcggcgcgggcgagaagacgctgaagctcagctggttcaaaaaggggtccagcatcggcaagatgttcgaagccaccgcgcggggtgcccggcgcatggccatcttgggggacaccgcctgggacttcggatccataggcggtgttttcacctcagttgggaagttagtgcatcaaatcttcggcacggcctatggggtgctgttctccggcgtcagctggaccatgaagatcgggataggcgtgctcctgacctggctcggcctgaactcccgaagcacctctctgtcgatgacgtgcatcgcggtggggctcgtgacgctgtacctgggggtaatggtgcaggcggacagtgggtgcgtcattaactggaagggccgggagctcaagtgcgggagcggcatcttcgtgaccaacgagatccacacctggaccgagcaatacaagttccaagccgacagcccgaagcgcctgtccgcggccataggcaaagcgtgggaggaaggggtgtgcggaatccggagcgccacgaggctggagaacatcatgtggaagcaaatctcaaacgagctcaatcatatcctcctggagaatgacatgaagttcactgtcgtggttggtgatgttgccggcatcctggcccaggggaagaagatgatccggccccagcccatggagtacaagtatagctggaaatcatggggcaaggcaaagatcatcggcgcagatgtgcagaacaccaccttcatcatagatgggcccaatacgcccgaatgccccgatgaccagcgcgcctggaacatctgggaggtggaggattacggattcgggatcttcacgaccaacatctggcttaagctgcgggacagctacacccaggtctgcgatcaccgacttatgagtgccgccataaaggatagcaaggcggtccatgcagacatgggctactggatagagtccgagaagaatgagacgtggaagctggcgcgggcaagtttcatcgaggtgaagacctgcatctggcccaagtcccacaccctgtggagcaacggcgtcctcgagtccgagatgatcatccccaagatctacgggggcccgatctcacaacataactaccgccctgggtacttcacccagacggccggcccctggcacctggggaagctcgagttagatttcgacctgtgtgagggtaccaccgtggtggtcgacgaacactgtggcaatcgcggtccttcactgcgcaccacgacggtgacgggcaagataatccacgaatggtgctgtcggagctgcactctgccgcccctccgctttcgcggcgaggacgggtgctggtacgggatggagattcgcccagtaaaggagaaggaagaaaacctggtcaagtccatggtgagcgccggaagcggcgaggtggactcattcagcctcgggctactctgcatctccatcatgatcgaggaggtcatgcggagccgctggtcccggaaaatgctcatgacgggtaccctggccgtgttcttccttctcatcatggggcagctgacctggaacgacctgatccgactctgcattatggtgggcgcaaacgccagcgaccgcatgggcatgggcaccacgtacttagccctgatggcgaccttcaagatgcggccgatgttcgcagtgggcctcttatttcggcggctgacatcccgcgaggtgctcctcctgaccatcgggctcagcctggtcgcctccgtcgagctgcccaacagcctcgaggagcttggcgacggtctggccatgggcataatgatcttgaaactgctcactgacttccaaagccaccagctctgggccaccctgctgtcgctcaccttcataaagaccacgttctccctgcattatgcgtggaagaccatggccatggtgctgagcatcgtctccttattccccctgtgcttgagcaccacctcccagaagacgacctggctccccgtactgctagggagcttggggtgcaagccgctgaccatgttcctgatcgccgagaacaagatctggggccggcgctcctggcctctcaacgaggggattatggccgtgggcatcgtcagcattctgctgtcaagcctactgaagaacgacgtgcccctggccgggcccctcatcgccggcggcatgctgatcgcctgctacgtgatcagcgggtcttcggccgacctgtccctcgagaaggccgcagaagtcagctgggaggaggaggctgagcactccggcgccagccacaatatcctggtggaggtgcaggacgacgggaccatgaagatcaaggacgaggagcgggatgataccctaacgatcttactgaaagccaccctgctcgcagtctccggggtctatccgctgagcatccccgcgacactgttcgtgtggtacttctggcagaagaagaagcagcgctccggagtgctctgggatacccccagcccaccagaggtggagcgggccgtattagacgacggcatctaccgcatcatgcagcggggcttgctgggacgctcccaggtcggcgtgggcgtgttccaagagaacgtcttccacacgatgtggcacgtgacccggggcgcagtgctcatgtatcaggggaagcgcctggagccgagctgggcctcagtcaagaaggacctcatctcgtacggaggcgggtggcgactccagggatcctggaacaccggggaggaggtccaggtcatcgccgtcgaaccgggtaagaaccccaagaacgtgcagaccgcgccagggacgttcaagacccccgagggcgaggttggcgccatcgccctggatttcaagccggggaccagcggctcgcccatagtcaatagagaaggaaagatcgtgggactgtacggcaacggggtggtcaccacgagcggcacctacgtgtctgccatcgcccaggccaaggcctcccaggagggtccgctccccgagatcgaggacgaggtgttccggaagcgcaacctgaccatcatggatctgcacccgggcagcgggaaaactcggaggtatctccctgccatcgtacgggaggcgatcaagcgtaagctgcgcacgctgatactcgcgcccacgagagtggtggcctccgagatggccgaggccctgaaggggatgcccatccgctaccagaccaccgcagtcaaaagcgagcacactggcaaagagatcgtggacctgatgtgccatgcgacatttaccatgcggcttctatcccccgtgcgcgtccctaattacaatatgatcataatggacgaggcccatttcaccgaccccagttctatcgccgcgcgggggtacataagcactcgcgtgggcatgggggaagccgcggccattttcatgaccgccaccccgcccggctccgtggaggccttcccgcaaagcaatgccgtcatccaggacgaggagcgcgatattcccgagcgctcctggaacagcgggtacgagtggatcacggactttcccggcaaaacggtgtggttcgtgcccagcatcaagagcggaaacgacatcgctaactgcctgcgtaagaacgggaagcgcgtcatccagctctcccggaagacgttcgacaccgagtatcagaagacaaagaacaacgactgggactacgttgtgacgaccgacatcagcgagatgggcgccaatttccgcgccgaccgggtcatcgacccgcgccggtgcctgaagcccgtgattctgaaggacggtccggaacgcgtaatactcgcggggcccatgccggtgaccgtggcgtccgccgcccagcggcgcgggcggatcggtcgcaaccacaacaaggagggcgaccagtacatatacatggggcagcccctgaacaacgacgaggaccacgcccactggaccgaggccaagatgctgctcgacaacatcaacacgccggaggggattatacccgcgctgttcgaaccggagcgtgaaaagtccgccgccatcgacggggaataccggctgcgcggcgaagcccgaaagaccttcgtcgagctcatgcgccgcggggacctcccggtgtggctgtcctacaaggtcgccagcgagggattccaatacagcgacaggaggtggtgcttcgacggcgagcgcaacaaccaagtcctcgaggagaacatggatgtggaaatctggactaaggagggagagcgtaagaagctcagaccccggtggctggacgcgcgtacatactccgaccccctcgcactgcgcgagttcaaggagttcgccgccggccggcggtctgtgtccggcgaccttatcctcgagatcgggaagctcccccagcacctgacgcagcgcgcccagaacgcgttggacaatctggtcatgctgcacaacagcgagcagggcggtcgggcctaccgccacgccatggaggagctccctgacaccatcgagaccctgatgttactcgctctgatagctgtgctgaccggaggggtgaccttattcttcctgagtggccgaggactgggtaagacgagcatcggcctcctgtgcgtaatggcatccagcgtactgctatggatggcctccgtcgagccacactggatcgcagccagtataatcctggagttcttcctgatggtccttctgatccccgagccggacagacagcggacaccccaggataatcagcttgcctacgtggtgatcgggctcctgttcatgatcctgactgtcgccgccaacgagatgggactcctggagacgacgaagaaagacttaggcatcggccacgtggccgtggagaaccaccaccacgctgcgatgctcgacgttgacctgcacccagcctcggcgtggactctgtacgccgtggccaccaccatcatcaccccgatgatgaggcatacaattgagaacaccaccgcgaacatcagcctcacggccatcgccaaccaggcggcgattctaatggggctggataagggctggcccatctccaaaatggacattggcgttccgctcctcgcactcgggtgctacagccaggtcaacccgctaaccctgaccgccgccgtgctaatgttggttgctcactatgcaatcatcggcccggggctccaggccaaggcaacccgcgaggcgcagaagcgcacggccgcgggcatcatgaagaatcccacggtcgatgggattgtggccatagatctggaccccgttgtctacgacgccaagttcgaaaagcagctcgggcagataatgctgttgatcctctgtacctcccagatcctgctgatgcgcaccacgtgggccctctgcgagagcatcaccctggccacaggccccctgaccaccctctgggaggggagtccgggcaagttctggaacacgaccattgcggtttctatggccaatatcttccgggggtcctatcttgccggggccggactggcattcagcttaatgaagtccctcggcggcgggcgccgggggaccggggcgcagggcgagacgctgggcgagaagtggaagcgccagctcaaccagctgtccaagagcgagttcaacacctacaagcggtccggcataatggaggtggaccgctccgaggctaaggagggcctgaagcgcggtgagaccacgaaacacgcagtctctcggggcacggccaagctccggtggttcgtggagcgcaacctggtgaagcccgagggaaaagtcatagatctgggctgcggccgcggtggttggagttactactgcgcggggctgaagaaggttaccgaggtgaagggttacaccaagggaggccccggccacgaagaacctatccccatggctacatacgggtggaacctcgtgaagctgcactccgggaaggacgtgttcttcatcccacccgaaaagtgcgatacgctcctctgcgatatcggcgagagctcccccaaccctaccatcgaggagggtcgcaccttgagagttttaaagatggtcgagccctggctacgcgggaatcagttctgcatcaagatcctgaacccctacatgccgagcgttgtggagacgctggagcagatgcagcggaagcacggcggcatgctcgtccgcaacccgctctcccggaatagcactcacgagatgtactgggtgtcctgcgggactggcaacatcgtgagcgccgtaaacatgacgtccaggatgcttctgaaccgcttcaccatggcccaccggaagcccacctacgaacgcgacgtggacctaggtgccggcacgcgtcacgtagcggttgagcccgaggtggccaatctggacatcatcggccagcgaatcgagaacatcaagcacgaacacaagagcacctggcactatgacgaggacaacccctacaagacgtgggcctatcacgggagttacgaagtgaagccgagcggttccgccagcagcatggtcaacggggtggtcaaacttctgaccaagccctgggacgtgatccccatggttacgcagatcgccatgaccgacaccacccccttcggtcagcagcgggtctttaaggagaaggtggacacgcgcaccccgaaagcgaagcgaggaaccgcccaaatcatggaggtgaccgccaaatggctgtggggcttcctctctcgcaacaagaagccccgcatctgcacgcgcgaagagtttacccggaaagtccgatctaacgccgccatcggcgcggtgtttgtggatgagaaccagtggaactcagccaaggaggccgtagaggacgagcggttctgggatctggtgcaccgcgaacgggagttgcacaagcagggtaagtgtgcgacttgtgtgtacaatatgatgggaaagcgcgagaaaaagctcggcgagtttggcaaagcgaaggggtcacgggccatctggtacatgtggctgggcgcccgctttctggagttcgaggccctcggctttatgaatgaggaccactggttctcacgggaaaacagcctgtccggggtcgagggcgagggtctgcacaagctgggctatatactgcgtgacatcagtaagatcccagggggcaacatgtacgccgacgacaccgcgggctgggatacgcggatcaccgaggacgacctccagaacgaagcccgaatcacagacattatggagccggagcacgccctactggccaagtccatcttcaagttgacgtatcagaacaaggtggtgcgcgtacagcggcccgccaagaacgggacggtgatggatgtgatctctcgacgggaccaacgcggatccgggcaggtcgggacctacggcctcaacaccttcaccaacatggaggcgcagctgatcaggcagatggagagcgagggtatcttcagtcccagcgaactggagactcccaacctcgccgagcgcgtgctggactggcttgagaagtacggtgtggaacggctcaagcgcatggctatcagtggggatgactgcgtcgtgaaaccgattgacgaccgattcgccaccgccttaaccgctctaaacgacatgggcaaggtgcgcaaagacatccctcaatgggaacccagcaagggatggaacgactggcagcaggtcccattttgttcccaccactttcaccagctcatcatgaaggacggccgggagatagtggtcccgtgcagaaaccaggacgagcttgttggccgggcccgcgtgagtcagggcgccgggtggagcttacgggagaccgcctgcctcggaaagagctacgcccaaatgtggcagttaatgtacttccaccgcagagaccttcgcttagcggccaacgccatctgcagcgccgtgcccgtcgactggatcccgacgtcccggaccacctggagcatccatgcgcaccaccagtggatgaccacggaggacatgctgtccgtgtggaaccgcgtgtggatcgaggaaaacccctggatggaggacaagactcacatcagctcctggggcgacgtcccgtacctggggaagcgcgaggaccagtggtgcggcagcctcatcggcctgaccgcccgggcgacctgggccaccaacatccaagtggccattaaccaggttcgccggctgatcgggaatgaaaactacctcgactatatgacgtccatgaagcgcttcaaaaacgagagtgaccccgagggcgcgttatggtga

SEQ ID NO: 24539 - RNA, 9879 nt, synthetic construct
  misc_feature 1..9879: note = derived and/or modified CDS sequence (opt11) from DENV-1__EU482800__SS-prME
  source 1..9879: mol_type = other RNA
agcgtgaccatgctgctcatgctgatgcccaccgcactggcatttcacctcaccacccggggtggggagccccacatgatcgtgagcaagcaggagcggggaaaatcactgctgtttaaaaccagcgcgggggtgaacatgtgcaccctcatcgccatggacctgggagagttctgtgaggataccatgacttacaagtgcccccgcatcaccgaggccgagcctgacgacgtggactgctggtgcaacgccaccgacacgtgggtcacctacggtacctgcagccagaccgggcagcaccgacgagataagcggtccgtggcactggcgccccacgtgggtctcgggctggagacgcgcactgagacctggatgagctccgagggcgcctggaagcagatccagcgggtcgaaacttgggctctgcgccaccctgggttcactgtgatcgcactcttcctggcacacgccatcggcacctctatcacccagaaggggatcatcttcatcctgttgatgctggtgaccccatctatggcgatgcgctgtgtcggcatcggcagccgcgattttgtggagggcttatccggggccacgtgggtggacgtcgtgcttgagcatgggagctgcgtgactaccatggccaaggacaagcccacactggacatagagctgctcaagacggaggtcaccaaccccgcggtgctgcggaagctgtgcatcgaagccaagatctccaacaccaccatcgactcacgctgcccgacgcaaggcgaggcaaccctcgtggaggagcaggacgctaactttgtatgccggcgaaccttcgtggaccggggctggggtaacggctgtgggctgtttggcaagggatccctgatcacgtgcgcaaagttcaagtgcgttacgaagcttgagggcaagaccgtccagtacgagaacctgaagtacagtgtaattgttaccgtgcacaccggtgaccagcaccaggtggggaacgagtccaccgagcacggcaccaccgcgaccatcacgccccaagcccctagcacagaaatccagctgaccgactatggggccctcaccctagactgctcaccgcggaccggcttagacttcaacgagatggttctcctgacgatgaaggagaagtcgtggcttgtgcacaagcagtggtttctcgatctgccgctgccctggacctcgggggcctccaccagccaggagacctggaaccgcaaggacctcctggtcacgtttaagaccgcccacgcgaagaagcaggaggtcgtggtgctgggctcccaggagggcgccatgcacaccgccctgaccggcgctacggagatccaaacctctggcaccacaacgattttcgcggggcatctgaagtgccgcctgaagatggacaagctcaccctgaagggcatgtcctacgtgatgtgtaccggaagcttcaagctggaaaaggaggtggcggaaacccagcatggcacggtgctggtccagatcaagtacgaggggaccgacgccccctgcaagatccccttctcaacacaggacgagaaaggggtcactcagaacggacggctgatcacggcgaatcctatcgtgaccgacaaagaaaagcccgttaacatcgaggcagaaccccccttcggggagtcttacatcgtcatcggggcgggcgagaaggcgctaaagctgtcttggttcaagaagggcagctccatcggcaaaatgtttgaggctaccgccaggggggccaggcgcatggcgatcctcggcgacaccgcttgggacttcgggagcattggtggtgtcttcacgagcgtcgggaagctggtgcaccaaatcttcggcaccgcctacggcgtactgttcagcggcgtctcctggaccatgaagatcggaatcggcgtactgctgacctggctcggactcaattcacgttccacgagcctctccatgacctgcatagccgtggggttggttaccctctacctaggcgtgatggtgcaagccgactctgggtgcgtcatcaactggaagggccgggagctgaagtgcgggagcggcatcttcgtgaccaacgaggtgcacacttggacggagcagtacaagttccaggcggactccccaaaacgcctcagcgccgctatcggcaaagcctgggaggagggggtctgcggcatcagatcggtgaccaggctggagaacattatgtggaaacagatcagcaatgaactgaatcacatccttttagagaacgatatgaagtttacggtggtcgtgggggacgttgccggtatcctggcgcaggggaagaagatgatccgtccacagcccatggagtacaagtactcgtggaagtcctggggcaaggccaaaatcatcggcgccgacgtccagaacaccacgtttatcatagatgggcccaacaccccagagtgccccgacgaccaacgcgcctggaacatctgggaggtggaggattacggtttcgggatcttcaccaccaacatctggctcaagctgcgggactcctacacccaggtgtgcgaccaccgactgatgagcgcggccataaaggactctaaggccgtccatgccgacatgggctactggatcgagagcgagaagaacgagacctggaagctcgccagggcatcttttatcgaggtgaagacctgtatctggccgaagagccacaccctgtggtctaacggcgtactggagagcgaaatgatcatcccgaagatatacgggggcccgatatcccagcacaactacagaccagggtactttacgcaaactgccggcccctggcacctcgggaagctggaactggacttcgacctgtgcgagggcaccacagtcgtggtggacgagcactgcggcaatagagggccgagcctacgcacgaccaccgtcaccggcaaaatcatccacgagtggtgctgccggtcatgcacactgccgcccctgcgcttcaaaggtgaggacggctgctggtacgggatggagatccggcccgtgaaggagaaagaagagaaccttgtcaagagcatggtcagcgccggctctggtgaggtggacagcttctccctgggcctcctgtgtatctcaatcatgatcgaggaggtcatgcgctcccggtggagccgaaaaatgttaatgaccggcacccttgccgtgttcttcctactcatcatgggccagctcacctggaacgacctgatccggctgtgcatcatggtaggcgcgaacgcgtcagaccgtatggggatgggcaccacgtacctcgctctaatggcgaccttcaagatgcgcccgatgttcgccgtgggattgctattccggcgactgactagccgggaggttctgctcctgaccattgggttaagtctcgtggcaagcgttgagctgcccaattcccttgaggagctcggagacggactggcgatgggcataatgatcttaaagctcctgaccgacttccagagccaccagctgtgggccaccctcctgagcctgaccttcatcaagactaccttcagcctccactacgcttggaagaccatggcgatggtgctgtccatcgttagcctgttccccctctgcctgtctaccacgtcacagaagaccacctggctgccggtcctcctcggctccctggggtgcaagccgctgactatgttcctgatcgcggagaacaagatctggggtcggaagtcctggccactgaacgagggaatcatggctgtggggatagtaagcatactactgtctagcctgctcaagaacgacgttccattagccgggccccttattgccggcggaatgctcattgcgtgctacgtgatctccgggagctccgcggacctgtcgttggaaaaagccgccgaggtgtcctgggaggaggaggccgagcacagcggcgccagtcacaacatcctcgtcgaggtgcaggacgacgggaccatgaagatcaaagacgaggaacgggacgacacccttaccatcttgctcaaggccaccctgctggcggtatccggcgtctacccgctctccatccccgccactttgttcgtgtggtacttctggcaaaagaagaagcagagatcaggggtgctctgggacacgccctctccacccgaggtcgagcgggccgtgctcgacgatggcatctaccgcatcatgcagcggggcctgttggggcggagccaggtgggggtcggtgtgttccaagagaacgtcttccataccatgtggcacgtcacccgaggcgcggtgctgatgtatcaggggaagcgcctcgaaccctcctgggcaagcgtgaagaaagacttaatctcctacggtggagggtggcgcctgcagggcagctggaacaccggggaggaggttcaggtgatcgccgtggagcccggaaaaaaccccaagaacgtccagacggcccccgggaccttcaaaaccagcgagggcgaggtgggcgccattgccctcgacttcaagcccgggacctcaggctctcctatagtgaaccgcgagggaaagatcgtgggtctgtatggcaatggggttgtgacgacgagtggaacctacgtcagcgcgatcgcccaagcaaaggcttcgcaggagggacccctgccggagatcgaggacgaggtgttccggaagcgcaacctcaccattatggatctccaccccggctcgggcaagacgcgcaggtatctgccagctatcgtccgcgaggccatcaagcgcaagctccgcaccctgatcctcgcaccgacacgcgttgtagcctccgagatggctgaggcgctcaaaggcatgccgatccggtaccagaccacggccgtcaagtcagagcacaccggtaaggaaatcgtcgacctgatgtgccacgctaccttcacaatgcggttactgtcccccgtgcgcgtaccaaactacaacatgataatcatggacgaagcccacttcacggacccgtcctccatagcagcgcgggggtacatcagcacgcgcgtcgggatgggggaggccgctgccatctttatgaccgccactccgcccggctccgtagaggcgttcccccagagcaacgccgtcatacaggacgaagagcgggacatccccgagcggtcttggaacagcggttacgagtggataacagacttccccggcaagaccgtctggtttgtgccctccatcaagagcggtaacgacattgccaactgcctgcggaagaacggaaaacgcgtgatccagctttcccggaagaccttcgataccgagtaccagaagaccaaaaataacgactgggattatgtagtgacaaccgacattagcgagatgggtgcaaacttccgcgcggaccgggtgatagacccccggcggtgcctcaagccggtcatactgaaggatgggccagagagggtgatcctggccggccccatgcccgtgaccgttgcctccgcagcccaacgacgcggtcggatcggccggaaccataacaaagaaggcgaccagtacatctacatggggcagcctttgaacaacgacgaggatcacgcgcactggacggaggccaagatgctgttagacaatatcaacacccccgaggggatcatccccgcccttttcgagcccgagcgggaaaagtccgccgccatcgatggggagtaccgcctgcggggcgaggcgcgtaagacctttgtagagctgatgcggcgcggggacctcccggtctggttgagctacaaagtggcctccgagggctttcagtactctgaccgccggtggtgcttcgacggtgagcgcaacaatcaggtacttgaggagaacatggacgtagagatctggactaaggagggggagcggaagaaactccgcccgcggtggctggacgcccgcacgtactcggaccctctggcattacgggagttcaaggaattcgccgcgggtcgccggagcgtgtccggagacctgatcttagagatcggaaagctcccccagcacctaacgcagagagcccagaacgccctggacaacctcgtgatgttacacaactccgagcaaggcgggcgggcctaccgccacgcgatggaggaactgcccgacactatcgagaccctcatgctgctggcgctcatcgcggtcctgacgggaggcgtgaccctgttctttctctccggccgggggctgggcaagaccagcataggcctgctctgcgtgatggccagtagcgtgctgttatggatggcgtccgtggagccccactggatcgccgccagcatcattctcgagttcttcctgatggtacttctcatcccagagcccgatcgtcagcggactccgcaggacaaccaactggcctacgtcgtcatcggactactcttcatgatcctgaccgtcgccgccaacgagatgggcctgctcgaaacaactaaaaaagacttggggatcgggcacgtcgcggtggaaaaccaccaccacgccgccatgctggacgttgatctccaccccgcgtccgcgtggacactgtatgctgtcgccaccactatcataactcctatgatgcggcacaccatcgagaacacgactgccaacatcagcctgacagccatagcgaaccaggcagcaatcctgatggggttagataagggctggccgatctccaagatggacataggcgtacccctgctcgccctggggtgctatagccaagtgaatcccctgaccttgaccgccgcggtcctgatgctggttgcccactacgcgatcataggccccgggttacaggccaaagccacgcgagaggcgcagaagagaaccgctgctggtatcatgaaaaacccgaccgtggacggaatcgttgcaatcgacctggatcccgtggtgtacgacgccaagttcgagaagcagctaggtcagatcatgctactgatcctttgcacttcccagatcttactgatgcgcacgacgtgggcgctatgcgagagcattacgctcgcaaccggccccttaacgaccttgtgggagggttcccccggcaagttctggaacaccaccatcgcagtcagcatggctaacatcttccgcgggagttaccttgccggcgcgggcctggcattctccctgatgaagtccctcgggggcgggagacggggtacaggggcgcagggcgaaaccctgggcgagaagtggaagcgccagctgaaccagctctcgaagtccgagttcaatacctacaagcggagtggaataatggaggtcgatagaagcgaggctaaggagggtctcaagcgcggggagaccacgaagcacgctgtgtcccggggcacggccaagttacggtggttcgtcgagcgaaacctcgttaagcccgaggggaaggtgatcgacctgggatgcggacgtggcggttggtcatactactgtgccgggcttaagaaggttactgaggtaaaggggtacaccaaggggggacccggccatgaggagccgatccccatggccacctacggttggaacctggtgaagctccattccggcaaagacgtcttcttcatcccacccgagaagtgcgacaccctgctatgcgacatcggagaatcgtcgcccaaccccaccattgaagaaggcagaaccctccgggtgcttaaaatggtggagccgtggctgagagggaaccagttctgcataaagattcttaacccctacatgccgtctgtcgtggaaacgctggagcaaatgcagcgtaagcacggcggcatgctggtgcgcaacccgctctcccggaacagcacccacgagatgtactgggtatcctgcggtaccggcaacatcgtgagcgccgtgaacatgacctccaggatgctgctgaatcgattcaccatggtccacaggaagccgacgtacgaacgagacgtcgatctcggagcgggcacccggcacgtggccgtcgagccggaggtggccaacctggacattataggccagcgcatcgagaacattaagcatgagcacaagagcacctggcactacgacgaagataatccctacaagacctgggcataccacggttcctacgaggtcaagcccagcggcagcgcctcatccatggtgaacggggtggtaaagctgctcacgaagccgtgggacgtcatcccgatggtcactcaaattgcgatgaccgacaccacgccattcggccagcagcgggtgtttaaggagaaggtggacacccgcacccccaaggctaagcgggggaccgcccagatcatggaggtgacggccaagtggttgtggggcttcctctctcgcaacaagaagccgcggatctgcacccgcgaggaattcacccgcaaggtccgcagcaacgccgcaatcggcgccgtgttcgtggacgagaaccaatggaattccgccaaggaggcggtcgaggatgaacgtttctgggacctcgtgcatcgcgaacgggaactgcacaagcaggggaagtgcgctacttgcgtgtacaacatgatgggcaagagggagaagaaactgggcgagttcggcaaggcaaagggcagccgggccatatggtatatgtggctcggcgcccgctttctagagttcgaggccctgggcttcatgaatgaggatcactggttcagtcgtgaaaatagcttgtccggggttgagggcgaggggttacacaagctgggttacatcctccgcgacatttcaaaaatccctggcggcaacatgtacgctgacgacacggccggttgggacacccggatcacagaagacgacctgcagaatgaggctaagatcaccgatatcatggaacccgagcacgcactgctcgcgaagtccatatttaaactaacgtatcagaacaaggtcgtgcgcgtgcagcggccggcgaagaacgggaccgtaatggacgttatctcgcgccgcgaccagcgggggtctggacaggtcggcacctatggccttaacactttcacgaacatggaggcccagctgattcgccaaatggagagcgaaggcatcttctcccccagcgagctggagacccccaacctggccggccgggtgttcgattggctcgagaaacacggggtggagcgcctgaagcggatggccatcagcggggacgactgcgtcgtgaaacccatcgacgaccgcttcgccaccgcgctgaccgccctgaacgacatgggtaaggtgagaaaggacatcccgcaatgggagcccagcaagggctggaacgattggcagcaggtccctttctgcagccaccacttccaccagctgatcatgaaagacggccgcgagatcgtggtgccctgccggaaccaggatgagctggtcgggcgcgcccgggtgtcccagggggccgggtggagcctcagggagacggcctgcctgggcaaatcctatgcgcagatgtggcagctgatgtacttccaccggagggacctccggctggctgccaacgccatctgcagcgcagttccggtcgactgggtgcccacctcccgcaccacctggagcatacacgctcaccaccagtggatgactaccgaagacatgctgtccgtatggaaccgcgtctggatcgaagaaaacccctggatggaggacaagactcatataagctcttggggtgacgtgccatacttaggaaagcgtgaggaccaatggtgcggctctctgatagggctgaccgcccgggcaacgtgggccaccaacatccaagtcgcgatcaaccaggtccgtcggttaatcggcaacgagaactacctggactacatgacctccatgaagaggttcaagaacgagagcgatccggagggggccttatggtga

SEQ ID NO: 24540 - RNA, 9879 nt, synthetic construct
  misc_feature 1..9879: note = derived and/or modified CDS sequence (opt11) from DENV-1__EU482801__SS-prME
  source 1..9879: mol_type = other RNA
tcggtaaccatgttattaatgctgatgcccacagcgctggccttccatttaacgacgcggggcggggagccccacatgatcgtgtcgaagcaagaacggggcaagtccctgctgtttaagaccagcgccggcgtgaacatgtgcaccctcatcgccatggatctgggcgagctgtgcgaagacaccatgacctacaagtgcccccggatcaccgagaccgagccggacgacgtcgattgctggtgcaacgccacggacacctgggtcacctatgggacctgtagtcaaacgggcgagcaccggcgggacaagcggtccgtggctttagcgccccacgtgggtctggggttagagacacgcaccgaaacctggatgagttccgagggcgcctggaaacagatccaacgggtggagacgtgggctctgcgccaccctgggttcaccgtgatcgctcttttcctggcccacgcgattggcacctccattacccagaagggcatcatctttatactcctgatgttggttacccccagcatggccatgcgttgcgttggcattggcagccgcgacttcgtggaggggctttccggcgccacatgggtggacgtcgtgctggagcacgggagctgcgtaaccaccatggccaaggacaagcccacgctggacatcgagttactgaagacggaggtcacaaaccccgccgtgctgcgcaagctctgtatcgaggcgaagatctcgaacaccacgaccgatagccgctgcccgacgcagggggaggccactctggtggaagaacaggacgctaatttcgtttgcagacgtacgttcgtggacaggggctgggggaatggctgcgggctgttcggcaaaggatccctcatcacttgcgccaagttcaagtgcgtgactaaactggagggcaagatcgtccagtacgagaacctgaagtacagcgtgatcgtgaccgtccacaccggcgaccagcatcaagtgggtaatgagtccaccgagcatggcacgaccgctacgataactccccaggcgcccaccaccgagatacagttaactgactacggggcgctgacgcttgattgcagccccagaaccggcctcgactttaacgagatggtcctgctgacaatgaaagagaagtcctggctcgtgcacaaacagtggttcctggacctgcccctaccctggacaagcggggcgagcacgtcccaggaaacctggaaccggcaggatctgctggtaacattcaaaaccgcccacgcgaagaagcaggaagtagtggtgctcggcagccaagagggtgcgatgcacacggccctaactggagccaccgagatccagaccagcggcacgaccaccatcttcgcagggcacctgaagtgccgcttgaagatggacaagctgaccctgaagggcatgagctatgtcatgtgcacggggtcctttaagctagagaaggaggtggccgaaacccaacacggcacagttctggtccagatcaaatacgagggaaccgatgcgccttgcaaaatcccgtttagcacgcaagacgagaagggggtgacgcagaatggacggctgataacggccaatccgatcgtgactgacaaggagaagccggtcaacatcgaggccgagccaccctttggggagagctacatcgtgatcggcgccggcgagaaggccctgaaattgtcgtggtttaagaaaggatcctccatcggcaagatgtttgaagccacggcacgcggggcacggcgcatggcgatcttgggcgacaccgcgtgggattttggatccatcggcggcgtgtttaccagcgtaggaaagctggtgcatcagatcttcggaaccgcctatggggtcctcttctcgggcgtcagctggactatgaagattgggatcggcgtgctgctgacgtggttaggcctgaactcccgcagcacctccctgagcatgacttgcattgccgtggggttggtcacgctgtatctgggcgtgatggtgcaggcagacagcggatgcgtcatcaactggaagggccgcgaattgaaatgcgggagcggcatattcgttacgaacgaagtgcacacctggaccgagcagtacaagtttcaggctgacagcccgaagagactgtccgcggccatcggcaaggcctgggaggagggggtctgtgggattcggagcgccacgcgcctggagaacatcatgtggaagcagatctcgaacgaattaaaccacatccttctggagaacgacatgaaatttactgtggtggtcggggacgtggcgggcatcctcgcgcagggaaagaagatgatccggccccagcccatggagtacaagtacagctggaagtcatggggcaaggccaagatcatcggcgccgacgtccagaataccactttcataatcgacggtcccaacacccctgagtgcccggacgaccaacgagcctggaacatctgggaggtcgaggactacggcttcgggatctttaccaccaacatctggctgaagctgcgggactcatacacccaggtttgtgaccaccgtttgatgagcgccgcgatcaaagactcaaaggccgtgcacgccgacatgggctactggatcgagagtgagaagaatgagacctggaaacttgcccgggcgagcttcatcgaggttaagacatgcatctggccaaaatcccacaccctgtggtcgaacggcgtgctcgagtccgagatgattatccccaaaatctacgggggcccgatcagccagcacaactatcgccccgggtacttcacccagaccgctggaccctggcacttagggaagctggagcttgacttcgacctatgcgagggtacgaccgtggtcgtggatgagcactgtggcaaccggggaccgtccctgcgcacaaccacggtgacaggcaaaatcatccatgagtggtgctgccggagctgcaccctgccacccctccgcttccgcggagaggacggctgctggtacgggatggagatccgcccggtaaaggagaaggaagaaaacctggtcaagtccatggtgagcgccggcagcggcgaggtggactccttctcactcgggctgctatgcatctccataatgatcgaggaagttatgcggagccggtggagccggaagatgctcatgaccggcacactggccgtgtttttcctgctgatcatggggcagctgacctggaacgacttgatccgcctttgcattatggtaggagccaacgcaagcgaccgcatggggatgggcactacctacctagccctgatggccacgttcaagatgcgcccgatgtttgccgttgggctcctgttccggcgcctcacctcccgcgaggtgctactactaaccatcgggcttagcctggtcgcctccgttgagttgcccaatagtctcgaagaactgggcgacgggctggcgatgggcatcatgatcttaaaactgctaacggatttccagagtcaccaactctgggccacactgctgtccctcaccttcattaagaccaccttctccctccactacgcctggaaaacgatggccatggtcctgagcatcgtgtccctgttccccctttgcctgagcaccacctcccagaagactacgtggctccccgtgctgctaggcagcctagggtgcaagcccttgaccatgttcctgatcgcggagaacaagatatggggaagacgctcctggcccctcaacgaggggatcatggcggtcggcatcgtgagcatactgctgagctccctgctgaagaatgacgtccccctggccggacccctcatcgctggcgggatgctgattgcgtgctatgtcatcagcgggtcctctgcggacctgtccttagagaaggccgcggaagtcagctgggaggaagaggccgagcactcgggcgccagccacaacatcttagtggaggtccaggacgacgggaccatgaagataaaggacgaggagcgggacgacaccctgaccatcctcttaaaagcgactttgctcgccgtgtccggtgtgtacccgctgagcatccccgcaacactgttcgtctggtacttctggcagaagaagaaacagcgatccggggtcctctgggacacacccagcccgcccgaggtgggccgcgccgtccttgacgacggaatctaccgcattatgcagcggggtctgctgggacgcagccaggtgggggtgggcgtcttccaggagaacgtgttccacactatgtggcatgtgacgcgcggggccgtcctaatgtatcagggcaagcgcctggagcccagctgggcgtccgtgaaaaaggacctgatcagttacggagggggctggcggctccagggctcctggaataccggcgaggaggtgcaagttattgccgtcgagcccgggaagaaccccaagaacgtacagaccgcccccgggacctttaagacgcccgagggtgaagtcggggccattgccctggacttcaagcccgggacgagcgggtctccaatcgtgaaccgcgaggggaagatcgtgggcctgtacgggaatggcgtcgtgaccaccagcggaacgtacgtgagcgcgatcgcccaggccaaggcctcccaggagggcccgcttcccgagattgaagacgaggtcttccggaagcgcaacctgacgatcatggacctacatcccgggagcggcaagacgcgtcgctacctcccggcgattgtgcgcgaggccataaagcgaaagctacgtaccctaattctcgcacccacacgggtggtcgcctccgaaatggctgaggctctgaaaggaatgcccatcaggtaccagaccacagctgtcaaatccgaacacactgggaaggagatcgtggacctcatgtgccatgcgacgttcacaatgcgtctcctgtcccccgtccgggtgccgaattacaacatgatcattatggatgaggcccactttaccgatccctcttcaatagcggcgagaggctacatcagcacccgcgtgggcatgggcgaggcggctgctatcttcatgaccgcaaccccgccggggtctgtcgaggcgttcccgcagagcaacgccgtaattcaagacgaggaacgggatatccccgaaaggtcctggaacagtggctacgagtggatcaccgacttccccggcaagactgtgtggttcgttccctctatcaagagcgggaacgatatcgccaactgcctgcggaagaacggaaagcgagtgattcagctgtcgaggaagacgttcgacacggagtaccagaaaaccaaaaacaatgattgggactatgtggtcacgacggacatcagcgagatgggggcaaacttcagagccgaccgggtgattgacccgcgccggtgcctgaaacccgtgatactgaaagacggccccgagcgcgttattctcgcggggccgatgccggtgaccgtcgccagtgccgcccagcggcgtgggcggatcggcagaaatcacaacaaggagggggaccagtatatatacatgggccagcctctgaacaacgacgaagatcacgcgcactggaccgaggcaaagatgcttctggacaacatcaacacccccgagggcataatccccgccttgtttgagccggagcgagagaagtccgccgccatcgacggcgagtaccggctgagaggggaggcgcggaagacgttcgtggagctaatgcgcagaggggacctgcccgtatggctgagctacaaggtggcctctgagggcttccagtacagcgaccgccgatggtgcttcgatggggagcgcaacaaccaggttctcgaggagaacatggacgtcgaaatctggaccaaggagggtgagcgtaaaaagctgcgccctcgctggctggacgcccgcacctactcagatcccctggcacttcgggagttcaaggagttcgccgcggggcgtaggagcgtctcgggcgacctaatcctcgagatcggaaaactgccgcagcacctgacccagcgcgcccagaacgccctagacaacctggttatgttgcacaatagcgagcagggcgggcgggcctaccgccacgccatggaagaactacccgacacgatcgagaccctgatgttgctcgccctcatcgccgtgctcaccgggggagtcaccctcttcttcctgtccgggagaggactaggaaagacgagtatcgggctcctttgcgtgatggccagcagcgtgctgctttggatggcctcggtcgagccccactggattgcggccagcatcatactggagttcttcttgatggtactcctgatccctgagcctgaccggcaacgtacgccccaggacaaccagcttgcctacgtcgtcattggcttactgttcatgatcttgaccgtggcggccaacgagatgggactccttgagaccacgaagaaggatctgggaatcgggcacgtggcagtcgaaaatcaccaccacgcagctatgctcgacgtggatctgcaccccgcctccgcctggacgctgtatgcggtggcaaccaccatcatcaccccgatgatgcgtcacactatcgaaaacaccacagcaaacatcagcctaaccgccatcgccaatcaggccgccatcctgatgggcctagacaagggctggcccatctccaagatggacatcggggtgcccctcctggccctgggctgctatagccaggtgaaccccctcaccctgaccgctgcggtgctgatgctcgtcgcgcactatgccatcatcgggccgggtctacaagcgaaggccaccagggaggcgcaaaagcggactgccgcggggatcatgaagaacccgacggtcgacggaattgtggcgatcgacttagatcccgtggtctacgacgccaagttcgagaagcagctcggccagataatgctgctgatcctctgtaccagccagatcctgttaatgcgcacgacctgggcgttgtgtgagagcatcaccctggccaccgggcccttgaccaccctctgggagggatcccccgggaagttctggaacacgaccatcgccgtgagcatggccaacatcttcagaggctcctacctggctggcgcagggctggccttcagcttgatgaagtccctgggcggcggacgccgggggaccggcgcgcagggtgagacgctgggggagaagtggaagcgccagctcaaccagctctccaagtccgagttcaacacttacaagagatctgggatcatggaggtcgaccgaagcgaggccaaggagggactgaagcggggcgagaccaccaaacatgccgtgtcccgagggactgccaaactccggtggttcgtggagcgcaacctggtgaagcccgagggcaaggtcattgacctaggctgtggtcggggcgggtggagctactactgcgccggactgaagaaagtgaccgaggtcaaagggtacacgaaaggtggtcccgggcacgaggaaccgatcccaatggccacctacggctggaaccttgtgaagctacatagtgggaaggacgtgttcttcataccacccgagaagtgtgacaccctgctctgtgacatcggtgaaagctcccccaaccccacgatcgaggaggggaggacgttgcgggttctgaagatggtggaaccctggctccgtgggaatcagttctgcatcaagatactgaacccctacatgcccagcgttgtcgagactctggagcagatgcagcggaagcacggcgggatgcttgtacgcaatcctctgtcccggaacagtacccacgagatgtattgggtgtcctgcggcacggggaacattgtcagcgccgtgaacatgacgagtcgtatgctgttaaatcgcttcactatggcgcacaggaaacccacatatgagcgcgatgttgacctgggcgccggcacccggcacgtcgccgtggagcccgaggtggctaacctggacatcatcgggcagcgaatcgagaacatcaaacatgagcacaagagcacgtggcactacgacgaggacaacccctacaagacttgggcctaccacggctcctacgaggtcaagccgagcgggtctgcgagcagcatggtgaacggagtcgtcaagctcctgaccaagccatgggacgtgatccccatggtcactcagattgcgatgacggataccactcccttcgggcagcaacgggtgttcaaggagaaggtggacacccggacaccgaaggccaagcgtggcaccgctcagatcatggaagtaactgccaagtggctgtggggcttcctctcccgcaataagaagccgcgtatttgcacccgcgaggagttcacgcggaaggtgcgttcgaacgcggccatcggggcagtgttcgtagacgagaaccagtggaacagcgccaaggaggcggttgaagacgagcgtttctgggacctagtgcacagagagcgggagctgcacaagcagggaaagtgcgcgacctgcgtctataacatgatgggcaaacgcgaaaagaaactcggggagttcggaaaagcaaaaggcagccgcgccatctggtacatgtggctgggcgcccgcttcctggagttcgaggcgctcgggttcatgaacgaagaccactggttttcccgggagaacagcctgtccggcgtagagggcgaaggacttcacaaactcgggtacattctgcgcgacatttctaacatccctggcggtaacatgtacgccgacgataccgccgggtgggacacccggatcaccgaggacgacctgcagaacgaagcccgcatcaccgacattatggagccggaacatgcgctcctggctaagtcgatcttcaagctgacatatcagaataaggttgtacgcgtacagcggcccgccaaaaatggcaccgtgatggacgtcatcagccgccgggaccagcgcgggtccggccaggtgggcacgtatgggctgaacaccttcaccaacatggaggcccagctgatccgtcagatggagtctgaaggcatcttctccccatccgagctggagacaccgaacctcgccgagcgcgtgctggactggctggagaagtacggggtcgagcggcttaagcgtatggccatctccggtgatgattgcgtggtgaaaccgatcgatgaccggtttgctacagccctaaccgccctgaacgatatgggaaaggtcagaaaggatatcccccagtgggagccctccaaaggctggaacgactggcagcaggtcccattctgctcccaccactttcaccagttaatcatgaaggatggccgggagatcgttgtgccgtgccgaaaccaggacgagctggttgggcgagcccgcgtgagccagggggcggggtggtctctgcgggagactgcgtgcctcggaaagtcctacgcgcagatgtggcaattgatgtacttccaccgccgcgacctgcgcctcgccgccaacgccatctgcagcgccgtccccgttgactggatccctacctcccggaccacctggtccatccacgcgcaccaccagtggatgacaaccgaagacatgctgtcggtatggaacagggtgtggattgaggagaacccctggatggaggacaagacgcacatcagctcctggggcgacgtcccgtatttagggaagcgcgaggaccagtggtgtggcagcctcatcgggctgaccgcgcgggcgacctgggcgacaaacatccaggtggctataaatcaggtccgccgtctgataggcaacgaaaactacctcgattacatgacctcgatgaagcgcttcaagaacgagtccgaccccgagggggccttgtggtga

SEQ ID NO: 24541 - RNA, 9879 nt, synthetic construct
  misc_feature 1..9879: note = derived and/or modified CDS sequence (opt11) from DENV-1__EU482802__SS-prME
  source 1..9879: mol_type = other RNA
agtgtgaccatgctgctcatgctgatgccgaccgctttggccttccacctcacgacccgaggcggcgagccccacatgatcgtgagcaagcaggagcggggcaagagcttactattcaagacaagcgcgggggtgaacatgtgcacgctaatagcaatggacctgggagaattctgcgaggacactatgacctataagtgcccacgcatcactgaggccgagccggacgatgtggactgctggtgtaatgctaccgatacatgggtcacctacgggacttgctcccagaccggtgagcaccggagggacaagagatccgtagccctggcgccccacgtgggcctcgggctggagacgcgcaccgagacatggatgagctctgagggcgcctggaaacagatccaacgtgttgagacctgggccttacgtcaccccggctttacggtgatcgcgttattcctcgcccacgccataggcaccagcatcacccaaaaggggataattttcatcctgctcatgctggtaaccccttccatggctatgcggtgcgtcggcatcggcagccgcgacttcgttgaggggctgtcgggcgccacgtgggtggacgtggtgctcgaacacgggtcgtgcgtgactaccatggcaaaggacaagcccaccttggacatcgagctgctcaagacggaggtgaccaaccccgcggtcctgcggaaactgtgtatcgaggccaagatttccaacactaccacggacagccgctgcccgacccagggcgaggccacattggttgaggagcaagacgccaacttcgtctgcagacgaactttcgtggaccgcggctgggggaacggctgcgggctgttcggcaaggggtccctgatcacgtgtgccaagttcaagtgcgtgacaaagttagaggggaagaccgtccaatacgagaacttgaaatacagcgtaatagtcaccgtccacacgggtgaccagcaccaggtgggcaacgagtccacagagcacggcaccaccgcgacgatcactccccaggctcccagcaccgagatacagctgaccgactacggggccctaaccctggactgcagcccccgcacgggcctggattttaatgagatggtcctccttaccatgaaggagaaatcctggttggtccacaagcagtggttccttgaccttccgctgccctggaccagcggggcctccaccagccaagaaacgtggaaccggaaggacctccttgtgacattcaagacggcccatgcgaagaagcaggaagttgtggttttgggctcccaggaaggcgccatgcacactgccctcacaggggccaccgagattcagacctcaggtaccacgacaatcttcgccgggcaccttaagtgccgcctgaagatggacaagctcaccctgaagggcatgtcttatgtgatgtgtaccggaagcttcaagctggagaaagaggtcgcggagacgcagcacggcactgtcctcgtccagatcaagtacgagggcacagacgccccctgcaaaatccctttcagtacccaggacgaaaagggggtgacacagaacggccgactgataaccgccaaccctatcgtgaccgacaaggagaaacccgtcaacatagaggcggagccgccctttggggagagctacatcgtgatcggagcgggcgagaaggctctgaagctgtcttggttcaagaaggggagctccataggcaagatgttcgaggccaccgcccgcggggcccggcgcatggcgatcctcggcgatacggcctgggacttcgggtctattggcggcgtgttcacctccgtcgggaagctggtgcaccaaatcttcgggaccgcctacggcgtgctgttcagcggggtctcctggaccatgaagatcggtatcggcgttcttctgacgtggctgggcctcaatagtagatccacttccctctccatgacctgtatcgccgtagggctggtcacactctacctgggcgtgatggttcaggccgattcagggtgcgttatcaactggaagggccgagagctcaagtgcgggagcggcatcttcgtgactaatgaggttcatacgtggactgagcagtacaagttccaagccgactccccgaagcgcctctcagccgccatcggcaaggcctgggaagaaggagtctgcggcatccggagtgcaacaagactggagaatataatgtggaagcaaatcagcaacgagctgaaccacattcttctggagaatgacatgaagtttaccgttgtggtcggtgacgtggctggaattctggcccaagggaagaaaatgatccggccccagccgatggagtacaagtactcctggaagagctggggcaaggccaagatcatcggcgcggacgtacaaaatacgaccttcatcatcgacgggcccaataccccggagtgccccgatgatcagcgcgcgtggaacatctgggaggtcgaagactacggcttcggcattttcaccacgaacatttggctcaagctgcgggattcctacacccaggtgtgcgaccaccgcctcatgagcgccgccatcaaagactccaaggccgttcacgccgacatgggatattggattgagagcgagaagaacgagacctggaagctcgcgcgggcgagcttcatagaggtcaagacctgcatctggcccaaaagccacaccctgtggtccaacggggtgctggagtcggagatgattatccccaagatttacgggggcccgatctcccagcacaactaccgccccgggtacttcacccaaaccgccggcccctggcaccttggcaagctggagctggacttcgatctatgcgagggcaccacggtggtcgttgacgagcactgcggtaaccgggggccgagcctgcgaaccaccactgtgacgggaaagatcatccacgagtggtgctgccggagttgcaccctgccacccctgcgcttcaaaggggaagatggctgctggtacgggatggagattcggcccgtcaaagagaaggaggaaaaccttgtaaagagcatggttagcgccggcagtggtgaagtcgacagcttctccctagggttgttgtgcatcagcattatgatcgaagaggtgatgcgctccaggtggtcgcgcaaaatgctgatgacgggtaccctcgccgttttctttctgttgatcatggggcagctcacgtggaacgacttaatccggctgtgcattatggtcggcgcgaatgcctccgaccgcatggggatgggaaccacatacctagccctgatggccacgttcaagatgagaccgatgttcgcagtcgggctcctgttccggcgtctgacgtctcgggaggtactgctcctgaccatcggtctgtccctagtagcttcagttgagctgccgaactccctcgaggagctcggcgacggtttagccatgggcataatgatattaaaactccttaccgactttcaaagccaccagctgtgggcgaccctactgagtctgacgtttatcaaaacaaccttcagcctccattacgcctggaagaccatggcgatggtgctgtcgatcgtgagcctgctccccctgtgcttgtccacgaccagccagaagaccacgtggctccccgtgctactgggctccctcggttgcaagccgctgacgatgtttctgatcgccgagaataaaatatggggccgcaaatcatggccactcaatgaagggattatggcggtcgggatcgtcagcatcctactgtccagcttactaaagaacgacgtgcccctggccgggcccctcatcgcgggcggcatgttgatcgcgtgctacgtcatctccgggtcttccgcggatttatctctcgagaaggccgccgaggtctcttgggaggaggaggccgagcatagcggcgcatcccacaacatcctcgtagaggtccaggatgacgggacgatgaagatcaaggacgaggaacgggacgacacattaacaatcctcctgaaggccaccctgctcgccgtcagtggcgtctatccgctgtccatccctgccacgctgttcgtctggtacttctggcaaaagaagaagcagcgcagcggggtactctgggacaccccctcaccacccgaggtggagcgggcagtcctggatgacggaatttacaggatcatgcagagaggtctgctggggcgcagccaagtgggggtgggggtcttccaggaaaatgtgttccacaccatgtggcacgtgactcggggcgcggtcttaatgtaccaagggaagaggctcgaaccctcctgggccagcgtgaagaaggatctgatttcctatggcggtggctggcggctgcagggcagctggaacacgggggaggaagtacaagttatcgccgtggagcctggcaagaaccccaagaacgtgcagaccgcccccggaaccttcaaaacctccgagggcgaggtcggcgccatagcgcttgacttcaagccagggacgagcggcagcccaatcgtaaatcgtgagggcaaaatcgtgggcctctacggtaatggcgtagtgaccacctccggcacctacgtcagcgcgatcgctcaggcgaaggcgtcccaggaggggcccctccccgagatcgaggacgaggtctttcggaagcgcaacctgacgattatggacctgcacccaggctctgggaagacccggcgctacctccccgccatagtgcgggaggcaatcaagcgcaaactgaggaccctgattctcgcacccacccgcgtagttgcctccgagatggcggaggctctgaagggaatgcccatccgctaccagacaaccgccgtcaagagtgaacacaccggtaaggagatcgttgaccttatgtgccacgcaaccttcacgatgcgacttctgtcccccgtccgtgtgccgaactacaacatgatcatcatggacgaggcccacttcaccgacccgagctccattgcggctcgggggtacatcagcacgcgcgtgggaatgggggaggcggccgccatcttcatgaccgctacgcctcctggctccgtcgaagccttcccgcagagcaacgccgtcatccaggacgaggagcgggacatcccggaaaggtcctggaacagtgggtatgagtggattaccgactttccaggcaagaccgtttggttcgtcccctcgatcaagagcggcaacgacatcgccaattgcctgcggaagaatgggaaacgtgtgatacagctctcccggcgcaccttcgacacagagtaccagaagacaaagaacaacgactgggactatgtggtcaccaccgacatcagcgaaatgggcgcgaactttcgggccgaccgcgtaattgacccccggcgctgtctgaagccggtgatcctaaaagacgggcccgagcgggtcatccttgccgggccaatgcccgtgacggtcgcctccgctgcgcagcgccggggaaggatcggccggaaccacaacaaggagggcgaccagtatatatacatggggcagccgctcaacaacgacgaggaccatgcccactggaccgaagctaagatgttgctcgacaacatcaacacgcccgagggcattatccccgccttattcgagcccgagcgcgagaagtcagccgcgatagacggtgagtaccgcctgcggggcgaggcacgcaaaacctttgtggagctaatgcggcgcggggacctgccggtgtggcttagctataaggtcgcctcggagggcttccagtacagcgaccgtcggtggtgcttcgacggcgagcggaacaaccaggtgcttgaggagaacatggacgtggagatctggacgaaggagggtgagcgcaaaaagctgagaccccgctggctagacgcgcggacttactccgacccactcgccctgcgcgagttcaaagagttcgcggccggccggcgaagcgtttctggggacctgatcctcgagatcggcaaactgccacagcaccttacccaacgggcccagaatgctctcgacaacctggttatgctgcacaacagcgagcagggcggccgcgcgtaccggcacgccatggaggaactcccggacacaatcgagacgctgatgctgctcgcgctgatcgccgtgctgaccggcggggtcaccctcttctttctgtccggccgcgggctgggcaagacctcaatcggcttactgtgtgtcatggcatccagcgcgctgctctggatggcctccgtggaacctcactggatcgccgccagtattatcctggagttctttctgatggtcctccttatccccgagccagaccggcagcgcaccccgcaggacaaccaactggcctacgtggtcatcggtctcctgttcatgatcctgacggtcgcggccaacgagatgggcctcctcgaaaccactaagaaggaccttgggatcggacacgtggccgtggaaaatcaccaccatgccgctatgctcgacgtcgacctgcaccccgcctccgcctggaccctgtacgccgtggcgacgaccatcattactccgatgatgcgacacactatcgagaacacgaccgccaacatcagcctcacagcgatcgccaaccaagccgccatcctgatggggcttgacaagggctggccgatctcaaaaatggatatcggggtgcccctcctagcgctgggttgctacagccaggtcaacccgctaacacttacagccgccgtcctgatgctcgtggcgcactacgccatcataggccccgggctgcaggcaaaggccacccgagaggcccagaagcgcaccgccgcgggtattatgaagaatccgaccgttgacgggatcgttgcaatcgacctggaccccgtggtctacgacgccaagttcgagaaacagctgggccagatcatgctgctgattctttgcacgtcccagatcctgctgatgcggaccacgtgggcactgtgtgaaagcatcaccttagccacgggccccctgaccaccctgtgggaggggtccccgggcaaattttggaacaccactatcgccgtaagcatggcgaacatcttccgggggagctatctggccggcgccggtctggcattcagcttaatgaagtctctcgggggcggtcggcgcgggaccggggcgcagggcgagaccctgggggagaagtggaagcgtcagctcaaccagctttccaagagcgaattcaacacctacaagcggtccgggatcatggaggtggaccgaagcgaggccaaggagggcctaaagcgcggggagactaccaagcacgccgtcagtcggggcaccgcgaagctccgctggttcgtggaacggaacctggtgaaacctgaggggaaggtcatcgacctgggctgcggccgtgggggctggtcatactactgtgccgggctgaaaaaggtgaccgaagttaagggctacacaaagggcgggcccggacacgaagagcctatacctatggctacctacgggtggaacttagtcaagctgcactccggcaaggacgtgttctttatccccccggagaagtgcgacaccttactctgcgatattggggagagctccccgaacccaaccatcgaggagggccgcacgctacgcgttctgaagatggtcgagccgtggctacgggggaaccagttctgcattaaaattctgaacccgtacatgccctccgtggttgaaaccctggagcagatgcagcgcaaacatggcggcatgctggtgagaaaccctctaagtcgcaactccacccacgagatgtactgggtgtcctgcgggaccggtaacatcgtgagcgcggttaacatgacctcccggatgctgttgaaccgcttcacgatggcccacagaaagccgacctacgagcgggacgtggacctaggggccggcactaggcacgtggctgtcgaacccgaggtggcgaacctggatatcatcggccagcggatcgagaatatcaagcacgagcacaagagcacctggcactacgacgaggacaacccctacaagacctgggcctatcacggatcctacgaagtgaagcccagcggttccgcctccagcatggtcaatggggtggtgaagttgctgaccaagccctgggacgtgatccccatggtgacccagatcgctatgaccgatactacgcctttcgggcagcagcgcgtcttcaaggagaaggtagacacccggacacccaaatccaagcgcgggacagcacaaatcatggaggtgaccgcgaagtggctgtggggattcttaagcaggaacaagaagccgcgcatctgtacccgggaggagtttacgcgaaaagtcagatcgaacgcagccatcggcgccgtgttcgtggacgagaaccagtggaattctgcgaaagaggctgtcgaggatgagaggttctgggatctggtgcaccgggagcgcgagctgcacaagcaggggaaatgcgccacgtgcgtctataacatgatggggaagcgggagaaaaagctcggggagttcggcaaggcgaaagggtcccgcgccatctggtacatgtggctgggcgcgcggtttctggagttcgaggccctgggatttatgaacgaagaccattggttctcacgagagaactccctcagcggggtcgaaggcgaggggctgcacaagctcggatacatcctccgggacatctccaagatccccgggggaaacatgtacgccgacgacaccgctggctgggataccagaatcaccgaggacgacctgcagaacgaggccaagataacggacattatggagcccgagcacgcgttactggccaagagcatcttcaaattaacctaccaaaacaaggtggtgcgggtgcagcgcccggccaagaacgggaccgtgatggacgttatctcccgccgtgaccaacgcggcagcgggcaggtcggcacttatgggctcaacaccttcacgaacatggaagctcagctgatccggcagatggagtccgaggggatcttcagcccatcggagctggagacccccaatctcgccggccgcgtcctggactggctggagaagcacggggtggagcggttgaagcgcatggccatctcaggggacgactgcgtcgtgaaaccaatcgacgaccggtttgccaccgctttgacggccctaaacgatatggggaaagtccgcaaggatatcccgcagtgggaacccagcaaaggctggaacgactggcagcaggtgcctttctgctcccaccacttccatcagcttatcatgaaggacggcagggagatcgtggtgccctgcaggaaccaggacgagctggttgggcgagcccgagttagccagggtgcgggctggtccttgcgggagaccgcctgcctcggaaaaagctacgcccagatgtggcagttaatgtactttcaccgccgggacctgcgcctcgctgcgaacgccatatgctccgctgttccggtcgactgggtgcccacttcccggaccacttggtcgatccatgcccaccaccagtggatgacgaccgaagatatgctgagcgtgtggaaccgcgtctggatcgaagagaacccttggatggaagacaagacccatatctccagctggggcgacgtgccctacctgggcaagcgtgaggaccaatggtgcggctctctcatcgggctgacggcccgcgcgacctgggccaccaacatccaggtggccatcaaccaggtaaggaggctgatcggcaacgagaactacctcgactacatgacctctatgaaacgcttcaagaacgagtccgatccggagggggccttgtggtga

SEQ ID NO: 24542 - RNA, 9879 nt, synthetic construct
  misc_feature 1..9879: note = derived and/or modified CDS sequence (opt11) from DENV-1__EU482804__SS-prME
  source 1..9879: mol_type = other RNA
tcagtgaccatgctgctcatgcttatgcccactgccctagccttccaccttaccacccggggaggggagccccacatgattgtgagcaagcaagagcggggcaagagcttattgttcaagacctcggccggggtgaacatgtgcacgctcatcgcgatggaccttggcgagttctgcgaggacacgatgacttacaagtgccccagaatcaccgaggccgagcctgacgatgtagactgctggtgtaacgcaaccgacacctgggtgacttacgggacctgctcacagactggcgagcaccggcgggacaagcggtccgttgccctggcgccccacgttggcctggggctggaaacgcgcaccgaaacctggatgtcgtccgagggcgcgtggaaacaaatccagcgggtggagacctgggccctgcgccaccccggctttaccgtgatagccctcttcctggcgcacgccatcggcaccagcatcacccagaaaggcatcatcttcatcctgcttatgttagtcaccccctccatggccatgcggtgcgtcgggatcgggagccgcgacttcgtagaagggctctcgggggctacctgggtggacgtcgtgctcgagcacgggtcatgcgtaaccaccatggccaaggacaagcctaccctagatatcgaactgctcaaaacggaagtcaccaaccccgcggtactgcggaaactgtgcatcgaggccaaaatctccaataccaccacggacagccgctgccctacccagggcgaagccacccttgtagaggaacaggatgcgaactttgtctgccggcgcactttcgtggacagaggctgggggaacggctgcggactgtttggcaagggatccctgatcacttgcgccaagtttaagtgtgtgaccaaattggagggcaaagtcgtccagtacgaaaacttaaagtacagcgttatcgttaccgtgcacaccggtgaccagcaccaagtggggaacgagtccacggagcacggtaccaccgctacaattacaccccaggcccccagcacggagattcagctcaccgactacggggccctcaccctggactgttcgccccggaccggcttagatttcaatgagatggtgctcctgacaatgaaggagaagtcctggctggtgcacaagcagtggtttctcgacctgccgctgccttggacctcaggcgcttccacatcccaggagacatggaaccggaaggacttgctggtgacgttcaagaccgcgcacgccaagaagcaggaggtggtggtcctgggctcccaggaaggcgccatgcataccgccctcaccggggcaactgagatccagaccagcggcaccaccacgatctttgcggggcacctgaagtgccgtctcaagatggacaaactcaccctcaagggcatgagctacgtgatgtgcactggttcctttaagctagagaaggaggtggcggagacccagcacggcactgtcctcgtgcagattaaatatgagggcacagacgctccctgcaagatccccttctccactcaggacgagaagggggtaactcagaacggtcggctgatcacggctaaccctatcgtcacagacaaggagaagcccgtgaacatcgaagcggaaccgcccttcggggaaagttacatcgtaatcggcgcgggggaaaaggctcttaagctctcctggttcaagaaagggtcgtccatcggcaagatgttcgaggctaccgcgcgcggggcccgccgcatggcgattttgggggacactgcctgggacttcgggtcgatcggcggggttttcactagcgttggtaaacttgtgcaccagatcttcggcactgcctatggggtccttttcagcggcgtgagttggacgatgaagatagggatcggcgtgctcctaacttggttaggcctcaactcgaggtcaacgagtttatccatgacttgcatcgccgtcgggctggtaaccctttacctgggtgtgatggtacaagccgatagcgggtgcgttataaactggaagggtcgggagttaaagtgcgggagcggcatcttcgttaccaacgaggtccatacttggacggagcaatacaaattccaggcagattccccgaaacgcttaagtgccgccatcggaaaggcctgggaggaaggggtttgcggtatcaggtcaacaacccgcctggaaaacataatgtggaagcagatcagcaacgagctgaaccatatcctactagaaaatgacatgaagttcaccgtggtggttggggacgtggccggcatcctggcgcaagggaagaagatgatccggccccaacccatggagtacaagtactcctggaaaagctggggcaaggccaaaatcattggcgctgacgtacagaatacgacctttatcattgacgggcccaacaccccggaatgcccagatgatcagcgcgcctggaacatctgggaggttgaggattacgggttcggtatattcaccaccaacatctggctcaagctgcgcgactcctacacccaagtgtgcgatcaccgcctgatgtcggcagctatcaaagattcgaaagccgtccacgcggacatggggtactggatcgaaagcgagaaaaatgaaacctggaagctcgcgcgggcttccttcatagaggtgaaaacctgcatctggcccaaaagccacacactgtggagtaacggagtgctggagtcagaaatgatcatccccaagatctacgggggcccgatctctcagcacaactatcgccccgggtacttcacccagacggccggaccctggcatctcgggaaactggagctggacttcgacttatgcgaaggcaccacggtcgtggtggatgagcactgtggcaaccgggggccgtccctgcgcaccactaccgtcacggggaagatcatccacgagtggtgctgccgcagctgcaccctgccgcccttgcgctttaaaggagaggacggctgttggtatgggatggagatccggcctgtgaaagagaaggaggaaaacctggttaaaagcatggtcagcgccggctctggggaggtggacagcttctccttggggctcctatgcattagcattatgatcgaggaggtgatgcgctcccggtggagccgcaagatgctgatgacaggtaccctcgcggttttctttctgctaataacgggacagcttacttggaacgacctaatccgcctttgcattatggtcggtgcgaatgcctcggatcgtatggggatggggaccacctacctcgccctaatggccaccttcaagatgcgaccgatgttcgccgtagggctactgttccgtcgcctgaccagccgggaggttttgctattgacgataggtctctccttagtggcaagcgtcgagttgcccaactccctcgaggagttaggggacggactggcgatgggcatcatgatattaaagctcctgacggacttccaaagccaccaactgtgggcgaccttgctgtcccttaccttcatcaagaccacctttagccttcactacgcctggaagacgatggccatggttctttctatcgtctcgctgttcccactctgcctgtccacaacgtcgcagaagacaacgtggttgcccgtcctcttgggctccctgggctgcaaacctctcaccatgttcctgatcgcggagaacaagatatgggggaggaagtcttggccgcttaatgaagggatcatggcagtgggcatagtcagcatcctcctgtccagcctattgaaaaatgacgtacctctcgcaggacctctgatcgccggaggcatgctaatcgcctgttacgtaatttcgggcagctccgcggacctgagcctggagaaggccgccgaggtatcctgggaggaagaggccgagcatagtggcgcatcacacaacatcctcgtcgaagttcaagacgatgggaccatgaaaatcaaggacgaggaacgggacgacaccctgaccatcctactcaaggcgactctgctggccgtgagcggggtgtacccgctctcaatccccgccacgctgttcgtttggtacttctggcagaagaagaaacagcgctcaggggtactatgggatacgcccagtccacccgaggtcgagcgggccgtgttagacgacggcatataccgtatcatgcagcggggactgctggggaggtcccaggtgggcgtcggggtattccaagagaacgtctttcatacgatgtggcacgtcactcgtggcgccgtgctgatgtaccaggggaagcgcctcgaaccgtcctgggcgagtgtaaagaaggacctgatatcctacggcggcgggtggcggttacagggctcgtggaatactggagaggaggtccaggttattgccgtggagcccgggaagaatcccaagaatgtccagacagcccctgggaccttcaaaacctcggagggcgaggtgggcgccatcgccttggactttaagccggggacctctgggagccctatcgtgaaccgggagggtaagatcgtcggcctgtacggaaatggggtggtgaccacatccggcacgtacgtcagtgcgattgcccaagccaaggcatctcaggaaggtcccctgcccgagatcgaggacgaagtcttccgcaaaagaaacctcacgatcatggacctgcaccccggaagcgggaaaactagacgatacctgcccgcgatcgtgagagaggccattaagcgcaaattacgcaccttaatcttggcccctactcgcgtcgtggctagtgagatggccgaagccttaaagggcatgccaatacgctatcagaccaccgccgtcaaaagcgagcacaccggaaaggaaatagtcgatcttatgtgtcatgccacgttcaccatgcggttattatcccctgtgcgcgtgcccaattataacatgatcatcatggatgaggcccattttacggatccgagctctatcgccgcgcggggctacattagcacacgcgtcggtatgggtgaagccgcagctatctttatgacggcaacgccacccggctccgtggaggccttcccccagagcaacgccgtgatacaggacgaggagcgcgacattccggagcgctcctggaacagcgggtacgaatggatcaccgacttcccaggcaagaccgtttggttcgtgccatctatcaagtctggcaacgacatcgccaattgcttacggaagaacgggaagcgcgtcatccagttaagccggaagacattcgataccgagtaccagaagacgaagaacaacgattgggactatgtggttaccacggatataagcgagatgggcgccaacttcagggcggaccgggtcatcgacccgagacggtgcctcaagcccgtcatactgaaagacggtccagagcgagtcatcctcgccggccccatgcctgttaccgtggcctctgccgcccagaggagagggcggatcggccgcaaccacaacaaggaaggggaccagtacatctatatggggcagccgctaaacaacgatgaggaccacgcgcactggaccgaggccaagatgctgctggacaatattaatacgcccgaaggtatcatccccgccctcttcgagccggagcgggaaaaatccgccgccatcgacggggagtaccgcctgcgcggtgaggcgcggaagacttttgtggagctgatgcgccgcggggacctcccagtttggcttagctacaaagtggcctccgagggcttccagtactcggatcgccggtggtgttttgatggagagcgcaacaatcaagttctggaggagaatatggacgtcgagatctggacgaaggaaggggaacggaaaaagctccgcccccgctggctagacgcgcgcacctactctgaccctctcgccctgcgggagttcaaggagttcgccgccggccgcagaagcgtgtccggggacttaatactggaaatcggcaagctcccccagcacctgacccaacgtgctcaaaatgcattggacaacctcgttatgctgcacaacagcgaacagggcggccgggcctacagacacgccatggaggagctgccggacacgattgaaactctcatgcttctcgccctcatcgccgtcctgaccggcggagtgaccctgttctttctgtcaggccggggtctaggcaaaacgagtatcggtcttctctgcgtgatggcttctagtgtcttgctgtggatggcaagcgtggaaccccattggatcgcggcctctattattctggagttcttcctgatggtcctgctcattcccgagcctgaccgccaacggacgccacaggacaaccaactcgcctatgtcgtaatcggactcctcttcatgatcctgacagttgccgccaatgagatgggtctgctcgaaaccaccaagaaagacctgggtatcggccacgttgctgccgagaatcaccaccacgccgccatgctggacgtggacctccatccggcgtccgcgtggacgctgtacgccgtagccaccaccatcataaccccgatgatgcgccacaccatcgaaaataccacggccaacatttctctaaccgcgatcgctaaccaggccgccatactcatggggttagacaagggatggccgatctccaagatggatataggcgttccacttctcgcgctcggatgctattctcaggtgaatccacttaccctcaccgcggctgttctgatgcttgtcgcccactacgctatcatcggcccggggctccaggcaaaagcgaccagagaggcccagaagcgcacagctgccggcatcatgaagaacccgacggtcgacggaatcgttgcgatcgacctggaccccgtcgtttatgacgcgaaattcgagaagcaactgggccagatcatgctcctgatactgtgcacaagccaaatcctcctaatgcgcacaacctgggccctgtgtgagagcatcacgttggccactggccctctgacgacgctgtgggaggggtcaccaggaaagttctggaataccacgatcgctgtcagcatggccaatatcttccgtgggagctacctcgctggagccggcctcgccttctccctaatgaagtccctcgggggcggccgccggggcaccggggcgcagggcgagacgctaggcgagaagtggaagcgccagcttaaccagctctccaagtcggagttcaatacctataagcggtccgggatcatggaagtcgaccgcagcgaggcgaaagagggcctgaagcggggcgagaccaccaagcacgccgtgagccgcggcacagccaagctgcgctggtttgtggagcgcaaccttgtcaagccggagggtaaggtgatcgatctgggctgcggcagaggtgggtggtcatactactgcgcgggcctgaaaaaggtaacggaagttaagggatataccaaaggcgggccgggacatgaggagcccatccccatggccacctacggctggaacctggtaaagttgcactccggtaaagacgttttcttcattccgcctgagaaatgtgacaccctgttatgcgacatcggggaaagctccccgaaccccacaatcgaggagggccgcaccctccgagtgctgaagatggtggagccgtggctgcgagggaatcagttttgcatcaagatattgaacccgtatatgccctctgtggtcgagaccctggagcagatgcagcggaagcacggcggcatgctggttcgcaaccctctctcccgtaacagcactcacgagatgtactgggtgagttgcggtaccggcaacatcgtgtctgcggtgaacatgacgtcgcgcatgctactgaaccggttcacgatggcccaccgcaaacccacctacgagagagacgttgacctgggggctggcacgcggcacgtcgcagtggagcctgaggtggccaacttagacattatcgggcaacgcatcgagaatatcaagcacgaacacaagagcacctggcactacgacgaggacaacccttacaagacatgggcgtaccacgggagttacgaggtcaagccctcgggtagtgctagtagcatggtgaatggggtcgtgaaactgcttacgaagccatgggatgtgataccaatggtaactcagatcgccatgactgacaccaccccattcggccagcagagggtgtttaaagagaaggttgacacccgaactcccaaggctaagcgggggaccgcccaaatcatggaggtcaccgctaagtggctgtggggcttcctctcccgcaacaagaagccgcgcatatgcacccgcgaagagttcacgcgtaaggttcgcagcaacgcagctatcggcgccgttttcgtggacgagaaccagtggaacagcgccaaagaggccgtggaggacgagaggttctgggacttagtacaccgcgaaagggagctgcacaagcagggtaagtgcgcgacctgcgtttacaacatgatgggaaagcgcgagaagaagctgggtgagttcggcaaggccaagggtagcagagcgatttggtacatgtggctcggagcgcgattccttgagtttgaggcactgggcttcatgaacgaggaccactggttttcccgtgaaaactccctctccggggttgagggtgaggggctgcacaaactgggatacatactccgggacatttctaagatcccagggggcaacatgtatgcagacgataccgccggatgggatacccgaatcaccgaagacgacttgcagaacgaggccaagattaccgacatcatggagcccgagcacgcactgcttgcgaagtccatcttcaagctgacctaccagaacaaggtagtcagggtacagcgtccggctaagaacggcaccgtgatggacgtgatctcccgcagagaccagcggggatccggccaggtgggtacgtacggcctgaataccttcacaaacatggaggcccagctcatccgccagatggagagcgaggggatcttttcaccatccgagctggagacccccaacctggctggccgggtgctcgactggctagagaagcacggggtggagcgcctgaaacggatggcgatctcaggagacgactgcgtggtcaagccaattgacgaccgcttcgccacggctctcaccgccctaaatgacatggggaaggtcaggaaggacattccgcagtgggaaccgagcaagggctggaacgactggcagcaagtccccttctgcagtcaccacttccaccagcttatcatgaaagacggaagggagatagttgtcccctgtaggaaccaagatgagttagtggggcgagccagagtgtcccagggcgcgggctggtccctgcgcgagaccgcctgcctgggaaaatcctacgcccagatgtggcagctaatgtactttcatcggcgcgatctgcggctggccgcgaatgccatttgctcagcggtcccggtggattgggttccgacctcccgcactacgtggagcattcacgctcaccaccagtggatgaccaccgaggacatgctctctgtttggaatcgggtgtggatagaggaaaatccctggatggaggacaagacacacatctcgtcctggggagacgtgccgtatttaggcaagcgcgaggaccaatggtgcggctccctgatcggtctgactgcccgggctacgtgggccacaaacattcaagtggccatcaatcaggtgcgacggctgatcggcaacgagaactatctggattacatgaccagcatgaagcgcttcaagaacgagtctgacccggaaggggccttatggtga

SEQ ID NO: 24543 - RNA, 9879 nt, synthetic construct
  misc_feature 1..9879: note = derived and/or modified CDS sequence (opt11) from DENV-1__EU482806__SS-prME
  source 1..9879: mol_type = other RNA
tctgtgaccatgctgctcatgctgatgcccacagctctggccttccatcttacaacccgcggcggcgagccccacatgatagtgaccaagcaggagcggggcaagagcctcctgtttaagacctctgcgggggtaaacatgtgcacactcatagccatggacctcggtgagttgtgcgaggacaccatgacttacaaatgcccgcggattaccgaggccgagcccgacgacgtcgactgctggtgtaacgccacggatacatgggtcacctacgggacgtgcagccaaacgggcgaacaccggcgcgataaacggtccgtagccctcgctccccatgtgggcctgggtctggagacccgtactgagacgtggatgagttctgagggcgcatggaagcagatccagcgggtcgagacgtgggccctcaggcatcccgggtttactgtcatcgccctgttcctggcgcacgcaatcggcacctcaatcacacagaagggtatcatattcatactccttatgctggtgacgcccagtatggccatgcggtgcgtcggaatcggcagtcgggattttgtagaggggctcagtggcgccacctgggtggacgttgtgctggagcacgggtcctgcgtgaccaccatggcgaaggacaagccaacgctggacatcgaacttttaaagaccgaggtcaccaaccctgcggtgctgcggaagctgtgcatcgaggccaagatctcgaacactacgaccgacagccgctgcccaacccaaggcgaagctaccctgatggaggagcaggatgccaacttcgtatgcagacgcacgttcgtcgatcggggttgggggaatggctgtgggctgttcggcaaggggtcgctaatcacgtgcgccaagttcaagtgcgttaccaagctggagggcaagattgttcagtacgagaacttgaagtacagtgtcatagtaaccgttcacacaggcgaccagcaccaagtcgggaacgaaagcaccgagcacggtacaaccgcgaccattacgccccaagcccccacctctgagatccagctcaccgattacggagccctgaccttagactgcagcccccgtacgggccttgacttcaacgagatggtgctactgaccatgaaggagaagtcctggctcgtccacaagcagtggttcctggacctgccgctcccctggacctctggggcaagcacgtcccaggagacgtggaatcgccaggacctgcttgtgacgttcaagacagcccacgcgaagaaacaagaggtggtggtgctcggcagccaggagggcgcgatgcacaccgcactgacaggagccaccgaaatccagacctcgggcaccacgacaatcttcgctggccacctcaagtgccgcctcaagatggacaaacttacgttaaagggcatgtcgtacgtgatgtgcacggggtccttcaagctcgagaaggaagtcgcggagacgcaacacgggaccgtgcttgtccaaatcaagtacgagggcacagatgcaccctgcaagatccccttcagtacccaggatgagaagggtgtcacgcagaacggccggctaattactgcgaaccccatcgtgacggataaggaaaagcctgtcaacatcgaagccgagccgcccttcggggagtcctatatcgtaatcggcgcgggtgagaaggctctgaagctcagctggtttaagaaaggcagctccatcggaaaaatgttcgaggccaccgcgcgcggtgcacggcgcatggccatcctgggcgacacggcctgggacttcgggtccataggcggcgtgttcaccagcgtgggaaaattggtccaccagatcttcggcaccgcgtacggtgtattattctccggcgtgagctggacaatgaaaatcgggataggagtccttttgacgtggctcggtttgaactcccgatcaacgtcactaagcatgacatgtatcgccgtcggtctcgtgaccctgtacctcggggtcatggttcaggccgactccgggtgcgtcatcaactggaagggccgggagctgaagtgcggaagcggtatctttgtcacaaacgaagtccacacgtggaccgagcaatataagttccaggcggactcaccgaagcgtctgtccgccgccataggaaaggcctgggaggagggagtgtgcgggatacggtcagcgacacgcttagagaatatcatgtggaagcagatttccaacgagctgaaccacatcctgctggagaatgacatgaaattcactgttgtggtgggtgatgtcgtgggcattctcgctcaggggaagaaaatgatccgtccccaacctatggaacataagtacagctggaagtcctggggcaaagccaagatcatcggagccgatgtccagaacacgaccttcatcatagacgggcccaatacaccggagtgcccggatgaccagagagcctggaacatatgggaggtcgaggactacggattcggtatcttcaccacgaacatctggttgaaactgcgagacagctatactcaggtatgcgaccaccgcctaatgtcagcggcaatcaaagacagcaaagccgtccacgccgacatgggttattggatcgagtccgagaagaacgagacttggaagctggccagagcgtcattcatcgaggtcaagacctgcatctggcccaagtcgcatacgctgtggagcaacggcgtcctcgaatcagagatgatcatccccaagatctacggtggcccaatctctcaacacaactaccgccccgggtattttactcagaccgctggcccctggcacctaggaaaattagagctcgacttcgacctatgcgaaggcaccaccgtcgtggtggacgagcactgcggaaatcgggggccgtccttgcgcacgaccaccgtgacaggcaagatcatccacgagtggtgctgtcggtcctgcacacttccacctctccggttcaaaggggaagatggctgttggtacggaatggaaatccgtcccgttaaggaaaaggaggaaaatctggtaaagagcatggtgtccgccggaagcggtgaagtcgattccttctctctcggtctactgtgcatttctataatgatagaggaagtgatgcgctcccggtggagccgtaaaatgctcatgacaggtacactggccgttttcttactgttgatcatgggccaactgacgtggaatgacctgatcagactgtgcataatggtgggcgccaacgcgagcgacagaatggggatggggaccacctacttggccctcatggccacctttaagatgcgtccgatgtttgccgtgggcctgctgtttaggcgtctcacgtcccgggaggtgctgctgctcaccatcggcttgagcctggttgcctctgtcgagttgccaaactccctggaggagctgggcgacgggcttgcgatgggcattatgatcctcaaactgctaacggactttcagagtcaccagctgtgggcgacgttattaagcctaacgttcataaaaaccaccttgtccttgcattacgcctggaagactatggccatggtccttagcatcgtttccctcttccccctttgcctatcgaccacctcccagaagaccacctggttacctgtgctcctaggcagtctagggtgcaagccgctcacgatgttccttatcgcggaaaacaagatctggggacgcaaatcctggcccctcaacgaaggtatcatggccgtcggcgtggttagcatccttctaagctcgctgctgaaaaacgacgtccccctggccgggcccctgatcgccggcggcatgctcatagcgtgctacgtgataagcgggtccagcgctgacctatccctggagaaggccgcagaggtatcgtgggaagaagaggccgaacacagtggtgcctcgcacaacatactcgtcgaggtgcaggacgacgggaccatgaagatcaaagacgaggagcgggacgacactctcacaatcctgctcaaggcgactcttctagcagtctccggcgtctacccgctgtcgatacccgccactctgtttgtgtggtacttctggcagaaaaagaagcaacgaagtggtgttctgtgggatacacctagtccgccagaggtcgagcgggctgttctggacgatggcatataccgcattatgcaaaggggcctactggggaggtcacaggtgggtgtcggggtgttccaggagaacgtgttccacactatgtggcacgtcacacggggcgccgtgctgatgtaccaggggaagcgtctcgaacccagttgggcttccgtgaaaaaggacttgatcagctacggaggcggatggaggcttcaaggatcctggaacacgggggaggaagtccaggtgatcgcggtggagcccgggaagaaccctaagaacgtccagaccgccccaggcacctttaaaacccccgagggcgaagtgggcgccatcgcactcgacttcaagcctgggacgtcaggctcccccatcgtgaaccgtgaggggaagatcgtcggcctgtacggcaatggggtcgtgaccaccagtggcacatacgtaagcgcgatcgcccaggcgaaggcatcccaggagggtcccctgcccgaaattgaggacgaggtgttcagaaagcgcaacttgacgatcatggatctacaccccggctcggggaagacgcgtcggtacctgcctgcgatagtgcgggaagccattaagcgcaagctacgtaccctgatcctggcccccacccgcgtcgtggcttcagagatggccgaggcattgaagggcatgccgatacgctaccagacgaccgccgtaaagtctgagcatacaggcaaagagatcgtcgaccttatgtgtcacgccacgtttactatgcggctactgtcccccgttcgagtgcccaactacaacatgataatcatggatgaagcccactttacggacccgagctccatcgccgctcgtgggtacatctccacccgtgtcggcatgggtgaggcggccgccatcttcatgacagcgactccacccggcagcgtggaagcgttcccgcagagcaacgcggtcatccaggatgaggaacgagatattcccgagcggtcctggaacagcggctacgagtggatcaccgactttcctgggaagactgtttggttcgtcccctccatcaagtcaggcaatgatatcgcgaattgcctgcggaagaacgggaagcgcgtgatccaactgtcccggaagacgtttgacacggaataccagaaaaccaagaataacgactgggattacgtcgtgaccaccgatatcagcgagatgggagcgaatttccgcgctgaccgagtgatcgacccgagacggtgcttaaaacccgtcatcttaaaggacggtcccgagcgcgtgattctggccggacccatgcccgttactgtggcttctgccgcccagcgacgcggtcggatcgggcgcaaccataacaaggagggcgatcagtatatatacatgggtcagcccctcaacaacgacgaggaccacgcgcactggaccgaggccaagatgctgctcgataacatcaatacccccgagggcataatccccgcgctattcgagccggagcgggagaagtctgcagccatagacggggagtacaggctgcgcggcgaggcccgtaagaccttcgtggaactaatgcgacgcggggacctccccgtctggctgtcctacaaggtggcctcggagggcttccagtacagcgaccggcggtggtgcttcgacggcgagcgcaacaaccaggtactggaggagaacatggacgtcgaaatctggacaaaggagggagagcgcaaaaagctccgcccccggtggctcgacgcaagaacctactccgacccccttgccctccgggagtttaaggagttcgccgccggccgccggagcgtctcgggggacctgatcctggagattgggaagctcccgcagcatcttacccagcgcgctcaaaatgctctggataacttagtcatgctgcacaacagcgaacagggcgggcgagcctatcgccatgccatggaggagctgcccgatacaatcgagacgctcatgttactcgcccttatcgccgtcctgaccggcggggtgacgctattctttctctccggccggggtctgggcaagacctcgatcggactgctctgcgttatggcctcctccgtcctactgtggatggcatctgtggaaccccattggatcgcggcctcgatcatcctcgagttctttctgatggtgttattgatccccgagcctgacaggcaacggacgccccaggacaaccagctggcgtacgtcgtgatcggccttctctttatgatactgacggtggccgccaacgaaatgggcctgctagagactaccaagaaggacctggggatcggccacgttgcggtggagaatcatcaccacgccaccatgctggacgtggacctccacccggcgtctgcctggacgctctacgccgtagccaccaccatcataaccccgatgatgcgccatacgatcgaaaataccacagccaacattagcctgaccgccatcgccaaccaggccgcgatactcatgggtcttgataaaggctggccgatctcaaagatggacatcggcgtacctctgctcgcactggggtgctacagccaggtgaatcccctgactttaaccgccgcagtcctgatgctagtggcgcattacgccatcataggtccggggctccaggccaaggcgactcgggaggcccaaaagcgaaccgctgcgggtatcatgaagaaccccacggtcgacggcatcgtcgccatcgacttagaccccgtggtgtacgacgccaagttcgaaaagcagttgggccagataatgctcctgattttatgcacgtcccaaatactcctgatgcgcacaacgtgggccctgtgcgagtccattacgctagcgaccggccccctaaccactctgtgggaggggtccccaggcaaattttggaatactacaatcgcagtcagcatggctaacatcttcagagggtcctacttggcaggcgccgggctggcgttcagcctaatgaagtccttagggggtggaagacgggggaccggggcccagggtgagacgctgggtgagaaatggaagcgccaactgaatcagctcagtaaaagcgagttcaacatctacaagaggtccgggatcatggaggtggacaggtccgaggccaaggagggactgaagcgcggggagacgacccgccacgccgtgagtcggggaacagcgaagctgcgctggttcgtcgagcgcaatctggttaagcctgaagggaaagtgatcgatctcggatgtggccgcgggggatggtcttactattgtgccggacttaagaaggttaccgaagtgaagggttacaccaagggaggacccggccacgaggaaccaatcccgatggcaacgtacggctggaacctggtgaagctacactccggcaaagacgtcttctttacgccacccgagaagtgcgatacccttttatgcgacatcggggagagctcccctaacccgacgatcgaggaagggaggaccctccgggtcctaaagatggtagagccctggctgcgggggaaccagttctgcatcaagatcctcaatccttacatgcccagcgttgtggagaccctagagcagatgcagcggaagcatggcggcatgctggtgcgtaatcccctctcccgcaacagcacccacgagatgtactgggtatcctgcgggacgggcaacatcgtttctgctgtgaacatgacttcccggatgttgctgaaccgcttcacaatggctcaccgtaagcccacctatgaacgtgacgtcgacctgggcgcgggaacccgccacgtagcagtagagccagaggtcgccaacttagacataattgggcagaggatcgagaatatcaagcacgagcacaagagcacgtggcactacgacgaagacaacccctacaaaacctgggcttaccacggaagctacgaagtgaagccgagcggcagtgccagtagcatggtcaacggggtagtgaagctcttaaccaagccctgggacgttatccctatggtcacccaaatcgccatgacggacaccaccccgttcggccaacagcgcgtcttcaaggagaaggttgacacccgaacgccgaaggcgaagaggggaacggctcagattatggaagtcaccgcccggtggctgtggggcttcctgtcccgcaacaagaagccccgtatctgcacccgcgaggagttcacgcggaaggtacgaagcaacgccgcgattggtgctgttttcgtggatgagaaccaatggaactccgccaaggaagccgtggaggacgagagattttgggaccttgttcagaaggagcgggagctgcacaaacagggaaaatgcgcgacctgcgtatacaacatgatgggaaagcgggaaaagaagctgggtgagttcggcaaggccaagggaagccgcgccatctggtacatgtggctaggcgccaggttcctggagttcgaagccctcggcttcatgaacgaggaccactggttctcccgcgaaaattctctctccggggtggaaggcgagggactgcacaagctgggctacattcttcgtgatatctctaagatacccgggggcaacatgtatgccgacgatacagcgggctgggacacccgaatcactgaagacgacctgcagaacgaggccaagatcaccgacataatggagccagagcatgccctgcttgctacctccatattcaagttgacctaccagaacaaagtcgtaagagtccagcgtccagcaaagaacgggactgtcatggacgttatcagcaggcgcgatcagcgcggctccggccaggtgggtacctacggcctgaacaccttcaccaacatggaggcacagttaatcaggcaaatggagagcgagggcatcttctccccatgcgagctggaaatcccaaacctggcagagcgcgtgctcgactggctggagaagtacggcgttgagcgactgaagaggatggccataagcggcgacgactgcgtggtcaaacctattgatgaccgcttcgcaacggccttaacagccctgaacgatatggggaaggtacggaaggacgtaccgcagtgggagccttcgaaggggtggaacgactggcaacaagtgcccttctgctctcaccacttccaccaacttatcatgaaggatggccgggagatagtggtgccgtgcaggaaccaagacgagctcgtcggccgagctcgcgtatctcagggggccggctggagtctgagggagaccgcctgcttgggcaagagctacgcccaaatgtggcagctaatgtattttcaccgccgtgacttacgcctggccgccaatgccatctgttccgcggtccccgtcgactgggtgcctacaagtaggaccacctggtcaatccacgcgcaccaccaatggatgacaacggaagacatgctcagcgtgtggaatcgtgtctggatcgaggagaacccctggatggaagacaaaacgcacgtgtcgtcctggggcgacgttccgtatctgggtaaacgcgaagatcagtggtgcggatccctgatcggcctcaccgcccgcgccacctgggcctcaaatatccaggtcgcgatcaaccaggtgaggagactgatcggcaacgagaactacctggactacatgaccagcatgaagcgttttaagaacgaaggcgaccccgaaggagctctctggtag

SEQ ID NO: 24544 - RNA, 9879 nt, synthetic construct
  misc_feature 1..9879: note = derived and/or modified CDS sequence (opt11) from DENV-1__EU482807__SS-prME
  source 1..9879: mol_type = other RNA
tccgtgaccatgctgctcatgctgatgcccacagccctggccttccatctcacgacccgcggcggggagccacatatgatcgtgagcaaacaggagcgggggaaaagtctgcttttcaaaacctctgcgggggtgaacatgtgtaccctggtcgccatggatcttggggaattttgtgaagatacgatgacctacaaatgtccccgcatcactgaagcagaacccgacgacgtagactgttggtgcaatgcaaccgacacgtgggtgacctacggaacctgctcccagaccggggagcaccggcgcgataagcggtccgtggccctggcgccccacgtgggcttagggctggagacgcgcaccgagacctggatgagctctgaaggcgcctggaagcaaatccagcgggtggagacctgggccctgcgtcacccggggttcacggtcatcgcgctctttctggcacacgccattggcaccagcatcacacaaaagggcatcattttcattctactcatgctggtcaccccctccatggccatgcggtgcgtggggatcggaagccgcgacttcgtggaggggctgtccggcgccacatgggtcgacgtggtgctcgagcatgggtcgtgcgtcaccaccatggccaaggataaaccgaccttagatattgagctgctcaagacggaggtgaccaaccccgcggtgctgcgtaagttatgcatcgaggcaaagatctcaaacaccacgacggacagccgctgtccgacgcagggggaggccaccctagtcgaggagcaggatgccaatttcgtgtgccgccgcacatttgtggacaggggctggggaaacggttgcgggctgtttggtaaggggtccctgatcacttgcgcaaagttcaagtgcgtcacgaaacttgaaggcaagacagtgcagtacgagaatctgaagtacagcgtgatcgtgactgtccatacgggcgatcaacatcaggtggggaacgaatctaccgagcacggaaccaccgcgaccatcacgccacaggcccccagcaccgagatccagctgactgactatggggctctcactctggactgctctccccgcaccggcctggacttcaacgagatggtactcctgaccatgaaggagaagtcctggctggtgcacaagcaatggttcctcgacctgccgttgccatggacgagcggggcctccaccagccaggaaacgtggaataggaaggacctcctggtcacatttaagaccgcgcacgcgaagaagcaggaggtcgtggtattgggctcccaggagggtgccatgcacaccgcccttaccggggccacggagatccagacgagcggcaccacaacaatcttcgccgggcatttaaagtgtaggctcaagatggacaagctcaccctgaagggcatgtcctacgtaatgtgcaccggctctttcaagctggaaaaggaggtggccgagacgcagcacggcacggtcctagtgcagatcaaatatgagggcaccgatgccccgtgtaagatccccttctccacccaggacgagaaaggggtcacgcagaacggccggctgatcaccgccaacccgatcgtaaccgacaaggagaagcctgtgaacattgaggctgaaccgcccttcggagagagctatatcgtaatcggcgcgggcgagaaagcccttaagctgtcctggttcaagaaaggaagcagcatcggcaaaatgttcgaagccaccgcgcgcggggcccggcgtatggcgatcctcggcgacacagcatgggacttcgggagcatcgggggcgtgttcacaagcgtgggtaaactggttcaccagatatttggcaccgcctacggggtattattcagtggcgtttcctggaccatgaagattgggatcggcgtattacttacgtggctgggcttaaacagtcgcagtaccagtctgtccatgacctgcatcgccgtcgggctggtgaccctatacctgggcgttatggtccaggcagacagcgggtgcgtgatcaactggaaaggcagggagcttaagtgcggaagcggcatcttcgtgactaacgaggtacatacatggaccgaacagtacaaattccaggccgactcgccgaagcggttatctgccgccatcggcaaggcctgggaggagggcgtctgcggaatcaggtcggccacccggctcgagaacatcatgtggaaacagatttcaaacgagctaaaccacatcctcctggagaacgacatgaagttcaccgtggtcgtaggggatgtggctggcatcctcgcccaagggaagaaaatgatccggcctcagcccatggagtacaaatattcctggaaatcatggggcaaggccaaaatcataggagccgacgtacagaacacgacctttatcatcgacggacccaataccccggagtgtcccgatgaccagcgtgcgtggaacatctgggaggtggaagattacggcttcgggatctttaccaccaacatctggttaaagctgcgggattcctacactcaagtgtgcgaccaccggctgatgagcgccgccatcaaagactccaaagccgtccacgccgacatgggctattggatcgagagcgagaagaacgagacctggaagttagcgagggcgagttttatcgaggtaaagacttgcatctggcccaagagccacacgctctggagtaacggcgtgctggagtccgaaatgatcatacctaagatatacgggggcccgatctcccagcacaactaccgccccggctactttacccaaaccgccggcccctggcatttggggaaactggagctggactttgacctttgtgaggggaccacggtcgtggtggacgaacactgcggcaaccgcgggccaagcctgaggaccacaaccgtgacggggaaaattatccacgagtggtgctgccggtcctgtaccctgccacccctgaggttcaagggggaggatggctgttggtacggcatggaaatacggcccgtgaaggagaaggaggaaaatttggtcaagagcatggtcagcgcgggatccggcgaagtggactcgttctccctgggactcttgtgtataagcatcatgatcgaggaggttatgcgctcccggtggtcacgcaagatgctgatgaccggcaccttggccgtgttctttctgctgatcatcggacaactcacgtggaacgaccttatcaggctgtgcatcatggtgggcgcaaacgcttccgaccgcatgggaatgggcaccacctacctcgccctcatggccaccttcaagatgagaccgatgttcgccgtgggcttactgttccggcgtctgacgagtcgggaagtcctcctccttaccatcggcttatccctcgtagcgagcgtcgagctgcccaattcgttggaggagctgggagacgggttagccatgggtatcatgatcttaaagctcctgaccgacttccagtctcatcaactgtgggccacgttactcagcctgacgttcatcaagaccaccttcagtctccactacgcctggaagaccatggccatggtgttaagtatcgtgagcctgttcccactctgtttatccactaccagccagaagactacctggctgcccgtcctcctaggctccttgggctgcaaaccgctcacgatgttcctgatcgccgagaacaaaatatggggcaggaggtcgtggcccctgaatgaggggatcatggccgtaggcatcgtaagcatcctcttatccagcctgttaaagaacgacgtccccttggccggaccgctgatcgcgggcggcatgctcatcgcgtgctacgtaatatccgggagctccgcggacctgagcctagagaaggccgccgaggtgtcttgggaggaggaggccgagcactcgggcgcgtcccacaacattctggttgaggtgcaggacgacggaaccatgaaaatcaaggacgaggagcgcgatgacaccctgaccatcctgctgaaggccaccctgctagcggtaagcggagtttacccactctccatccccgcgaccctgtttgtgtggtacttctggcagaaaaagaagcagcggtcaggagtcctgtgggacaccccgagcccgcccgaggtcgagcgcgccgtgctcgacgacgggatctaccggatcatgcagcgaggcctgctggggcgttcccaagtgggcgtcggtgtcttccaggaaaacgtgtttcacaccatgtggcacgtcacgcgcggtgcggtactgatgtaccaggggaagcggttagaaccctcctgggcgagcgttaaaaaggacctaatctcatacggcggcgggtggaggcttcagggaagctggaacacgggggaggaggtccaggtgatcgccgttgagcccggaaagaaccccaagaacgtccaaaccgcccctgggacctttaagacctccgagggtgaggtcggcgccatcgcgctcgactttaaacccggcacgagcgggagccccatcgtgaaccgagagggaaagatagtcggcttatatgggaacggggtggtgaccacttcggggacgtacgtgtctgccatcgcccaggccaaagcgtcccaggaggggccactgccggagatcgaggatgaggtgttccgcaaacgcaacctgaccatcatggacctgcaccccggcagcgggaagacccgccgttacctgccggccatcgtgcgcgaggccataaagcggaagttaagaacccttatcctggcccctacgcgcgtcgtggcctctgagatggccgaggccttaaagggaatgccaatacgttatcagacaactgccgttaaaagtgagcacacgggcaaagagatcgtcgacctaatgtgccatgccaccttcacgatgcgcctactttcccccgtgcgggtgcccaactataacatgatcatcatggacgaggcccatttcaccgacccgtcgagcatcgcggctcgcggatatatcagcactcgggtcggcatgggtgaagcggccgccattttcatgaccgcgacgccgcccggcagtgttgaggcgtttccccagagcaacgccgtcatacaggacgaggagcgcgacataccggaaagatcctggaacagcgggtacgagtggataaccgatttccccggcaagaccgtctggttcgtaccctccatcaaatctggcaacgacatcgctaactgtctgcgcaagaatgggaagcgggtgatccaactgagccgcaagacattcgacaccgagtaccagaagaccaagaacaacgactgggactacgtcgttaccaccgacatcagcgagatgggcgccaactttcgggccgatcgcgtgatagacccccggcgctgcctcaaaccggtaatcctgaaagacgggccggagagagtgattctggccgggcctatgcccgtcacggtggcctccgcagcgcagcgtagaggccgtatcggccggaaccacaataaggagggtgatcagtatatctacatggggcaacccttaaacaacgacgaggaccacgcccactggactgaggccaagatgctactagacaatatcaacaccccagagggcatcatccccgccctcttcgagcccgagagggagaagtccgccgcgatcgacggggagtaccggttacgcggagaggcccgcaagacgtttgtggagctgatgaggcgcggggatctcccggtatggttatcctataaggtggcatcagagggcttccaatatagcgaccggcgctggtgtttcgacggtgaacggaataaccaggtgctcgaggagaacatggacgtggaaatctggaccaaggagggggaacgcaagaagctccgtccccgctggctcgacgcgcggacttactcggacccgctggccctacgcgagtttaaggagttcgcagcaggtcggagaagcgtgtcaggggatctaatcctggagataggcaagctgccccagcacctgacccagcgggcccaaaatgcgctggacaatctcgtgatgctacacaatagcgagcaaggagggcgcgcgtaccggcacgctatggaggagctgccggataccatcgagacgctgatgcttctggctctcatcgccgtcctgacgggcggggtgaccctgttctttctctctggccgcgggttaggtaagaccagcataggcctcctctgcgtgatggcctccagcgtcctactgtggatggcgtccgttgagccgcactggatcgccgccagcatcatactcgagttctttctaatggtgctgctcatccccgagcccgatcggcagcgtaccccgcaagacaatcaacttgcgtacgtagtgattggtctcctctttatgatcctgacggtggcggcgaacgaaatgggcctattggagacaaccaaaaaggacctgggtatcgggcacgttgccgtggaaaaccaccaccacgccgccatgctggacgtggatttacaccccgcgtccgcgtggaccttatacgctgtggcgacgacgatcataaccccgatgatgcggcacactatcgagaacacgacggccaacatatccctgaccgccatcgctaatcaagccgccattctcatggggctggataaaggatggccgatcagcaaaatggacatcggcgtgcccctgctagcccttgggtgttactcgcaggttaaccctctaaccctcacggccgcggtcttgatgctagtagcacactacgcaatcatcggccccgggctgcaagcaaaggcgactcgcgaggcccagaagcgcaccgccgcgggcatcatgaagaacccgacggtagatgggatcgtcgccatcgacctggaccccgtggtttacgacgcgaagtttgagaagcaactgggccaaataatgctcctaattctgtgcacatcccaaattctcctgatgcgcacgacctgggccctgtgcgagtctatcaccttggccacgggccctctgaccacgctgtgggagggctccccgggaaaattctggaacacgacgattgccgtcagcatggccaacatttttaggggttcatacctcgcgggcgccggattagccttctccctgatgaagtccctcgggggcgggcggagaggcacaggggcccaaggtgaaacgctaggcgagaagtggaaacggcaactgaaccagctatccaagagcgagttcaacacctacaagcgatcggggatcatggaagtggaccgcagcgaggccaaagagggtctgaagagaggggaaacgaccaagcacgccgtatcccggggtactgcgaagctgagatggttcgtcgaacggaacctcgtgaaaccggaggggaaagtgattgacctgggctgcggccgcggcggctggagttactattgcgccgggctgaagaaggtcaccgaggtaaagggctacacgaagggcgggcccggccacgaggagccgatccccatggcaacctacggatggaacctggtgaagctacactccggcaaggacgtcttctttatcccgccggaaaagtgcgacaccctgctgtgcgatataggggagagctcccccaaccccaccatcgaggagggccggactctacgcgtgctgaagatggtagaaccctggctgaggggcaaccagttctgtatcaagatcctcaacccctacatgccctccgtcgtggagaccctggagcgcatgcaacggaagcacggcggcatgctggtacgcaaccccctctccagaaattcgacccacgagatgtattgggtctcttgcggtacaggtaatattgtgtcagcggtgaacatgacctcccgcatgcttctgaaccgcttcacgatggcccaccggaagccgacctatgagcgcgacgtggacctcggagctggaacccgtcacgtggccgtggagcccgaggtggccaacctggacatcatcggccagcgcatcgagaatatcaagcatgagcacaagagcacgtggcactacgacgaggacaacccctacaaaacttgggcgtaccacgggtcctatgaagtgaaacccagcggcagcgcgagcagtatggtcaacggggtggtgaagctcctcaccaagccgtgggacgtcatccccatggtgactcagatcgccatgacggacacaacccccttcggccaacagcgggtgttcaaggagaaagtcgacacccgcacccccaaggctaagagggggacggcccagatcatggaagttaccgctaagtggctgtggggctttctgtcccggaataagaagccgcggatctgcacccgcgaagagttcactcggaaggtacgaagcaacgccgctatcggcgctgtcttcgtggacgagaaccagtggaactccgcgaaggaggccgtagaggacgagcggttctgggacctcgtccatcgcgaacgggagctgcacaagcaagggaaatgcgccacttgcgtgtacaacatgatggggaagcgggagaagaagctgggggagttcgggaaggccaaagggagcagggcaatctggtacatgtggctcggcgcacgctttctggagttcgaggcccttggcttcatgaacgaggaccactggttctcccgggagaacagtctgagtggggtggagggcgaggggctgcataagttaggctacatcctccgcgacatcagcaagatccctgggggcaatatgtacgctgacgacaccgccggatgggacacccggataactgaagacgacctgcagaacgaggcgaaaattaccgacatcatggagccagagcacgcgctgttggccaagagcatcttcaaactgacataccagaacaaagtcgtccgtgtacaacgcccggccaagaacgggaccgtgatggacgttattagccgtcgcgaccagcggggttccggccaggtgggaacgtacggcctgaacacgttcacgaacatggaggcgcaacttattcgccaaatggagagcgagggtatattctcacctagcgagctcgagacacccaacctggccgggcgggtcttagactggctggagaaacacggggtagagcgcctgaagcggatggctatctcgggtgacgactgcgtggtaaagccaatcgacgaccgcttcgccactgcgctcacggccctgaacgacatggggaaggtgcgtaaggacatcccgcagtgggagcccagcaagggctggaatgactggcagcaggtccccttctgcagccaccacttccaccagctgataatgaaggacggccgcgagatcgtcgttccctgccggaaccaggacgagctcgtggggcgagcccgggtctctcaaggcgcggggtggagcctgcgcgagacggcctgcctgggcaagtcctacgcccagatgtggcagctcatgtacttccacaggcgggacttgcggctggccgcgaacgcgatctgcagcgccgtgcccgtggattgggtccccacatcgcgcactacgtggagcatccatgcccaccaccagtggatgaccaccgaggacatgctctcggtgtggaaccgcgtgtggatcgaggagaatccatggatggaggataaaacacacatttcgtcctggggcgacgtcccctacctcggtaaacgcgaggaccagtggtgcggcagcctgattgggctcaccgcccgcgcaacctgggccaccaacatccaggtggccatcaaccaggtgcggcgcctgattgggaacgagaactacctggattacatgacctccatgaagcggtttaaaaacgagtccgacccagaaggcgctctctggtaa

SEQ ID NO: 24545 - RNA, 9879 nt, synthetic construct
  misc_feature 1..9879: note = derived and/or modified CDS sequence (opt11) from DENV-1__EU482808__SS-prME
  source 1..9879: mol_type = other RNA
agcgtgaccatgcttctgatgctcatgccaaccgccctggccttccacctcacgacccgtggcggggagccacatatgatcgtgagcaagcaggagcggggcaagagccttctgttcaagacctcagccggggtgaacatgtgcaccctcatcgccatggacctgggcgagttctgcgaggacactatgacgtataagtgccccagaatcaccgaggccgagcccgacgacgtggactgctggtgcaacgccaccgacacgtgggttacatacgggacctgcagccagactggagagcaccggcgggacaagcggtccgtagcgctggcgccccatgtgggcctcgggctggagacgaggaccgagacctggatgagctccgagggcgcgtggaagcagatccagcgagtggagacctgggccctgcgccaccccggcttcactgtgatcgccctcttcctggcgcacgccattggtaccagcatcacccagaaggggataatcttcatcctgcttatgctggttaccccctccatggcaatgaggtgcgtcggaatcggcagccgcgatttcgtggaggggttgtccggcgccacgtgggtggatgtcgtactcgagcacgggagctgtgtaaccaccatggccaaagataaacccaccctggacattgagctgttgaagacggaggtcaccaatccagcggtgctacggaagctatgcatcgaggccaagatcagtaacacgaccacggacagccgctgcccgacccaaggcgaggccaccctcgtcgaggagcaagacgccaacttcgtctgtcggcggacctttgtggaccggggctgggggaacggctgcgggctgttcggcaagggctccctgatcacgtgcgccaaattcaagtgcgtgaccaaactcgaaggcaagaccgtccagtacgagaacctgaagtacagcgtgatcgttaccgtccatacgggcgatcagcaccaggtggggaacgagagtaccgagcacgggacaaccgcgaccatcacgccccaggcacccagcaccgagatccagctcaccgactacggggccttaacactggactgctccccccggacggggctggacttcaacgagatggtcctcctgaccatgaaggagaagtcctggctggtgcacaaacagtggttcctcgacctgccgctgccctggaccagcggggcatcaacatcgcaagagacatggaacagaaaggatctcctggtgaccttcaagaccgcccacgcgaaaaagcaggaggtcgtggtgctgggttcccaggaaggagccatgcataccgctctcacgggtgctaccgaaattcagaccagcggcactacgactatcttcgccgggcacctgaagtgccgcctgaagatggacaagctcacccttaaggggatgtcttacgtcatgtgtaccgggagcttcaagctggaaaaggaggtggcggaaacccagcacggcaccgtgctcgtacaaattaagtatgagggcaccgacgccccgtgcaagatccccttcagtacccaggacgagaagggtgtgacgcagaacggcaggctgatcaccgccaacccgatcgttaccgacaaggagaagcctgttaacatagaggcggaaccgcccttcggggagagctacatcgtgataggcgccggcgagaaggccctgaagctgtcctggttcaaaaagggaagctccatcggcaaaatgttcgaggccaccgcccgcggggcccgcaggatggcgatcttaggcgatacggcctgggatttcgggagcattggcggcgtgttcacctccgtcggaaagctggtgcaccagatcttcggcaccgcctacggggtgctgttcagcggcgtctcgtggaccatgaagatagggatcggcgtgctcctcacgtggctgggcctcaattcacgtagcaccagcctgtcaatgacctgcatcgctgtgggtctggtgaccctctatctgggcgtaatggtgcaagccgattcagggtgcgtcatcaactggaaaggccgggagctgaaatgcgggagcggcatattcgtcacgaacgaggtgcacacctggaccgagcagtacaagtttcaggcggactcgccgaagagactgagcgccgccatcgggaaagcctgggaagagggggtctgcggcatccggtccgccacccgcctggagaacatcatgtggaagcagatcagcaacgaactgaatcacatcttattggagaacgacatgaagttcaccgtggtcgtgggggacgtggcgggcatcctggcccaggggaagaaaatgatacggccccagcccatggagtacaaatactcctggaagtcctgggggaaagccaagatcatcggcgcagacgtgcagaacacgacgttcattatcgacgggcccaacacgccggagtgccccgatgaccaaagggcgtggaacatctgggaggtcgaagattacggctttggaatcttcaccactaatatctggctaaagctgcgggactcctacacccaggtgtgcgaccaccgcctgatgagcgccgccatcaaggactccaaggctgtgcatgcggacatgggctactggatcgaatctgagaagaacgaaacctggaagctcgcgcgagcgtccttcatcgaggtcaagacctgcatatggcccaagtcccacacgctgtggtccaacggcgttctggagagcgagatgattatccccaagatctacgggggcccgatctcccagcacaactaccgccctggatactttacacagaccgcgggcccttggcacctcgggaagcttgagctggatttcgacctctgcgaaggcaccacagtggtcgtggacgagcactgcggcaacagagggccgagcctgcgcaccactaccgtgacgggcaagataatccacgagtggtgttgccggtcctgcaccctgccgcccctgcgcttcaagggggaggatggctgctggtacgggatggagatccggcccgtcaaggagaaggaggagaacctggttaagagcatggtgtctgctggctctggcgaggtcgactctttttctctggggctcctgtgcattagcatcatgatagaggaggtgatgcgctcccggtggtcccgcaagatgctgatgaccggcacgctcgccgtgttcttcctgctgataatgggtcagctcacgtggaacgacctgattcgactgtgcatcatggtcggcgcaaatgcctccgaccgcatggggatgggtaccacctaccttgccctgatggccacctttaagatgcgccctatgttcgccgtcgggctcctgttccggcgcctgacgagccgagaggtgctgctcctgaccatcgggctgtccctagtcgcgagcgtcgagctgcccaactcactagaagaactcggcgacgggcttgccatgggcatcatgatcctaaagctcctgaccgacttccagtcacaccaactgtgggcgacgttgttatccctgacgttcatcaagaccaccttcagcctccactacgcctggaagaccatggcgatggtactgtccattgtgagccttttccccctctgtctgtccacgaccagccagaagaccacatggctgcccgttctcctgggctccttggggtgcaagccgctcacaatgttcctcatcgccgaaaacaagatctggggccgcaagagctggccgctgaatgaggggatcatggccgtcggcatagtgagcatccttctgtccagcctgctcaagaacgacgtgcccctggccgggccccttatcgccggcggcatgctgatcgcgtgctacgttatctccgggagcagcgccgatctgagcctggagaaggccgcggaggtgtcctgggaggaggaggccgaacacagcggcgcgtcgcacaacatcctagtggaggtccaggacgacgggacgatgaaaatcaaggacgaggagcgggatgacaccctgaccatcctgttaaaggccaccctgctggccgttagcggcgtgtacccgctctccatcccagccacgctgttcgtctggtatttctggcagaaaaaaaaacagcgctccggggtgctttgggacaccccctctccgccggaggtggagagagccgtcctcgacgacggcatctaccgaatcatgcagcgggggctgctggggcgctcccaggtgggcgtcggagtcttccaggagaacgtgttccataccatgtggcacgtgacgcggggcgcggtgctgatgtaccaggggaagcgcctcgagccctcctgggcttctgtgaagaaggaccttatctcgtacggcggcgggtggcggctgcagggcagctggaacacgggggaggaggtgcaggtcatcgccgtagagccgggcaaaaaccccaaaaacgtgcagaccgctcctgggaccttcaagacctccgagggggaggtcggcgccatcgcgctcgacttcaagcccggaacgagcggcagccccatcgtcaaccgcgaggggaagatcgtgggactatacggcaatggggtcgtgaccaccagtggaacctacgtgagcgccatcgcccaggccaaggcgtcccaggagggtccgctgccggagatcgaggacgaggtcttccggaagcgaaacctcacgatcatggacctacaccccggaagcgggaagacccgacgctacttgcccgccatagtccgggaggccatcaaacggaagctccggaccctcatactggccccgacccgcgtcgttgcttccgagatggcggaggccctaaaagggatgcccattcggtaccagaccaccgccgtcaaaagcgagcacaccggcaaggagatcgttgacttaatgtgccacgcaacatttacgatgcgacttctctcaccggtccgcgtaccaaactacaatatgataattatggacgaggcacacttcaccgacccgagttcaattgcggcccgcgggtatatcagcacccgcgtgggcatgggggaggccgcggccatcttcatgaccgcaactccgccaggctccgtcgaggcctttcctcagagcaacgctgtgattcaggacgaggaacgggacatcccggaacgctcctggaacagcgggtatgagtggatcaccgacttcccaggcaaaaccgtgtggttcgtgccctccatcaagagcggcaacgacatcgccaactgcctacggaagaacgggaagcgcgtgatccagctgtcccggaagaccttcgacacggaataccagaagaccaagaacaacgactgggattacgtcgtcactaccgacatcagcgagatgggcgcgaatttccgcgccgacagggtcatcgacccccgcaggtgcctcaaaccggtgatcctgaaggacgggcccgagcgcgtcatccttgcaggcccaatgcccgtgacggtcgcctccgccgcccagcggcgcgggcggatcggccgcaatcacaacaaggagggcgaccagtacatctatatggggcagccactcaacaacgacgaggatcatgcacactggactgaagccaagatgttactggataacatcaacacccccgaaggcatcatccccgccctcttcgaacccgagcgggaaaagtccgcagcgatcgacggggagtatcgcctgcgcggcgaggctcggaagaccttcgtggagttaatgcgtcgcggggacctcccggtgtggctgagctacaaggtcgcctccgagggcttccagtacagcgataggcgctggtgcttcgatggcgagcgcaataaccaggtgctggaggagaacatggacgtggagatctggacgaaggagggggagcggaagaagctccgcccccggtggctggacgcccgtacatactccgaccccctggccctaagggagttcaaggagttcgcggccggccgccggagcgtctccggggatctgatccttgagatcggcaagttaccccaacacctcacccagcgcgcccagaacgccctggacaacctcgtgatgctgcataacagcgagcagggcgggcgggcgtaccgacacgccatggaggagctgccggacaccatcgagacactcatgctcctggccctcatcgccgtgctgaccggtggggtcaccctgttcttcctgagcggccgtgggctgggcaagaccagcataggactgctgtgcgtgatggcctccagcgtgctgctatggatggcgtccgtcgagccccactggatcgccgcgtcgattatcctcgagttcttcctgatggtccttctcatccccgagcccgaccgccagcggaccccgcaggacaaccagttagcctacgtggtaatcgggctcttgttcatgatcttaaccgttgccgcgaacgagatgggcttactcgaaaccaccaagaaggacctggggatcggccacgtggccgtagaaaaccaccaccacgccgccatgctggacgtggacctacaccccgcctccgcgtggaccctgtacgcagtcgccactaccattatcaccccaatgatgcgccacaccatcgagaacacgaccgccaacatcagcttgaccgccatagcgaaccaggccgccatccttatggggctggacaagggctggccgatcagcaagatggatatcggcgtccccctcctggccctggggtgctacagccaagtcaacccgctgaccctcacggccgccgtgctgatgctggtcgcccactatgctatcatcggccccgggctccaggccaaagcgacccgggaggcccagaagagaaccgccgccggcatcatgaagaacccgactgtagatgggatcgtggccatcgaccttgaccccgtcgtgtacgacgcgaagttcgaaaaacagctggggcagatcatgctcctaatattgtgcacatcccagatcctgctgatgcgcaccacctgggccctgtgtgaaagcatcaccttagccacgggacccctgactaccctgtgggagggttccccaggcaagttctggaacaccacgatcgccgtaagcatggcgaatatattccgggggagctatctcgcgggcgccggactcgccttttccctgatgaaatccctagggggcggtcgtagagggaccggggcccagggcgagacgctgggagagaagtggaagaggcagctgaaccagttatccaagagcgagttcaatacctacaagagatccgggatcatggaggtcgatcgcagcgaagcgaaggagggtctgaagcgaggggaaacgaccaaacacgccgtttcccgcggcaccgccaagctgcggtggtttgtggaacgcaacctcgtaaagcccgaagggaaagtgatcgacctggggtgcggtcgaggcgggtggtcctactattgcgccgggctgaagaaggtcactgaggtcaaaggatacacgaagggcgggcccgggcacgaggagcccatccccatggccacctacggctggaacctggtaaagcttcattctggcaaggacgtattcttcaccccacccgagaagtgcgacaccctgctgtgcgacattggggagagctcccccaatcccacgatcgaagagggccgcactctccgggtcctgaaaatggtggagccgtggcttcgcgggaaccagttctgcatcaagatcctcaatccctacatgccctccgtggtagaaaccctggagcaaatgcagcggaagcacgggggcatgctcgtgcgcaaccccctctcccggaacagcacccacgaaatgtattgggtgtcctgcggtaccggcaacatcgtctcggcggtgaacatgacgtcccgcatgctgcttaaccggttcacgatggcccaccgcaagccgacctatgagcgcgacgtggatctcggggccggcacccggcacgtcgccgtggagcccgaggtggctaacctagacataatcggacagcgcatcgagaacattaagcacgagcacaaaagcacgtggcactatgacgaggacaatccctacaaaacgtgggcgtaccacgggtcctacgaggttaagccctcgggcagcgcctcgtcaatggtcaacggggtcgtgaagctactcacaaagccgtgggacgtgatacccatggtcacccagatcgccatgacagacacaaccccctttgggcaacagcgggtctttaaggagaaagtggataccaggacgcccaaggccaagcgggggactgcccaaatcatggaggtcaccgcgaagtggctgtggggatttttatcccgcgacaagaagccgcggatctgcacccgcgaggagttcactcggaaggtgcgttccaacgccgccatcggcgctgtgttcgtagacgagaaccagtggaacagtgcaaaagaggccgttgaggacgagagattctgggacctcgtgcaccgcgagcgggaactgcacaaacagggcaagtgcgcaacctgcgtctacaacatgatgggtaaacgcgagaagaagctgggggagttcggcaaggctaaggggtcgcgggccatctggtacatgtggctcggtgcccgattcctggaattcgaggcgctgggcttcatgaacgaagaccactggttctcccgcgagaacagcctatcgggggtggagggcgaggggctgcataagctggggtacattctccgagacatcagcaaaatcccagggggcaacatgtacgccgacgacaccgccggatgggacaccagaatcactgaagacgacttgcaaaacgaggccaagattacggacatcatggagccagagcatgcgcttttagcgaagtccatcttcaagctgacctaccagaacaaggtggtaagagtgcagcggccggccaaaaacggcactgtcatggacgtcatcagccgccgcgatcagcggggctccggccaggtgggcacgtacggccttaacaccttcaccaacatggaggcccagttgatcagacagatggaaagcgaggggatcttcagtccctcagagctggagacccccaacttagccggccgggtgctggactggctggagaagcacggggtcgagcgcctgaagagaatggcgatctctggcgacgactgcgtggtgaaacccatcgacgaccgcttcgccactgctctcaccgccctgaatgacatgggaaaggtccggaaggacatcccgcagtgggagccctctaaaggctggaacgactggcagcaggtgccattctgcagccaccatttccaccagctgataatgaaggacggccgcgagatcgtcgtcccctgtcggaaccaagacgagctcgtgggacgcgcccgggtgtcccagggcgcggggtggagcctgcgtgagaccgcgtgcttgggaaagagctacgcccagatgtggcagctcatgtacttccaccggcgcgaccttcggctggccgcgaatgccatctgcagcgccgtaccggtggactgggtgccaacctccagaacgacctggagtatacacgcccatcaccaatggatgacgaccgaggacatgctctccgtctggaaccgagtgtggatcgaagagaacccatggatggaagataagacgcatattagcagttggggagacgtcccctacctgggcaagcgcgaggatcaatggtgcggaagcctgatcgggctcaccgcccgggcaacttgggccaccaacatccaggtcgccataaaccaagtgcgccgcctgatcggcaacgaaaactacctggactacatgacctctatgaagcggttcaagaatgagtcagacccggagggtgccctctggtga

SEQ ID NO: 24546 - RNA, 9879 nt, synthetic construct
  misc_feature 1..9879: note = derived and/or modified CDS sequence (opt11) from DENV-1__EU482809__SS-prME
  source 1..9879: mol_type = other RNA
tcagtgacaatgctgctgatgctgatgcccaccgcgctggccttccatctcacgacccggggcggcgaaccgcatatgatcgtgtctaagcaggagcggggtaagagcctgctgtttaaaacaagcgccggggtgaacatgtgcaccctcatcgccatggatctaggagagttttgcgaagataccatgacgtataagtgtccgcgcattacagaggccgaacccgacgacgtggactgctggtgtaatgccaccgatacgtgggtaacatacgggacgtgtagccagactggcgagcaccggagagacaagcggagtgttgcgcttgctccccacgttggactgggtctggaaacccgcactgagacctggatgtcctcggaaggcgcctggaagcagatccaacgggtagaaacctgggccctgcgccatccagggtttacggtgatcgccctcttcttggcgcacgctattggaacaagcatcacccagaagggaatcatctttatactgctaatgcttgtgaccccctccatggcgatgcggtgcgtcggaattggaagcagggacttcgtggaagggctgtccggcgccacgtgggtggatgtcgtgctggagcacggtagctgcgtgaccaccatggccaaggacaagcccactctggatatcgagttgctaaagacggaggtcactaaccccgccgtactgcggaagctgtgtatcgaggcaaagatttccaacacgaccacggactcccgttgtccgacccagggcgaggccaccctcgtagaggagcaagacgccaactttgtctgccggcgcaccttcgtcgaccggggatggggaaacggctgcgggctgttcggaaagggttccctgatcacgtgcgccaagttcaagtgcgtgaccaaactcgagggaaagatcgtacagtacgagaacctgaagtatagcgtgatcgtgactgtccacaccggcgaccagcaccaggtggggaatgagtccacggagcacggaaccaccgctaccattacgccccaggcaccatctacggaaattcagctgacggattacggagccctcaccctggactgctctcctcgcacaggcctggacttcaatgagatggtattgctgacgatgaaggagaaatcttggctagtgcacaagcagtggttcctggacctaccgctgccctggacgagcggtgcgtcaacaagccaggagacatggaaccggcaggacttgctggtgacattcaaaaccgcccacgcgaagaagcaagaggtcgtggtgctaggctcccaagagggcgccatgcacaccgcccttaccggcgcaacagagatacagacaagcggcacaacaacgattttcgccggtcatttaaaatgtcgcctgaagatggacaagctcaccctgaagggcatgtcctacgtcatgtgcaccgggagcttcaagctggagaaggaggtagcggagacacagcacggaactgtgctcgtacagatcaagtacgagggcacagatgcgccatgcaaaatccccttctccacccaggatgagaagggggtgacccagaacggccgcctcatcactgcaaatccgatcgtgaccgacaaagagaagccagtcaacatagaggcagagccccccttcggggagagctacatcgtgatcggcgcgggcgaaaaggcccttaagctttcctggtttaagaagggttcgtccattggcaagatgttcgaagccaccgcccgcggggcacggcgcatggcgatactgggggataccgcctgggattttgggagcattggcggcgtgttcacatcagttgggaagctggtgcaccagatttttggcaccgcctacggggtcctgttcagcggggtctcatggaccatgaagattggcattggcgtgttactcacctggctgggactcaacagccgctccaccagcctgtcgatgacctgcatcgcagtggggctggtcaccctctatctgggcgtcatggtccaagccgatagcgggtgtgtaatcaactggaaagggcgggagctgaagtgcgggtcgggcatcttcgtgaccaacgaggtccacacttggaccgagcagtataaattccaggcggactcgccaaaaaggctctctgccgctattggaaaggcctgggaggagggggtctgcggaataaggtctgcgactcgcctggaaaacatcatgtggaagcagatcagtaacgaactaaaccacattctcttggagaacgacatgaagctaaccgtagtggtcggagacgtggcaggcatcctcgcccaggggaagaagatgatacggccccagcccatggagtacaaatattcctggaaatcctggggcaaagccaagatcatcggggccgatgttcaaaataccacgtttatcatcgacggaccaaatacgccagaatgccccgacgaccaacgcgcgtggaatatctgggaggtcgaggattatggatttgggattttcactaccaacatatggctgaaactgcgggattcgtacacacaggtgtgcgatcaccggctcatgagcgccgctatcaaggacagtaaggccgtacacgccgatatgggctactggatcgagagcgagaagaacgagacctggaagctggcccgggcctcattcatcgaggtaaagacctgtatatggcccaaatctcataccctgtggagcaacggcgtgttagagagcgagatgatcattcccaagatctacggtggcccgataagccagcacaattatcgccccggctatttcacgcagaccgccggcccctggcacttgggtaagctggagctcgacttcgacctgtgtgagggcaccaccgtagtggtcgacgaacactgcgggaatcgggggccgtccctgcgcacgaccactgtaactggcaagatcattcacgagtggtgttgtagatcgtgcaccctgccgcctctcagattcaaaggggaggacggatgctggtatggtatggagatacggccggtcaaggagaaggaagagaatctggtcaagtctatggtgtccgccgggtccggggaagtcgatagtttctctctcgggctgctgtgcatcagcataatgatcgaggaagtcatgcgctccagatggtcccggaagatgctcatgaccggcacacttgctgtgttcttcctcctaatcatggggcagctgacctggaacgacttgatccggctctgtatcatggttggcgcgaacgcttcggacaggatgggtatgggcacgacctacttggcactgatggcgaccttcaaaatgcgccccatgttcgctgtcggcctcctgttccggcgtctgacctcgcgggaggtactcttgctgacgattgggctctctctggtcgcgagcgtggagctgcccaacagtctcgaggagctgggggacggactcgcaatgggcatcatgatactcaagcttctgaccgacttccagagccaccagttatgggccaccttgctgagtctaactttcatccgcacgacgttcagcctgcactatgcatggaagaccatggccatggtcctttccatcgtgagcctcttccccctgtgcctttccaccaccagccaaaagaccacctggctccccgtcctgctgggctccttggggtgcaagccgctgaccatgttcctgattgccgaaaacaagatctggggcaggaagtcatggcccctcaacgaagggataatggccgtcggaatcgtgtctatcctgctgagttccctcctgaaaaacgacgtgcccctggccgggccactcatcgccggcggcatgttaattgcgtgctacgtcatctccgggtcctccgccgacctgtcgctcgagaaagcggccgaggtgtcctgggaggaagaggccgaacacagcggcgcgtcccacaacatattggtagaggtccaggacgacgggacgatgaaaatcaaggacgaggagcgggacgacaccctgaccatcttactgaaggccaccctgctcgccgtctctggggtctaccctctgtccatccccgcaacgctgttcgtctggtacttctggcaaaagaagaaacaacggagcggggttttatgggacacgccctcacccccagaggtcgaacgagcagtcttggacgacggtatctaccggatcatgcagcgcgggttacttgggagaagccaagtcggcgtgggcgtcttccaagagaacgtcttccacaccatgtggcacgtcacccgcggagcggtgctcatgtaccaagggaagcggttggagccttcttgggccagcgtgaagaaggacctaatatcctacggcggaggctggcggctacagggctcctggaacacgggggaggaggtgcaggttattgcagtggaacccggcaagaaccccaagaatgtgcagaccgcgccggggactttcaagacctcggagggcgaggtcggcgccatcgcccttgatttcaagcccgggacctcggggtcacctatcgtgaatcgtgagggtaagatcgttggactgtatggtaatggtgtcgtgactacctccgggacgtacgtgagcgctatcgcccaggccaaggccagtcaggagggacccctccctgagatcgaggatgaggtcttcagaaagcggaaccttactataatggacctgcaccccggcagtgggaagacgcgccgttacctccctgccatcgtgcgtgaggccatcaagaggcgcctgcgcacattaattctggcccctaccagagtagtcgccagcgagatggccgaggcgttaaagggcatgcccatcagataccagactactgccgtaaagagcgagcacaccggaaaggagatcgtcgacctgatgtgtcacgcaacattcaccatgcgcctgctgtcacccgtccgcgtgcccaactacaacatgatcatcatggatgaggcccacttcacggacccgagctcaatcgcggcccgggggtatattagcacccgcgtgggcatgggggaggctgcggcgatcttcatgaccgcaacgccgccaggttctgtcgaagcctttcctcagagcaacgccgtaatccaagacgaggagcgggacatcccagaacgctcctggaactcagggtacgagtggatcacggactttccgggcaagaccgtgtggttcgtcccaagcatcaaaagcggaaatgacatcgcgaactgcctgcggaagaacgggaaacgcgtgatccagctatcccggaaaaccttcgacaccgagtatcagaagacgaaaaacaacgactgggactacgtggtgaccaccgatatctcagagatgggagcgaacttccgcgcagaccgcgtcatagacccccgccggtgcctgaagccggtgatacttaaggacggccccgagagggtgatcctcgctggccctatgcctgtaacagtcgcctcagcagcacagcggcgcgggcggatcggtaggaaccacaacaaagaaggcgaccagtacatctatatgggacaaccgctgaacaacgacgaggaccatgctcactggacggaggcaaagatgctcctcgacaatatcaacacccccgagggcatcatccccgccctgttcgagcctgaacgcgaaaagtccgccgcaatcgacggggagtatcggctgagaggtgaggcacggaagacctttgtggagttgatgcgccgtggggacctgccggtctggctgtcctacaaagtggcgtcggaaggcttccaatacagcgatcgccggtggtgtttcgatggggagcgcaacaaccaggtactcgaggagaatatggacgtcgagatctggacaaaggagggagagcgaaaaaagctaagacccaggtggctggatgcccgcacgtacagtgaccccctcgccctgcgggaattcaaggaatttgcagcgggtcgccgatcggtcagtggagatctaatactagaaatcggcaaactgccacaacacttaacccagcgcgcccagaacgcccttgacaacttggtgatgctacacaatagtgaacagggcggccgggcgtaccgccacgccatggaggagctaccagacacaatcgaaaccctgatgctcctcgcgctaatcgccgtgctgacgggcggggtcaccctcttctttctgtccggcagagggttgggcaaaaccagcatcggccttctgtgcgtgatggccagctctgtcctgctatggatggcgtcagtggagccccactggattgcagcctcaatcatactagagttcttcctgatggtgctcttgatccctgagcctgaccgccagagaaccccgcaggataaccagctagcctacgtggtcattggcctgctgttcatgatcttaaccgtagccgcaaacgagatgggattactggagactaccaagaaggacctgggcataggccacgtggcagtcgagaaccaccaccacgccgccatgttagacgtcgacctgcaccccgccagtgcctggaccttatacgcagtggctaccacgatcatcacccccatgatgcgccacaccatagagaacactacggcaaacatcagcctaacagccatcgcgaaccaggccgcgatcctgatggggcttgacaagggctggccaatttccaagatggacataggcgtgcccttattggccctgggctgctacagccaagttaacccattaaccctgaccgcggcagtgttaatgctagtcgcccactatgccataatcggccctggtctccaggccaaggctactcgcgaggctcaaaaaagaacagccgccgggataatgaaaaaccctaccgtggacggaatcgttgccattgacctggacccggtcgtatacgacgccaaatttgagaagcagctcggacagataatgttactgatattgtgcaccagccagatactgctgatgcgcacgacctgggcactctgcgaatctatcaccctagctaccggccccctgacgaccctctgggaggggtctcccggcaagttttggaacacaaccatcgctgtgagcatggctaacatcttccgggggagctatttagcgggcgcaggactcgcgttttcgctcatgaagagtctaggaggcgggcgccgggggacgggggcccagggcgaaacgttgggcgaaaaatggaaacgccagctcaaccagttatccaaaagcgaattcaatacatacaagaggtcgggaattatggaggtcgaccggagcgaggcgaaagagggcctgaagcgcggtgagaccacaaaacacgctgtatcccgcggcacagccaagctccggtggttcgtggagaggaacctggttaagcccgaggggaaagtgatcgacctcggctgcggccggggcgggtggagttactattgcgccgggttgaagaaggtgaccgaggtcaaggggtacacgaagggtggaccgggccacgaggagcctattccaatggccacgtacgggtggaacctcgtgaagctgcatagcggcaaggacgtgttcttcatcccacctgaaaagtgcgacaccctgctctgtgacattggagagagctctcctaatccaactatagaggaaggccgcaccttacgggtcctgaaaatggtggagccgtggctccgcggcaaccagttttgcatcaagatattgaacccatacatgccgagcgtagtcgagacgctggaacagatgcagcggaagcacggcggaatgctcgtgcgcaatcccttatcccgtaattcgacccacgagatgtactgggtctcatgcgggactggaaatatcgtcagcgctgtgaacatgacctctcgcatgcttcttaacaggttcaccatggcccaccggaagccgacgtatgagcgcgacgttgacctgggggctggcacgcggcatgtcgccgtggagcccgaagtagccaatctagacatcatcggccagaggatcgagaacatcaagcacgaacacaagtcgacctggcactatgacgaggacaacccctacaagacttgggcataccacggatcctacgaggtcaagccctccggaagcgcctccagcatggtgaacggggtcgtcaagctcctgacgaagccgtgggacgtaatccccatggtcacacagatcgccatgaccgacaccacgccctttggccagcaacgggtcttcaaggagaaggttgacacaaggacccccaaggccaaacggggcacggcccagattatggaggttactgcaaagtggctgtggggcttcctgtcccgcaacaagaagccccggatatgcacccgcgaggagttcactcggaaggtgcgcagcaatgccgccattggggccgtgtttgtcgatgagaatcagtggaattccgccaaggaagccgtggaggacgaaaggttctgggacctggtgcaccgcgagcgggagctgcacaagcaggggaagtgcgcgacctgcgtctacaacatgatgggcaagcgcgaaaagaagctcggggagttcgggaaggccaaggggagcagagccatctggtatatgtggctgggcgcgcgcttcctggagttcgaagccctgggcttcatgaacgaggaccactggttttcccgtgagaatagtctgtccggggtcgagggcgagggtctgcataagttgggctacatcctgcgcgacataagcaaaatacccggaggaaatatgtacgcagacgacacagccggctgggacacccggatcaccgaggacgacctgcaaaacgaggccaagatcacagatatcatggagcccgagcatgcgctcttggccaagtcgatatttaaactgacgtaccagaacaaggtcgtgcgcgtccagaggcctgccaagaatggtaccgtgatggacgtgataagccggagagaccagcggggatccgggcaggttggcacctatggtctcaatactttcacgaatatggaggcacaattgatccgccaaatggaaagcgagggcatcttctccccgagcgaactagagacccctaatctcgcgggccgggtgctggattggctagagaagcacggggtcgagcgccttaagcgaatggcgatctcgggggacgattgcgtcgtgaagccaatcgatgatcgcttcgcaaccgccctgaccgccctgaacgacatgggtaaggtgcggaaggatatcccgcagtgggaaccctcaaagggttggaacgactggcaacaggtgcccttctgtagccaccatttccaccagctcatcatgaaggatggccgggagatcgtggtcccctgtcggaatcaagacgagcttgttggtagagcccgcgtctcccagggagcgggatggagcctacgggagacggcctgcttgggtaagtcgtacgcccagatgtggcaactgatgtacttccacagaagagacctgcgcctcgccgcgaacgctatctgcagcgccgtcccggtggactgggtacccacctcgcgcacgacatggagcattcatgcacatcaccagtggatgactaccgaagatatgctgtccgtctggaatagggtctggatagaggagaatccatggatggaggacaaaacccatgtgtcctcctggggcgatgtcccctatctgggcaaaagagaggaccagtggtgcgggagcctcatcgggctgaccgccagggctacgtgggcaaccaacatccaggtagctatcaaccaagtccgacggctcctcggcaatgagaactacctggactatatgacgtctatgaagcggttcaagaacgagtcggacccggagggggctctgtggtaa

SEQ ID NO: 24547 - RNA, 9879 nt, synthetic construct
  misc_feature 1..9879: note = derived and/or modified CDS sequence (opt11) from DENV-1__EU482810__SS-prME
  source 1..9879: mol_type = other RNA
agcgtaaccatgctgctcatgttaatgcccaccgcccttgccttccacctcaccacccgcggcggagagccccacatgatcgtgagcaaacaagagcggggcaagagcctccttttcaagacttcggccggggtaaatatgtgcaccctcatcgccatggatctgggcgagttctgcgaggacacgatgacctataagtgccctcgcatcaccgaggccgagcccgacgatgtggactgctggtgcaacgccaccgacacctgggtcacctacgggacctgcagccaaactggcgagcaccggcgcgacaaacggagtgtggccttggcgccccacgtggggctcggcctggagacgcgcaccgagacttggatgtcttccgagggcgcgtggaagcaaatccagcgggtcgagacctgggccctgcgccatcccgggttcacggtgattgcactcttcctcgctcatgccatcggcacgagcatcacccagaaagggatcatcttcatcctgctcatgctagtcacccccagtatggccatgcggtgcgtcggcatagggtcgcgcgactttgtggagggcctttccggagccacgtgggtggacgttgtgctcgagcacgggagctgcgtgacgactatggctaaggacaaaccgaccctggatatcgagctgctcaaaacggaggtaaccaaccccgcggtactgagaaagttatgtatcgaagccaagatctccaatactaccacggacagccgttgcccgacccagggtgaggcaaccctcgtggaggaacaggatgccaactttgtttgccgtcgcacgtttgtggatcgcggctgggggaacggctgtgggctgttcggcaaagggtccctgataacctgcgcgaagttcaagtgtgtgactaagctcgaaggcaagatcgttcaatacgagaatctgaagtatagcgtcatagtcacagtccacacgggcgaccagcaccaggtcggcaacgagtccaccgagcatgggaccaccgctactatcacaccccaagcccccagcacggagatacagctgactgactacggagcccttaccctggactgcagcccgcggacgggcctagacttcaacgagatggtcctactgacgatgaaggaaaagtcctggctggtccataagcagtggttcctcgacctgccgctgccctggaccagcggggcttcgacgagccaggagacctggaaccggcaggacttgctggtgacgttcaagaccgcccacgcgaagaagcaggaagtcgtggtgctgggcagtcaggagggcgccatgcataccgccctaaccggagccacggagattcagaccagcgggaccaccacgatcttcgccgggcacctgaagtgccgccttaagatggacaagttaaccctgaagggtatgtcctacgtcatgtgtactgggagcttcaagctggagaaggaggtggcggagacccagcatggcacagtgctcgtccagatcaagtacgaggggacggatgccccctgcaagatccccttctccacacaggacgaaaagggggtgacccagaacggccggctgatcacggcaaacccaatcgtgactgacaaggagaagcccgtcaatatcgaggccgagccaccctttggggagagctacatcgtgatcggggcgggcgagaaggccctgaagctgtcctggttcaagaaggggagtagcatcggcaagatgttcgaggccaccgcccgcggggcccggagaatggcgatcttaggggacactgcctgggacttcggttctatcggcggcgtgttcacctccgtcgggaaacttgtacaccagatcttcggcaccgcctacggggtactgttctcgggcgtctcctggaccatgaagattgggatcggcgttctccttacgtggctgggcttgaacagcaggtccacgtcactgtccatgacctgcatagccgtagggctggtcacactgtacctaggtgttatggtgcaggccgacagcgggtgcgtcatcaactggaaaggccgggagctgaaatgcgggagcgggatcttcgtgaccaacgaagtgcacacgtggaccgaacagtacaagttccaggcggacagtccgaaacgcttgtcagccgccatcggcaaggcctgggaggagggggtctgcggcatccgttccgctacccgcttagaaaacatcatgtggaaacagatatcaaacgaactgaaccatatcctcctggagaacgatatgaaactgaccgtggtggtgggtgacgtggcgggcatcctcgctcaggggaagaagatgatcaggccccagcccatggagtacaagtactcatggaagtcctggggcaaggccaagatcatcggcgctgacgtgcagaacactacgttcatcatcgacggacccaacactcccgagtgtcccgacgaccaacgcgcctggaacatttgggaagtagaagactacggcttcggtatcttcaccaccaacatctggcttaagttgagggactcctatacgcagatgtgtgatcacagactaatgtcagccgccataaaggactccaaggccgtgcacgccgacatgggctattggatagagagtgagaagaatgagacctggaagctggccagagcatccttcatcgaggttaagacgtgtatctggcccaagagccacaccctgtggtccaacggcgtcctagagtctgagatgatcatccccaagatctacggtgggccgatctcccagcacaactaccggcctgggtatttcacccagaccgcggggccctggcacctgggtaagctcgagctggacttcgacttatgcgaaggcaccaccgtggtggttgatgagcactgtggcaatcgggggccgagcctgcgcactaccaccgtgaccgggaagataatacacgagtggtgttgcagatcttgtacgcttcctccccttcgcttcaaaggagaggacggctgctggtacgggatggagatccggcccgtcaaggagaaggaggagaacctggtcaagagcatggtgagcgcgggctccggcgaggtggacagcttctcacttgggctgttgtgcatcagcatcatgatcgaggaggtcatgcgatcaaggtggagccgcaagatgctcatgacgggcaccctggccgtgttctttctgctgatcatgggccagttaacctggaacgacctgatacggctatgcatcatggtgggcgcgaacgcctccgaccgcatggggatgggcacgacctacctcgccctgatggccactttcaagatgcgcccgatgttcgctgtcgggctcctgttccggcgcctgacttcgcgggaggtgcttctcctcacgatcggactctccctggtggcgagcgtcgagctgcccaactccctcgaggagcttggcgacgggcttgccatggggatcatgatccttaagctgttaactgacttccagagccaccagttgtgggccactttactgtccatgacgttcattcgcaccactttcagcctccactacgcctggaagactatggcgatggtgctgtccatagtcagcctgttcccgctctgtctgtcgaccacatctcagaagaccacctggttaccagtactcttaggcagtttgggttgcaaacccctcaccatgttcctgatcgctgaaaataaaatttggggcagaaagagctggcccttgaacgaagggatcatggccgttggaatagtgtccatcctcctcagtagcctgcttaagaatgacgtgcccctggccgggcccctgatcgccgggggcatgctcattgcttgctacgtgatatccggcagctccgctgacttgagcctggagaaagccgcagaagtttcctgggaggaggaggctgaacacagcggcgcttcccacaacattcttgtggaggtgcaggacgacgggacgatgaaaatcaaggatgaggaaagagacgacaccctgaccatcctgctcaaggccaccctgctggcagtcagcggcgtgtacccactctccattcccgccaccctgttcgtgtggtacttctggcagaagaaaaagcaacggagcggtgtcttatgggacacgccatcgccgcccgaggttcaacgcgccgtgttggacgatgggatctaccggatcatgcagcgcggcctgctggggcggagccaggtaggggtgggcgttttccaagagaacgtcttccacaccatgtggcacgtgactcgcggggcggtactgatgtatcaggggaagcggttggagccctcctgggcgtccgttaagaaggatctgatttcgtacggcggcgggtggcgcctgcagggcagctggaacaccggggaggaggtccaggtgatcgccgtcgagcctggcaagaacccaaagaacgtccagaccgcgcccgggaccttcaaaacctccgagggcgaagtgggcgccatcgcgctcgacttcaagcccgggacgagcggcagccccatcgtcaaccgggaggggaagatcgtgggcctgtacggcaatggtgtggtgacgaccagcggcacctacgtgagcgcgatcgcacaagcgaaggcgtcccaagagggccccttaccagagatcgaggacgaggtgttccgcaagcggaacctcacaatcatggacctgcacccaggctcggggaaaacccgccggtacctaccggccattgtccgcgaggccataaagcggaaactccgcaccctgattcttgccccgacacgtgtggttgcatccgagatggcagaggcgctcaagggcatgcccatccggtaccagaccacggccgtcaagagcgagcacaccggcaaggaaatagtggacctgatgtgtcacgccaccttcaccatgcgcttactcagcccggtgcgggtccctaactacaatatgatcatcatggacgaggcgcacttcacagacccgagctccattgctgcccgcgggtacatctccacgcgggtggggatgggggaggccgccgccatcttcatgactgcgacgccgcctggctctgtcgaagccttcccccagtcgaatgccgtcattcaggacgaagaacgagacatcccggagcggtcctggaactcggggtacgagtggatcacggacttccccggcaagaccgtctggttcgtgccctccatcaagtccggcaacgatatcgccaactgcctacggaagaacgggaaacgggtaatccagctgtcccgcaaaacctttgacaccgagtaccagaaaacgaagaacaacgactgggactatgtggtgaccaccgacatctcagagatgggcgcgaacttccgggccgaccgcgtcatcgacccccggcgctgcctcaaaccggtgatcctgaaagatggacccgagcgggtgattctggccggccccatgcccgtgaccgttgcatccgccgcgcagcgccgggggcggatcggccggaaccacaacaaagagggcgatcagtacatatatatggggcagccgctcaacaacgacgaggatcatgcccactggacggaggcaaagatgctactggataacatcaacacccccgagggcatcatccccgccttgttcgagcctgaacgtgagaagtcagcagctattgacggggagtacagattacggggcgaggccagaaaaacattcgtcgagctgatgaggcgcggggacctcccggtgtggcttagccacaaggtagcctccgagggtttccagtacagcgacaggagatggtgcttcgacggcgagcgcaataaccaggtgctggaggagaacatggacgtggaaatctggaccaaggagggggagcgcaagaagttgcggccccgctggctggacgcccggacttactctgaccctttggccctccgcgagttcaaggagttcgccgccggccgtcgctccgtgtccggagacctgatcctggagatcggtaaactcccccagcatcttacccaacgggcccagaacgcacttgacaacctagtcatgctgcacaacagcgagcagggtgggcgcgcgtaccggcacgccatggaggagctgccggacacgatcgagacacttatgctgctggccctcatcgccgttttaaccggaggggtgactctgttcttcctctccggtcgagggctgggaaaaaccagcatcgggctgttgtgtgtcatggcctcctccgtgctgctgtggatggcgtccgtggagccccattggatagcggccagcatcatcctcgagttcttcctgatggtgttgctcatcccagagcccgaccggcagcgcaccccgcaggacaaccaactcgcgtacgtggttatagggctcttgttcatgatcctgaccgtagccgcgaacgagatgggcctgctcgagaccacgaagaaggatctgggaattggccacgtggccgtagagaatcaccaccatgcagccatgcttgacgtcgatctccaccccgcctccgcgtggaccctgtacgccgttgctacaacgatcatcacccccatgatgcggcacaccatcgagaacaccactgcgaacatcagcctgaccgccatcgcgaaccaggcagcaatcctcatggggcttgacaaaggatggccaatatctaagatggacattggcgtgcccctgctcgccctggggtgctacagccaggtcaaccccctgaccctaaccgcggccgtgttaatgctggtggcgcactacgccatcataggacccgggctccaagccaaggcgactcgcgaggcccagaagcgcacagccgccggtataatgaagaacccgacagtggacgggatcgtggccattgacctggaccccgtggtctatgacgcgaagtttgagaaacagttaggccagataatgctcctaatattgtgcaccagtcagatactcctgatgcggacgacctgggcgctgtgcgagagcattaccctcgccaccggccccctcactactttatgggaggggtcccccggcaagttctggaacaccaccatagccgtgagcatggccaacatcttccgtgggagctatctcgcgggtgcgggcttggccttctccctgatgaaatccctcgggggcagccggcgcgggacgggcgcccaaggagagaccctgggcgaaaagtggaaacggcaactgaaccagctcagcaagtccgagttcaacacctacaagcggagcggcatcatggaggtggaccggtcggaagcgaaggaggggctgaaaaggggcgagactactaaacacgccgtatctcggggaactgccaagctgcgctggttcgtggagcggaatctcgtgaagccggagggaaaggtcatagacttaggatgcggccgcggcgggtggtcctattactgtgcaggcctgaagaaagtaactgaggtgaaggggtacaccaagggcgggcccggccacgaggaacccatcccgatggccacttatggctggaaccttgtcaagctccacagtgggaaggacgtgttcttcatcccgcctgagaagtgcgacacgctgctgtgcgatataggcgagagctcccctaaccccaccatcgaggaggggcggaccctccgggtgctaaagatggtcgagccgtggctgcggggcaaccagttctgcataaagatactcaatccgtacatgccgtcggtggtggaaacgctggaacagatgcaacgcaaacacgggggcatgctggtccggaaccccctctccaggaactccacccacgaaatgtactgggtgagctgcggtacggggaacatcgtgtccgcggtcaacatgaccagccgcatgctgctgaaccgcttcaccatggcccaccgcaaaccgacgtacgagcgggacgtggacctcggcgccgggacacgtcacgttgccgtcgagcccgaggtagcaaaccttgacatcatcggccaacggatcgagaacatcaagcacgagcacaaatcaacctggcactacgacgaagacaacccgtacaagacttgggcgtaccacgggagctacgaggtgaagcccagcggtagcgccagctccatggtaaacggcgtggtaaaactgctcacgaagccctgggacgttatacctatggttacccagatcgccatgacagacacgactcctttcggacagcaacgcgtcttcaaagagaaagtggacacccgcacgcccaaggccaagcgcgggaccgcccagatcatggaggtgacggcgaagtggctatgggggtttcttagccgcaacaaaaagccacgcatatgcacccgggaggagttcacccgcaaggtccggtccaacgccgcgattggcgccgtgttcgtggacgagaaccagtggaacagcgccaaagaggccgtcgaggacgagcgcttctgggatctcgtgcaccgggaacgcgagctgcacaagcaggggaagtgcgctacatgcgtgtacaacatgatggggaagcgggagaaaaagttgggcgagttcggaaaggctaagggctcccgcgccatttggtacatgtggctcggtgcgcggttcctggagttcgaggcccttggcttcatgaacgaggatcactggtttagccgcgaaaattccctaagcggggtcgaaggcgaaggtctacacaaattggggtacattctccgggacatatccaagatccccggcgggaatatgtatgccgacgatacggcgggatgggacacccggatcaccgaggacgacctgcagaacgaagccaaaatcaccgacattatggagcccgagcacgcgctgctcgcaaaaagcatctttaagctgacgtaccagaacaaagtggtccgggtccagcgcccggctaagaacggcaccgttatggacgtcataagtcgccgggatcaacgcggcagcggccaagttgggacctacggcctaaatacgttcacgaacatggaggcccagctcattcgtcagatggaatccgagggcatcttcagccccagtgagctggatacccccaaccttgccggacgtgtgctcgactggctggagaagcacggcgtggagcggctgaagcgcatggcgatcagcggggacgactgcgtggttaaacccatcgatgaccggttcgctaccgctctcaccgccctgaacgacatgggcaaggtgcgcaaggacatcccccaatgggagcccagcaagggctggaacgactggcagcaggtccccttctgctcccaccacttccaccaacttatcatgaaagacggccgagagatcgtggtgccctgccgcaaccaggacgagctggtcggccgggctcgcgtgtcacagggggctggctggtccctgcgggagacggcatgcctgggcaagagctacgcccagatgtggcagttaatgtactttcaccgccgggacctgcgtttagccgcgaatgcgatatgctccgccgtgccggtcgactgggtgcccacgagccggactacatggtcgatccatgcccaccaccagtggatgacaactgaggacatgctgagcgtgtggaaccgcgtctggatcgaagaaaacccctggatggaggacaagacccatatttcgtcttggggcgacgtgccctatctgggaaagcgggaggaccaatggtgcggatcccttatcggcctcacggcccgtgcaacatgggccacaaatatccaggtggccatcaaccaggtgcgccggcttctggggaacgagaactaccttgattacatgacctcaatgaagcgtttcaagaacgagtcgggccctgagggggccctgtggtga

SEQ ID NO: 24548 - RNA, 9879 nt, synthetic construct
  misc_feature 1..9879: note = derived and/or modified CDS sequence (opt11) from DENV-1__EU482811__SS-prME
  source 1..9879: mol_type = other RNA
agcgttacgatgctgttaatgcttatgcctacagccctggccttccacctcaccacccggggcggggaaccccacatgattgtcagcaagcaggaacggggcaagagcctgttgttcaagaccagcgccggagtaaacatgtgcacactcatcgccatggacctgggcgagctatgcgaggataccatgacttacaagtgcccccggatcaccgaggcggaaccggacgatgttgactgctggtgcaacgccaccgacacgtgggttacctacgggacctgttcccagactggcgagcaccggcgagagaaacggtccgtggcacttgcccctcatgttgggctaggactggagacgcgcacagaaacctggatgagttctgagggcgcatggaagcagatccagcgggtcgaaacctgggcactcaggcacccggggtttacggttatcgccttattcctggcccacgccatcggtacaagcatcacccagaagggaataatatttatactcctgatgctggtgacaccctccatggccatgcggtgcgtcggcatcggcagccgcgactttgttgaggggctgtccggcgcaacgtgggtggacgtagtgctcgaacacggcagctgtgttactaccatggccaaagataagcctacactggatatcgagctcttaaagacggaggtcaccaaccctgcggtgctgcggaagttatgcatcgaagccaagatatcgaacacaacgaccgactctcggtgccccacgcaaggggaagcgactttagttgaagaacaagacgccaactttgtctgccggcgcaccttcgtggatcggggatggggaaacggctgtgggttgttcggcaaagggtcgctcctgacctgtgccaagttcaaatgcgtcaccaagctggaggggaagatagtccaatacgagaacctcaaatatagcgtcatcgtgaccgtccacaccggcgatcaacaccaggtggggaacgagagtacagaacacggcaccaccgctaccattacgccgcaggctcctaccactgagatacagctgacagactacggggcccttacccttgactgctccccaagaacgggcctggatttcaatgagatggtcttgctcacaatgaaagagaagagttggctggtacataagcagtggtttttggacctccctctgccctggaccagcggggcatcgacatcccaggagacatggaaccggcaagatctgcttgtgaccttcaagaccgcccatgcaaagaagcaggaggttgtggtcttgggctcacaagagggcgccatgcacaccgccctaacgggtgccacagaaattcagacctccgggaccacaactatatttgccggacacttgaagtgtcggctgaagatggacaaacttacgctaaagggtatgagctacgtgatgtgcaccggtagttttaaacttgagaaggaggtcgcggagacgcagcacgggactgtgctggtacaaatcaagtacgagggtactgacgcaccctgcaaaattcccttctcgacccaggacgaaaagggggtgacacaaaacggccggttgataaccgccaaccccatcgtcaccgacaaagaaaaacccgtaaatatcgaggccgagccgccattcggagagagctatatagtgatcggcgcgggcgaaaaggccttaaaattatcttggttcaagaaggggtcctcaatcggcaagatgttcgaagcaaccgccagaggggccaggcgcatggccatcttgggcgacacggcttgggatttcggatcaatcggtggcgtgttcacctctgtggggaagttagtgcaccagatcttcggcacagcctatggggtgctgttctcgggcgtcagttggaccatgaaaatcggaataggggtactgctcacctggctgggcctaaattcccgctcgaccagcctaagcatgacgtgcatcgccgttgggctggtcaccctttacctcggcgtgatggtgcaggcggactccgggtgcgtcatcaattggaagggaagggaactcaagtgtgggtccggcatcttcgtgacgaacgaggtacacacctggacagagcagtacaagtttcaagcagactccccgaaacgcctgagtgctgccattggcaaggcctgggaagagggggtttgcggcatcaggagcgcaacaagactcgagaacatcatgtggaagcaaatctccaacgagttaaatcatattttgctcgagaacgacatgaagttcaccgtggtggtcggggacgttgccggtattctggtccagggcaagaagatgatccggccgcagcccatggaatacaagtactcttggaagtcctggggaaaggccaagattatcggtgccgacgtccaaaattccacctttattattgacggacccaacaccccggagtgtccggacgatcagcgggcatggaacatctgggaggtggaggactacggcttcggcattttcacaaccaacatctggctgaagctccgggactcctacacccaggtctgtgaccatcgcctgatgagtgcggcgatcaaagacagcaaagccgtccacgctgacatgggctattggatagagagcgaaaagaacgagacttggaagttggcccgggcatcgttcattgaagtcaaaacctgcatctggcccaagagccacactctgtggtccaatggcgtcctggaaagcgagatgattatccccaagatacatgggggtccaatttcccagcataactaccgccccgggtacttcacacagaccgctggcccatggcatctgggaaaactcgagttggacttcgacctctgcgagggaaccaccgtagtggtggacgagcactgtggaaaccggggtccgagcctccgcactaccaccgtcaccggaaagatcatacacgagtggtgctgtcggtcctgcactctgcctccactgaggttccgcggggaggacggctgctggtacgggatggaaatacgtcccgtgaaggagaaggaagagaacctcgtaaagagcatggttagcgccggatccggagaggtggacagcttcagcctcgggctgctttgtatcagcatcatgatcgaggaggtaatgaggtcccgttggagcaggaagatgctcatgactgggaccctggctgtctttttcttactgatcatggggcagctgacatggaacgacttaatcaggctctgcataatggttggcgccaatgcaagtgaccgcatgggcatgggtacgacgtacctggccctgatggcgacgttcaagatgaggcctatgttcgccgttggcctgcttttcaggaggctcacctcgcgcgaggtcctcctgctcaccatcgggctgtccctagtcgccagcgtcgaattgcccaactccctggaggagttgggcgacggcctggcgatgggcatcatgatcttaaagctgctcaccgatttccagagttaccaactgtgggcgacccttctctcattgaccttcatcaagactacgttcagcctccactacgcctggaagactatggccatggtgctgagcatagtgtcactgttccccttgtgtctctccaccactagccagaagaccacctggctgcctgtcttactcgggtccctggggtgtaagccgcttaccatgttcctaatcgcggaaaataagatctggggcaggaaaagttggcccctgaacgagggcatcatggccgtgggcatcgtgtccatcctgctctccagccttcttaagaacgacgtcccactcgcagggcccctaatagccggaggaatgctgatcgcctgctatgtaatatcggggagctccgcggacctaagcctggaaaaggccgctgaagtttcttgggaagaggaggccgagcacagtggcgccagccacaacatcttagttgaggtgcaggacgacggaacgatgaagatcaaagacgaggagcgtgatgataccttaactatcctactgaaagcaaccctcctggccgtatctggcgtttacccgctgtccatccccgcaacgttattcgtatggcatttctggcagaaaaagaagcagagaagcggagttctctgggatacgccaagccctcccgaagttgagcgcgccgtactggacgacggcatttatcggattatgcaaaggggcctgttagggcggagccaggtgggcgtcggggtgttccaggagaatgtgtttcacacaatgtggcatgtcacccgcggagccgttctgatgtaccaggggaagcgcctggagccctcctgggcgtctgtgaagaaagatctgatttcctacggcggaggatggaggttacagggcagctggaacaccggagaagaggttcaggtgatcgcggtggagccaggcaagaatcctaagaatgtgcaaactgcaccggggacttttaaaacccccgagggagaagtgggggccatcgctctggactttaagcccgggacatcgggcagcccgatcgtgaatcgtgaagggaagatcgtcggcctttacggcaacggtgttgtgacgacctcgggcacctacgtgtcggcgattgcccaggcgaaagcgtctcaggaggggccgctgcccgagatcgaagacgaggtgttcagaaagcggaacttaacaatcatggacctccatcccggctctggcaagactagacggtaccttccggcgatcgtgcgcgaggctatcaaacgtaaactgcgcaccctaatactcgctcccacccgagtagtggcctcagagatggccgaggcactgaaaggtatgcccatccggtaccagacgacggccgtaaagagtgaacacacgggcaaggagatcgtagacttaatgtgtcacgccacgtttaccatgaggttactctcccccgttcgggtgccgaactataatatgattatcatggacgaggcccacttcaccgatcccagtagcatcgccgccagagggtacatctcaactagggtcggaatgggggaggccgccgctatcttcatgaccgccactcccccaggcagcatggaagccttcccacagtcaaacgccgtgatccaggacgaggaacgtgacatacctgagaggagctggaactcaggttatgagtggattactgacttcccaggtaaaaccgtgtggttcgtgcccagcatcaaggctggcaatgatatcgcaaactgcctcagaaagaatggcaagcgggtgatccaactgagtcgcaagacctttgataccgagtaccagaagactaaaaacaatgactgggactacgtggtcaccactgacatcagtgagatgggcgcaaatttccgcgccgaccgcgtgattgacccccggcgctgtctaaaacccgtcattttgaaagacgggcccgagcgggtcatcctggctggcccaatgccggtaaccgtggcttctgccgcccagcgcagagggcgcataggccggaaccacaacaaagagggcgaccagtacatctacatgggtcaacccctgaacaacgatgaggatcatgcccattggaccgaggccaaaatgcttcttgataacatcaataccccagaggggatcatcccagccctgttcgagccggagagggaaaagtccgctgcgatcgatggtgagtaccgcctccggggagaggcccgcaagacattcgtggagctgatgcggcggggagacttacccgtgtggctctcctacaaggtcgccagcgagggattccagtatagcgatcggcgctggtgcttcgacggagaacggaacaaccaagtcttggaggaaaacatggatgttgaaatctggaccaaggagggggagcgcaagaagttacggccacgctggctggacgcgcggacttactccgaccccctggccctgagggagttcaaagagttcgcagcgggccggcgcagcgtctccggggacctcatcctggagattggcaaacttccgcagcatctcacccagagagcccagaacgcactggacaacctggtgatgctccacaatagtgaacagggtgggagggcctatcggcacgcaatggaggagctgcccgacactatagagacactgatgctactggccctgatcgccgttctcactggcggggtaacactgttctttctatccggcaaagggctcgggaagaccagcatcggcttactttgcgttatggcctcctccgtactcctctggatggcgtccgtcgaaccccactggatcgcggccagcatcatccttgaatttttccttatggtgctgctcattccagaaccagatcgacagcgcacgccgcaggacaatcagctcgcctacgtggtcatcgggctgctgtttatgatcctcacagtggccgcgaacgagatgggtctgttggagacgaccaaaaaggacctcgggataggccatgtggctgtcgagaatcaccaccacgctgccatgttagatgtggacctgcaccccgcctctgcgtggaccctttacgccgtggccacgacgatcatcaccccaatgatgcgacacacgatcgagaacaccaccgccaatatcagcttaactgcaatagccaaccaggcagccatccttatggggctcgacaagggctggcccatctccaagatggatatcggggtccccctgctggccctcggctgctactcgcaagtgaaccccctcacccttaccgctgccgtgctaatgctggtcgcccactacgcgattatcggcccggggctgcaggccaaagcgacgcgggaggcacagaagcgtaccgccgccggcattatgaagaaccccaccatcgacgggatcgtggccatcgacctcgaccccgttgtctacgatgctaaatttgagaagcagctcggtcaaataatgcttctcatcctatgcacctcccaaatcctcttgatgcgtaccacatgggccctctgcgagtctataaccctagctacgggccccttaacgaccctctgggagggatctccgggtaaattttggaacacaaccatcgctgtaagcatggccaacattttccggggtagctacttggcgggagccggcttggccttcagcttgatgaagtcgctcggaggagggcgccgggggactggtgcccagggcgagactttgggggagaaatggaagcgccagctgaaccagttgtctaagagcgagttcaacacgtacaaacgttccgggattatggaggtagacagaagcgaggctaaggaaggcctaaagcgtggggagaccacgaagcacgcggtatcacgcggcacagccaaattgcggtggtttgtggaacgcaatctggttaagcccgaggggaaagtcatcgatctgggctgtggcagagggggatggagctactactgtgcggggctcaagaaggtgacagaggttaaaggctacaccaaaggcggccctggccacgaggagcccatccccatggcaacctacggatggaatttagtcaagctgcattctggcaaggacgtgttctttataccacccgagaagtgcgacacgttactgtgtgacatcggggagagctcccccaatccgaccatcgaagagggccgcaccttacgtgtactaaagatggtagaaccgtggttacgcggtaaccaattctgcatcaagatactgaacccctacatgcccagcgtggtggaaactcttgaacaaatgcaacggaagcacggcggcatgctagtgcgcaacccgctgtccagaaacagcacccacgagatgtattgggtgagttgcggtacgggcaacatcgtgagcgctgtcaatatgacgagtcgcatgttactgaaccgcttcaccatggcccacagaaaacctacgtacgagagagatgtggacctgggtgccggcacacggcacgtggccgttgagcccgaggtggccaacttggacatcatcggacaacgcatcgagaatatcaagcacgaacacaagagcacctggcactacgacgaggacaacccctacaagacatgggcgtaccacgggtcctatgaggtcaagcccagcggctccgccagtagcatggtaaacggcgtggtcaaacttctgacaaagccctgggacgtgatccccatggtcacacagattgcaatgaccgacaccacaccctttggccagcaaagagtcttcaaggagaaggtggacacgagaaccccgaaggcaaagcgggggaccgcccagataatggaagtgacggcacgatggctctggggatttttgagccggaacaagaagccccgaatctgcacccgtgaggagttcacccgcaaggtgcgcagcaacgcggccatcggcgcagtgttcgttgacgagaatcagtggaactccgcgaaggaggcggttgaggatgacagattctgggacctggtgcaccgggagagggaactccataagcaagggaagtgcgcaacatgcgtatataacatgatgggcaagcgggaaaagaaactgggggagttcggaaaggctaagggatcacgtgctatctggtacatgtggttaggcgcgcggtttctcgagttcgaggccctcggattcatgaacgaagatcattggttcagtcgagagaactccttgtcgggagtagagggcgagggactccataaacttggctacatcctgcgggacataagcaagatccctgggggcaacatgtatgccgacgatacggcgggctgggatactcgcatcacagaagacgacctccaaaacgaggccaagatcaccgacatcatggagccggaacacgcgttactagcaaagtccatcttcaagctcacgtatcagaacaaggtggtgcgggtccagaggccagccaagaatgggacggtcatggacgttattagcagacgggatcaacgcggctcagggcaggtcggaacatacggcctgaacaccttcacgaatatggaggcccaactaatacgacagatggaaagcgaggggatatttctcccaaatgagctggagacccccaacttagccgggagagtattggactggctggagaagtacggagtggagcggctgaagaggatggccatctcgggggacgactgcgtcgtcaagccgatcgatgatcggttcgcaaccgccctcaccgccctgaacgacatggggaaggtgagaaaggacatcccgcaatgggagcccagcaaaggctggaacgactggcagcaggtccccttttgctcccatcatttccatcagctgatcatgaaggacggccgggagatcgtggtgccctgtagaaaccaggacgaactcgtcgggcgggcccgcgtgtcgcaaggcgcggggtggtctctgagagagacggcatgcctgggcaagtcatacgcccagatgtggcagctgatgtactttcaccgccgggacctgcgccttgccgcgaacgccatctgttcagccgtgcccgtcgactgggttcccacctcccggaccacctggagcatccatgcgcaccaccagtggatgactaccgaggacatgctctccgtgtggaaccgcgtctggatcgaggaaaacccctggatggaggacaaaacccgtatcagctcatgggaggacgtgccatatctgggcaagcgcgaggaccagtggtgcgggtctctgattggcctcacagcccgagcgacatgggccaccaacatccaggttgccatcaaccaagtacggcgactgataggtaacgaaaactattccgactatatgaccagcatgaaacgattcaagaacgagtcggagccagagggcgcgctctggtga

SEQ ID NO: 24549 - RNA, 9879 nt, synthetic construct
  misc_feature 1..9879: note = derived and/or modified CDS sequence (opt11) from DENV-1__EU482812__SS-prME
  source 1..9879: mol_type = other RNA
agcgtgacgatgctgctcatgttgatgcccaccgcactggccttccacctaaccacccggggcggtgagccccatatgatcgtgagcaaacaagagcggggcaagagcctgctgttcaagaccagcgccggggtgaacatgtgcacgctcatcgcaatggatctgggagagctctgtgaggacacaatgacctacaaatgcccgcggattaccgaaacagagccagatgacgtggactgctggtgcaatgcgacagatacttgggttacctacgggacctgcagccagacgggagagcatcggcgagacaaacggtccgtggccctcgcgccccacgtaggcttgggactggagacgcgcacagagacgtggatgagcagcgagggcgcctggaagcagatccagcgcgtagaaacgtgggccttacggcaccccggattcaccgtgatcgcgctgtttctagcccatgccatcggtacaagcatcacccagaaagggatcatcttcatacttctaatgctggtaacgcccagtatggccatgcggtgcgtgggcatcggcagccgcgacttcgtggaagggctatccggggcaacctgggtggatgtggtactggaacacgggtcgtgcgtgaccaccatggctaaagacaagcccacactagacatcgagcttctaaagaccgaggtcaccaaccccgcagtcctgcggaagctctgtatcgaggccaagatcagtaacaccaccacggacagccgatgccccacgcagggtgaggccacgctggtggaggaacaggatgccaatttcgtatgtcggcgcaccttcgtggatcggggctgggggaacggctgcgggttgttcggcaaggggtcactgatcacgtgcgccaaattcaagtgcgtcaccaagcttgaagggaagatcgtacagtacgagaacctcaagtactccgttatcgtgacagtacatacgggcgatcagcaccaggtgggtaacgagtccaccgaacacggcaccacagcaaccatcacgccacaggcacccaccaccgagatacagttaaccgattatggggcgctgaccctggactgcagtcctcgcaccgggctcgacttcaacgagatggtcctgctgaccatgaaggagaagtcttggctggtgcataagcagtggttcctggatctgcctctaccctggacgtctggggccagtacgtcccaggagacatggaaccggcaggatctgctggtgaccttcaagacggcccacgccaagaagcaggaagttgtggtgcttggaagccaggagggcgcgatgcatacggccttgaccggtgctactgagatccagacctccggcacaacgaccattttcgctgggcatctgaagtgtcgcctcaagatggacaagctaacgctgaagggcatgtcgtacgtcatgtgcacagggtcctttaagctcgagaaggaggtggccgaaacccagcatggtaccgtgctagtccagatcaagtacgaagggactgacgcgccctgcaaaattccttttagcacgcaggacgagaagggggcaacccaaaatggccggctgattaccgccaacccaatcgtcactgataaggagaaacccgtgaatatcgaggccgagccaccgttcggggagtcctatattgtcatcggagcgggcgaaaaagcgttgaaactcagctggtttaaaaaaggttccagtattggcaagatgttcgaggccacggcgcggggagcccggcgtatggcgattcttggcgataccgcctgggacttcgggagcatcggcggcgtcttcacatcggtggggaaactggtccaccagatatttggcaccgcctacggggtgctgttttccggcgtatcatggaccatgaagataggtatcggtgtattactcacctggctcggcctgaactctagatccacgtcccttagtatgacttgcattgccgtggggctcgtgacactgtacctaggtgtcatggtgcaagcggattcgggctgcgtgatcaactggaaggggcgggagctcaagtgcgggagcggaattttcgtcactaacgaggtgcacacctggaccgaacagtataagtttcaggcagactctccaaagcgcctctccgccgctatcggtaaggcctgggaggagggggtgtgcggcatccggtctgccactcgactggaaaacatcatgtggaagcaaatctccaacgagctcaaccatatcctgctggagaacgacatgaagttcacggtggtggttggggacgtcgcgggaatcctcgcccagggtaagaagatgatccgaccgcagccgatggagtataagtacagctggaagtcctggggcaaggccaagattattggcgccgacgtgcagaacaccaccttcattatcgacgggcctaacactccggagtgccccgacgaccagagagcgtggaacatctgggaggtcgaagactatggcttcgggattttcactacgaacatctggctcaagttacgggatagctatacgcaggtctgcgaccaccgcctcatgtccgccgccatcaaggacagcaaagccgttcacgccgacatgggctactggatcgagtctgagaaaaacgaaacatggaagctggcacgtgccagctttattgaggtgaagacgtgcatctggccaaaatcccacaccctgtggtcaaacggggtactcgaatccgagatgatcatccccaaaatctacgggggcccgataagccagcataactatcgtcccggatactttacccagaccgcaggaccctggcacctgggtaagctggagctagacttcgatctgtgcgagggcaccaccgtggttgtcgatgagcactgcggcaaccgggggccatctctgaggacaaccacagtgacgggcaagatcatacatgaatggtgttgcagaagctgcacactgcctcccctcaggttccgcggtgaggatggctgctggtacgggatggaaatccgtcccgttaaggagaaagaggagaacctggttaagtccatggtttccgccggctcgggcgaggtggactctttcagcttaggactgctgtgcatctccatcatgatcgaggaggttatgcgcagccgctggagcaggaaaatgcttatgaccggcacgttagcggttttcttccttctaataatgggtcaattgacatggaacgaccttattcgcttatgcattatggtgggcgcaaacgccagcgataggatggggatgggaacgacctatctggctctgatggccacgttcaagatgcggccgatgtttgccgtaggccttcttttccgtcggcttacgtcgcgcgaagtgctcctgctgaccatcgggctctcgttagtggcttccgtcgagcttccgaatagcctggaggaattaggagacggtttggcgatgggcattatgatcctcaaactgttaaccgacttccaatcacaccagctctgggctactctgctgagccttaccttcatcaagaccaccttttcccttcattacgcatggaagacgatggcgatggtcctgagtattgtctccctcttccccttgtgtctgtcgacaacctcccagaagaccacgtggctcccggtgttgctgggcagcctcggttgcaagcctctgacaatgtttctgatcgctgagaataagatctggggccgtcgcagttggcccttgaacgaggggattatggccgtgggcattgttagtatacttctaagttccctcctaaagaacgatgttcccctggcagggcccctcatagcgggggggatgttgatcgcgtgctacgtgatctcagggtccagtgcagatctatctctggagaaggccgcggaagtctcctgggaagaggaggcagagcactccggcgccagccacaacatccttgtggaagttcaagacgacggcactatgaagatcaaggacgaggagcgggacgacacattgactatacttttaaaagccacgctgctcgccgtttctggcgtgtatcctctgtcaatccctgccaccctgttcgtatggtacttctggcagaagaaaaaacagaggtccggggtcctctgggacactccatcgccgccagaggtcgaacgggccgtgctggatgatggtatctaccgcattatgcagcggggtctgctggggcgctcccaagtgggcgtgggagtcttccaggagaacgtatttcacacaatgtggcacgtgacgagaggcgcggtgctcatgtaccaggggaagcgcttggagccctcatgggcatccgtgaagaaggatctgatttcttacggcggcggttggcgcctccaaggatcgtggaacacgggagaggaggtccaggtgattgccgtagagcccggcaagaacccgaagaacgtgcagacagcgcccgggaccttcaagacgcccgaaggcgaagtcggcgctatagcgctggacttcaaacccggaacgagcggctctcccatcgtcaaccgggaggggaagatcgttggcctgtacgggaacggggtggtgaccacaagcggcacgtatgtgagtgccatcgctcaggctaaggcgagccaggaaggtccgctccccgagatcgaggatgaggtatttcggaaaagaaacctaaccattatggacctccatcccggctcagggaagacccgacgctatctgccggccatcgtccgggaggccataaagcggaagctgagaaccctgatcctcgctcccactcgggtggtcgcctcagaaatggccgaggctttgaagggcatgcccatcagatatcagaccaccgccgtaaagtctgaacacaccggcaaggagatcgtggatctgatgtgccacgccacgttcaccatgcggcttctgtcacccgtgcgcgtcccgaactacaacatgatcatcatggacgaggcccactttaccgacccgtcgtccatcgcagctcgcgggtatatcagcacccgcgttggcatgggggaggctgccgccatattcatgacagcgaccccgcccggcagcgtggaggccttcccgcaaagtaacgcagtcatccaggatgaggagagagacatacccgaacgctcgtggaacagcgggtacgaatggatcaccgacttccccggcaagaccgtgtggtttgtgccctctatcaagtcggggaacgatatcgccaactgtcttcggaagaatggaaagcgcgtcatccagctctccagaaagacctttgacaccgagtatcagaagaccaagaataacgattgggattacgtggtgacaactgacatctcagagatgggcgcgaactttagagccgaccgagtcatcgatccccgccggtgcctgaagccggtaatcttgaaggacggtccggaacgcgtgatcctagccggtcctatgccggtgacggtggcctccgcagctcagcggcgcggtcgcatcggccgcaaccacaacaaggagggggaccaatacatatacatgggacagccccttaacaacgacgaagatcacgctcactggaccgaggccaagatgctactcgacaacatcaacacgccagaggggatcattcccgccttgttcgagccggaacgcgagaagtcagcggcgatagacggggaatatcggttgcgaggcgaagcgcggaagacgtttgttgaactaatgcgccgtggggacttgcccgtgtggctgtcttacaaggtggcaagcgaaggcttccaatacagcgacaggagatggtgctttgatggcgagcgtaataaccaagtactggaggagaacatggacgtggagatctggaccaaggaaggggagcgcaaaaagctgcgaccacggtggctggacgctcgcacctactcggacccactcgcgctgcgcgagttcaaggagtttgcggccggccgccggagcgtgtccggggacctgatcctcgaaatcggcaagctgccgcaacacctgacccaacgggcccagaatgccttagacaacttggtcatgctgcacaacagcgagcagggcgggcgggcgtaccgccacgcaatggaagaactccccgacaccatagagactctaatgctgctcgccctgatcgcagtgctcaccggtggggtgaccctcttcttcctttccggcagagggctgggtaagaccagtattggcctgctgtgtgtcatggctagtagcgtgctattatggatggcgtccgttgagccccactggatcgccgcctccatcatccttgagttcttcctgatggtgttgttaatccctgaaccggatcgccaacggactcctcaagacaaccagctggcatacgtggtgatcgggctgctctttatgatcctgacagtcgctgcgaacgagatggggctgctggagaccactaagaaagatcttgggatcggccacgtggccgttgagaatcaccatcatgctgccatgctcgacgttgatctacatccggcctcagcatggacgctgtacgcagttgccactaccatcatcaccccgatgatgcgccatacgatcgagaataccaccgccaacatcagcctcaccgccatcgcaaaccaggccgccatcctcatggggttagacaagggctggcccatcagcaagatggacatcggcgtccccctactggcccttggatgctattcacaagttaatcccttaactctaaccgcggccgtgctgatgctcgtggcccactacgccatcataggcccggggctgcaggcgaaggcgactagggaggcccaaaagagaaccgctgccgggattatgaaaaaccctacggtcgacgggatcgtagccatcgacttagacccagtcgtctatgatgccaaatttgagaagcagctgggtcagatcatgttattgatcctctgcacatcccagatcctcctgatgcggacgacttgggccctatgcgagtcaatcacccttgctaccggccccctaaccaccctctgggaggggtccccggggaagttctggaacacgaccatcgccgtgagcatggccaacatcttcagagggtcctacctggcgggcgccggattagccttcagcctcatgaaatccctcgggggggggcgccgggggaccggggcccaaggcgagaccctgggcgagaagtggaagaggcagcttaaccagctatccaagagcgaattcaacacgtacaagcggtctggaattatggaagttgaccgctcggaggctaaggaaggcttaaagagaggggagaccacaaagcatgccgtatcccgcggcactgccaagcttcgctggttcgtggagcgcaacttggttaagcctgaggggaaagtcattgatcttgggtgcggccgcggaggctggagctactactgcgccgggctaaagaaagtgacggaggtgaaaggctacaccaagggcggtcccggccacgaagagcccatcccgatggccacctatgggtggaaccttgttaagctgcatagtggcaaggacgtgttcttcattccgcccgagaagtgcgacactcttctctgcgacataggggagtcatccccaaatcccacgatcgaggagggcaggaccctgcgagtcctgaagatggtcgagccctggctccggggtaaccagttttgcattaaaatcctgaatccctacatgccttcggttgtcgagaccttagagcagatgcagcggaaacacggcggcatgttagtccggaacccgttgagtaggaacagcacccacgagatgtattgggtctcctgcgggaccggaaacatcgtgagtgcggtcaacatgacgtcgcgcatgcttttgaatcgcttcaccatggcccaccggaaacccacctacgaacgcgatgtggacctgggggccgggacccggcacgtggcggttgaaccagaggtggccaatcttgacataatcggccagcgcatagagaacatcaagcacgaacataagtcgacctggcactacgacgaagacaacccctacaaaacctgggcgtatcacgggtcctacgaagtgaagccgagcggctccgcgtcgagcatggtcaatggggtggttaagcttttgaccaagccctgggacgtgatccccatggtgacgcaaatcgcgatgacggacaccacacccttcggccaacagcgggtgttcaaggagaaggtggacacccgcacgccgaaggctaagagaggaaccgcccagattatggaggtgaccgccaagtggctgtggggcttcctcagtagaaacaagaagccacggatttgcacccgggaagagttcacgcgcaaggtcaggtcaaatgcggcaatcggtgccgtgttcgtggacgagaaccagtggaattcggcgaaggaggccgtcgaggacgaacggttctgggacctggtacaccgagagcgcgagctgcacaaacaggggaagtgtgcgacctgtgtgtacaacatgatgggcaagcgcgagaagaaactcggggagttcggaaaggccaaagggagccgggccatatggtacatgtggttaggcgcgcgcttcctggagttcgaggccctaggcttcatgaatgaggaccattggttctctcgggaaaacagcctgtccggggtagaaggcgaggggctgcataagctcggctacatcctccgagacatatccaaaatcccaggaggtaacatgtatgccgacgacaccgccggttgggacacccggattacggaggacgacctgcagaacgaagccagaattacagacattatggagccggagcacgcgctactggccaaatccattttcaagctgacataccaaaacaaggtggtacgtgtccagcggcccgcaaagaacgggacggtgatggacgtgatcagccgccgcgaccaaagaggaagcggccaggtaggaacgtacggattgaatactttcaccaacatggaggcccagctgatccgccagatggagtcggaggggatcttctcacccagcgagttggagaccccaaacctagccgaaagggtgctcgactggcttgagaagtacggcgtagagcggctcaagcgcatggcgatctcgggggacgactgcgtcgttaagccaatcgacgatagattcgctacggctttgacagctctgaacgatatgggtaaggtgcgaaaggacataccacagtgggaaccgtcaaaggggtggaacgactggcagcaggtccccttctgcagtcaccatttccaccagctcatcatgaaggacggtcgggagatcgtagtcccatgtcgcaaccaggatgagctggtggggcgtgctcgtgtgtcccagggcgcgggctggtcgctgcgcgagaccgcgtgcctcggcaagtcatacgcccaaatgtggcagctaatgtacttccaccgccgggacctccgactcgccgcgaacgccatctgctctgccgtgcccgtcgactggattccaacctccagaacaacctggagcatccacgctcaccaccagtggatgaccaccgaggacatgttgtccgtgtggaaccgcgtgtggatcgaagagaacccctggatggaggataagacccacatatcgtcctggggtgacgtaccgtacttagggaaacgcgaggatcagtggtgtgggtcactcatcggcctgaccgcgcgcgcaacctgggcaacaaatattcaggtggcaataaaccaggtgcgtcggttaatcggaaacgagaactacctcgactacatgacctccatgaagcgcttcaagaatgaatcggatcctgaaggcgccctgtggtaa

SEQ ID NO: 24550 - RNA, 9879 nt, synthetic construct
  misc_feature 1..9879: note = derived and/or modified CDS sequence (opt11) from DENV-1__EU482813__SS-prME
  source 1..9879: mol_type = other RNA
agcgtgaccatgttactaatgcttatgcccacggcgttagcgtttcacttaacgacccggggtggtgagccccacatgattgtgagcaagcaggaacggggcaagagccttctgttcaagaccagtgccggggtgaacatgtgcaccctcatcgccatggatctgggtgaattttgcgaggacacgatgacttacaagtgcccaaggatcaccgaggccgagcccgacgacgtggactgctggtgtaacgccacagacacatgggttacctatggcacgtgctctcaaaccggtgagcaccggcgtgacaagcggtccgtagccctggcaccccacgtgggcttggggctggagactcgaaccgagacctggatgagcagtgagggcgcctggaagcaaatacagcgggtggagacctgggccctgagacatcctgggtttacggtgatcgccctcttcctggcccacgccatcgggaccagcatcacgcagaaaggtatcatattcatcctgctcatgctggtgaccccctcaatggctatgcgatgcgtcggcatcggctcccgtgacttcgtggaggggttaagcggcgccacatgggtggacgtggtgctcgagcacggttcttgcgtcaccaccatggcgaaggacaagccaaccctggacatcgagctgctcaagacggaggtcacgaatcccgcggtgctgcgaaagctatgtatcgaagccaagatctccaataccaccaccgactctcgctgcccgactcagggcgaggccaccttagtggaggagcaggacgccaacttcgtctgtaggcgcacgttcgtggacagaggctggggcaacggctgcgggctgttcggcaaagggtccctcatcacgtgtgctaagttcaagtgtgtaaccaagctagagggcaagacagtccaatatgagaacctaaaatacagcgtgatcgtcactgttcatacaggcgaccagcatcaggtggggaacgaatccaccgagcacggcactaccgcgaccattacgccccaggccccgagcacggagatacaactgaccgactacggcgcactcacactggactgcagcccccggactggcctcgattttaacgagatggtcctcctgacgatgaaggaaaagtcttggctggtgcacaaacagtggttcctcgacctgccgctcccctggaccagcggtgcctctactagtcaggagacgtggaaccggaaggacctcttggttaccttcaagaccgcccacgctaagaaacaggaggtcgtcgttctaggcagccaggagggcgccatgcacactgccctgacgggggcaaccgagatccagaccagcggaaccacgaccatcttcgccgggcacctgaagtgccgcctgaagatggataagctcaccctaaagggcatgtcatacgtgatgtgcactgggtccttcaaattggagaaggaggtcgcggagacgcaacatggcacggtgctcgtccagatcaagtacgaaggaaccgacgccccgtgcaagatccccttctcaacccaggacgagaagggggtgacgcagaacggtagacttatcactgccaacccgatcgttaccgataaggagaagcccgtgaacatcgaggcggagccgcccttcggcgagagctacatcgtgatcggcgcgggcgaggaagctctgaagcttagctggttcaagaaggggagctcaatcggcaagatgtttgaagccaccgcccgtggggcccggcgcatggctattctaggggacactgcctgggatttcgggtccatcggcggcgtattcacctccgtcgggaaactggtgcatcagatcttcggcacggcgtacggggtgctgtttagcggcgtatcctggacaatgaagatcgggatcggcgtgctcctaacatggctgggcctcaatagccgctctaccagcctttccatgacctgtatcgccgtggggctggtcacgctctatctgggcgtgatggtgcaggccgactcagggtgcgttattaattggaagggtcgggagctgaagtgcggcagcggtatctttgtaactaacgaggtgcacacctggaccgagcagtacaagttccaggcggacagcccgaagcgcctctccgcggcaatcggcaaagcctgggaggagggggtctgcggcatacggtccgccacccgactggagaacattatgtggaagcagatcagcaacgaactgaaccacatcctcctggagaatgatatgaagttcacggtggtggtcggggatgtggctggcatcctggcccaggggaagaagatgatccgcccccagcccatggaatataagtactcctggaaatcgtggggcaaggccaagataatcggcgccgacgtgcaaaacactacattcatcatagacggacccaacacaccagagtgcccagacgaccagcgtgcgtggaacatttgggaagtcgaagactatggctttgggatcttcaccacgaacatctggctcaagcttagagactcctacacccaggtgtgcgaccatagactgatgagcgccgctataaaggactccaaggcagtgcacgccgacatgggctactggattgaaagcgaaaaaaatgagacctggaagctcgcgcgagcctccttcatcgaggtcaagacctgcatctggcccaagagccacacgctttggtctaatggcgtgctggagagcgagatgatcatccccaagatctacggaggaccgatctcccagcacaactaccgccccgggtatttcacacagaccgccgggccctggcacctggggaagctcgagctggacttcgacctctgcgaaggcaccacggtcgtcgtagacgagcactgtggtaaccgggggccgagcctgagaaccaccaccgtgacaggcaagattatacacgagtggtgttgccggagctgcactctgccgcccctgcgcttcaaaggggaagacggttgctggtacgggatggagatccggcccgtgaaggagaaggaggagaacctggtcaagtcaatggtgagcgccggctcgggcgaggtcgacagcttctccctagggctcctgtgtatcagcatcatgatcgaggaggtgatgcgctcgaggtggagcagaaaaatgcttatgaccggcaccctggccgtgttcttcctgctgatcatggggcagctcacgtggaatgacctcattcggctgtgtattatggtaggtgctaacgctagtgaccggatggggatgggcaccacctacctggccttaatggccaccttcaaaatgaggccgatgttcgccgtggggctcctgttccggcgcctgacgtcgagggaggtgttactactcaccatcggtctgtccctcgtcgcaagcgtggagttgcccaattctctggaggaactcggcgacggactggccatgggtatcatgatcctcaagctcttaaccgacttccagagccaccagctgtgggccactctgctatcccttacgttcattaagaccaccttcagtctccactacgcttggaagacgatggcgatggttctgtccatcgtctcgctgtttcccctctgcctgtccactaccagtcagaagaccacatggctgcccgtgctcctaggctccttgggctgcaagccgttgaccatgttcctgatcgcagagaataagatttggggccgaaagagctggcccctgaacgaaggaattatggcagtgggcatcgtgagcatccttttgagcagcctattaaagaacgacgtgccgttggccggacccctgatcgccggcggcatgctcatagcgtgctacgtcatatccgggtcgtccgccgacttgtcactggagaaggccgccgaggtgtcctgggaagaggaggcagagcactccggcgcttcccacaacatcctcgtcgaggtccaagacgacgggacgatgaaaatcaaggacgaggagcgggacgatacactgaccatcctgttaaaggccacccttctggccgtgagcggcgtgtacccgctctctatccccgccacgctgtttgtctggtacttctggcaaaaaaagaagcagcgctctggagtgttatgggacacaccctcaccgcccgaggtggagcgggcagttctggatgatggaatctaccggataatgcagcggggcctgctagggcgcagccaggttggcgtgggggtctttcaggaaaacgtattccacacgatgtggcacgttacccggggcgcggtcctgatgtaccaagggaagcgactcgagccctcctgggccagcgttaagaaggatctgatctcctacggcggaggatggcggttacagggctcatggaacacgggggaggaggtgcaggtcatagccgtggaacccggcaagaaccccaagaacgtgcagaccgcccccgggaccttcaagacctccgagggtgaggtcggtgccatcgcgctcgacttcaagcccgggacgtccggcagcccaatcgtgaaccgagagggtaagatagtgggcctgtatggtaatggggtcgttaccacctccggcacttacgtgagcgcaatcgcccaagccaaggcctcccaggagggacctctgccggagatcgaagacgaggtcttccggaagagaaacttgacgataatggacttacaccctggcagcgggaaaacgcggcgctacttgcctgcgatcgtgcgggaggccatcaagcgcaaactacggaccctgatcctggcaccaacccgagtggtcgcttccgagatggcggaggccttgaaaggaatgcccatccgctaccagacgaccgccgtgaagagcgagcacaccggcaaggaaatcgttgacctgatgtgccacgccaccttcacgatgcgtctgctctcccccgtccgagtgcccaactacaacatgatcatcatggacgaagcccacttcaccgacccaagctccatcgcggcccgggggtatatcagcaccagagtgggaatgggggaagcagccgcaatctttatgacggcaaccccgcccggctcggtcgaagcgttcccccagagcaacgccgtcatccaggatgaggaaagagacatcccggagcgctcctggaacagcgggtacgagtggataaccgacttccctggcaagaccgtgtggtttgtccccagtatcaagagcggcaacgacatcgccaactgcttgcggaagaacgggaagcgcgtgatacaactgtcgcggaagaccttcgacaccgagtatcagaagacaaaaaacaacgactgggactacgtggtcaccacagatatcagcgagatgggcgcgaacttccgcgccgaccgggtgatcgacccccgccggtgcctcaaaccggtgatcctgaaggatggccctgaacgcgtgattcttgccggccccatgcccgtcaccgtcgcctccgcagcgcaacgtcgcgggcgtatcggtcgcaaccataacaaggagggcgatcagtacatctacatgggtcagcctctcaacaatgacgaagaccacgcccactggacagaggccaagatgcttctggacaacatcaacacccccgaaggtatcatacccgctttgttcgagcccgagcgggagaaatccgcagcgatcgacggggaatacaggcttcgcggcgaagcccggaaaacgtttgtggagctgatgcgccgcggggacttgcctgtatggctgagctataaggtcgcctctgagggattccagtatagcgaccgccggtggtgtttcgacggggaacgcaataatcaggttctggaggagaacatggacgtggagatctggaccaaggaaggggagcggaagaagctccgcccccggtggctcgacgcccgcacatactccgatcccctagccctccgtgaattcaaggagttcgctgccggacgccggagcgtctccggggacctgatcctggagatcggcaagctgccccagcacctgacccagcgcgcacagaatgccttggacaatctcgtgatgctacacaactctgaacaaggtgggcgggcgtaccgccacgctatggaagaactgccagacacaatagaaaccctaatgctgctggccttgatcgccgtgctgaccggcggggtgacactgttctttctctccggccggggattaggcaagacgtcaatcggcctgctttgcgttatggcgtcctctgtgctgctctggatggcgtctgttgaaccccactggatagccgccagcatcattctcgagttcttcttgatggtgttgctcatccctgagcccgaccggcagcggaccccccaagacaaccagctggcctacgtggttattggtttacttttcatgatcctgacggttgcagcgaacgagatgggactgctcgaaaccacaaagaaggacctggggatcggccacgtggccgtcgagaaccaccaccatgccgcaatgctggacgtagacctccaccccgcctccgcgtggaccctgtacgccgtggccacgaccattatcacccctatgatgagacacacaatcgagaacacgaccgccaacatcagcctgaccgcaattgcgaaccaggccgccatcttaatggggctggacaaggggtggccaatctcgaagatggacatcggcgtccctctgctcgccctggggtgctacagccaggtgaatcccttaaccttgacggcggccgtgctgatgctggtagcccattacgccataattggaccggggctccaagccaaggcaacacgggaggcccagaagcgcaccgccgccggcatcatgaaaaacccgactgtggatgggatcgtcgccatcgacctggaccccgtcgtctacgacacgaagttcgagaagcagctgggccagataatgctcctaatcctgtgcacatcacaaatcctccttatgcgcaccacctgggcgctgtgcgagagcatcaccctcgccaccggacctctcaccaccctctgggaggggtcccccggaaagttctggaacacgaccatcgcagtgagcatggcgaatatcttcagagggtcttacctcgccggcgcgggcctagccttctccctgatgaaatcactcggcggcgggcgccgggggactggggcccagggggagactctgggcgaaaagtggaagcgccagctaaaccaattatccaagtctgagttcaacacgtataagcgttccgggatcatggaggtcgaccgcagcgaggccaaggagggcttaaagcgcggagaaaccaccaagcacgcggtgtccagaggcaccgccaagttacggtggttcgttgagcgaaatctcgtcaagcctgaggggaaagtgattgacctgggctgcggccgcggtgggtggtcgtactactgcgccggactgaaaaaggtcacggaggtaaagggctacaccaagggcgggcccggccacgaggagcccatccccatggcaacctacgggtggaacttagtgaagttacactccggcaaggacgtgttcttcatcccgcccgaaaagtgcgacaccctgctctgcgacattggggagagtagccccaaccccacgatcgaggagggtcgcaccctccgggtgctgaaaatggtggagccttggttgcgggggaaccaattctgcatcaagatcttaaatccctacatgcccagcgtggtcgagaccctggagcagatgcagcgcaagcacggtggcatgctagtgcgcaaccccctctcccggaactcgacacacgagatgtactgggtgtcctgcggcaccggcaacatcgtatccgctgtgaatatgacgtcccgcatgctcctgaacagattcactatggcgcaccgcaagcctacctacgagcgggacgtggacctcggggccggcacccggcacgtcgctgtggagcccgaggttgcaaaccttgatatcatcggccagcgcatcgagaatatcaagcacgagcacaagagcacgtggcattacgacgaggacaacccctacaagacatgggcctaccacggatcgtacgaggtcaagcctagcgggagcgcatcctctatggtaaatggggtcgtgaagctcctcaccaagccttgggacgtgatccctatggttacccagatcgcgatgacggacaccacccccttcggtcaacagcgcgtgttcaaagagaaggtggacacacgcactccgaaggccaaacgggggaccgcccagatcatggaagtcaccgccaagtggttgtggggcttcctctcccgtaataagaagccacggatttgcacccgcgaggagttcacgcggaaggtgaggagcaacgcggcaatcggcgccgttttcgtagacgagaaccagtggaactcagccaaggaggcggtggaagacgagcggttctgggacctcgtgcacagagagcgggaattgcacaaacaggggaagtgtgcgacgtgcgtctataacatgatgggcaagcgcgagaagaagctcggcgagttcggcaaggccaaagggtccagggccatctggtacatgtggctcggtgctcgcttcctcgagttcgaggcgctgggcttcatgaacgaggaccactggttctcccgcgagaacagcctcagtggggtggaaggcgaggggctgcacaagctgggctatatactccgcgacatctcgaagatcccggggggaaacatgtatgccgacgacaccgccggctgggacacccgcatcacggaggacgacctgcagaacgaggccaagattaccgacatcatggagcccgagcacgccctgctcgcgaagtccatcttcaaactgacctaccaaaataaggttgtcagagtgcaacggcccgccaagaacggaaccgtgatggacgtcatctcccgcagggatcagcggggatcaggccaggtgggcacgtacggcctgaacaccttcaccaacatggaggcgcagttgatccgccagatggagagcgaggggatcttctccccaagcgagctggaaactcccaatctggccggacgggtactcgactggctcgagaaacatggtgtcgagcgactgaagcggatggccatctcgggcgacgactgcgtggtgaaaccaatagacgaccgcttcgcgaccgctctcaccgccctgaacgatatggggaaggtccggaaggacatcccgcagtgggagccgagcaagggctggaacgactggcagcaggtccccttttgcagccaccacttccaccagctgataatgaaggatggccgcgagatcgtggtcccttgccggaaccaggatgagctcgtaggccgtgcccgggtgagccagggtgccgggtggagtttgcgggagaccgcatgcctgggcaagtcctacgcacagatgtggcagctcatgtactttcaccggcgcgacctgcggctggccgccaacgccatttgcagcgcggtaccggtggattgggtgcccaccagtcgcacgacctggagcatccacgcccaccaccagtggatgaccaccgaagacatgctctccgtctggaatcgggtgtggatagaggagaacccgtggatggaggacaagacgcatattagttcctggggcgacgtgccttacttaggtaaaagggaggaccaatggtgtggttcactgatcgggctaaccgcccgggccacctgggcgaccaatatccaggtcgcgatcaaccaggtgcgccgcctgatcggaaacgagaactacctggattacatgacatccatgaagcgtttcaagaacgaaagcgacccagaaggtgcgctgtggtaa

SEQ ID NO: 24551 - RNA, 9879 nt, synthetic construct
  misc_feature 1..9879: note = derived and/or modified CDS sequence (opt11) from DENV-1__EU482814__SS-prME
  source 1..9879: mol_type = other RNA
tccgtgacgatgttactcatgttgatgcccaccgccctagcattccacctcacgacccggggcggtgagccccacatgatcgtgagcaagcaagagcggggcaaaagcctgctgttcaagacaagcgcgggggtgaacatgtgcaccctcatcgctatggacctgggtgagttctgcgaggacacgatgacctacaagtgcccccgcatcaccgaggccgagcccgacgacgtggattgctggtgcaacgccaccgacacgtgggtcacctacgggacctgcagccagaccggcgagcaccggcgggacaagcggtccgtggccctggctccccacgtgggcttcgggctcgagacgcgcaccgagacctggatgagctccgagggcgcctggaagcagatccagcgggtagagacctgggccctgcgccaccccgggttcacggtgatcgccctgttcctcgcacacgccataggcaccagcatcactcagaaaggaatcattttcatcctgttaatgctcgtgaccccctctatggccatgcggtgcgtcggcattgggagccgcgactttgtggaggggctgtccggcgccacgtgggtggacgtcgtgctggagcacgggagctgcgtgaccaccatggccaaggacaagcccaccctcgacatcgagctgctgaagacggaggtcaccaaccccgcggtcctccgtaagctgtgcatcgaggccaagatctccaacaccaccacggacagccgctgccccacccaaggcgaggccaccctggtggaggagcaggacgctaacttcgtctgccggcgaaccttcgtggaccggggatgggggaacggctgcggactcttcggcaaggggtccctgatcacgtgcgccaagttcaagtgcgtgacaaagttggaaggcaagaccgttcagtacgagaacctcaaatacagcgtgatcgtgaccgttcacacgggcgaccaacaccaggtggggaatgagtccaccgagcacggcaccacagcgaccatcacgccccaagcccccagcacagagatccagctgacagactatggggcactgaccttagactgcagcccccggacaggcctggacttcaacgagatggtcctgctcaccatgaaagagaagtcctggttggtgcacaagcagtggttcctggacctccccctaccctggaccagcggggcctcgacctctcaggagacgtggaaccgtaaggacctgctcgtgactttcaagaccgcccatgcgaaaaagcaggaggtcgtggtgctaggttcccaagagggcgccatgcacaccgccctgacgggggccaccgagatacagaccagtggtaccacgaccatcttcgccgggcacctcaagtgccgcctgaagatggacaaactcaccctcaaaggcatgtcctacgtcatgtgcaccgggagcttcaagctggagaaggaggtggcggagacgcagcacggcaccgtgctggtccagatcaagtacgagggcaccgacgcgccctgcaaaatacccttctccacccaggacgagaagggcgtaacgcagaacggccggctaatcaccgccaacccaatcgtcaccgacaaggagaagcccgtcaacatcgaggccgagcctcccttcggtgagagctacatcgtgatcggggcgggcgagaaggcactcaagttgtcatggttcaagaagggtagctctatcggcaagatgttcgaggcaaccgcccgcggggcgcggcgcatggcgattctgggcgacacggcctgggatttcgggtcaatcggtggggtgttcacctccgtcgggaagctcgtgcaccagatcttcggcaccgcctacggggtgctgttcagcggcgtctcctggaccatgaagatcgggataggcgtcctgctaacctggctgggcctgaacagtcgctccacctcgttgtccatgacctgcatcgccgttgggctggtaaccctttacctaggcgtgatggttcaggccgacagcgggtgcgtcattaactggaagggccgggagctgaaatgcgggagcgggatcttcgttacaaacgaggtgcacacctggaccgagcagtacaagttccaggcggactcgccgaagcgcctgagcgcagctataggcaaggcctgggaggagggggtctgtggcatccggtccgcgacgcgcctcgagaacatcatgtggaagcagatcagcaacgaattaaatcacattctgctcgagaacgacatgaagttcaccgtggttgtgggggacgtggcgggcatccttgcccaggggaagaagatgatccggccccagcccatggagtacaagtactcctggaagtcctggggcaaggccaagatcatcggtgctgacgtgcagaacacgacattcatcatcgacgggcccaacaccccggagtgccccgacgaccagagggcgtggaacatctgggaggtcgaggattacggattcgggatcttcacgacgaacatctggctcaaacttagggactcctacacccaggtgtgcgaccaccgcctgatgtccgctgccatcaaggactccaaggccgtacatgccgacatgggctactggatcgagagcgagaagaacgagacgtggaagctggcgagggcttcctttatcgaggtcaagacctgtatctggcccaaaagccacacgctctggtccaacggcgtgctggagagcgagatgatcatccccaagatctacgggggccccatctcccagcacaactaccgccccgggtactttacccagaccgccggcccctggcacctagggaagctcgaactggacttcgacctgtgcgagggcaccacggtggtggtggacgagcactgcggcaaccgggggccgtcgttacgcaccaccaccgtaacgggcaaaatcattcacgagtggtgctgccgcagctgtactctgccgccgctgcgcttcaagggggaggacggctgttggtatgggatggaaatccggcccgttaaagagaaggaggagaacctcgtcaagagcatggtgagcgccggctccggcgaggtcgacagcttctccctggggttgctctgcatatctatcatgatcgaggaggtgatgcgctcccgctggagccggaaaatgctgatgaccggcaccctggccgtgtttttcctcctgatcatggggcagctgacgtggaacgatctcatccggctgtgcatcatggtaggcgcgaacgcctccgaccgcatggggatgggcaccacctacctggccctcatggcaaccttcaagatgcgcccgatgttcgccgtgggcttgctgttccggcgcctaacgtctcgggaggtgctcctgctcaccatcgggctgtccctggtcgcgagcgtggagctcccgaactccctggaggaactgggcgatgggctcgcaatgggcatcatgattcttaagctgctcaccgactttcagagccaccaactgtgggctaccttactctccctgacattcattaagaccaccttcagcttgcactacgcttggaagaccatggcgatggtcctctccatcgtgtcactgttccccctgtgcctctcgacgaccagccagaagaccacctggctgcccgtgttgctcggctccctgggatgtaagccgctcacgatgttcctcatcgcagagaacaagatctggggccgcaagtcatggcctctgaacgaggggatcatggccgtcggcatcgtcagcatcctgctctccagcctgctgaagaacgacgtgcccctcgcggggcctctgatcgccggcggcatgctgatcgcgtgctacgttatttccgggagctctgccgacctcagcctggagaaggccgccgaggtgtcttgggaggaggaggccgagcatagcggcgcgtcccacaacatcctggtggaagtccaggacgacgggaccatgaagatcaaggacgaggagcgggatgacaccctcaccatcttactgaaggccaccctcctggccgtgagcggtgtgtacccgttatccatacccgccaccctgttcgtctggtatttttggcagaagaagaagcagcgctcaggggtgctgtgggacacccccagccctcccgaggtggagagagcggtcctggacgacggaatctaccgcatcatgcagcgaggcctcttgggacgcagccaggtgggcgtgggggtcttccaggagaacgtgttccacaccatgtggcacgtgacccggggcgcggtactgatgtaccaggggaagcgcctggagccctcctgggcatcagtgaagaaggacttgatatcctacggcggagggtggcggctccagggaagctggaacacgggggaggaggtgcaggtcatcgccgtcgagcccggcaaaaatcccaaaaacgtgcagaccgcccccgggacctttaagacctcagaaggcgaggtcggcgccattgcgctggacttcaagccagggacgagcggcagccccatcgtaaaccgcgagggaaagatcgtaggcctctacggcaacggggtcgtgaccacctccggcacctatgtgtcagccatcgctcaggccaaggcgtcccaggaggggcccctgccggagatcgaggacgaggtcttccgaaagagaaacctgacgatcatggacctccaccccgggagcgggaaaacccggcgctacctgcccgccatcgtccgggaggctatcaagcggaagctgcggaccctcatcctggccccgacccgcgtcgtggcctccgagatggcggaggcccttaaaggcatgcccatccgctaccaaacgaccgccgtcaagagcgagcataccggcaaggagattgtggacctcatgtgtcacgccacgttcacgatgcggttgctgtcccccgtccgcgtgcccaactacaacatgatcataatggacgaagcccacttcaccgacccgagctctatagcggcccgagggtacatcagcaccagggtgggtatgggggaggccgccgccatcttcatgaccgcgacgccgcccggatccgttgaggccttcccccagagcaacgccgtgatccaagacgaggagcgggacatccccgagcgctcctggaacagcgggtacgagtggatcaccgacttccccggtaagacagtgtggttcgtccccagtatcaagagcggcaacgacatcgctaactgcctccggaagaacggaaaacgcgtgattcagctgagcaggaagaccttcgacacggagtatcagaagaccaagaacaacgactgggactacgtagtcacgaccgatattagcgagatgggcgcgaacttccgcgccgatcgggtgatcgacccccgccggtgcctgaagccggtgatactcaaggacgggcccgagcgcgtgatcctagccggccccatgcccgtgacggtcgccagtgctgctcagcggcgagggcggatcgggcgcaaccacaataaagaaggcgaccagtacatttacatggggcagccgttaaacaacgacgaggaccatgcccactggaccgaggccaaaatgctcctggacaatatcaacactcccgagggcatcatccccgcactattcgagcccgagcgggagaagtccgccgcgatcgacggggagtaccgcctcaggggcgaggcccggaagaccttcgtggagctgatgcgccgcggggacctgccggtatggctctcctacaaggtggcctccgagggctttcagtacagcgacaggcggtggtgcttcgacggggagcgcaacaaccaggtgctggaggagaacatggacgtggagatctggacgaaggaaggggagcggaagaagctgcgaccccggtggctcgacgcccgcacctattccgaccccctggcccttcgggagttcaaggagttcgccgccggccgccggagcgtgtcaggggatctcatcctggagatcggtaaacttccccagcacctcactcaaagagcgcagaacgccctggacaacctggtgatgcttcacaactcggagcagggcgggcgggcgtatcgccacgccatggaagaactgcccgacaccatcgagacgctgatgctgctggctttgatcgccgtgctcacaggcggggtcaccctgtttttcctgtccggccggggactcggcaagacctcgatcggcctgctgtgcgtgatggcgtccagcgttttactatggatggcgtccgtcgagccccactggattgccgccagcataatcctggagttcttcctcatggtgttacttatccccgaacccgaccgccagcggaccccgcaggataaccagctcgcctacgtggtcatcggcctgctgttcatgatcctcacggtggccgcgaacgaaatgggcctattagagaccaccaagaaggacctcgggatcggccacgtggcggtcgagaaccaccatcacgccgccatgctggacgtggacctgcacccagcatccgcgtggacactctacgccgtggccacgaccataatcaccccgatgatgcggcacaccatcgagaacacgactgccaacatcagcctgaccgccatcgcgaaccaggccgctatcctgatggggttggacaagggctggccgatttccaagatggacatcggcgtgccgctgctggccctcgggtgctatagccaggtgaacccactgaccctgacagcggccgtgctcatgctggtcgcccactacgccataatcggcccagggctgcaggccaaggcgacccgggaggcccagaagcgcaccgccgctggcatcatgaagaacccgaccgtggacgggatcgtggccatcgacctcgaccctgttgtgtatgacgcgaagttcgagaaacaactgggacagatcatgctgctcattctgtgcacgtcccagatcctgttaatgagaaccacttgggccctttgcgagagcatcaccctggccacgggcccccttaccaccctgtgggaggggtcgccaggcaagttctggaacaccacgatcgccgtgagcatggccaatatattccgggggagctacttagcgggcgccggcctcgccttctccctgatgaagtccctcgggggcgggcgccgggggaccggggcccagggcgagaccctcggcgagaagtggaagcgccagctgaatcagctatccaagagcgagtttaacacatacaagcggtccggaatcatggaggtcgaccgcagcgaggcaaaggagggcctcaagcgcggggagacgaccaagcatgccgtgtccagaggcaccgctaagctacggtggttcgtggagcgcaacctggtcaagccggaggggaaggtcatcgacttaggctgcggccggggcgggtggagctattattgcgccgggctgaagaaggtgaccgaggtcaaggggtacacgaagggcgggcccggccacgaggagcccatacccatggccacctacgggtggaacctggtgaagctgcactccggcaaggacgtgttcttcatcccacccgagaagtgtgacaccctcctgtgcgacatcggggaaagctcccccaaccccaccatcgaggagggtcgcacgctgagagtcctcaagatggtggagccttggctgcgcgggaaccagttctgcatcaagatcctaaacccctacatgcccagcgtggtcgagaccctcgagcagatgcagcggaagcacggcggcatgctggtgcgtaacccgctgtcccggaacagcacccatgagatgtactgggtgtcctgcggaaccggcaacatcgtgtctgcagtgaacatgacctcccgcatgcttctgaatcggttcacgatggcccaccgcaagccaacatacgagcgcgacgtggacctgggggccggcacccggcacgtcgccgtggaacccgaggtagccaacctcgacatcatcggccaacgcatcgaaaacatcaagcacgagcacaagtcaacctggcactacgacgaggacaacccctacaagacgtgggcgtaccacgggtcctacgaggtcaagcccagcggctccgcctccagcatggtgaacggggtcgtgaagctgttgaccaagccgtgggacgtgatccccatggtcacccagatcgctatgaccgatacgaccccctttggccaacagagggtgttcaaggagaaggtggacacccgcaccccgaaggccaagcgggggactgcccagatcatggaagtcaccgcgaagtggctctggggcttcttatcccgcaacaagaagccgcggatctgcactcgcgaggagttcacgcgcaaggtgcgcagcaacgccgccattggcgccgtcttcgtcgatgagaaccagtggaactccgcgaaggaggccgtggaggacgagcgattttgggaccttgtgcaccgggagcgggagctccataagcaggggaagtgcgccacgtgcgtctacaacatgatgggcaagcgcgagaagaagctgggggagttcggcaaggccaaggggagcagagccatctggtacatgtggctgggcgcgcgcttcctcgagttcgaggctctgggcttcatgaacgaagaccactggttcagtcgggagaactcactgtccggggtggagggcgaagggctccacaagctgggttacatcctgcgcgacatcagcaaaatccccgggggcaacatgtacgccgacgataccgccggctgggacacccggattacagaggacgacctccagaatgaggccaagataacggacatcatggagcccgagcacgcattactggccaagtccatctttaagctcacctaccagaacaaagtggtccgcgtgcagcggccggctaagaatgggaccgtgatggacgtcatcagccgccgcgaccagcggggctcgggccaagttggaacttacggcctgaacacgttcaccaatatggaggcccagctgatccgccagatggagtctgaggggatcttctccccctcggaactcgagacccctaacctggccggccgggtcctggactggctcgagaagcacggggtcgaacgcctgaagcggatggcgatctctggagacgactgcgtggtgaaacccatagacgaccgctttgccaccgccctgacggctctcaacgacatggggaaggtccggaaagacatcccgcagtgggaacccagcaagggctggaatgactggcagcaggtacccttctgtagtcaccacttccaccagctcatcatgaaggatggccgcgagatagtggtcccctgccggaaccaggacgagctggtaggccgagcacgggtgtctcagggcgcggggtggtctctccgcgagaccgcgtgcctgggcaaatcctacgcccagatgtggcagctgatgtacttccaccggcgcgacctccggctggccgcgaacgctatctgcagcgccgtcccggtggactgggtgcccacctcacgcacgacgtggagcatccacgcccaccaccaatggatgaccaccgaggacatgctgtccgtctggaaccgggtgtggatcgaggagaacccctggatggaggacaaaacccacatcagctcatggggcgacgtgccctacctcggcaaacgcgaagaccagtggtgtggcagcttaatcgggctcacggcccgggcgacctgggccactaacatccaggtcgccatcaaccaggtgcgcagactcatcggcaatgaaaactacctggactacatgacctccatgaagcggtttaagaacgagagcgacccggaaggggccctgtggtga

SEQ ID NO: 24552 - RNA, 9879 nt, synthetic construct
  misc_feature 1..9879: note = derived and/or modified CDS sequence (opt11) from DENV-1__EU482815__SS-prME
  source 1..9879: mol_type = other RNA
agtgtgaccatgctattgatgctaatgcccgccgccctggcgttccacttaaccacccggggcggggaaccgcacatgatcgtgagtaagcaggagcggggcaagagcctgctattcaaaaccagcgcaggcgtgaacatgtgcacgctcatcgccatggacctgggcgagttctgtgaggacaccatgacgtacaaatgtccccgtatcaccgaggccgagcccgacgacgtcgactgctggtgcaacgccaccgacacctgggtcacgtacggtacctgcagccagaccggcgagcaccggcgggacaagcggtccgtagcgttggccccgcacgtgggcctagggctcgagaccaggacggagacctggatgagcagcgaaggcgcctggaagcagatacagcgggttgaaacatgggcccttaggcaccctgggtttaccgttatcgccctgttcctggcccacgccatcggcacgagtatcacccagaagggcatcatcttcatcctgctcatgcttgtgaccccctcgatggccatgcggtgcgtcggcataggcagccgcgatttcgtggaggggctgtccggggcaacctgggtggatgttgttttggagcacggtagctgtgtaacgaccatggcgaaggacaagcccaccctggacatcgagttgctcaaaaccgaagtcactaaccctgctgtgctgagaaagttgtgtatcgaggccaagatctccaacactacaaccgactctcgctgcccgacgcagggcgaggcaaccctggtggaagagcaggatgcaaattttgtctgccggcgcaccttcgtggaccggggctgggggaacggctgcggactgttcggcaaagggtcactaatcacgtgtgcgaagttcaaatgtgtgacgaagcttgagggcaagaccgtccagtatgagaatctgaagtacagcgtaactgtgactgtccacacgggcgaccagcatcaggtgggcaacgagtccaccgagcacggaactaccgcgaccatcacccctcaggcccccagcaccgaaatccagttaaccgactacggggccttaaccctggactgtagcccacggacgggcctggacttcaacgagatggtcctgctcacaatgaaggaaaaatcctggctagttcacaagcagtggttcctagacctgccgctgccctggaccagcggggcctccaccagccaggaaacgtggaacagaaaggatctcttagtaaccttcaaaaccgcgcacgccaagaagcaggaggtcgttgttctgggctcccaggagggcgctatgcacacagccctcacgggggccactgagatccagaccagcggcaccacgacaatattcgcggggcacctgaagtgccgccttaagatggacaagctcaccttaaagggcatgagctacgtcatgtgtaccgggagtttcaagttagagaaggaggtcgccgagacgcagcacggaaccgtgctcgttcagatcaagtatgagggcaccgatgccccctgcaaaatccccttctcgacacaggatgagaagggggttactcagaacggccggctaatcaccgctaacccgatagtgaccgacaaggagaagcccgttaatatcgaggcggagccgcccttcggggagagctacattgtgataggagcaggcgaaaaagccctaaagctgtcatggttcaagaaggggagcagtattggcaagatgttcgaggccacggcccgcggcgcacggaggatggcaatattaggcgacacggcctgggatttcgggagcataggcggcgtattcacctccgtcgggaagctggtgcaccagatcttcggcaccgcctacggggtgctgtttagcggcgtctcctggaccatgaaaataggtatcggcgtgctcctgacgtggttaggcctcaattctagatccacctcgctttctatgacgtgcatcgccgtggggttggtcaccctctacctgggcgtgatggtccaggcggacagtgggtgcgtcatcaactggaagggccgggagctgaaatgcgggagcggcatcttcgtgacaaacgaggtgcacacatggaccgagcagtacaagtttcaggcagactccccgaagaggctctcagccgcaatcgggaaggcatgggaggagggggtctgcgggatccggtccgcgacgagactggagaacatcatgtggaagcagatcagcaacgagcttaaccacattctcctggagaacgacatgaaattcaccgtggtcgtcggggacgtcgccggcattttggcccaggggaagaagatgatacgcccacagcctatggaatacaagtactcctggaagtcctggggcaaggccaagattatcggggcggacgtgcagaacacgacattcatcatcgacggccccaacaccccggagtgcccggacgaccagagagcctggaacatatgggaggtcgaggactacggctttggaatattcaccacgaacatctggctcaagctgcgggactcctacacccaggtatgcgaccatcgcctgatgagtgccgccatcaaggattccaaagcggtgcatgctgacatgggttactggatcgagtcagaaaaaaacgagacatggaagctggcccgcgcctccttcatcgaggtcaaaacctgcatctggcccaaaagccacactctgtggtctaatggcgtgctcgagagtgaaatgatcatccccaagatctacgggggcccgatctcccaacacaactacaggcccggatacttcactcaaacggccggaccctggcacttggggaagctggaactggatttcgacttgtgcgaggggaccactgttgtcgtggacgagcactgtggcaatagaggcccgagcctgcgcaccaccacagtgacgggaaaaatcatccacgagtggtgttgtcggtcatgcaccctgccgcccctgagattcaagggggaggacggctgctggtacggaatggagatcagacccgtcaaagaaaaggaagagaacttggtcaagtccatggtgtcagccggttccggcgaggtggacagtttctctttgggtttactgtgcattagcatcatgatcgaggaggtgatgcgtagccgctggtcacgcaaaatgctgatgaccgggacactcgcggtgttcttcctgctgattatggggcagctaacgtggaacgacctgattaggctgtgtatcatggtaggcgccaacgcttccgacagaatggggatgggcacgacctacctcgccctgatggctacattcaagatgcggccgatgttcgcggtgggcctcctcttccgccgcctgacgagccgggaggtgctgctcctgaccatcgggctgtccctcgtcgctagtgtggagctgcccaactccctggaagaattaggcgacgggctggccatgggcattatgatcttgaagttgctgaccgacttccagagccaccagctgtgggccaccctcctgtccctgacctttatcaagactacgttcagcctccattacgcgtggaaaaccatggccatggtcttgtcaatcgtttctctcttccccctctgcctgtccacgaccagccaaaagaccacctggctcccggtgttgctgggctccctggggtgcaaaccactcacaatgttcttcatagccgagaataaaatctggggacgcaagagctggcccctcaatgaggggatcatggccgtcggcatcgtcagcatcctgttatccagcttgctcaaaaacgacgtacccctcgcagggcccttgatcgcgggcggcatgctaatcgcctgctacgtaatctccgggagctccgccgacctgtcgctggaaaaggccgccgaggtgtcctgggaagaggaggcggagcacagcggtgccagtcacaatatcctggtggaggtgcaggacgacggcaccatgaagataaaagacgaggagcgggacgacactttgacgatcctgctcaaggccacccttctggcagtgtcgggtgtgtatcctctgtccatcccggctaccctcttcgtgtggtacttctggcaaaagaagaagcagcgcagtggggtgctgtgggacactcccagcccccccgaagttgaacgggcggtcttagacgacggcatctatcgcatcatgcaacggggcctcctgggacgctcgcaggtaggcgtgggtgttttccaggagaacgtgttccacaccatgtggcacgtgacccggggcgccgtcctgatgtaccaggggaagcgcctggagccatcctgggctagcgtgaagaaggacctaatcagttacggcggcgggtggcggctccagggtagctggaacacgggggaggaggtgcaagtaattgcagtggagcccggcaagaacccgaagaacgtgcagaccgcccccgggacctttaagacctccgagggcgaagtcggcgcgatcgccctggacttcaagccagggacgagcggcagccccatcgtgaaccgcgagggaaagatcgtgggcctctacggaaatggggtcgtcaccacctccggcacttacgtgagcgccatcgcccaggctaaagcatcccaggagggtcccctgccggagatcgaagatgaggtcttccggaagcgtaaccttacgataatggacctccaccccggcagcgggaagacccgtcgctacctacctgccatcgtccgcgaggccatcaagcgcaagctgcggaccctaatcctagcccccacgcgcgtggtcgcgtcagagatggcggaggcccttaagggtatgccaatacgctaccagacgaccgccgtcaagagcgagcacaccggcaaggagatcgtggacctcatgtgccacgccaccttcacgatgcggttactgtccccggtccgcgttcccaactacaatatgatcattatggacgaggctcatttcacggaccccagctccatcgctgcccgtggatacatctccacccgtgtgggtatgggggaggccgcggccatcttcatgaccgctacgccacccggttccgtcgaggccttcccccagagcaacgccgtaatccaggacgaagagcgtgacatcccggagcgttcctggaacagcgggtacgagtggatcaccgacttccccggcaaaaccgtgtggttcgtcccctcaatcaagagcggcaacgacatcgcgaactgcctacgaaaaaatgggaaacgcgtgatccaactgtcacggaagacgttcgatacggagtatcagaagactaagaacaatgattgggattacgtcgtgaccactgatatcagcgagatgggggccaacttccgtgccgaccgtgtcatcgacccccgcagatgcctgaagcccgtgatcctcaaggatgggcccgagcgcgtcatcctggcaggccccatgcccgttacagtcgccagtgcggcccagcggcgcggaaggatcggccgaaaccacaacaaggagggcgaccagtacatctacatggggcagccgctgaataacgatgaggaccatgcccattggaccgaggccaagatgcttctcgacaacataaacactccggaaggcatcatccccgccctcttcgagccggagcgggagaagtccgcggccatagacggcgagtaccgtctccgaggcgaggctcggaagaccttcgtggagctgatgagacgcggtgacctaccagtatggttaagctacaaggtagcctccgagggcttccaatactccgaccgacgctggtgtttcgacggtgagcgcaacaaccaggtgctggaagaaaatatggacgtggagatctggacgaaggagggagagcggaagaagcttcgccccaggtggctcgacgcccgcacctactccgaccccctggcgctgcgggagttcaaggagtttgccgccggccgccggagcgtctcgggggaccttatccttgagattggcaagctgccccaacacctgacccagcgcgcccagaacgcgctggacaacctggtcatgctccacaacagcgagcagggtggtcgggcctatcgccacgccatggaggagctgccggacaccatcgagacgctaatgctactcgccctgatcgccgttttgaccgggggggtcacacttttcttcctgtccggcagggggctaggcaagactagcatcggcctgctgtgcgtgatggcatcctcagccctactgtggatggcctccgtggagccccactggatagctgccagcatcatcctggagttcttcctcatggtcctgctgatcccggagcccgaccgacaacgcaccccgcaggacaaccagcttgcgtacgtggtgatcggactcctgttcatgatcttaacggtcgctgccaatgagatggggctgctggagaccaccaaaaaggatctggggatcggccacgtggctgtggagaaccaccatcatgccgctatgttggacgtcgacctgcaccccgcctccgcctggacactctacgccgtggccacgaccatcatcacccctatgatgcgccacaccatcgagaacacaaccgccaacatcagcttaaccgccatcgccaaccaggccgcgatcttgatggggctcgataagggctggcctatctcaaagatggacataggcgtgcccttactggccctcggatgctacagccaggtcaacccgctgactctgacggccgcagtgctcatgttagtcgcgcactacgcgatcattggccccgggctgcaggcgaaggccacacgggaggcccaaaaaaggacggccgcgggcatcatgaagaatcctaccgtcgatgggatcgtcgccatcgacctcgacccggtggtctatgacgccaagtttgagaagcagctgggccagataatgctgctcatcctttgcacgagtcagatcttactgatgcgcacgacatgggccctgtgcgagagcatcaccctggctacaggtcccctcaccaccctgtgggagggatccccgggcaagttttggaacaccaccatcgccgtaagcatggccaacatcttcagagggagctacttggctggtgcgggcctcgcgtttagtctgatgaagtccctcggcggcgggaggcgaggtaccggtgcccagggtgagaccctcggcgagaaatggaagcgccaactgaaccagctgtccaagtctgaattcaacacctacaaacggtccgggatcatggaggttgaccgcagcgaggccaaggagggccttaagcgcggagaaacgacaaaacacgccgtctcccgcggtaccgcgaagctgcggtggttcgtggagcgcaatctggttaagccagagggaaaagtcatcgacttaggctgcggtcgcggtgggtggagctactactgcgcggggttgaagaaggtgaccgaggtaaaggggtacacgaagggcggccccggccacgaggagcccataccaatggccacctacgggtggaatctggtgaagctgcactccgggaaggacgtgttcttcatcccgcccgagaaatgcgacaccctcctgtgcgacatcggggagagctcccccaatccaactatcgaagaaggccgcacgctgcgggtgctaaagatggtcgagccctggctgcgcgggaatcagttctgtattaagatcctgaatccttacatgccctcggtggtggagacgttagagcagatgcagcgtaagcacggcggtatgctggtccgcaacccactgtccaggaacagcacccacgagatgtactgggtttcctgcgggacgggcaacatcgtgagcgccgtcaacatgacctcgcgaatgcttctcaaccggttcacaatggcccaccgtaagccgacatacgagcgcgacgtggacttgggggccggcacacggcacgtagccgtcgagcccgaggtcgctaacctcgatatcattggccagcgcatcgaaaacataaagcacgaacacaaaagcacctggcactatgacgaagacaacccctataagacctgggcctaccatgggtcctatgaggttaagcccagcggcagcgcatccagcatggttaacggggtggtcaagctgctgacgaagccgtgggacgtgatacctatggtgacccagatcgcaatgaccgacacgacaccctttggccagcagagagtcttcaaggagaaggtggacacccgtacccccaaggcgaagcgggggacggcgcagatcatggaagtgaccgccaagtggttatggggcttcctgtcgcgcaacaagaaaccacggatctgcaccagagaggagtttacgcggaaggtccgatctaacgccgcgatcggcgccgtctttgtcgacgagaaccagtggaactccgccaaggaggccgtcgaggacgagcggttctgggacctggtgcaccgcgagcgggagttacacaagcagggaaagtgcgccacatgcgtgtacaacatgatggggaagcgcgagaagaagctaggggagttcggcaaggccaaggggagccgagccatctggtacatgtggctgggcgcccgcttcctcgaatttgaggccctgggctttatgaacgaggaccactggttctcccgggagaactcattgtcaggcgtggagggcgaggggctccataagctgggctacatcttacgcgatatcagcaagatccccggtggcaacatgtacgccgacgacaccgcgggatgggacactcggatcaccgaagacgacctccaaaatgaggccaagatcacggacatcatggagcccgagcacgccctgctggcgaagtccatcttcaagctcacctatcagaacaaggtggtgcgtgttcagcggccggcgaagaacgggaccgtgatggacgtcatctcccgccgcgaccaacgaggttccggtcaggtcggtacctacggcctgaacacgttcaccaacatggaggctcaactgatccgccagatggagtccgaggggatcttctccccctcagagctcgagacccccaacctggccggccgggtgctggactggctcgagaaacacggggtggaacgcctgaaacggatggccatatcgggcgacgactgcgtcgtgaagcccatcgacgaccgctttgcaaccgccctgacggcgctcaacgacatgggcaaagtgcggaaggacattccgcagtgggagcccagcaaaggctggaacgactggcagcaggtcccattctgtagccaccactttcaccagctgattatgaaggatggtcgcgaaattgtggtcccctgccggaaccaagacgagttggtcgggagggcccgcgtgtcccagggcgccggttggtctctccgcgaaaccgcctgcttaggcaagtcctatgcgcagatgtggcagctgatgtacttccaccggcgggatttaaggctggctgccaacgccatctgcagcgccgtgcccgtcgactgggtgccaacgagccgcaccacgtggagcatccacgcgcaccaccagtggatgaccaccgaggacatgctgtcggtgtggaaccgggtctggatcgaagagaacccctggatggaagacaagactcacatttcctcctggggcgacgtgccctacctcggcaagcgcgaggaccagtggtgtggcagcctgatcgggctgacggcacgggctacgtgggccaccaacatccaggtggccatcaaccaggtccgccgcctcatcgggaatgagaactacctggattacatgacctccatgaagcgattcaagaacgaaagcgacccagaaggggcgctgtggtga

SEQ ID NO: 24553 - RNA, 9879 nt, synthetic construct
  misc_feature 1..9879: note = derived and/or modified CDS sequence (opt11) from DENV-1__EU482816__SS-prME
  source 1..9879: mol_type = other RNA
agcgtgaccatgctcctcatgctgatgccaaccgcgttggccttccatttgaccacccggggcggggaaccccacatgatcgtgtcgaagcaggaacggggcaagtcccttctgtttaagaccagcgccggcgtgaacatgtgtacactcatcgccatggatctaggagagttctgcgaagatacgatgacctataagtgcccccgcatcacggaagccgaaccggacgatgtagactgctggtgtaacgctaccgacacctgggtgacctacgggacctgcagccagacgggcgagcaccggagagacaaaaggtccgtggccctggcgccccacgtaggactcgggctagagacacgcaccgagacctggatgtcatccgagggtgcttggaagcagatacaacgggttgagacatgggccctgcgtcacccgggctttacagtgattgcacttttcctggcgcacgccatcgggacaagcatcacccagaaggggatcatattcattttgctcatgctggtgaccccctccatggccatgcggtgcgtcggcatcgggtcccgcgatttcgtggagggtctttccggagcaacatgggtggacgttgttctcgagcatggaagctgcgtcaccaccatggcgaaagacaaacccaccctggacatcgagctactcaaaacggaggtaaccaaccccgcggtgctgaggaagttgtgtatcgaggccaagatttccaacacgactacggacagccgctgtcctacccaaggcgaggcgaccctcgtggaagaacaggacgccaactttgtctgccgccgcaccttcgtggaccgtggctgggggaacggctgtgggctgtttgggaaggggtcactgattacgtgtgccaagttcaagtgtgtaaccaagctcgaagggaagacggtccagtacgagaacttgaagtactccgtgatcgtgacggtccatacgggggaccagcaccaggtgggaaacgagtccaccgagcatggcaccacggcaaccattacgccccaggcgccaagcaccgagatccaattaaccgactacggggcgctaaccctcgattgcagcccacggacgggcctcgacttcaacgagatggtcttgctgaccatgaaagagaagtcttggctagttcacaaacagtggttcttggatctgccccttccgtggacctctggggcctccacgagccaggagacctggaaccggaaggatcttctggtgaccttcaagaccgcccacgcgaagaagcaggaagtcgttgtgctgggctcccaagagggcgccatgcataccgccctcacaggggccacggagatccagaccagcggtaccacgacgatcttcgctggtcacctaaaatgtcgcctgaagatggataaactcaccctgaaaggtatgtcctacgtcatgtgcactgggagcttcaagctggaaaaagaggtcgcggagactcagcatggcaccgtgctcgtgcagatcaagtatgagggaaccgacgcaccctgcaaaatccccttctcaacccaggacgagaagggggttacgcagaacggccggctgatcacagccaacccgatcgtaaccgataaagagaagcccgtcaacatcgaggccgagccgccattcggcgaaagctacatcgtgatcggcgcgggcgagaaagccctgaagctctcctggttcaagaaggggagctcaatcggcaagatgttcgaggccaccgcccgcggtgctcggcgtatggcaatcctaggagacaccgcctgggacttcgggagcatcggcggggtgttcacctcggtcgggaagttagtgcaccaaatcttcggaaccgcctacggggtcctgttctcaggagtcagctggaccatgaagatcgggatcggtgtgctattgacgtggctgggccttaacagccgttcaacctctctgtcgatgacctgcattgcagtaggtctcgtcaccctttacctgggtgtgatggtgcaggcggatagcgggtgtgtcatcaattggaaggggcgggagcttaagtgtggtagcggaattttcgtgacgaacgaggtgcacacctggaccgagcagtacaaattccaggctgactcgcccaagcgcctcagcgccgctataggcaaggcctgggaagagggtgtctgcggcatccggtcagccactcgccttgagaacatcatgtggaagcaaatcagcaacgaattgaaccatatcctcctggaaaacgacatgaagttcaccgtagtagtcggggacgtcgcgggcattctggctcagggtaagaagatgataaggccgcagcccatggaatacaagtacagctggaaatcctggggcaaggccaagatcataggcgccgacgtgcagaacacgactttcatcatcgacgggcccaatacccctgagtgtcccgacgaccagcgcgcttggaacatctgggaggtagaggactatggcttcggcatcttcactacgaacatctggctaaaacttagagactcctacacccaggtgtgtgatcaccgcctcatgagcgccgccatcaaggattccaaggccgtccacgccgacatgggctactggattgagtctgagaagaatgaaacctggaagctcgcgcgggcctccttcatcgaggtcaaaacctgcatatggcccaaaagccatacactgtggtcgaatggtgtactggagtcagaaatgattatccccaaaatctacggtggcccgatctcccagcataactaccgccccggttattttacccagactgccggcccctggcacctcgggaagctagagctcgacttcgacctatgtgagggtacgacggtggtggtggatgagcactgcggcaaccgggggccgagcttgcgcaccaccaccgtgactggcaagattatccacgagtggtgctgccggtcctgtacactaccgccgctacgcttcaaaggggaagacggctgctggtatgggatggaaatacggccggttaaagaaaaggaggagaacctggtcaagtcaatggtaagcgctggtagcggcgaggtcgatagcttttccctcggtcttctctgtatctcaattatgatagaggaggtgatgcgcagtcggtggtcacgcaagatgctcatgaccggcactctagcagtgttcttcctgctgataatgggtcagctcacgtggaacgatttaatccggctgtgcatcatggtcggcgcaaacgcctctgacagaatgggcatgggtaccacctatctagctctcatggccacattcaagatgcgccctatgttcgcagtggggttactgtttcggcgcctgacgagcagagaagtgctgttactaaccatcgggctgtccctcgtcgccagcgtggagttaccaaactccctggaggagctcggtgacggactggctatgggtatcatgatcctgaagttactgactgattttcagagccatcagttatgggccacgctcctgtccctgaccttcataaagacaacattcagtctccattacgcctggaaaacaatggctatggtcctgtctatagtgagcctgttccccctctgtttatccaccacttctcagaagaccacgtggctcccggttctcctgggttctttggggtgtaagcccctcacgatgttcctgatcgctgagaacaagatctggggccgcaagtcctggccgctcaacgagggtataatggcagtcggcattgtctctattttgctatcgagccttttaaagaacgacgtaccactggccgggccgctgatagccggcgggatgttgatcgcgtgctacgtgatttccgggtcatccgcagacctaagcctggagaaggccgccgaggtctcctgggaggaagaggccgagcactctggcgcgtcccataacatcctcgtggaggtccaggacgacgggacgatgaaaatcaaggacgaggaaagggatgatacgctaaccatcctgctcaaggccaccctgttagctgtgagcggggtatacccattatccatcccagccacgcttttcgtctggtacttctggcagaaaaagaagcagcggagcggggtgctgtgggacactcccagcccgcccgaggtagagcgggctgtcttagacgacggcatctacaggatcatgcaacggggactgctcgggcgatctcaggttggcgtgggggtcttccaggagaacgtatttcataccatgtggcacgtaactcgtggcgcggtcctgatgtaccaaggcaagcgcctcgaaccctcctgggctagcgtcaaaaaggaccttatctcgtacggcgggggctggcgcctccagggcagctggaataccggcgaagaggtccaagtcattgccgtggagcccggcaagaaccccaagaatgtgcaaaccgcccccgggacgttcaagacctccgagggcgaggtcggcgccatcgcgctcgatttcaagcccgggacaagcgggagcccgatcgtgaaccgtgaggggaagatagtcggcttatacggcaacggagttgtgacaacgagcgggacatacgtatccgcaatcgcacaggcgaaggcgtcccaggaagggcccctcccagagatcgaagatgaagtcttccggaagcgtaacctcacgatcatggatctgcaccccgggagcgggaagacccggcgttacctgccagccatagtccgggaggccatcaaaagaaagctccgcaccttgattcttgccccgacgcgtgtggtcgcttccgagatggcggaggcattgaagggcatgccgattcgctaccagacaacggccgtcaagagcgagcacactggcaaggaaatcgttgacctaatgtgtcatgcgaccttcacgatgcggctgctctccccagtccgggtgcccaactacaacatgatcatcatggacgaagcccacttcactgacccgagctccatcgcggctcgggggtacatttctacccgcgtcgggatgggagaggcagccgccattttcatgaccgcgacaccgcctgggagcgtagaggctttcccccagagcaacgccgtgatccaggatgaggagcgggatataccggagcgctcctggaactctggctatgagtggattacagacttccccggcaagacagtttggttcgtgccttccatcaagagcggcaacgacattgcgaactgcttgcgtaagaacggtaagagggtgatccagctgtcgcgcaagacttttgatacggaataccaaaagaccaagaataacgactgggactacgtggtcaccacggatatcagcgaaatgggcgcgaacttccgcgccgaccgtgtgatcgatccccggcgttgtcttaagccagtgatactgaaggacgggcccgaacgcgtcatcctggccgggccgatgcccgtaacggtcgcctccgcagcacagcggcgcggtcggatcggtcgtaaccacaacaaggagggtgaccagtacatctacatggggcaacctcttaacaacgatgaggatcacgcccattggacggaagccaagatgctgttggacaacatcaatacccccgaaggcattatccccgccttattcgagcctgagagggagaaatccgccgcgatcgacggagaatacaggctgcgaggcgaagcgcggaagacattcgtggaacttatgcgccgcggagacctcccggtatggttaagctacaaagtcgcctccgaagggtttcagtatagcgaccgtcgatggtgcttcgacggagagcgcaacaaccaggtcctagaagaaaacatggacgtagagatctggacgaaagagggcgaacggaagaagctccgaccccgttggctcgacgcccgcacttactcggaccccctggccctcagggagttcaaggagttcgcagccggccgccgaagtgtctctggtgacttgatcctagaaattgggaagctcccccagcatttgacccagcgtgcccagaacgccctggacaacctcgtgatgctgcataacagcgagcagggcggaagggcgtaccgccatgccatggaggagctgccggacaccatcgaaacactcatgctgctcgcactcatcgcggttctcacgggaggtgtgaccctgttcttcctctcgggccggggtctaggaaagacctcgattgggctgctctgcgtgatggcctcctcagtgctcttgtggatggcgtccgtcgagccccattggatcgctgccagcatcatcctcgagttcttcttaatggtgctgttgattcctgagccagaccgccagcggacgccgcaggacaaccagctggcctacgtcgtaatcggtctgcttttcatgatactgacggtggcagcgaatgaaatgggactgctcgaaacgaccaagaaggacctcggtatcggccatgtggccgtcgaaaaccatcaccatgcggcgatgctggatgttgacctccaccccgcctccgcctggaccctgtacgcggtggccaccacaatcataacgcccatgatgcgccacaccatcgagaacacaaccgcaaacatcagcctcaccgccatagcgaatcaggcagcaatcctcatggggcttgacaagggctggcccattagcaagatggacatcggtgttcccctcctcgcactggggtgctatagccaggtgaaccctctgaccctgacggcggccgtgctgatgctggtcgctcactacgctatcatcggccccgggttacaggcgaaggcgacacgagaggcccagaagcgcaccgccgctggaattatgaagaacccaaccgtcgacgggatcgtggccatagatctagaccccgtagtctacgacgcgaaattcgaaaagcaactgggccagatcatgttgctgatcctatgcacatcacagatcctcctaatgagaaccacatgggccctgtgcgagagcattaccctcgccacgggccctctgaccaccttatgggaagggtcccctggcaagttctggaataccacaatcgcagtgtcgatggcgaacatcttccgagggagctatctagcgggcgccggcctggccttctccctgatgaagtccttaggaggcgggcgccgcggcacgggggcccaaggcgagacgctgggcgagaagtggaagagacaactaaatcagctctccaagtcggaatttaacacatacaaaagatccgggatcatggaagtcgaccggtcggaggcaaaggagggactgaagcgcggagagacgaccaagcacgccgtgagccgtgggaccgcgaagctgcgctggttcgtggagcgaaatctcgtcaagccggaggggaaggtaattgacctgggttgcggtcgcggcgggtggagctactactgtgccgggctgaagaaggtgaccgaggtcaagggatacacgaagggcgggccgggacacgaggagcccatacccatggcaacctacggatggaacctagttaagctccactccggtaaggacgtgtttttcacaccccctgaaaagtgcgacaccctcctgtgcgacatcggggaaagctccccaaaccccacgattgaggagggccgcacgctcagggtgctgaagatggtggagccctggctgcgagggaaccagttctgcatcaagatcctgaatccctacatgcccagcgtggtcgagaccttggaacagatgcagcgaaagcacggtgggatgcttgtgagaaacccgctatcccgaaacagcacccacgagatgtactgggtttcctgcgggaccggcaacatcgtgagcgcggtaaacatgacgagccgcatgctgctgaacaggttcacgatggcgcaccgcaagccgacttatgagcgagacgtagacctcggagcaggcacccggcacgtcgccgtggaaccagaggtagcaaacctggacatcattggccaacgaatcgagaatatcaaacacgagcacaagagcacttggcactatgacgaagataacccgtataagacttgggcgtatcacgggtcctatgaggtcaaacctagcggatcagcctccagtatggtgaacggcgtagtgaagctgttaaccaagccgtgggacgttatccccatggttacccagatcgccatgacggacaccaccccattcggacagcagagagtgttcaaggaaaaggtggacacccgcacgcccaaggctaagcgcgggaccgcccaaatcatggaagtcaccgcgaaatggctgtggggcttcctgtccaggaacaagaagccgcggatctgcacccgggaagagttcacgcgaaaagtgcggagtaacgccgccatcggcgccgtgttcgtcgacgaaaatcagtggaactccgcgaaggaggccgtggaagacgagcgtttctgggacctagtccacagagagcgggagctgcacaagcagggaaagtgcgcgacctgcgtctacaatatgatgggaaagagggagaagaagttaggagagtttgggaaggccaaggggtctcgggctatctggtacatgtggctcggcgctcgctttcttgagttcgaggccctgggcttcatgaacgaggatcactggttctcccgggaaaacagcctctccggggtggagggcgagggtttgcacaaactgggctacatcctccgtgacatttcaaaaatcccagggggcaacatgtatgccgacgacaccgccggatgggacacccggataacggaggacgacctgcagaacgaggccaagatcaccgacattatggagcccgaacatgctttgctcgccaagtccatattcaagctcacctaccagaacaaggtggtccgcgtacagcgtccggccaagaacgggaccgtgatggacgtcatcagtcgccgcgaccagcggggttccggtcaagtcggcacctacggcctgaataccttcaccaacatggaagcacagttaatccgccagatggagagcgaggggattttctccccctcagagttggagaccccaaacctggccggcagggtgttggactggctggaaaagcatggggtcgagcgcctgaagcgtatggcgatctccggagacgactgcgtggtgaagcccatcgacgatcgcttcgctacagcgctcacggcactgaacgacatgggaaaggtcagaaaggacatcccgcagtgggaaccttcaaaaggctggaacgactggcagcaggttcctttttgcagccaccacttccatcagctgattatgaaggacggccgcgagatcgtggtcccctgcagaaatcaggacgagctcgtggggcgcgctcgcgtaagccagggcgcggggtggtcattacgtgagaccgcgtgccttgggaagtcttacgcacagatgtggcagttgatgtacttccaccggcgcgacctgcgactggcagcgaacgccatctgtagcgcagtccctgtggactgggtgccaactagcaggacgacctggagcatccacgcccaccaccagtggatgaccactgaggatatgctatcggtctggaacagagtgtggatcgaggagaatccttggatggaggacaagacgcacatcagctcctggggcgacgtgccttatctcggcaagcgcgaagaccagtggtgcggcagcctgatagggctcaccgcccgggctacctgggccaccaatatccaggtcgctatcaaccaagtgcgccgtctgatcggcaacgagaactacctggactatatgaccagtatgaagcggtttaagaacgagagtgacccggagggcgccttatggtga

SEQ ID NO: 24554 - RNA, 9879 nt, synthetic construct
  misc_feature 1..9879: note = derived and/or modified CDS sequence (opt11) from DENV-1__EU482821__SS-prME
  source 1..9879: mol_type = other RNA
agcgttaccatgctgttgatgctgatgcccaccgccctggcattccacctcaccacacggggtggggagccccatatgatcgtgagcaaacaagagcgtggcaagagcctgctgttcaagacctcggctggcgtgaacatgtgcaccctcattgcgatggacctcggcgagctgtgcgaggacaccatgacatacaagtgcccccgcatcacagagacggagccggatgacgttgactgttggtgcaacgccacggacacttgggtcacctacgggacctgcagccaaaccggggagcaccgacgcgataagaggtccgtggccctagccccccacgtgggactagggctggagaccagaaccgagacgtggatgtcatccgagggcgcgtggaagcaaatacaacgggtggaaacatgggccctccgccaccccgggttcaccgtaatcgcactgttcctggcccacgcaataggcacctccatcactcagaaggggataatatttatcctcctgatgctggtcacgccctccatggctatgcggtgcgtgggcataggcaaccgcgatttcgtcgaggggctctccggcgccacctgggttgacgtagtgctggaacacggttcttgcgtgaccaccatggccaaggataaaccaacgctagacatcgagcttctgaagaccgaggtaactaaccctgccgtcctacggaagctctgcatcgaggcgaaaattagtaacaccactaccgactcacgctgcccaacccagggtgaagccactctggttgaggagcaggatgcaaattttgtctgccggcgcactttcgtagaccggggttgggggaacgggtgcgggctgttcggaaaagggagcctcattacgtgtgccaagtttaagtgcgtaacgaagctggagggcaagattgtccaatacgagaacctgaagtactcagtgatagtgactgtccacaccggagaccagcaccaggtgggtaatgagagcaccgagcacggcaccacggccacaatcacaccccaggcccctacgaccgagatccaactcaccgactacggtgccctaacgctggattgtagcccccggaccggcctcgactttaacgagatggtcctgttgaccatgaaagagaagtcgtggctcgtccacaagcaatggttcctggacctgccccttccctggacgtccggcgcctccacgagccaggagacctggaaccggcaggacctgctggtgacttttaagaccgcacacgctaagaagcaggaggtcgtggttttaggctcccaggaaggtgcgatgcatacggccctgacgggggccacggaaatccagacgagcggcacgaccaccatttttgcggggcatcttaagtgtaggctcaaaatggacaagctaaccctgaaaggcatgagctatgtgatgtgcacgggctccttcaaacttgaaaaagaggtcgctgagacgcagcatgggaccgtgctggtgcagatcaaatacgaaggcactgatgcgccctgcaagatcccgttttccacgcaagacgagaaaggggtgacccagaacggacggttaataactgccaatccgattgttaccgacaaggaaaagccggtaaacatcgaggccgaaccgccgtttggggaatcttacatcgtgatcggcgcaggcgaaaaggccctgaagctttcctggttcaagaaaggttcttccatcggcaaaatgttcgaagccacagccagaggggctcggcgcatggcaatccttggtgataccgcgtgggattttgggagcatcgggggcgtattcacctccgtcgggaagcttgtgcaccaaatcttcgggaccgcatacggggtcctcttcagcggtgtatcatggacaatgaaaatcgggatcggcgtcctgttaacatggctgggccttaactcccgatcaacatccctgtccatgacctgtattgccgtggggctcgtaacactgtaccttggagtcatggttcaggcggacagcggttgcgttatcaactggaagggccgggagcttaaatgcgggagtggcattttcgtgaccaatgaagtgcacacctggaccgaacagtacaaattccaggccgacagcccaaagcggctgagcgcggctataggcaaggcctgggaagagggggtatgcggaatcagatcagctacccgcctggagaatattatgtggaagcagatcagtaacgagctcaaccacatcctattagaaaacgatatgaagttcaccgtggtggtaggtgacgtggccggcatcctcgcccaggggaaaaaaatgatccggccccaacccatggagtacaaatactcatggaagtcctggggcaaagccaagatcatcggcgccgacgtgcagaacaccacattcatcatcgatggccccaataccccggagtgccctgacgaccagcgcgcctggaacatttgggaggtcgaggattacggctttgggatcttcacgaccaacatatggctgaaactgcgggactcctatacccaggtatgcgaccaccgcctcatgagcgccgccatcaaggactccaaggccgtgcatgcagacatgggctactggatcgaaagcgagaagaacgagacgtggaagctggcccgggcgtcgttcattgaggtcaagacatgcatctggcccaagagccataccctgtggtccaatggcgtgttggagtcggaaatgattatccccaagatctacgggggcccgatctcacaacacaactacagacccgggtactttacacaaaccgccggcccctggcacttggggaagttagagctcgacttcgacctgtgcgagggcacaacggtggttgtggacgagcactgcggtaaccgggggccgagcctgcgtaccacgacggtgactggcaagataatccacgaatggtgctgccggtcgtgtaccctgccacccctccgcttccgcggggaggacggctgctggtacgggatggagatcaggcccgtcaaggagaaggaagagaacttagtcaagagcatggtgtccgcaggcagcggcgaggtcgactcgttctcattggggctgctgtgcatctcaatcatgatcgaagaagtgatgcgttctcgctggagccggaagatgctcatgacagggacgctggcggtgttttttttactcattatggggcaactaacctggaacgacctgatccggctgtgcattatggtcggcgccaacgcttctgaccgcatggggatggggaccacctacttagccctgatggcaaccttcaaaatgcggcccatgttcgccgtcggactgttgttccgacggctgacgagccgcgaggtgctactgctgaccatcgggttgtccttagtcgccagcgttgagctgcccaactcccttgaggagctgggcgacggcctggcgatgggcatcatgatcctcaagctgctgactgatttccagtctcaccagttgtgggccacactgttgtcactcacttttatcaaaacaaccttctctctgcattacgcctggaagacgatggccatggtcctgtccatcgtgtccttattccctctgtgcctgtcgaccacaagccaaaagaccacttggctccccgtgctgttaggttccctcggctgcaagcccctaaccatgtttctgattgcggagaacaagatctggggtcggcgcagttggcccctcaatgagggcatcatggccgtcggcatcgtgagtatactgctgagctccctcctgaagaatgacgttcccctcgctgggcccctcatcgccgggggaatgctgatcgcatgttacgtcatcagcggaagctctgcggacctgtctctcgaaaaggccgcagaggtgtcatgggaggaggaggccgagcactcaggcgcgtcccacaacatcctggtagaggtccaggacgatggcaccatgaagatcaaggacgaggagcgggatgacaccctgaccatactcttaaaagcaacgctcctagccgtgtcgggcgtgtatccgttgagcatccctgccactctgttcgtctggtacttctggcaaaagaaaaagcagcggagcggtgtgctctgggatacgccctccccgccggaggtgggccgggccgtgctggatgacgggatctaccgcataatgcagcgggggttactgggcaggagccaggtgggggtaggtgtcttccaggaaaatgtgttccacaccatgtggcacgttacgcgcggggctgtcctaatgtaccagggaaagcgcctggagccttcctgggcttctgtaaagaaggacctaatctcctatggaggggggtggcggttacaggggagctggaataccggtgaggaggtacaggtaatcgccgtggagcccgggaaaaaccctaagaacgtgcagacagctcccggtacctttaaaactccggaaggtgaggttggggcaatcgccctggacttcaagccaggcacatccgggtcacccattgtcaatcgagaaggaaagatcgtgggcctgtacgggaacggcgtcgtgaccacgtctgggacgtatgtatccgctatagcacaggccaaagcttctcaagagggcccgttgcctgagattgaggacgaggtgttcaggaagcgtaacctgaccataatggacctgcaccccgggtccggaaagacccggcgttacctcccagcaatcgtgcgggaggccatcaaaagaaaactacgcaccctgattttagcccccacgcgagtggttgccagcgagatggccgaagccttgaagggtatgccaatccgataccagaccacggccgttaagagtgaacacaccgggaaggagatcgtggatctaatgtgccacgccacgttcactatgcgtctactgtcgcccgtgcgcgtgcctaactataatatgatcataatggacgaggcacatttcacagacccctccagcatcgcagcgcggggatacatctcaacccgcgtcggtatgggcgaggccgccgccattttcatgacggcaacgcctcccgggagcgtcgaggcgttcccgcagtccaacgccgtaatccaggacgaggaaagagacatacccgagaggagctggaactccggttacgaatggataacagactttcccggcaaaactgtgtggtttgtaccgtcaatcaagtccgggaacgacatcgccaactgcttacgaaagaatggtaagcgagtcatccaactctcccggaagacgtttgacaccgagtaccagaagacgaaaaacaacgattgggattacgttgtgaccacggacatttctgagatgggggccaatttcagagcggaccgagtaatagacccccgtcgatgcctaaagcccgtgatcctgaaggatgggcccgaacgggtcattctcgccggtccgatgccggtgaccgtcgcgtctgcagctcagcgtagaggaagaatcgggcgcaaccacaacaaagagggggaccagtacatttacatgggccagcccctgaataacgacgaagaccatgcgcactggaccgaggcaaagatgctactcgacaacattaacacacctgaggggatcatccctgccttgttcgagccggagcgagagaagagcgcggcaatcgacggggaataccggctacgtggggaagcacggaaaactttcgtggagctcatgaggcgtggggatctgcccgtttggctcagctataaggtcgcttcagagggcttccagtatagcgaccgccggtggtgcttcgatggggaaaggaacaatcaggtgctcgaagagaacatggacgtcgagatctggaccaaggaaggcgagagaaagaaactgcgcccgagatggttggacgccaggacctacagcgacccactcgccctcagggaattcaaggagttcgccgcggggcgccggtccgtcagtggcgacctgatcctcgaaatcggtaagttaccgcagcacctgacccagcgcgcacagaacgccttagacaatctggtgatgctgcacaactccgagcagggaggccgcgcctaccgccacgccatggaggagcttcccgatacgatcgaaactctgatgctgctggccctgatcgccgtcctgaccgggggcgtcaccctatttttcctgtcaggacggggtctgggcaagacgtccatcgggttactttgcgtgatggctagctccgtgctgctttggatggcctctgttgagccccattggatcgcggcttccatcatactggagttcttcctcatggttctactgatacccgagccagaccgccagcggacgccccaagacaaccagttggcgtacgtggtgatcggcctactgttcatgatcctaaccgttgccgccaatgagatggggctcttagaaaccaccaagaaggatctgggcataggccatgttgcggtcgagaaccaccaccacgccgccatgctcgatgtcgacctacaccccgcctcggcgtggacgctatacgctgtggccaccaccatcattaccccgatgatgcgccacacgatcgaaaacacaaccgccaacatctctctgaccgccattgcaaaccaagcggcgatcctgatgggcctggacaagggatggcccataagcaagatggatatcggtgtcccgctcctggcactgggctgctactcccaggtgaacccgctcacgctgaccgccgcagtgctgatgctggtcgcccactacgccatcatcgggccgggacttcaagcaaaggccacccgcgaggcgcagaagcggactgccgccgggatcatgaagaacccgacggtggacgggatcgtggcgatagacttagacccagtcgtgtacgacgccaagttcgaaaagcagctaggccaaataatgttgcttatcctctgcacatctcagatcctgctgatgcgcaccacctgggcgttatgtgagtccatcacgttagccacggggcccctgaccacactctgggagggaagcccggggaagttctggaacacgacaatcgcagtgtccatggccaacatcttccggggaagctatcttgcgggcgcggggctggcgttctccctgatgaagtccctgggcgggggcaggcgggggaccggcgctcagggcgagaccctgggggagaagtggaagcgccaactcaaccagctgagcaaaagcgagtttaatacttataagaggagcggcatcatggaggtagacaggtccgaggccaaagaggggctgaaacgaggcgagactaccaagcacgcggtcagccgggggacggcaaagctccggtggtttgtggagcgtaatctggtcaaacccgagggcaaggtgatcgacctcggatgcgggaggggcgggtggtcctactattgcgccggcctgaagaaggttactgaggtcaaagggtacacgaagggcggcccagggcacgaggagcccataccgatggccacctacggctggaatctcgtaaaactgcacagcgggaaggatgtgttcttcatcccgcccgagaagtgcgacactttgctctgcgacataggggagtcgtctcccaacccgacaattgaggaggggcgcacactgagggtgctcaaaatggttgagccctggctccgcgggaaccagttctgcatcaaaattctgaacccttatatgccgtccgtggttgaaacccttgagcagatgcagcggaagcacggcgggatgctggtgcgcaacccactcagccggaacagcacccacgagatgtactgggttagctgcggcacggggaacatcgtgtccgctgttaacatgactagccgtatgctactcaatcgcttcaccatggcgcaccgcaaacccacatacgagagggacgtggaccttggcgccgggacccggcatgtggccgtggaacccgaggtggccaacctggacatcattggacagcgaattgagaacatcaagcacgagcacaagtccacgtggcattacgatgaggataacccctacaagacctgggcctaccatggcagctacgaggtcaaaccaagcgggagcgcctccagcatggtgaacggcgtcgtgaaactcttaacgaagccctgggacgtcattccgatggtcacgcaaatcgccatgacggacaccactccattcgggcagcagcgtgtgttcaaggagaaggtggacaccaggaccccgaaggctaagcggggcacggcccagatcatggaagtaacagccaaatggctgtggggcttcctctcacgcaacaagaagccccggatttgcacacgcgaagagtttacacggaaggttcgctcaaacgcggcgatcggggccgtgttcgtagatgagaaccagtggaacagtgccaaggaggccgtggaagacgagcggttctgggacctcgtgcaccgcgagagagagttacacaagcaaggaaagtgcgcgacgtgcgtgtacaatatgatggggaagagggagaagaaactcggggaatttgggaaagctaaaggcagcagggccatatggtacatgtggctcggagccaggttcctggagttcgaggcgctaggcttcatgaacgaggaccactggttctctcgggagaattccctaagcggggtggagggggaggggctccacaagctcgggtacatcctgagagatatatccaacatccccggcggaaacatgtacgcggacgacaccgctgggtgggacacccgcattacggaggacgatctgcaaaatgaggccagaatcaccgacatcatggaaccagagcacgcactcctggctaagagcatcttcaagcttacctaccagaataaggtggtccgtgtgcagaggcccgccaaaaatggcacggtgatggacgtcatctctcgccgggaccagagaggatcgggccaggtgggaacgtacgggctcaacacttttacgaacatggaggcacagctgatcagacaaatggagtccgaggggatattctcaccctccgagcttgagaccccaaacctcgccgagcgcgtgttagattggctggaaaagtacggggttgagagattaaaacgcatggccattagcggcgatgactgtgttgtgaagccaattgatgaccgtttcgcgacggccttgacggcgcttaacgatatgggtaaggtccgcaaagacatcccccagtgggaaccctcaaagggctggaacgactggcagcaggtgcctttttgcagccaccacttccaccagttgatcatgaaagatggccgtgagatcgtagtgccgtgtcgcaaccaggacgagctcgtagggcgggctcgcgtgagtcaaggcgccgggtggagtctgcgggaaaccgcttgcctcggcaagagctacgcccagatgtggcagctgatgtatttccatcggcgggacctgcgtctggcagccaacgcgatctgctccgccgtccccgtggactggatccccacctctcggacgacctggtccatccatgctcaccatcaatggatgactaccgaggatatgctgtccgtctggaacagggtctggatcgaggagaacccctggatggaagacaaaacgcacatatcgtcctggggcgacgtcccgtacctaggcaaacgcgaggaccagtggtgcggctccttgatcgggctaactgcgcgcgccacctgggcaaccaacatccaggtggcaatcaaccaggtcaggcgtctgatcggcaacgagaactacctggactatatgacgtcgatgaagcgatttaagaatgagtctgaccccgagggggcgctgtggtaa

SEQ ID NO: 24555 - RNA, 9879 nt, synthetic construct
  misc_feature 1..9879: note = derived and/or modified CDS sequence (opt11) from DENV-1__EU482822__SS-prME
  source 1..9879: mol_type = other RNA
tccgttacaatgttattaatgctaatgcccaccgcactggccttccacctcacaacccggggcggggagccccacatgatagtgacgaagcaggagcgtggcaagtcactgctgttcaagacgtcggccggggtgaacatgtgcaccctcattgctatggatctgggcgaactttgtgaggataccatgacctacaaatgtccccggattactgaggccgagccggacgacgtggactgctggtgcaatgccacggatacatgggtgacctacgggacatgctctcagacaggcgagcaccggcgcgacaagcggagcgtggcccttgcgccccacgtgggcctggggcttgaaacccgcaccgagacgtggatgtctagcgagggcgcctggaagcaaatccagcgggttgagacgtgggctctcaggcaccccgggttcacggtgatcgccctgttcctggcgcatgctatcggcacctccataactcagaaggggatcatcttcatcctcctgatgcttgttacacccagcatggccatgcggtgcgtcgggatcggctcccgcgactttgtggaggggctcagcggcgctacctgggtcgatgttgtgcttgaacacggctcctgcgtgacgacaatggcgaaggataagccgacactggacatagaactcctgaagaccgaggtgaccaaccccgcgattctacgtaagctgtgcatcgaggccaaaatctccaacaccacgacagattcccgctgccccacacaaggcgaggccacccttatggaggagcaggacgccaacttcgtgtgccggcgcacgttcgtggaccgcggctgggggaacggttgtgggctattcggcaaagggtcgctcatcacgtgcgctaagttcaaatgcgttaccaaactagagggcaagatagtacagtacgaaaacctgaagtactccgtgatcgtcacagtacacacgggggaccaacaccaggtgggaaacgaaagcacggagcacggtaccaccgctactatcacgccccaggcaccgacttccgaaattcagctcaccgactatggggccctgaccctggactgctctccccgaacgggcctcgacttcaacgaaatggtcctgctgaccatgaaagagaagtcgtggctggtgcacaagcagtggtttctggatctgccgctgccctggacgagcggggctagcaccagtcaggaaacctggaacagacaggacctgcttgtcaccttcaagaccgcccatgccaagaaacaggaggtcgtggtgctcggctcacaagagggcgccatgcacacagccctgactggggctactgagatccagacctccggcaccactacgatattcgctgggcatctaaagtgccgccttaagatggacaagttgaccctgaagggcatgtcatatgtgatgtgtaccgggtccttcaagctcgagaaggaggtggcggagacgcagcatggcacggtcctggttcaaatcaagtacgaaggcaccgacgcaccctgcaagatcccattctcaactcaagatgaaaagggggtaacgcaaaacggccgcctgattaccgcgaacccgatcgtcaccgacaaggagaaacccgtgaacatcgaggcagagccgccattcggggagtcctacatcgtgatcggcgcgggcgagaaggccttgaaactcagctggttcaagaaggggtccagcatcggcaagatgttcgaggccactgcgcggggcgctcggcggatggcgatcctgggcgacacggcctgggacttcggctccattggcggggtcttcaccagcatcgggaagttagtgcaccagatcttcggtaccgcctacggggtcctgttctccggcgtcagctggaccatgaagatcggaattggcgtgttgctgacgtggctcgggctgaacagtcgcagcacgagtttgagcatgacttgcatcgctgtcgggctcgtcaccctgtacctgggcgtgatggtgcaagctgactccgggtgcgtcatcaactggaagggccgtgagctgaaatgcgggagcggcatctttgtcacgaacgaagtgcacacctggactgagcagtacaagttccaagcggactcaccgaagcgcttgtccgccgccataggcaaggcatgggaggaaggtgtctgtggcatccggagcgctacccggctcgagaacataatgtggaagcaaatcagtaacgaattgaaccacatcctgctagaaaatgacatgaagttcactgtggttgtaggggacgtggtgggcatcttagcgcaggggaaaaagatgattcggccacagcccatggagcacaaatatagctggaagtcctggggcaaggccaagattatcggagcagacgtccagaacacgaccttcataatcgacgggcccaacaccccagaatgccccgatgaccagcgcgcctggaacatatgggaggttgaagactacggcttcgggatattcaccacaaacatttggctgaagatgcgggactcgtacacgcaagtgtgcgaccacaggttaatgtcagcggccatcaaggatagcaaagccgtgcacgccgatatgggctactggatcgagtccgaaaagaacgagacgtggaagctagcccgggcgtctttcatagaggtgaagacgtgtatttggcccaagtcacatactctgtggagcaacggcgtgctggagagcgagatgatcatccccaagatttacgggggccctatctcgcagcacaactatcgcccagggtacttcacccaaaccgccggcccatggcatctcgggaaactggagctggacttcgacctatgcgagggaaccacggtcgtggttgacgagcactgtggcaaccgggggccttccctgcgtaccaccaccgtcacgggtaaaattatccacgagtggtgctgccggtcttgtaccctgccgcccctccgcttcaaaggcgaggacggctgctggtacgggatggagatccggccagtgaaggagaaggaagagaatctggtcaagtcgatggtctcggccggcagcggcgaggtcgactccttcagcctggggctcttgtgcatctccatcatgatagaggaggtgatgcgcagccggtggagtcgcaagatgttgatgactggaacgctagccgtgtttctgctcctcataatgggtcagctaacgtggaacgacctgatccgtctctgcattatggtgggcgccaacgcaagcgaccgcatggggatgggcaccacctaccttgccctgatggccacattcaagatgcgcccgatgttcgccgtgggactcctgttccggcgtctgacgtcccgggaggtcctcttactgaccattggcctaagcctggtggcctccgtggaactgcccaacagcctagaggagctaggagatgggctagcgatggggatcatgatcctgaagctgctgacggactttcaatcgcaccagctctgggctaccctgctgagcctgactttcatcaagactactttgtccttgcattacgcctggaagaccatggccatggtactcagcatcgtctctcttatccccctttgcctcagcacgacctcccagaagacgacgtggctgcccgtcctactcggcagcctggggtgtaagccgttaacgatgttcctcatcgcggagaacaaaatatggggccgtaagtcctggcccctgaacgaggggataatggccgtgggcgtcgtctctatcctcttaagctcactactgaagaacgacgtgcccctcgccggacccctgatagccggaggcatgcttattgcctgctacgtgatctcggggagttcggccgacctcagcctggagaaggctgctgaggtcagctgggaggaggaggccgagcattcgggcgctagccactccatcctggtagaggtccaggacgacggcaccatgaaaatcaaggatgaggagcgggacgacaccttgaccatactcctgaaagctaccttgctggccgtaagcggcgtgtatccgttatccatacccgccaccctcttcgtgtggtacttctggcagaaaaagaaacagcgctcaggggtcctgtgggacacccccagcccacccgaggtggagagagcagtgctggacgacggcatataccgcatcatgcagcggggcctgctcggccggtctcaagtcggcgtgggggtgtttcaggagaacgtgtttcataccatgtggcacgttacacgcggtgccgtgcttatgtatcagggcaagcgactggagcccagctgggcgagcgtgaagaaggacctcatatcatacgggggcggttggcggctccagggcagctggaacacaggggaggaggtccaggtgattgccgtcgagcccggaaagaaccccaaaaacgtgcaaacggctcccgggaccttcaagaccccggaaggcgaggtgggcgccatcgccctggatttcaagcccgggacgtccggcagtcccatagtcaaccgcgaggggaaaatcgtgggcctctacggcaacggggtggttacgacctcggggacctatgtatccgccatcgcgcaagccaaggccagtcaggaggggcccctcccagagatagaggacgaggtgttccggaagcgcaacctgaccatcatggacctccacccgggctcagggaaaactcgtaggtacctgccggcaatcgtccgcgaggccatcaagagaaagctgcggaccctgatattagccccgactcgcgtggtggctagcgagatggccgaagcgctaaaggggatgcctatacgctaccagacgaccgccgtcaagtccgagcacaccggcaaggagatcgtggacctaatgtgtcacgccacctttacgatgagactgctcagccccgtgcgcgtccctaactacaacatgatcattatggacgaggcccattttaccgacccttccagcatagctgcgcgtgggtacatcagtacccgcgttggtatgggggaggccgccgccatcttcatgaccgcaacaccgccggggagcgtcgaggcgttcccgcagtccaatgccgtcatccaagacgaggaacgggatatccccgaacgaagctggaactccggttacgagtggataaccgatttccctggcaagaccgtatggttcgtgcctagtattaagtccggcaacgatattgccaactgcctccggaagaacggtaagcgcgtcatacagctgagccggaagaccttcgacactgagtaccaaaagaccaaaaacaacgactgggactatgttgtgaccaccgacatctccgagatgggcgcaaacttccgcgcggaccgggtcatagacccgcgtcggtgcctaaagcccgtgatcttaaaagacgggcccgaacgggtgatattagccggcccgatgccggtcaccgtggccagcgcggcccagagaagaggccggataggccgtaaccacaacaaggaaggagaccaatacatctacatggggcagcccctgaacaacgacgaagaccacgctcactggaccgaggccaagatgctcctggacaacatcaatacccccgaaggaatcatccccgccctgtttgagccggagcgggagaagtcagccgcaatcgatggggaatacaggctaaggggagaggcgcggaagacgtttgtcgagctgatgcgcagaggggacctgcccgtgtggctcagttacaaggtggcctcggagggcttccagtactctgaccgccggtggtgcttcgatggggagcggaataaccaggtcctggaagagaatatggacgtggagatctggacgaaggagggggagcggaagaagctgcgcccccggtggttagacgcacgcacctacagcgacccgctcgccctgcgggagttcaaggaatttgccgcgggccgtcgatccgtgagcggggacctcatactagagatcggcaagttaccacagcacctcacccagcgcgcccagaatgccctcgacaacttagtcatgctccacaattccgagcagggagggcgggcctatcgccacgcaatggaggaactcccggataccatcgagacgctgatgctcctggccctgatcgccgtgctcaccggcggggtgaccctcttctttctgagcggccgggggctcgggaagacatcaatcggcttattatgcgtcatggcaagctcagtgcttctgtggatggccagcgtggagccacactggatcgcggcatccatcatcctggagttctttctcatggtcctgctgatccccgaaccggacagacagcgaacacctcaggataatcagttggcctacgtcgtgatcggcctgctgtttatgatattaactgtcgctgcaaacgagatgggcctgttagagacaaccaaaaaggacctcgggataggccacgttgcagtcgagaatcaccaccacgcaaccatgttggatgtcgacctgcaccccgccagcgcctggacgctctacgctgtggcgaccacaatcattaccccaatgatgcgccacacgattgaaaataccacagccaacatctccctgactgccatcgctaaccaggcagcgatcctgatgggcctcgacaagggctggcccataagcaagatggacattggcgtgccgttgttggccctcgggtgctacagtcaggtaaacccgctgacgctgaccgccgccgtgctcatgttggtggcgcactacgccatcatcggccccgggctgcaggccaaagcgaccagggaagcccagaagcgcaccgctgccggcatcatgaagaaccccactgtcgacgggatcgtggctatcgacttagacccggtagtatacgatgccaagttcgagaagcaactgggccagatcatgctgctcatcctgtgcacaagccagatcctgctaatgcgcacgacatgggcgctgtgtgagtccatcacgctggcgacaggccccctcaccaccctctgggaagggagccctggtaagttctggaacacgaccatcgccgtgtcaatggccaatattttccgggggagctacctggccggcgccggcctcgcgttctctcttatgaagtcccttgggggagggcgccgtgggaccggggcccagggcgagaccctgggcgagaagtggaagcgacagctgaatcagctgagtaagtcggagttcaatatctacaagcggagcgggatcatggaggtggaccgctctgaggccaaggagggcctcaagcgcggggagacgacgagacacgccgtcagccggggcaccgcgaaactgcgctggtttgtggagcgcaatctggtgaagccggaggggaaggtgatcgacctggggtgcggccgcggagggtggtcctactactgcgccggtctcaagaaggtgactgaggtcaagggatacacgaagggtgggccaggccacgaggagccgatcccgatggccacgtacgggtggaacctggtcaagctgcatagcggaaaggacgtgttcttcacgcctccagaaaagtgcgacaccctactgtgcgatatcggggagtccagccccaaccccacgatcgaggaggggaggactctgcgcgtgctcaagatggtcgagccctggctgcgagggaaccagttctgcatcaagatcctgaacccctatatgccctccgttgtggagaccctcgagcaaatgcagcgcaaacacggcggcatgctggtccggaaccccctgagccgcaactccactcacgagatgtattgggtgagctgcgggaccggtaacatcgtatccgcggtcaatatgacatcgcgtatgctcctgaaccgctttaccatggcccaccgcaaacccacttacgaaaaggacgtggatctgggggcgggcaccagacacgtcgcggtcgagcccgaggttgcgaacctcgacatcatcgggcaacgcatagagaacatcaaacacgagcacaaatccacttggcactacgacgaggacaatccatacaaaacctgggcctatcatgggagctacgaagtgaagccatccggcagcgcctcctccatggtcaatggggttgtcaagctgctgaccaagccctgggatgtgattcccatggtgacccagatcgcaatgacggatacgacccccttcggccagcaacgtgtctttaaagaaaaggtggatacacgcacgcccaaagccaagcgggggaccgtgcagatcatggaggtcaccgccaggtggctctggggcttcttgagccggaataagaagccccgcatctgcacccgcgaggagttcacccgcaaagtgcggagcaatgcggccatcggcgcggtgttcgttgacgagaaccaatggaacagcgcaaaggaggcagttgaggacgagcgcttctgggacttggtgaagaaggaacgggagctccacaagcaggggaagtgtgcaacctgcgtctacaacatgatgggcaagcgtgagaagaagctgggggagtttggcaaggctaaggggtcgcgtgctatctggtacatgtggttaggggcccgctttcttgagtttgaggccctcggcttcatgaacgaggaccactggttcagccgggaaaactccctgagcggcgtcgaaggcgaggggctccacaagctgggctacatcctgcgtgacatcagtaagatcccagggggcaacatgtacgccgacgacacagcgggctgggacacccggatcacggaggacgacctccagaacgaggccaagattactgatatcatggagccggaacacgccctcctggctacctcaatcttcaaactcacctaccaaaacaaagtggtgcgcgtgcagcggcccgccaaaaacgggacggtgatggacgtcatatcccgccgcgaccagcggggttcaggtcaggttggaacctacggcctgaacacgttcacaaacatggaggcgcagctgattcgtcagatggagtccgaggggatcttcctgccatctgagctggaaactcccaacctcgccgagcgggtgctcgactggctggagaagtacggcgtagaacgcctgaagcgtatggcaatctccggggacgactgcgtggtgaagccgatcgacgacaggttcgccaccgccctcacggcacttaacgacatgggcaaggtccgaaaggacatcccgcagtgggagccgagcaaggggtggaacgactggcagcaggttcccttctgtagtcaccatttccatcagctgattatgaaagatggccgcgagatcgtggtcccgtgccggaaccaggacgaactcgtgggccgggcacgggttagccagggggccggctggagcttacgggagaccgcatgcctggggaagtcctatgcccagatgtggcagctcatgtacttccaccggcgggacctaagattagctgcgaacgccatctgcagcgcagttcccgtcgactgggtgccaacgtcccgtaccacctggagcatacacgctcaccaccagtggatgaccacggaggacatgctgtccgtctggaaccgggtgtggatcgaagaaaacccctggatggaggacaagacgcacgtgtcttcctggggcgacgtcccgtacctgggtaagcgcgaggaccaatggtgcggcagcctgatcggcctcaccgccagggctacctgggcctccaacatccaggtggcgatcaaccaggtgagacgattaatcgggaacgagaactacctggactacatgaccagcatgaagcggttcaagaacgagggcgaccccgagggggcgttatggtga

SEQ ID NO: 24556 - RNA, 9879 nt, synthetic construct
  misc_feature 1..9879: note = derived and/or modified CDS sequence (opt11) from DENV-1__EU482476__SS-prME
  source 1..9879: mol_type = other RNA
agcgttacaatgctactcatgctgatgcccaccgccttggccttccacctaaccacacggggcggggaaccccacatgatcgtgaccaagcaggagcgggggaagagcctgctgttcaaaacctcggcgggcgtgaacatgtgtaccctcatagcgatggacctgggagaactgtgcgaggacaccatgacgtataagtgcccacgcatcactgaggccgagccggacgacgtggactgctggtgtaacgcaacggatacatgggtgacttacgggacctgcagccagacaggcgagcaccggcgcgacaagaggagcgtagcgttagcgccccacgtgggcttagggttagaaaccagaacagagacgtggatgagcagcgagggcgcctggaaacagatccagcgggtagaaacgtgggcattacgtcaccctgggttcaccgtgatcgccctgtttttagcccacgcgatcggcacctccatcacccagaaggggatcatttttatccttctcatgctggtgactccttccatggctatgcgatgcgttggtatcggtagccgcgacttcgtggagggactcagcggcgccacctgggtcgacgtggttctggagcacggatcctgcgtgacgaccatggccaaggacaagcccacgctggatatcgagttgctgaagacggaagtaaccaaccccgcagtactccggaagctctgcatcgaggcgaagatcagcaacaccactaccgactcacgctgcccaacccagggcgaggccaccctgatggaggagcaggatgcaaactttgtgtgtcggcgcacgttcgtcgacagaggctgggggaacggctgtgggttattcggcaaaggcagcctcatcacgtgtgccaagttcaagtgtgtaacaaagctggaggggaagattgttcagtacgaaaacctgaaatattctgtcatcgtaaccgtgcacacgggagaccagcaccaggtcggtaacgagagcacagagcacggcacgactgcgactatcacgccccaggccccgaccagtgagatccagctaaccgactatggggcactaacacttgactgcagcccccgaacaggcctagatttcaacgagatggtgctgctgacgatgaaggaaaaatcctggctcgtacacaagcagtggtttctggatctgccactcccctggacaagcggtgcgagcacctcccaggagacgtggaaccggcaagacctcctggtgaccttcaagaccgcccacgcgaaaaaacaagaagtagtcgtgttaggaagccaggagggcgccatgcataccgctctgaccggggctaccgagatccaaacctccggcactacgacaatctttgccgggcaccttaagtgtcgcctcaaaatggataaactgacccttaagggcatgagctacgtgatgtgcaccgggtcctttaaacttgagaaggaggtcgccgagactcaacacggcaccgttctggttcagatcaagtacgaagggaccgacgccccctgcaaaatccccttctctacgcaggatgagaagggcgtaactcagaacggacgtttgatcactgccaatcccatcgtgaccgacaaggagaaacctgtcaacatcgaggcggaaccgcccttcggggagtcttacatcgtcattggcgccggtgagaaggcccttaagctcagttggttcaagaaggggtcgagcatcggcaagatgttcgaggccaccgcccggggcgcccggaggatggcgatcctgggcgatacggcctgggatttcggctccatcggcggcgtgttcaccagcgtgggtaagctggtccaccagatctttggcaccgcgtatggggttctgttctcgggagtgagctggacaatgaagatcgggattggcgtcctgctaacttggctaggactgaattcacgcagcacctcactgagcatgacctgcatagcagtggggttggtcacgctatatctgggcgtaatggtgcaggcagattccgggtgcgtgatcaactggaagggccgggagctcaaatgcgggagcggcatcttcgttacaaacgaggtgcacacctggaccgagcagtacaaattccaggcggacagcccgaagcgcctttccgccgctatcggaaaagcctgggaggagggggtgtgcggcatccggagtgcaacccgcctggaaaacatcatgtggaagcagatcagtaacgaactcaatcacatcctgctggaaaacggaatgaagttcaccgtcgtggtgggcgacgtcgtggggatcctcgctcagggcaagaaaatgatccggccccagccaatggagcacaaatactcttggaagtcatggggtaaagccaaaatcatcggagccgacgtgcagaacacgaccttcataatcgacggtccgaacacccccgagtgccctgacgaccaacgcgcttggaacatctgggaggtcgaggattacggatttggcatctttaccacaaatatctggctgaagctgcgagattcatacacgcaggtgtgtgaccatcggctcatgtctgcggccatcaaggattctaaggccgtgcacgctgacatgggttactggattgagtccgagaagaatgaaacctggaagttagctcgcgcgagcttcattgaggtcaagacctgtatctggcccaaatcacacacgctatggagcaacggggtgctcgagtcggagatgatcatccccaaaatctacggcgggcctatcagccagcacaactaccgccccggatacttcacccagacggccgggccctggcacttgggaaagctcgagctcgatttcgatctgtgtgagggtaccacggtcgtagtggacgagcactgcggcaatcggggtccgtcgttgaggacaactaccgtgacgggcaagattatccacgaatggtgctgcaggtcttgcaccctgccgcccctccgcttcaagggcgaggacgggtgctggtacggcatggagatccggccggtgaaggagaaggaggaaaacctggtgaagagcatggtgagtgccggctcaggtgaggtcgattcgttcagcctcggcctgttatgcacctccatcatgatcgaggaggtcatgcgcagccgctggtcccgcaagatgctaatgaccgggacgctggccgttttcctgctcctgatcatggggcaactgacctggaacgacttaattcggctctgtatcatggtcggggccaatgcaagtgatagaatggggatgggcaccacctatttggccctcatggccactttcaagatgcgcccgatgttcgctgtggggctgctgttccgtcgattgacgagtcgtgaggttctgctgctcacgatcggattgagcctggtcgcctccgtggagctacctaatagcctggaggaactgggagacggcctcgcgatgggaatcatgatcttaaagctactcaccgacttccagtctcaccagctgtgggccacgctgcttagtctcacctttatcaagacaacattatccctccactatgcctggaagacgatggccatggtcctgagcattgtgtccctgtttcccttgtgcctcagcaccacctcccaaaagactacgtggctgccagtgttgcttgggtcccttggatgcaagccgctaacaatgttcctgatcgctgagaataagatctggggccgcaagtcctggcccctaaacgagggcattatggcagtaggggtggtgagcatactcctcagctccctgctcaagaatgacgtccccctggccgggcccctaatcgccggcgggatgttgatcgcctgctacgtgatcagcggcagcagcgcggacctttccctggaaaaggccgccgaggtaagctgggaggaggaggcggaacactccggggcgagccacaacatcctcgtagaagtgcaggatgacggcaccatgaaaattaaggacgaggaacgggacgataccctgacaatcctgctcaaagctacgctgttagccgtctcgggagtctacccactctcgatccccgccacccttttcgtgtggtacttctggcagaagaagaagcagcgttccggcgtgctgtgggacacgccgagcccccccgaagtcgagcgggccgtattggacgacggcatttaccgcatcatgcaacgggggctcctgggccggtcccaggtcggggtcggcgtgtttcaagagaacgtcttccacaccatgtggcacgtgacgcgcggcgcggtgttaatgtaccagggcaagaggctcgagcccagctgggcgtcggtaaagaaggatcttattagctatggcgggggctggcggctacaggggtcctggaacaccggcgaggaggtccaagtgatcgcagtggagcccgggaagaaccccaaaaacgtccagacagcacctggcaccttcaagacacccgaaggcgaagtgggggccatcgcactggatttcaagcccggcacgtcggggtccccaattgtgaaccgtgagggcaagattgtcggcctttacgggaatggcgtcgtgaccaccagcgggacgtatgttagcgcgatcgcccaagccaaggcgtcccaggagggccccctgcctgagatcgaggatgaggtgttccggaagcgcaatctcaccataatggaccttcatcccgggagcggcaagactaggcgctacctcccggcaatcgtccgggaagccataaagcgcaaactccgcaccctgatcttagccccgactcgcgtcgtggcctccgagatggccgaggcgttaaagggcatgcccatccgctaccagacgacagctgtaaagagcgagcacaccggtaaggagattgtagacttaatgtgccacgcaactttcacgatgcggctgttatcccccgtgcgtgttccgaactataacatgatcattatggacgaggcccactttaccgacccgtcgtccatagccgcgcggggctacatcagcactcgagtcgggatgggagaagctgcagccatcttcatgactgctactcccccagggtccgtagaggcgtttccgcagtctaacgccgtgatccaggatgaggagcgcgacatcccggagcgctcctggaactctggttacgaatggatcaccgacttccccggcaagaccgtctggtttgttccttccataaagagcgggaacgacattgccaactgcttacggaaaaatggaaaacgtgtcattcaactctccaggaagacgttcgacacagaataccaaaagaccaagaataatgactgggattatgtagttaccactgacatttccgagatgggagccaacttccgcgcggaccgggtgatcgacccacgccgctgcctaaagcccgtcatcctcaaggacggacccgagagggtgatcctggccggacccatgccggtcacggtggcatccgcagcccagcgacgcggaaggatcggcagaaaccacaacaaggagggggatcagtacatctacatgggccagcccttgaataatgacgaggaccacgcgcactggactgaggccaagatgctgctggataatataaacacgcccgagggaatcatccccgctctcttcgagccggaacgggagaagagcgccgccattgacggtgaataccgcctgcgcggggaggcccggaaaacattcgtggagctaatgcgccgtggcgacctcccagtctggctgtcctacaaggtggctagcgagggctttcagtattccgataggcggtggtgctttgatggggaacgtaacaaccaggtccttgaggaaaacatggacgtggagatctggaccaaagagggcgagcggaagaagctgagaccgcggtggctggacgccaggacctactccgatcccctggctctcagggaatttaaagagttcgccgctgggcgacggagtgtgtccggcgacctgattttggagatcggcaagctgccgcaacacctgacccaaagagctcaaaacgccctggacaacctcgtgatgctacacaacagtgagcagggaggaagggcctatcgccacgcaatggaagaactgcccgacacgatcgagaccctcatgctgctggccctcatcgctgtcctgacaggtggcgtgacattgtttttcctttctggtcgtggccttggcaaaaccagcattgggctgctctgcgtgatggcctccagcgtcctgctctggatggcatccgtagagccgcattggatcgcggccagcatcatattggagttcttcctgatggtgctgctcattcccgaacctgacagacagcggacgcctcaagacaaccagctggcgtacgtggttattggactcttattcatgatcctcacagtggccgcaaatgagatgggtctgcttgagacaaccaagaaggacctgggcatcggtcacgtagcggttgagaaccaccaccacgcgacgatgctggacgtggacctccatccagcgtccgcatggaccctttacgccgtcgcgaccaccataatcactcccatgatgcgccacaccatcgagaacacgactgcaaacatcagcctcacggccatcgccaatcaagccgcgatcctcatgggcctggacaaagggtggcctatctctaaaatggacatcggcgtgcccctgcttgccttgggctgttacagccaggtcaacccactaactctaactgcagccgtcctaatgctggtggcgcactatgcaattatagggccggggctccaggcgaaggccacgcgggaagctcagaagcgcacagccgccgggatcatgaaaaaccctaccgttgatggcatcgtcgcgatagatctggacccagttgtgtacgatgccaagttcgagaaacagctgggacagatcatgctcctgatcctgtgcacctcgcagatcctcctgatgcgcaccacgtgggccttatgcgagagcattacgctcgcgacaggccctcttactaccctgtgggagggctccccgggaaagttctggaacactacgatcgccgtcagcatggccaatatcttccggggatcctatctcgccggggccggcctggccttctccctaatgaagtcgctcggcgggggccgccgggggacgggcgcacaaggcgagacactgggggaaaagtggaaacgccagttaaatcagctctccaagtctgaattcaacatctataagaggtccggcatcatggaggtggatcgcagcgaggccaaggaagggctgaaacggggtgagacaacccgccacgccgtcagtcgggggacggcgaagctgcgctggttcgtcgagcggaatctcgtgaagccggagggcaaagtcatcgatcttggctgcgggaggggcgggtggagctattactgcgcagggctgaagaaggttacggaggtgaaggggtacacgaagggcggcccggggcacgaggagcccataccgatggccacatacgggtggaacctggtgaagcttcacagtggtaaggacgtgttctttacgccgcccgagaagtgcgacacgctcctgtgcgacataggcgagagctcccccaacccgaccatcgaggaaggacgcacgctccgcgtgctcaagatggtggaaccatggttacggggtaaccagttctgcatcaagattctcaatccctacatgcccagtgtcgtcgaaactctggagcagatgcagcgcaagcacggcgggatgctggtgcggaacccgctcagccgcaactcgacgcatgagatgtattgggtctcgtgcggcacggggaatatcgtgagcgctgtgaatatgacaagccggatgctactgaatcgcttcacaatggcccaccgcaagcccacctacgagcgggatgtcgacttgggagcgggcacgcgccacgtagcagtagagcccgaagtcgccaacctggacatcattgggcagagaatcgagaatatcaagcacgaacacaagagcacctggcactacgatgaggataacccctataagacttgggcctatcatgggtcgtatgaggtgaagccgtcggggtcggctagcagcatggtcaacggggtggtaaagctgctcaccaagccctgggacgttatccccatggtaactcagatcgctatgaccgacacaactcccttcggtcagcagcgcgttttcaaggaaaaggtcgacactcggactccgaaagcgaaacgaggcaccgcacaaataatggaagttacggccaggtggctgtggggcttcctgtcccgcaacaagaagccccggatatgcacgagagaggagttcactagaaaggtgcgcagcaacgccgcaatcggtgccgtatttgtcgacgagaaccagtggaactcagccaaagaggccgtggaagatgaacgattctgggacctcgtccagaaagagagagaacttcacaagcaaggcaagtgcgccacctgcgtgtacaatatgatggggaaacgggagaagaagctcggcgagttcgggaaggccaaaggcagccgcgctatctggtacatgtggctcggcgcccggttccttgaatttgaggctctgggatttatgaacgaggaccactggttttctcgcgagaacagcctctccggggtagaaggggaaggcctgcacaagctcgggtacatactaagagacatcagcaagatccccggcggcaacatgtacgcggacgacaccgccgggtgggacacgcgcatcaccgaggatgatttacaaaacgaagccaaaatcaccgacatcatggaacccgagcacgccttgctcgccacttctatattcaaactgacgtaccaaaataaggtcgtgcgagtccagcgccctgcgaaaaacggcacagtaatggacgtgatcagtcgccgggatcagagggggtctgggcaagttggcacctatgggctgaacactttcaccaacatggaagcacagctcatccggcagatggagagcgaaggcatattcttgccctccgagctggaaacgccgaacctcgccgagcgggtgctagactggctggagaaatacggggtggagcgactcaagcggatggccatcagcggcgacgactgcgtggtaaagcctatcgacgatcggttcgccaccgcgctggccgcgttgaacgatatgggcaaggtccgcaaggacattccccagtgggagccctccaagggctggaacgactggcaacaggtccccttctgctctcatcacttccaccagttaataatgaaggacggcagagagatcgtcgtgccttgcaggaaccaggatgagctggtaggccgggcccgggtcagtcagggcgccgggtggtctctccgggagaccgcgtgtttggggaagagctatgcacagatgtggcagctgatgtacttccaccgccgggacctacgcctagccgctaacgctatctgctcagctgtgccagtagactgggtccccacgtcccggaccacgtggtcgatccacgcgcaccaccaatggatgaccacggaagacatgctgagcgtgtggaaccgcgtgtggattgaggagaatccctggatggaggataaaacccacgtatcctcctggggagacgtcccgtacttgggcaagcgggaggaccagtggtgtggctcactcatcggtctgactgcgcgggctacctgggcgtcaaacatacaggtggccataaaccaggtccgccgacttatcggaaacgaaaactatttggactacatgacgagtatgaagcgctttaagaacgagggagaccccgaaggagccctgtggtag

SEQ ID NO: 24557 - RNA, 9879 nt, synthetic construct
  misc_feature 1..9879: note = derived and/or modified CDS sequence (opt11) from DENV-1__EU482477__SS-prME
  source 1..9879: mol_type = other RNA
agtgttaccatgctgctgatgctaatgcccaccgccctggccttccatctcacgaccagaggaggggaaccccatatgatagtgtcgaagcaggagaggggcaagagcctgctgttcaagaccagcgcgggggttaacatgtgcaccctcatcgcgatggacttgggcgagctatgcgaggacacaatgacgtacaaatgcccccgcatcaccgaggcggagcccgacgacgtggactgctggtgcaacgccacggacacgtgggttacctacggtacctgctcgcaaaccggcgagcaccggcgggacaagcggtccgtggccctcgcgccccacgtgggcctagggctggagacgcgcaccgagacctggatgtcctccgagggcgcctggaagcagatccagcgggtggagacctgggccctccgccaccctgggtttaccgtgatagccctgttcctggcgcatgccatcggaaccagcatcacccagaaggggattatcttcatccttctcatgctggtgaccccctccatggccatgcggtgcgtcggcatcggcagccgcgacttcgtggaagggctctccggcgccacttgggtggacgtcgtgctggaacacggcagctgcgtgaccactatggcgaaggataagcccactctggacatcgaattgctaaagacggaggtcaccaaccccgcggtgcttcggaagctatgcatcgaggccaagatctccaacacaaccacggactcgcgttgccctacccagggcgaagccactctggtggaggagcaggacgccaactttgtgtgccgtcgcaccttcgtggacaggggctgggggaacggctgcggtctgttcggcaagggatccctcatcacttgcgcaaagttcaagtgcgtaaccaagctggagggcaagatcgtccagtacgaaaacctcaagtattctgtgatcgtgaccgtccacaccggcgaccagcaccaggtggggaacgagtccaccgagcatggcaccaccgcgaccatcacaccccaggccccgtcaacggagatacagcttaccgactacggggccctgaccctggactgtagcccaaggaccggactcgattttaacgagatggtgctgctgacaatgaaggagaagtcctggctggtccataaacaatggttcctggacctcccgttaccctggacctcgggcgcgtccaccagccaagagacctggaaccggcaggaccttctggtaactttcaagaccgcccacgctaagaagcaggaggtagtggtgctcggatctcaagaaggcgcaatgcacaccgcgctgaccggggccacggagatccagactagcggaacgaccacgatctttgcggggcatctgaagtgccgcctcaagatggacaaactgacccttaagggcatgtcctacgtcatgtgcacagggagcttcaaactcgagaaggaggtggcggagacccagcatggcaccgtgctggtccagatcaagtacgaggggaccgacgcaccctgcaaaatccccttctccactcaggacgagaaaggggtcacccagaacggccggctgatcacggccaacccgattgtgaccgacaaggagaaacccgtgaacattgaggccgaaccgccgttcggggagtcatacatcgtgatcggcgccggtgaaaaggcactgaaactttcctggttcaaaaaggggagctccatcgggaagatgtttgaggcgaccgcccgcggggcccggcgcatggcgatcctgggcgacacggcatgggacttcggtagcatcggcggcgtgttcacgagcgtcgggaagctggtacaccagatcttcggcaccgcgtatggggtcttatttagcggcgtgagctggaccatgaagatagggatcggtgtgctgctgacctggctgggccttaacagccgcagcacctctctgtccatgacatgcatcgccgtggggctagtgactctgtacctgggagttatggtgcaggccgactccggctgcgtcatcaactggaagggcagggagctcaaatgcgggtccggtatattcgttacgaacgaggtgcacacctggaccgaacagtacaagttccaggcggacagcccgaagcggctgtccgccgcaatcggcaaggcctgggaggagggggtgtgcggaatccggtccgccacccgcctggagaacatcatgtggaagcaaatttccaacgagctcaaccacatcctgctggagaacgacatgaaattcacagttgtggtcggggacgtcgcgggcatcctagcccaggggaagaagatgatccggccccagcccatggagtataagtactcctggaagtcctggggcaaggcaaagataatcggcgccgatgtgcagaataccactttcatcatcgacggacctaacactcccgagtgcccagacgatcagcgcgcgtggaacatttgggaggtggaggactatggtttcgggatattcaccaccaacatatggctgaaactccgggactcctacacccaagtatgcgatcaccgcctcatgtcagccgccatcaaggactccaaggccgtgcatgctgacatgggctactggatcgaaagcgaaaagaacgagacctggaagctagcccgggcctctttcatcgaggtcaagacctgtatttggcccaagtcccacactctgtggtcaaacggcgtgctcgagtcagagatgatcatcccaaagatttacggcgggcctatatcccagcacaactacagacccggttacttcacgcagaccgccggcccgtggcacctggggaagctggagctcgacttcaacctgtgcgaaggaacaacggtggtcgtggacgagcactgcggcaacaggggtccgtccctgcgcacaaccaccgtgaccggcaagatcatccacgaatggtgctgcaggtcctgcacactgcctcccctcaggttcaaaggggaggacggctgctggtacgggatggagatccggcccgtaaaagagaaggaggagaacctagtcaagagcatggtgagcgcgggttccggagaggtcgacagcttttccttgggtctattatgcatcagcatcatgatcgaagaggtgatgcgcagtcggtggtcccggaagatgctcatgacagggaccttggccgtgttctttctattaatcatgggtcagctgacatggaatgacctgatcagactctgcataatggtcggtgccaacgcctcggatcgcatgggcatgggcacgacgtacctggcactgatggccaccttcaagatgaggccgatgctggcggtaggcctgctgtttcggcgcctcacaagccgggaggtgttgctcctaacgattgggctgtccctggtcgcgagcgtggagcttcctaattccctggaggagctgggcgatgggctcgccatgggcatcatgatcctgaagctgctgaccgacttccagagccaccagctgtgggccaccctgctctccttgacctttattaagacgacttactcactgcactatgcctggaagaccatggcgatggtcctctccatcgtgagcttattccccctgtgcctctccaccactagccagaagaccacctggctgcccgttctgctgggaagtcttgggtgcaaaccactaacgatgttcctcatcgcggagaataaaatctggggccgcaagagctggcccttaaatgaggggatcatggccgtcggcatcgtcagcatcctgctctccagcctgcttaagaacgacgttcccctcgccgggcccttaatcgcaggaggcatgctgatcgcgtgctacgtcatctcaggcagctccgcggacctctcgctggagaaggccgccgaggtgtcctgggaagaggaggccgagcacagcggcgcgtcccacaacatcttagtggaagtccaggacgatgggacgatgaaaatcaaggacgaggagcgggatgacactcttaccatactgttgaaggccacgctcctggccgtgagcggcgtgtacccactgtcgattcccgccacactctttgtctggtacttctggcagaagaagaagcagcgcagcggagtactctgggacacgcccagcccgcccgaggtggagcgagccgtccttgacgacggcatctaccgcatcatgcagcggggcctgctcgggcgctctcaggtcggcgtaggggtcttccaggaaaacgtattccacaccatgtggcacgtcacccggggcgctgtcttgatgtaccagggaaaaaggttagagccctcttgggccagcgtgaagaaggacctgatatcttacggcggtgggtggaggctccagggctcttggaacaccggggaagaggtgcaggtcatagcagtggaacccggcaagaaccctaagaacgtgcagacggcccctgggaccttcaagacctccgagggcgaggtcggcgccattgcgcttgacttcaagcccgggactagcggcagcccaatagtcaaccgcgaggggaagattgtaggactctacggcaacggggtcgtgaccacttccggaacctacgtgtctgccatcgcccaagcaaaggcgtcacaagaagggcctctgcccgagatcgagaatgaagtcttccggaagcgcaatctgaccatcatggacctccaccctgggtcgggcaagacgcgaaggtatctacccgccatcgtgcgggaggccattaagcgcaagttgaggaccttgatcctggccccaactcgcgtggtcgcctccgagatggcggaggcccttaagggcatgcctatcaggtaccagactaccgccgtcaagtctgagcacaccggcaaggagatcgtggatctcatgtgccacgccacctttactatgcggttgctgtcccccgtccgagtgcccaactataacatgatcatcatggacgaggcccacttcacggacccgagcagcatcgctgccagagggtacattagcacccgcgtgggcatgggggaggccgccgccatctttatgaccgctacgccacccgggtccgttgaggccttcccccagagcaacgccgtgatccaggatgaggagagagacatcccggagcgctcctggaacagcgggtacgaatggatcacagactttcccgggaaaaccgtttggttcgtgccctccatcaagagcggcaacgatatcgccaattgccttcggaagaacggaaagcgcgtaatccagctgtcccgtaaaaccttcgacacagaataccagaaaacgaagaataatgactgggactacgtggtcaccactgatataagcgagatgggcgcgaactttagggccgacagagtgatcgacccacgccggtgcctgaagccggttatcctcaaagacgggcccgaacgcgtcatcctggcgggcccgatgcccgtcaccgtcgcctccgccgcgcagcggcgagggcggatcggccgcaatcacaacaaggagggggaccagtatatctacatggggcagcctcttaacaacgacgaggatcacgcccactggactgaggcaaagatgctcctggataacatcaatacccccgagggcatcatccctgccctgttcgagcccgagcgcgagaagagtgccgcgatcgacggggagtaccgcctccgtggtgaggctcggaagacctttgtggagctgatgcgccgcggggacctgccggtgtggctgagctataaagtagcctctgagggcttccagtattcagaccgtcggtggtgcttcgatggagagcgaaacaaccaggtgttagaggagaacatggacgtggagatttggactaaggagggggagcggaagaagctgcgcccccggtggctggacgcacgcacatacagtgaccccctggcactgcgtgaatttaaagagttcgcagccggcaggaggagcgtctccggggacttaatcctggagatcggaaagctgccccagcacctcacccaacgcgcccagaacgccttagacaacctagtgatgctccacaactcggagcagggaggacgggcgtaccgccatgccatggaggagctcccggacaccatcgagactctgatgctcctggccctcatcgccgtactcacgggcggggttaccctgttcttcctgtccggccgtggcctcggcaagaccagcatcggccttctgtgcgttatggcctccagcgtgctcctgtggatggcttccgtggagcctcactggatcgccgccagcatcatcttagagtttttcttaatggtactcctgatccccgagcccgacaggcagcggaccccgcaggacaatcagttagcctacgtggtcatcggcttactgtttatgatcttgaccgtggccgccaatgagatgggcctgctggagacgaccaagaaggacctcgggatcggccacgtggccgtcgaaaaccaccaccatgccgccatgctggatgtcgacctgcaccccgcttccgcgtggaccctctacgccgtggccaccacgattataacccccatgatgcgccacaccatcgagaacacgacggccaacatttccctgacggccatcgcgaaccaggccgccatccttatggggctcgacaagggctggccaatctccaagatggacatcggcgtacccctactggccttagggtgctactcccaggtgaaccccctgaccctgaccgcggcagtgctcatgctggtcgcccactacgccatcattggccccgggctgcaggcaaaggcgacgcgggaggcccagaagcgcaccgccgcgggcatcatgaagaaccccaccgtcgacggtatcgtggccatcgatttagaccccgttgtgtatgacgcaaaatttgagaagcagctggggcagatcatgctcctcatcctatgcacctcccagatactgctcatgcgcacgacatgggccctgtgtgaatcaatcaccctagccaccggccccctcacgaccctgtgggaagggtcccccggcaagttctggaacacaaccatcgcagtgagcatggccaacatcttcagagggagctacctggcgggggctggactcgccttctctttaatgaagtccctcgggggagggcgtaggggaacgggggctcaaggcgagacccttggcgagaaatggaagcgccagctgaaccaactgtccaagagcgagtttaacacttacaagcggtccgggatcatggaggtcgatcgctcggaagcgaaggagggcctcaagagaggggagacaacgaagcatgccgtgtcccgcggcaccgccaagctgcggtggttcgtggagcgcaatctcgtcaagccggaggggaaggtaatcgacctagggtgcggccgcggcgggtggagctactattgcgcagggctcaagaaggtgacagaggtcaagggttacaccaagggcggaccgggccacgaggagcccatccccatggcgacgtatggttggaatcttgtaaaactgcattccggtaaggacgtgttcttcatcccgcccgaaaagtgtgataccctcctttgcgacatcggggagtcctcccctaacccgaccatcgaggagggcagaaccctgcgggtcctcaaaatggtggagccgtggctgcgcgggaatcagttctgcatcaagatcttaaacccctatatgcccagcgtggtggagactttggagcagatgcagcggaaacacggaggcatgctggtgcgtaacccgctgtcccggaacagcacgcacgagatgtactgggtgtcctgcgggacagggaacatcgtctcagctgtgaacatgacatcccgcatgctcctgaaccggttcacgatggcccaccgcaagccaacgtacgagcgcgacgtagacttgggagcaggcacccggcacgtcgccgtagagcccgaggtcgcaaacttagacattatcggccaacgcattgagaacataaagcacgaacacaagtcgacctggcactacgatgaggataacccctacaagacctgggcgtaccacgggtcctatgaggtgaagccgtcaggcagcgcctccagcatggtgaacggggtcgtgaagctgctaacgaagccgtgggacgtaattccgatggtcacgcagatcgcgatgaccgataccacgcccttcggccaacagcgtgtgttcaaggaaaaggtggacacccgaaccccaaaggccaagcggggaaccgcacaaatcatggaggtaacggccaagtggctctggggcttcctgtcccgcaataagaagccgcgaatctgtaccagagaggagttcacccggaaggttcgcagcaatgccgccataggcgctgtattcgtcgacgaaaaccagtggaactccgccaaggaggccgtagaagacgagcggttctgggatctggtgcaccgcgaacgggagctacacaagcaagggaagtgcgcgacctgtgtctacaacatgatgggcaagcgcgaaaagaaactgggggagtttgggaaggccaaggggagccgggcgatctggtacatgtggctgggcgcgaggtttctagagttcgaggccttaggcttcatgaacgaggaccactggttctcgcgggagaacagcctgagtggggtcgagggcgagggtctgcacaaactggggtacatactgcgcgatatcagcaagatccccgggggaaatatgtacgccgacgatacggccggctgggacacccggataaccgaagacgacctgcagaacgaggccaaaataaccgacatcatggagcccgagcacgctctgctggccaaaagtatcttcaagctcacataccagaacaaagtggtgcgcgtgcaacggccggcgaaaaatggcaccgtgatggacgtcatcagccggcgcgaccagcgaggcagtggccaggtggggacatacggcctaaacaccttcactaatatggaggcccagctgatcagacagatggagtccgagggtatcttctcccccagcgagctcgagacccctaaccttgcaggcagggtgctggactggctcgaaaagcacggggtcgagcgattaaagaggatggcgatctccggcgacgattgtgtggtgaagcccatcgatgacaggtttgccacggccctgactgccctcaacgacatggggaaggtccggaaggatatcccgcagtgggagcccagcaagggctggaacgactggcagcaggtccccttctgcagccaccatttccaccagctcatcatgaaggacggccgcgagatcgtggtcccttgccggaaccaggacgaactggtggggcgggcccgggtgtcccagggcgcggggtggagcctccgcgagacggcttgcctgggtaagtcctatgcccagatgtggcagttgatgtatttccaccggcgcgacttgcggctggctgcgaacgccatctgcagcgccgtgccggtggactgggtcccgacctcccgcaccacttggagcattcacgcccaccaccagtggatgacgaccgaggacatgctgtccgtttggaaccgtgtgtggatcgaggagaacccctggatggaggataagacgcacatcagctcctggggcgatgtcccataccttggtaagcgcgaggaccagtggtgcggctcattgatcggactcaccgcccgtgcgacttgggccaccaacatccaagtcgccatcaaccaggtgcgaagactcatcggcaacgaaaactacctggactacatgacgtccatgaagcggttcaagaacgagagcgacccggaaggggctctatggtga

SEQ ID NO: 24558 - RNA, 9879 nt, synthetic construct
  misc_feature 1..9879: note = derived and/or modified CDS sequence (opt11) from DENV-1__EU482478__SS-prME
  source 1..9879: mol_type = other RNA
agcgtgacgatgttgctaatgctgatgcccacggccctggccttccacctcaccacccggggcggggaaccccacatgatcgtgtcaaaacaggaacggggcaagtctttactgttcaaaacctccgccggggtaaatatgtgtacgctcatcgcgatggacctgggcgagctctgcgaggacaccatgacctacaagtgcccccgaatcaccgagactgagcccgacgatgtggactgctggtgcaacgccacggacacctgggtcacctacgggacctgcagccagaccggtgagcaccggcgggacaaacggtccgtggccctcgcgccccacgtgggcctagggctggagacccggaccgaaacctggatgagctccgaaggcgcgtggaagcagattcagagggtcgagacgtgggctctccggcacccagggttcaccgtgattgccctgtttctcgcccacgcgattggcaccagcatcacccagaaggggatcatcttcatcctactgatgctggtgacgccttccatggctatgaggtgtgtcggcattggcagccgcgacttcgtggagggtctctccggggctacatgggtggacgtcgtgctagagcacgggagctgcgtcaccaccatggccaaggacaagcccacactggatatcgagctactgaagaccgaggtcaccaaccctgccgtgctgcggaaactgtgcattgaggctaaaatctcaaacaccacgaccgactctcgctgtccgacgcagggggaggctaccctggtggaggaacaggacgccaacttcgtctgccgacgcacgtttgtggaccggggctgggggaatggctgcggcctcttcgggaagggatccctcataacgtgtgccaagttcaagtgcgtgaccaagctggagggcaagatcgtccaatacgagaatcttaaatacagcgtgatcgtgaccgtccacacgggggaccagcaccaagtggggaacgaatccacagaacacggcaccactgccaccatcacgccccaggcgcctaccaccgagatccagctaaccgattacggtgccttgacgctggactgtagcccccggaccggcctcgacttcaacgagatggttcttctgaccatgaaggagaagtcctggttggtgcacaagcagtggttcctggatctgcccctcccctggaccagcggggccagcacgtcccaggagacttggaatcggcaggacctgctggttacattcaaaactgcgcacgccaagaagcaggaggttgtggtgttgggaagccaggagggggccatgcacacggccttgaccggggccactgaaatccagacctctggcacgacgaccatcttcgccgggcacctgaagtgccgccttaagatggacaagctgaccctgaagggcatgtcttacgttatgtgcacggggtccttcaagctcgagaaagaggttgccgagacccaacacggcaccgtgctggtccagatcaagtacgagggcaccgacgcgccgtgcaaaatcccattcctgacgcaggacgagaagggtgtcacccagaacggccgactgatcaccgccaaccccattgtgaccgacaaggagaagcccgttaacatagaggctgaaccgcctttcggggagagctacatcatcatcggcgccggggaaaaggcccttaagctgtcctggtttaagaaggggagctccatcggaaaaatgtttgaggccacggccagaggggcccggcgcatggccattctgggggacaccgcatgggacttcgggagcatcggtggagtattcacatccgtaggtaagctagtccaccagatcttcggtaccgcatacggggtgctgttcagcggtgtgtcctggacgatgaagatcgggatcggggttctgctcacctggctgggcctgaatagtcgctcgaccagcttgtcaatgacctgcatcgccgtggggttagtcacgctgtacctcggcgtcatggtgcaagccgactctgggtgcgtaatcaactggaagggccgggagttgaaatgcgggtccggcatcttcgtcaccaacgaagttcacacatggaccgagcaatacaagtttcaggccgacagccctaagcggctgagcgcagccatcggcaaagcctgggaggagggtgtgtgcggcatccggtccgccactcgcctcgagaacataatgtggaagcaaattagcaacgagctcaaccacattctgctcgagaacgatatgaagttcacggttgtggtgggggacgtagccggtatcctagcgcaaggtaagaagatgatccggccccagcccatggagtacaagtattcctggaagtcctggggcaaggcgaagataatcggggccgacgtacagaacaccaccttcatcatagatgggccgaacaccccggaatgtcccgacgaccagcgtgcttggaacatatgggaggtcgaggactacggcttcgggatcttcacgacaaacatttggctgaagctccgggactcgcacacccaggtctgcgaccacaggctgatgagcgcggccattaaggactccaaagccgtacacgccgacatgggctactggatcgagtcagagaagaacgagacctggaagctggctcgggcctccttcatcgaggtgaagacatgcatctggcccaagtcccacaccctctggtctaacggcgtcctggagagcgagatgatcatccccaagatctacgggggcccgatctcccaacataactatcgccctggatacttcacccagaccgccggtccctggcatctgggtaagctcgagctcgacttcgacctttgcgaaggcacgaccgtggtcgtcgacgagcactgcggcaaccgggggccatcactccgcacgaccacggtgaccggaaagatcattcatgagtggtgctgtaggtcttgcacactgcctcccctgcgcttcagaggtgaggacggctgctggtatggcatggagatccgccccgtgaaggagaaagaggagaatttggtcaaaagcatggtctcagccggcagcggggaggtggatagcttctcactggggttgctatgcatctcaattatgatcgaagaggtaatgcgctcccgctggagcagaaagatgctgatgactggaacgctggccgtgttcttcctcctgatcatgggtcaactaacctggaacgatctcatccgcctttgcatcatggtgggcgccaacgcttccgaccgcatggggatgggcaccacctatcttgcgctcatggcaacgtttaagatgcgacccatgttcgccgtcggcctgttattccgccggctgaccagccgcgaggtgctgctgctaacgatcggattatcgctcgtggccagcgtcgagctccccaactcccttgaggaactcggcgacgggcttgcgatgggtatcatgatccttaagctgctcaccgacttccagagccaccagctgtgggctacgctactctccctgaccttcatcaaaaccacgttcagcctgcactacgcctggaagacaatggcgatggtactctccatcgtcagcctgtttcctctgtgcctcagcaccaccagccagaagaccacgtggctacccgttctcctcggatcactgggttgcaaaccactgacgatgttcttgatcgccgagaacaagatctggggccggcgctcatggcccttgaacgaggggattatggccgtgggcatcgtcagtatcctcctgagctcgctactgaaaaacgacgtgcccctcgccgggccgctgatcgccggcggcatgcttatcgcctgttacgtgatcagtgggagctcagcggatctgagcctggaaaaggccgccgaggtcagctgggaggaggaggcagagcacagtggagcgtcccacaatatcctagtggaggtgcaggatgacggtaccatgaaaatcaaggacgaggaaagggacgacaccctaaccatcttactgaaagcgacgctcctggcagttagcggcgtgtatcctctaagtatccccgccacccttttcgtgtggtacttctggcagaagaagaaacaacgctccggggtactgtgggacaccccctcaccacccgaggtggagcgggccgtgttagatgacgggatataccgcatcatgcagcggggtctcctcgggcgcagccaggtcggcgtgggagtgttccaggagaacgtcttccacaccatgtggcacgtcacgaggggcgccgtgttaatgtaccaaggaaaacgcctggagccctcctgggcgagcgtcaagaaagatctcatctcgtacggcggcgggtggcggctgcagggcagctggaacacgggggaggaggtccaggttatcgccgtcgagcccggcaagaaccccaagaatgtgcagaccgcccccgggacctttaagactcccgagggcgaggtaggcgcgatagctctggacttcaagcccgggacctcgggcagccccatcgtaaaccgcgagggaaaaatcgtgggcctctacgggaacggtgtggtcaccacctccggcacgtatgtgtctgcgattgctcaggcaaaggcatcgcaggaggggccgctgcccgagatcgaggacgaggtattccggaaacgcaacctgaccatcatggatctccaccccggctccgggaagacccggcgctacttgccggcgatcgtccgagaagccatcaagcgcaagctccgcaccttgatcctggcacccacgcgtgtggtggccagcgaaatggccgaggctctgaagggcatgcctatccgctatcagacgactgccgtcaagtccgagcatactggcaaggaaatagtggacctcatgtgccacgccacgttcactatgcggctgctgagtcccgttcgcgtcccgaactacaacatgatcatcatggacgaggcccacttcaccgatcctagcagcatcgctgcacgtggctatatcagtacgcgcgtgggtatgggggaggcagccgccatctttatgacggccacaccacccggtagcgtcgaggcgttcccgcaatccaacgccgtcatccaggacgaggagcgggacattcctgagcgcagctggaactcaggatacgagtggatcacggacttccccggcaagaccgtttggttcgtgccgagcattaagtccggcaacgacatcgccaactgccttcggaaaaacgggaagcgcgtcattcaactgagccggaagactttcgacacggagtaccagaagaccaaaaacaatgactgggactacgtggtgaccacggacatcagcgagatgggcgccaacttccgcgcggaccgggtcattgacccgcgccggtgcctgaagccagtaatcctcaaggacgggccggagcgcgtgattctggccggacccatgccggtcacggtggcaagcgccgcgcagcggcgcgggcggatcggccgcaaccacaacaaagagggggatcagtacatctacatggggcagcccttgaacaacgacgaggaccacgcgcactggacggaggccaagatgctcctggacaacatcaacacccccgagggcatcattcccgccctgttcgagccggaacgcgagaagtccgccgcgattgacggggagtatcgtctccgaggagaggctcggaaaacgtttgtcgagcttatgcgccgcggggacctgcccgtgtggcttagctacaaggtggcatccgagggctttcagtacagcgaccgccggtggtgcttcgacggcgagcgcaacaaccaggtcctggaggagaatatggatgtggagatctggaccaaggagggggagcggaagaaactgcgcccccggtggctcgacgcccgcacctacagcgaccctctagccctgcgggagttcaaggagttcgccgcggggcgccggtccgtgtctggggatctcatcctcgagatcggaaaattaccccagcacctgacccagcgcgcgcagaacgctctggataacctggttatgctccacaattccgaacagggcggccgggcgtaccgccacgccatggaggaactgcccgacacgatagagactttaatgctattagccctaatcgccgtgttaacaggaggggtgactttgttcttcctgagtggacgggggctaggcaagacatccatcggccttctgtgtgtcatggccagctccgttctcctgtggatggcaagcgtggaaccccactggatagcggccagcatcatcctggagttcttcctcatggtcctgctgattcccgagccggaccggcagcggacgcctcaggacaatcagttggcatacgttgtaatcgggctgctgttcatgatactcaccgtcgcggcgaacgagatgggcctccttgagactaccaagaaggaccttggcataggccacgtggcggttgagaaccaccaccacgccgctatgctggacgtcgacctgcaccctgccagcgcctggacgctctacgcggtagccacaaccatcatcacccctatgatgcgccacacgatcgagaacacaacagccaacatctcactgacggcaattgccaaccaagcggccatcctgatggggctcgacaagggctggccaatttcaaaaatggacataggcgtgcccctgctggctctcgggtgctactcccaggtcaacccactgacactgaccgcagcggtgctcatgctggtggctcactatgccatcatcggcccggggctgcaagcgaaggcgaccagagaggcgcaaaagcggaccgccgccggcatcatgaaaaaccccacggtggacgggatcgtggccattgacttggaccccgtggtctacgacgctaagttcgagaagcagctgggccagatcatgctgctaatactgtgtaccagccagattctgctcatgcgcaccacttgggcgttgtgcgagtccattacgctggccaccggcccgctcaccaccctgtgggagggcagcccgggcaagttttggaacaccaccatcgccgtgagtatggccaacatcttccgaggttcgtatctggccggcgcgggccttgccttctccctgatgaaaagcctcgggggaggaaggcgggggaccggggctcagggcgagaccctaggcgagaagtggaagcgccagctgaaccagctgtcaaaatccgagttcaacacgtacaagcggagcggcatcatggaagtggaccgctctgaggccaaggagggattgaagagaggggaaaccaccaagcatgcggtcagccgtggcaccgccaagctacggtggttcgtggaacgcaatctggtaaaacctgagggcaaagtcatcgacctgggctgcggcagaggcgggtggtcctactactgtgccgggctcaagaaggtgacggaggtgaaagggtacacgaaaggcggccccggccatgaggagcccatcccgatggccacctacgggtggaatctggtcaaattgcacagtggcaaggacgtgtttttcataccacccgagaagtgcgacactctcttatgtgacatcggtgaatcatcccctaacccgacgattgaagaaggccgcaccttgagagtgctcaagatggtagagccttggctgcgtgggaaccagttttgcattaagatcctgaacccctacatgccctccgtggtggagactctcgagcagatgcagcggaaacacggtggcatgctggtccgtaacccgctgtccagaaattccacgcatgagatgtactgggtgagctgtgggacaggcaatatcgtttcggcagtgaacatgaccagccgcatgttactgaatcgcttcacaatggcacacagaaaacccacctacgagcgcgatgtggacttaggggcaggcaccagacacgttgccgttgagccagagatcgccaacctcgacatcatcggccagcgcatcgagaacataaaacacgagcacaagtccacgtggcattatgacgaggacaacccctacaagacctgggcctatcacgggtcatacgaggtgaagccgtccggcagcgcgtccagcatggtgaacggggtcgtcaaacttctgacgaagccctgggacgtcatccccatggtgacccaaatcgccatgacggacaccacccccttcggccagcagcgggtatttaaggagaaggtcgacactcgcacaccgaaagctaagcgggggaccgcacagatcatggaggttaccgccaagtggctctggggctttctgagtcgaaacaagaaaccccggatctgcacccgcgaggagttcacgcggaaggtgcgctccaatgcggccatcggcgcggtcttcgttgacgagaaccagtggaacagcgccaaggaggccgtggaggacgaacgattttgggacctggtccaccgcgagcgggagctgcacaagcagggaaagtgcgcgacctgcgtgtacaacatgatgggtaagagagagaaaaagttgggggagtttggaaaggcgaaggggtctcgggccatctggtacatgtggctgggagcacgcttcttagagttcgaggcactgggattcatgaacgaggaccattggttcagccgggagaactccctgagcggggttgagggcgagggactccacaagctgggctacatcctgcgcgacatctccaagattcccgggggcaacatgtacgcggacgataccgccggttgggacacccggatcactgaggacgatctccagaacgaagcacgcatcaccgacatcatggagccggagcacgccctgctggccaagagcatcttcaagctcacctaccagaacaaggtcgtgagggtgcagcggcccgcgaagaacgggacggtcatggatgtgatctcccgccgtgaccagcgcggcagcggacaggtgggcacctacggcctgaacaccttcacgaacatggaggcccagctgatccggcaaatggagtccgaggggatcttttcgccgtccgagctcgagacccccaatttggcggagcgcgtcctggactggctcgagaagtacggcgtagagcggctgaagcgcatggccatctcgggggatgactgcgtggtcaagccgatcgacgatcggttcgcgacggccttgaccgcccttaacgacatgggcaaggtgcgcaaggacatcccccaatgggagccctcgaaaggttggaacgactggcagcaggtccccttctgcagccaccactttcaccaactgataatgaaggacggccgggaaatcgtcgtgccctgtcgcaaccaggacgagctggtgggccgggcccgagtgtcccaaggggccggctggagccttcgggagaccgcatgcctgggcaagagctacgcccagatgtggcagctcatgtacttccatcgccgggacctccgcctcgctgccaacgcgatatgcagtgccgtgcctgtggactggatccccaccagccggacgacctggagtatccacgcccaccaccagtggatgaccaccgaggacatgctgagcgtctggaaccgagtgtggatcgaggagaacccttggatggaagacaagacgcacatctccagctggggcgacgtgccgtacctcgggaaacgcgaggatcagtggtgcggctcccttattggactgacagcacgggccacatgggcgaccaatatccaggtcgccataaaccaggtgcgccggctgattgggaacgaaaactatctggactacatgaccagcatgaaacgattcaagaacgagggcgaccctgagggggccctgtggtga

SEQ ID NO: 24559 - RNA, 9879 nt, synthetic construct
  misc_feature 1..9879: note = derived and/or modified CDS sequence (opt11) from DENV-1__EU482479__SS-prME
  source 1..9879: mol_type = other RNA
tcagtaacaatgctactcatgctcatgccaacagcccttgcctttcaccttacaactcggggcggggaaccacacatgatagtatcgaaacaagaacgaggcaaatctctgcttttcaaaacgtccgcgggggtaaatatgtgcacgctcatagcgatggatctgggggaactctgtgaagacacaatgacatacaaatgcccccggatcaccgagacagaaccagacgatgttgattgctggtgtaatgcgacagatacgtgggttacatatggaacatgttcacaaacgggcgaacatagacgcgataaacgttcggtggctctagccccacacgtcgggctagggctcgagacaagaaccgagacatggatgagcagcgaaggcgcatggaaacaaattcaacgagtcgaaacatgggccttacgtcacccggggttcacagtaatagccctcttcctcgcacacgccataggtacctcgattacccaaaagggtataatatttatacttctcatgctcgtcaccccgtccatggcgatgcggtgcgtaggtatcgggagccgagactttgtggagggactgagtggcgccacctgggttgatgtggtcctcgaacatggctcatgcgtcacaaccatggcgaaggacaaacccacgttagacatagaattgttgaaaaccgaggtcacgaatccagcagtgcttcgaaaactctgcattgaggccaaaatttccaacaccacgaccgacagccgttgcccaacccagggcgaagcaaccctcgtcgaagaacaagacgccaacttcgtctgccggcgcacattcgtagatagagggtggggcaacggatgcggtcttttcggaaaggggtcgttgatcacctgtgcgaagttcaagtgcgtaacgaaactcgagggcaagatagtacaatatgaaaacctaaaatattcagtgattgttaccgtccacaccggagaccagcaccaggtcggaaacgagagcacagaacacggaaccacggcaaccataacgccacaagcgcccaccacagagatacaacttacagattacggggccctaacgctagactgcagccccaggacagggttagatttcaacgaaatggtcttactcacgatgaaagaaaaatcgtggctagtccacaagcaatggttcctcgaccttccactaccctggacttccggcgcatccacgtcccaagagacatggaaccgacaagacctcctagtaaccttcaaaactgcgcacgcaaagaaacaagaagtcgtagtactagggtcacaagaaggagcaatgcacacggcactaacgggagctactgagatccagacctccggaacgaccactatcttcgcaggccacctgaaatgtcgattaaaaatggacaaactgacattaaaagggatgagctacgtcatctgcacaggctcttttaaactggagaaagaggtggcggaaacccaacacggaacagtattagtgcaaataaaatatgagggaaccgacgccccctgcaaaatccccttctcaacccaagatgagaagggggttacgcaaaatggacgactaatcaccgccaaccccatcgttacggacaaggagaaacccgtcaacatcgaggcggaaccaccattcggcgaatcatacattatcatcggagctggcgagaaagcgttaaaactatcatggttcaagaaagggtcctctatcggcaagatgttcgaagccactgcgaggggagcgagacggatggcaattttaggagacactgcatgggattttggaagtataggcggagtatttaccagcgtgggcaaacttgtacaccaaatatttgggacagcctacggggtactattctcgggcgtttcttggacgatgaaaatcggcataggggtcctactgacctggttagggctaaacagcaggagtacgtccctgtcgatgacgtgtatagcagtcggcctggttacactatacctaggagtaatggtgcaagcggacagcggctgcgtaatcaactggaaagggagagaattaaagtgtggcagcggaatattcgttactaatgaagtgcacacatggactgagcaatacaagtttcaagccgacagcccgaagagactgtccgcagccataggcaaggcttgggaagaaggcgtgtgtggaatcagatccgcgacccgcctagagaacataatgtggaaacagataagcaacgaactaaaccatatattactcgaaaacgacatgaagttcaccgtcgttgttggtgacgtagcggggatccttgcgcaggggaaaaagatgatacgacctcaaccgatggaatataaatacagctggaagagttgggggaaagcaaaaatcataggcgcggacgtccagaacacaactttcatcatagacgggcctaacactccggaatgcccagatgatcaacgagcatggaatatctgggaagtggaggattacggcttcggaatattcaccactaacatatggctaaagttgagggatagccacacccaagtgtgcgatcacagacttatgagcgcggcgatcaaagatagcaaagcggtacatgcggacatgggttactggattgagtcagagaagaacgagacttggaagctagctagagccagcttcatcgaagtcaaaacctgcatatggcccaagtcccacacactctggagcaacggcgtccttgaaagcgagatgatcatacccaaaatatacggaggaccgatttcgcaacacaactaccgcccggggtattttactcagaccgcaggaccttggcacttaggcaaactggaactggacttcgacctttgtgaaggcactactgtggttgtcgacgagcactgcggcaacagagggccatccttgagaacaactacggtaactggcaaaatcatacacgaatggtgctgcaggagttgcacgcttccaccgctgagatttcgtggcgaagacggatgctggtatgggatggaaataagacccgtcaaagaaaaagaagagaacctagtaaagtccatggtatcggccgggagcggagaagtagatagctttagtttaggactactatgcatatccatcatgatagaggaagtaatgcgctcgagatggtcgagaaagatgctcatgactggcacccttgcggtctttttcctcctaataatgggacagctgacttggaacgacctgatacggctgtgcataatggttggcgccaacgcctccgacagaatgggtatgggcacaacgtacctcgcattaatggcaacattcaagatgaggccaatgttcgcagtaggactactttttcgacgcctgacgagtagagaagtgcttctcctaaccattgggttatccctagtcgccagcgtagaactgcccaactcattagaagaactgggcgacggccttgcaatgggtatcatgatcctgaaacttctcacagacttccagtcacaccaactatgggccaccctactaagtctgacctttatcaagacgaccttcagtctgcactacgcctggaagacgatggctatggttcttagcatagtcagtcttttccccctgtgcctgagcacgacatctcaaaagacaacatggctccctgttctgctgggctcgctcggttgcaagccacttaccatgttcttaatcgccgaaaataagatatgggggcgtcgcagctggccgctgaacgagggtataatggcagtaggaatcgtcagtatactactctcaagtctgctcaaaaacgacgtgcctctcgccggacccttgatagctggagggatgctcattgcttgctatgtaatctctggcagcagtgccgatctgtcactcgaaaaagccgcagaagtcagctgggaggaagaagctgagcactcaggcgcgagccacaatatccttgtagaagtacaggacgatggaaccatgaagataaaagatgaagaaagagatgatacgctgaccatacttctaaaggcaacacttctggccgtatctggagtataccccctatccatcccagctactctgttcgtatggtacttctggcagaaaaagaaacagcgaagcggcgtactatgggacacgccatcgccccctgaagtagagagagcagtactggacgacggaatatacaggatcatgcaacgagggctgctcgggcgcagccaggtcggcgtaggcgtattccaagaaaatgtcttccatacgatgtggcacgtgacccgcggtgcagtgctgatgtatcaggggaagaggttagaaccgagctgggctagcgttaagaaagacctaataagctatggaggcggatggagactgcaggggtcctggaacaccggtgaagaagttcaagtcatcgcggtcgaaccgggaaagaaccccaaaaatgtccagacagcacccggaacatttaaaacgcctgaaggagaggtcggtgccatagcactagacttcaaaccgggcaccagcggatcgcccatcgtaaaccgcgaaggaaaaatcgtgggtttgtatggcaacggagtcgtaaccacgagcgggacttacgtaagcgcgatagcccaagcaaaggccagccaggaaggaccactacctgagatagaggatgaagtgttccggaaacggaacctaacaatcatggatctacacccaggatcaggcaaaacaaggagatatctgcccgccatcgttcgagaagccataaagcggaagctccggacactaatcctcgccccaacaagagtggtagctagcgagatggcagaagccctgaagggcatgccgatcaggtatcagacaacagcagtgaaatcagagcacacaggcaaagaaattgtagaccttatgtgccatgctaccttcacaatgagactattaagccccgttcgcgtgcctaactacaacatgattatcatggacgaagcacacttcacagacccaagttcaatcgcagcgcgaggatatattagcacacgggttggaatgggagaagctgcggcgatctttatgacagcaactccacctgggtcagttgaggcgttcccacagtccaatgcagtcatccaagacgaagaacgcgatataccagaacgtagctggaatagcggctatgaatggatcacagactttcccggtaagacggtatggtttgtccccagtataaaatcgggaaacgacatagccaattgtctccgcaagaacggaaagcgcgtcatacaattatcacgaaagacgtttgacaccgagtatcagaagaccaaaaacaacgactgggactacgttgtaaccacagacatctccgaaatgggtgctaacttccgagctgacagggtcatcgatccgagaagatgtctaaaacccgtgatactcaaagacgggccagagcgcgtaatcttagccgggccaatgccagtgacagtagcaagtgccgcccagcgacgggggaggataggtagaaaccacaacaaagagggcgaccagtacatctacatgggacaaccactgaacaatgacgaggaccatgcacactggacagaagccaagatgctactcgacaatatcaacacaccggagggaattatacccgcactttttgaaccggaaagggagaaatcagccgccatcgacggggagtaccggctacgcggggaagccagaaaaacattcgttgaactaatgcgaagaggggatctacccgtatggctgtcatacaaggttgcgtcagaaggattccaatattccgaccgccgttggtgcttcgacggcgaacgaaacaatcaagtactggaagagaacatggacgtagaaatatggacaaaggagggagagcggaagaaactccgcccacgttggctagatgcacgaacctacagcgatccgctagcgctacgcgagttcaaagaatttgcggctggccgccgcagtgtctcaggtgacctgatacttgaaattggaaagctcccacaacatctaacgcaacgcgctcagaacgctctagacaacctagtgatgctgcataattccgaacaaggcggtcgggcctacaggcacgcgatggaagaactcccggacacgatagagacgttgatgttactggcactcatagccgtcttgaccggcggagtaacactattcttcctgagtggacgaggactcggaaaaacaagcataggactactctgcgtcgtcgcgagcagcgtactcttatggatggcgagtgtggaaccacactggatagccgcctcaataatcctcgagttcttcctaatggtcttactcataccggagcctgacaggcaaagaaccccacaagataaccagctcgcatatgtggtgataggactactcttcatgattttaactgtagcagccaacgaaatgggactgctcgaaaccacaaagaaagatcttggaataggacacgtggccgttgagaaccaccaccacgcggccatgttggacgtggacctacaccccgcgagcgcctggacgctctacgccgtagccacgacgatcattacacccatgatgcgccacacaatcgaaaacacaaccgcaaacatctccttgacggccatagcaaaccaagccgcaattctcatgggcctcgacaagggctggccgatctcgaagatggatattggagttcccctgctggcattaggatgttactcgcaagtaaacccgctgactctgaccgccgcagtgctgatgctcgtcgcgcattacgctataatcggcccaggcctgcaggccaaagcaacgagagaggcgcagaaacgaacggctgcagggataatgaagaacccgaccgtcgacgggatagtagcaattgaccttgaccccgttgtctacgacgccaagtttgagaaacagctgggccagataatgctcctaattctgtgcacaagccaaatattacttatgcgaaccacatgggcactctgtgagagcataacgctggcaacggggcccctgaccacactctgggaagggtctccagggaaattctggaatacaaccatagccgtaagcatggccaacatcttccgcgggtcctacttggcgggcgccggattggcattcagcctcatgaaatctctgggcggagggcgacgcggcacgggagcacagggcgagacactcggagagaagtggaagcgacaacttaaccaattatcaaaatctgagttcaatacgtataagcgatccggaataatggaagtcgatcgcagcgaggcaaaggagggccttaaaagaggggaaaccacgaaacacgcggtcagccgaggcaccgcaaagctcaggtggttcgtcgagcgaaacctcgtaaaaccagagggaaaagtcattgaccttggctgtggcaggggtgggtggagttactactgtgccggactcaagaaagtgacggaggtgaaaggatacaccaagggcgggcccggacacgaggagccaatccctatggccacctacgggtggaacctcgtgaaactccacagtggcaaggatgtcttcttcatacccccagaaaagtgcgatacactactatgcgacatcggagaaagcagtccaaatccgactatagaggaaggacggactttgcgcgtactaaagatggtagagccgtggctacggggcaaccaattctgcatcaaaatactaaatccttatatgccatcggtagttgagactctcgaacagatgcagcgcaagcacggaggaatgctagtacgcaacccactaagccgcaactctacccatgaaatgtactgggtaagctgcgggacggggaatattgtatccgcagtcaacatgaccagtcgcatgctgctcaaccggttcaccatggcacaccgcaagcccacgtatgagaaagacgtagacttgggtgctggaacccggcatgtagctgtagagccagaggtagcaaacctcgacatcatcggccagaggatcgaaaacatcaaacacgaacacaagtcgacgtggcactacgacgaagataacccgtacaagacgtgggcttaccacgggagctatgaagtgaaacccagcggctcagcctcgtccatggtaaacggcgtcgtcaaactactcacaaagccctgggacgtcattccaatggtaacccaaatcgcaatgaccgataccaccccgttcggccagcaacgggtattcaaagaaaaagtcgacacccgcacgccgaaggccaagcgggggacggcccagataatggaagtcacagccaagtggctctggggctttctgagccgaaacaagaaaccgagaatatgcacacgcgaggagttcacccgaaaagtcaggagcaacgcagcaattggtgccgtatttgtagatgaaaaccagtggaacagcgcgaaggaagcggtcgaggatgagaggttctgggatctggtacaccgagagcgcgagctccacaaacagggaaagtgcgccacgtgtgtatacaacatgatgggcaaaagggagaaaaagctaggtgagttcggcaaggctaaagggtcacgtgcaatttggtacatgtggctgggggctcggttcctcgagttcgaggccctcggcttcatgaacgaggaccactggttttcgcgggagaacagccttagcggagtagaaggtgaaggattacacaaactagggtacatattaagggacatatctaagataccagggggaaacatgtacgcggacgacactgcgggttgggacaccaggataaccgaagacgatctacaaaatgaggcaagaatcaccgacatcatggagccggagcacgccctactcgccaaaagcatcttcaaactcacctaccaaaacaaggttgtaagagtccagcggccggcaaagaatggaaccgttatggatgtgatctcgcgacgtgatcagcgaggctctggtcaagtcgggacctacggcctgaacactttcacgaacatggaggcacaactaatccggcaaatggaatccgaagggattttcagcccatcagaactcgagacacccaacctggcggaaagagtgctggattggctcaagaaatacggggtggaacgtctaaagaggatggccatctcgggcgacgactgtgtagtgaaaccaatcgacgaccgattcgcaacagcactgacggcactaaacgatatgggtaaggtaagaaaggatatcccacagtgggagccctcgaagggctggaatgattggcaacaagtgccgttctgctcacatcatttccatcaacttatcatgaaagacggtcgcgaaatagtcgtcccatgccgaaatcaggacgagctagtagggcgcgccagagttagccagggggctggctggagccttcgggagacagcatgcctaggaaagagctacgcacaaatgtggcagttaatgtactttcaccggagagacttaaggttagcggcgaacgcgatatgcagtgccgtgcctgtagattggatacctaccagtcgcacaacgtggagcatacatgcccatcaccaatggatgacaaccgaggatatgttatcagtatggaatagagtctggatcgaggagaacccgtggatggaagacaagacccacatatcttcctggggcgacgtgccttacctgggaaaacgagaggaccaatggtgcggctcactcattgggctgaccgcacgagcgacatgggctacgaatatacaggtagcaatcaaccaagtcaggcggttaattggcaacgaaaactatctcgattacatgacgagcatgaaaagatttaaaaacgagggggacccagaaggagccttgtggtga

SEQ ID NO: 24560 - RNA, 9879 nt, synthetic construct
  misc_feature 1..9879: note = derived and/or modified CDS sequence (opt11) from DENV-1__EU482480__SS-prME
  source 1..9879: mol_type = other RNA
agtgtgaccatgctgctcatgctgatgcctaccgcccttgccttccacctgacgacccgggggggggaaccccacatgatcgtgagcaagcaggagcggggcaagtcgctgctgttcaagacctcggccggggtgaatatgtgcacgctaattgccatggacctgggtgagttctgcgaggacaccatgacctacaagtgcccgcggatcaccgaggccgaacccgatgacgtggactgctggtgcaacgcaaccgacacgtgggtcacctatgggacatgcacccagatcggcgagcaccggcgcgacaagcgaagcgtggccctggcgccacacgtgggactcggcctagagacgcgtaccgagacctggatgagcagcgaaggcgcatggaagcagatccagagggtcgagacctgggccttgcgccaccccgggttcacggtgatcgccctcttcctggcgcacgcgatcggcacatctatcactcagaaggggatcatctttatcctgctaatgctagcgacacccagtatggccatgcgatgcgtgggcattggcagccgcgacttcgtagaggggctgtccggcgccacgtgggtggacgtggttctcgagcacgggtcctgcgtgaccaccatggcgaaggacaagcccacccttgacatcgagctgctcaagacggaggtaaccaaccccgccgtcctgcggaaactgtgcattgaggccaagatctcgaacaccaccacggactcccgctgcccgactcaaggagaggccaccctcgttgaggagcaggacgcaaacttcgtgtgtcggcgcactttcgtcgaccggggctgggggaacggctgcggccttttcggcaaggggagcttgataacgtgcgcgaagttcaagtgcgtgaccaagctcgaaggcaagatcgtgcagtacgaaaatttaaagtactccgtgatcgtaaccgttcacaccggcgaccagcaccaggtcgggaacgagtcgacggagcacggcacgatcgcaaccatcacgccccaggccccctccaccgagatccagctgacggactacggagccctcaccctggactgcagcccccgcaccggcctggacttcaacgagatggtgctcctgaccatgaaggaaaagtcgtggctggtccacaaacagtggttcctcgacctgccgctgccttggacgagcggggccagtacctcccaggagacctggaacagacaagacctcttggtgactttcaagacggcgcatgccaaaaagcaagaggtagtcgtgcttggcagccaagaaggtgcgatgcacactgccctcaccggggctaccgagattcagacgtccggcaccaccacgatcttcgcggggcacctgaagtgccgcctgaaaatggacaagctcacgctgaagggcatgagctatgtgatgtgcaccgggtccttcaaacttgaaaaggaggttgccgagacccagcacggcaccgtgctcgtgcaaatcaagtacgagggcacggacgccccctgtaagatcccattcagcactcaggacgagaagggggtcacacagaacggccggctcatcaccgccaacccgatcgtgacggacaaggagaagcccgtgaatatcgaggcggaaccaccctttggggagagttacatcgtcatcggcgccggcgagaaggccctgaagttaagctggttcaagaaggggtccagcatcggcaagatgttcgaggccaccgcccgcggggcgcggcgcatggcgatactcggcgacaccgcctgggacttcgggtccataggcggcgtgttcaccagcgtggggaagctggtccaccagatatttggcacagcctacggtgtgctgttttccggcgtgagctggaccatgaagatcgggatcggcgtcctcctgacctggctgggcctcaactcccgcagcacctccctgagcatgacatgcatcgccgtggggctggtgactctctacctgggcgtcatggtccaggcagactccgggtgcgtcatcaactggaagggccgggagctgaagtgtgggagcggcatatttgtcactaacgaggtgcacacgtggacggagcagtataaattccaggccgacagccctaagcgcctctcagccgcgatcggcaaggcctgggaggagggagtgtgcggtatccggagcgcgacccgcctggagaatatcatgtggaaacagatctcaaacgagctaaaccacatcctcctggagaacgacatgaagctgaccgtagtggtgggggacgtcgccggcatccttgcccaggggaagaagatgatccggccccagcccatggagtacaagtacagctggaagatttggggcaaggccaagatcatcggagccgacgtgcagaacacaacctttatcatagacgggcccaacacgccagaatgccctgatgaccagcgcgcgtggaatatctgggaggtggaggactacggcttcgggatctttacaaccaatatctggctgaagctgagagactcctacacccaggtctgcgaccaccggctcatgagcgcggccatcaaggattccaaggccgtgcacgcggacatggggtattggattgagagcgagaagaacgagacgtggaaactggcccgtgcctccttcatagaggtgaagacctgcatctggcccaaaagccacaccctgtggtccaacggcgtcctagagtcggagatgatcatccccaagatctacgggggcccgatctcccagcacaactatcgccccggttactttacccagacggccggcccgtggcacctggggaagctggagctcgactttgacctgtgcgagggaaccaccgtggtagtcgacgagcactgcggcaaccgggggccgagcctacgcaccactaccgtgaccggaaagatcatccacgaatggtgttgccggtcctgcacgctaccccccctccggtttaagggggaggacggctgttggtacgggatggagatccgacccgtgaaggagaaggaggagaacctcgtcaagagcatggtgtcagcaggctctggcgaggtggacagcttctccctcggtctgctgtgtatcagcatcatgatcgaggaggtcatgcgctcccgatggagccgcaagatgctcatgacgggcaccctggctgtgttcttccttctcatcatgggacagctgacatggaatgacctgatccgactgtgcatcatggtgggcgccaacgcctccgaccgcatggggatgggcacgacgtacctggcattgatggccaccttcaaaatgcggccgatgttcgcggttggattgctattccgtcgcctgaccagtcgggaggtgctcctgttaacgatcgggctctccctggtcgccagcgtcgagctacccaacagtctggaggagctgggcgacgggctggcgatgggcataatgattctcaagctattaacagattttcagagccaccagctctgggcaaccctgctgtccctcacattcatccgcacgacgttcagcctgcactacgcgtggaaaaccatggccatggtgctgtccattgtcagcctcttccctctgtgcctgtccactaccagccagaagacgacctggctccccgtgttactcggatccctcgggtgtaagcctctgaccatgttcctgatcgccgagaacaagatctggggccggaaatcctggcccctcaacgaggggataatggccgtgggcatcgtctctatcctgctgagcagcctcctgaagaacgatgttcccctcgccgggcccctcatcgcgggcggcatgctgattgcctgctacgtgatctcagggagctccgccgacctgagcctcgaaaaggccgctgaggtctcctgggaggaggaggccgagcactccggagcctcccacaacatcctggttgaggtgcaggacgacgggaccatgaagatcaaggacgaagagcgagacgacacgcttacaatcctcctgaaggccaccctgctcgccgtcagcggggtgtacccgctgtccatacccgctactctgttcgtgtggtatttctggcagaagaagaagcaaagatctggtgttctctgggacacccccagcccccccgaggtggagcgcgcggtgttagatgatggaatctaccggatcatgcagcgcggactgctggggaggagccaagtcggagtcggggtgtttcaggagaacgtctttcacacaatgtggcacgtgacccgcggcgcggtgctcatgtaccaggggaagcggctggagccctcatgggccagcgttaaaaaagatctgatcagttatggcggcggatggcgactccagggcagctggaacaccggggaggaggtccaagtcatcgctgtggagcccggcaagaaccctaagaacgtgcagacggcccccgggacgttcaagacctccgagggcgaggtgggcgcgatcgccctggacttcaagcctgggaccagcggcagccccatcgtcaaccgggagggcaagatcgttggtctgtatggcaatggggtggtaaccactagcggcacctacgtgagcgctatcgcccaggcaaaggcctcccaggaggggcccctcccggagatcgaggacgaggtgttcaggaaacggaacctgaccatcatggacctgcaccccggcagcgggaagacccgccggtaccttcccgccatcgtccgcgaggccatcaagcggcgcctgcgcaccctgatactcgcccctactcgagtggtcgcgagtgagatggccgaggcactgaagggcatgccgatccgatatcagactaccgccgttaagtcagaacacacggggaaggaaatcgtggatctgatgtgccatgccacgttcactatgagactactgtcccccgtccgtgtccccaactacaatatgatcataatggatgaagcacacttcacagaccccagctccatcgctgcccggggttacatcagcacgcgcgtgggaatgggggaggccgccgcgatattcatgactgccacgcctcccggctccgtggaggccttcccccaaagcaacgccgttatccaggacgaggagcgggacatcccggaacgctcctggaacagcgggtacgaatggatcaccgacttccccggcaagacggtgtggttcgtgccctccatcaagagcggcaacgatatcgcgaactgcctgcgaaagaacggcaaacgcgtcatacagctctcccgaaagaccttcgataccgagtaccaaaagaccaagaacaacgactgggactatgtggtgacgaccgatataagcgagatgggcgctaactttcgcgccgaccgggtaattgacccccgccggtgcctgaagccggtgattctgaaggatgggcccgagcgcgtgatcctcgccggccctatgcctgttactgtggcatccgcggcccagcggcgggggcggatcggccgcaatcacaacaaagagggcgatcagtacatctacatggggcagccgctaaacaacgacgaggaccacgcccattggacggaggccaagatgctgctcgacaacattaatacgcccgagggaatcatccccgccctgtttgagcccgaacgagagaagtccgcggccatagatggcgagtaccggctgcgtggcgaggcccggaagacattcgtggaactcatgcgaaggggggacctgccggtgtggctgtcctacaaggtcgccagcgagggcttccaatactctgataggaggtggtgcttcgacggcgagcgcaataaccaagtactcgaggagaacatggacgtcgagatctggaccaaggagggggagaggaagaagctgcgcccccggtggctggacgcccgcacctactccgaccccctagcgctgcgggagttcaaggagttcgccgccggtcgccggagcgtgtcgggggacctgatactcgaaatcggcaagctgcctcagcacctaacgcagcgcgcccagaacgcgctcgacaacttggtaatgctgcataacagcgaacagggcggacgggcctaccgccacgctatggaggagctcccggacaccatcgagaccctgatgctgctcgccctgatcgccgtgctgactggcggggtgaccttattctttctgtccggccgaggtcttggcaagaccagcatcggcctcctgtgcgtcatggcgtccagcgtgttgctctggatggcctccgtggagccccactggatcgccgccagtatcatactggagttcttcctgatggtcctcctgattccagagcccgaccgccagcggaccccgcaggacaaccagttggcctacgtcgtgatcgggttacttttcatgattctgacagtagcggccaacgagatgggcctcctggagaccacgaagaaggacctggggatcggccatgttgccgtggaaaaccatcaccacgccgccatgctcgacgtcgacctacacccagcgtccgcctggaccctctacgcagtggcaacgaccataatcacgcccatgatgcgccacaccatcgagaacaccacggccaacatcagcctcacggcgatcgcaaaccaggccgcgatactgatggggctggacaagggctggccgatcagcaagatggacatcggcgtacccctcctggccctggggtgctacagccaggtcaaccccctcaccctgactgccgcagtgctgatgctcgtggcccactatgccataataggcccggggttacaggccaaagctacccgcgaggcccagaagcggacggccgccggcatcatgaagaaccctaccgtcgatgggatcgtggcgatcgacctggatccggtggtctacgacgccaagttcgagaagcaactcggccagatcatgctgctgatcctctgtacctcccaaatcttgctgatgagaaccacttgggccctctgcgagtcaatcaccctagccaccggccctctgacgacgctatgggaggggtcccccggcaagttctggaacaccaccatcgctgttagcatggcgaacatatttcgggggtcctacctggccggcgccggcttggccttcagcctcatgaagtccctcgggggcggtcgccgggggactggtgcacaaggcgagacgttaggagagaagtggaagcgccagctgaaccagttatcaaaaagcgagtttaatacctacaagcggtccgggattatggaggtagatagaagcgaggcgaaggagggcctaaagcgcggagagaccacaaagcatgccgtctcccgcggcactgccaagctccggtggtttgtggagcgcaatctcgtgaagcccgaggggaaagtcatagacctgggctgtggtcgcggcgggtggagctactactgcgccgggctcaagaaggttacagaggtcaagggatataccaagggcggccccggccacgaggaacccatccccatggccacctacggctggaacctcgtcaaactgcattctggcaaggatgtgttcttcatcccacccgaaaagtgcgacacgctgctctgcgacattggggagagcagtcctaacccgaccatcgaagaaggccgcacgctacgtgtcctgaagatggtcgagccgtggctccgcggaaaccagttctgcatcaagatcctgaacccctacatgccctctgtggttgagaccctggagcagatgcagcggaaacacggcggcatgcttgtccgcaacccattatcccggaactccacgcatgagatgtactgggtgtcctgcgggacaggcaacatcgtgtcggcagtcaacatgacctcccgcatgctgttaaaccgcttcaccatggcacaccggaagccgacctacgagcgcgacgttgacctgggggccggaacgcggcacgttgccgtcgagccagaggtggcgaatctcgacatcatcggccagcgcattgagaatatcaagcacgagcataaatctacctggcactacgacgaggacaacccatacaagacctgggcctaccacgggtcctacgaggtcaagcccagcggctccgccagcagcatggtcaatggagtcgtcaagctcctgaccaagccgtgggacgtgatccccatggtgacgcagattgccatgaccgacacgactcccttcggacagcaacgggtcttcaaggagaaggtggacacgcgcacccccaaggccaagcgtggaacggctcagatcatggaggtcaccgccaaatggctctggggcttcctctccaggaacaagaagccgcggatctgcacgcgcgaggagtttacgagaaaggtacgcagcaacgccgccatcggcgcggttttcgtggacgaaaaccagtggaattccgccaaggaggccgtcgaggatgagcggttctgggacttggtgcaccgcgagcgggagctgcacaagcagggaaagtgcgcgacctgcgtgtacaacatgatgggcaagcgcgagaagaagctaggtgagttcggcaaggccaagggatcccgggccatctggtacatgtggttaggcgcacgcttcctggagttcgaggccctcggcttcatgaacgaggaccactggttctcccgggagaacagcctgtccggtgtcgagggtgaggggctgcataagctgggctacatcctgcgcgacatcagcaaaatccccggtggcaatatgtacgccgatgacaccgcaggctgggatacgcggataaccgaggacgacctgcagaacgaggcgaagatcaccgacatcatggagcccgagcacgccctcctggccaagtccatctttaaactgacctaccagaacaaggtggtgagggtccagcgcccggccaagaacggtactgtcatggacgtgatctctcgccgcgaccagcggggatccgggcaggtcggcacctacggcttaaacaccttcaccaacatggaggcccagttgatcaggcagatggaaagcgaggggatcttctccccaagcgagctggagacgcccaacctcgctggccgggttctggactggctggagaagcacggggtggagcgcctcaaacggatggccatatccggcgacgactgcgtcgtgaagcccatagacgaccgcttcgcgaccgccttaaccgcgctcaacgacatggggaaagtgaggaaggatatcccgcagtgggagcccagcaagggctggaacgactggcagcaggtcccattctgttcccatcacttccaccaactcatcatgaaggacggccgcgagatcgtggtgccctgtcgcaaccaggacgagctggtcggccgcgcgcgggtgagccagggcgccggttggtcactgcgcgagacggcctgcctcggcaagtcctacgcacagatgtggcagcttatgtacttccaccggcgcgacctgcggctcgcggccaacgccatctgcagcgccgtgccggtcgactgggtgcccacgtcccgcacgacctggagcatccacgctcaccaccagtggatgaccacggaagacatgctgtccgtgtggaaccgggtgtggatcgaggaaaacccatggatggaggacaagacgcacgtgagctcctggggcgacgtgccctacctgggcaagcgcgaggatcagtggtgcggcagcctcatcgggttaactgcccgtgccacctgggccacgaacattcaggttgcaatcaaccaggtgaggcgcctgctcggcaatgagaactacctggactacatgacctccatgaaacggttcaagaacgaaagcgatccggagggtgcgctgtggtga

SEQ ID NO: 24561 - RNA, 9879 nt, synthetic construct
  misc_feature 1..9879: note = derived and/or modified CDS sequence (opt11) from DENV-1__EU482481__SS-prME
  source 1..9879: mol_type = other RNA
tccgtgaccatgctgctcatgttaatgcctaccgcgctggccttccatttgaccacgcgggggggggagccccatatgatcgtgaccaagcaggagcggggcaaatccttgcttttcaaaaccagcgccggggtcaatatgtgcacgcttatcgccatggacttaggcgagctttgcgaagacaccatgacctacaaatgcccccggatcaccgaggccgaaccagacgacgtagactgttggtgcaatgctaccgatacatgggtgacctatgggacgtgctcccagacgggcgagcatcggcgcgacaagagaagcgtggccttggcgccacacgttggtctgggattagagacccgcactgagacttggatgtcctcggagggagcctggaaacaaatccagagagtggagacgtgggcactgcgtcaccccgggttcactgtcattgccctgttcctggcgcacgctattggcacgagtatcacgcagaagggtatcatattcatcttgttaatgcttgtgacgccgagcatggctatgcgttgcgtaggcatcgggtctcgcgacttcgtggagggccttagcggcgccacttgggtggacgtcgtgctggagcacggctcctgcgtaacgacaatggctaaggataagcctacgctggacatcgaactcctcaagaccgaggttaccaacccggcggtgctgcggaagctctgtatcgaggcgaagataagtaacacgacgaccgactcacgctgtcccacccagggcgaagcgaccctgatggaggaacaggacgccaactttgtctgccggcgcacattcgtcgaccggggctgggggaacggctgcgggctcttcgggaagggttcacttatcacgtgtgccaagttcaagtgtgtgacaaaattggaaggcaaaatagtccagtatgaaaacctgaagtacagtgtcatcgtgaccgtgcacacgggcgaccagcatcaggtcgggaacgagtcaaccgagcacggcactaccgctacgatcacaccccaggcccccacctccgagatacagctcaccgattacggggccctgaccctggactgcagcccgcgcacgggcttagacttcaacgaaatggtgttactgacaatgaaagagaagtcatggttggttcacaaacagtggttcctagacctgcctctaccttggacctctggggcgtcgacctcccaggagacctggaaccggcaggatctgctggtgacgttcaagaccgcgcacgctaagaagcaagaggtggtcgtgctcgggagccaggaaggagccatgcacaccgccttaaccggcgccactgagattcaaacatccggaaccacgaccatcttcgcggggcacctgaagtgccgattgaagatggacaagctgaccttaaagggcatgtcctacgtgatgtgtaccgggtccttcaagctcgagaaggaggtcgcggagacgcagcacggcaccgtcctggtacagatcaagtacgagggcaccgatgcaccctgtaagattccattctctacccaggacgagaagggcgtcacgcagaacggcagactgataaccgcaaacccgatcgtcacggacaaggagaaacctgtgaatatcgaggcagagccgccctttggggagtcctacatagtaatcggcgcgggggagaaagcgctgaagctcagctggttcaagaagggaagcagcatcggcaagatgttcgaggccacggcccgcggggcaaggcgcatggctatcttaggagacacggcctgggacttcgggtccgtagggggcgtgtttactagcgtgggtaaactggtgcaccaaatcttcggtacagcctatggcgtactgttctccggcgtctcgtggacgatgaaaatcggaatcggagtgctgttaacttggctagggctgaactcccgcagcacctcgctaagcatgacctgcattgccgtgggactcgtgacactgtacctgggggtaatggttcaggccgattccgggtgcgttatcaactggaagggtcgggagctcaagtgtgggtctggcatctttgtcacgaatgaggtgcacacctggacggagcagtacaagttccaagcagactcgcctaagcgcctgtcagccgcaataggaaaagcctgggaggagggagtctgtggcatacggagtgccactcggctcgagaacatcatgtggaagcagatctccaacgaactcaaccacatactgctggagaacgacatgaagttcaccgtggttgttggggacgttgtgggcatactcgcgcaagggaagaagatgattcggccccaacccatggagcacaagtatagttggaagtcctggggcaaagcgaagattatcggcgctgacgtccaaaacacgacattcattatcgacggacccaataccccggaatgccccgacgatcagcgcgcatggaacatctgggaggtggaggactacggatttggaatctttactacgaacatctggctgaaactgagggacagctacacccaagtttgcgaccaccgtctcatgtcagcggccattaaggacagcaaggccgtacacgcagacatgggctactggattgaatccgagaaaaacgagacgtggaagctcgcccgggcgtcttttatagaggtgaagacttgcatctggccaaaatcccacaccctgtggagcaatggcgtgctcgagtccgaaatgattatccccaagatctacgggggcccgataagccagcacaatcaccggcccggctactttacccagacggccgggccctggcacttgggtaagctagagctcgactttgacctgtgcgagggcacaactgtcgtggtggacgagcattgcgggaatcggggcccgtccctgagaacgacgaccgtcacaggtaagatcatacatgagtggtgttgccgaagctgcaccctaccacccttgcgctttaagggggaggatgggtgctggtacggtatggagattcggcccgtaaaggagaaggaggagaatctggtcaaatccatggtctcagccggctcgggtgaggtggactccttcagcttaggactcctgtgcattagtatcatgatcgaggaggttatgcggtcacggtggtcacgcaagatgctcatgaccggcacactggcagtgtttctgctcctgataatgggtcagctcacgtggaacgacctcatccgtctgtgcattatggtaggcgccaacgcttcggaccgcatggggatgggcaccacttacctggccctcatggccacatttaagatgcgccctatgttcgccgttggcttgctgttccggcgcctcacgagccgggaggtcctgctgctcaccatcggcctgtcgctggtagcgtccgtcgagctccccaatagcctggaggagctcggtgacggtctcgcaatgggtatcatgatcctgaagcttctcacggacttccagtcccatcagctgtgggcaaccctgctcagcctgacattcattaagacaacgctctccctccattatgcttggaagacaatggccatggtgctgagcatcgtatcgttattcccactatgcttaagcaccacctcccaaaaaaccacgtggctgcctgttctactggggagcctggggtgtaagccgctcacgatgttccttatcaccgagaacaagatatggggacgcaagtcctggcccttaaatgaagggatcatggccgtgggcgttgttagcatcctcctgagctcgttgctcaagaacgatgtgcccctagccgggcccctaatcgccggcggcatgctcatcgcatgctacgtgatcagcgggtcctccgccgatctgtcccttgagaaggcggcggaagtcagctgggaggaggaggcggagcactcaggcgccagccacaacatcttagtggaggtgcaggacgacggaacgatgaagatcaaggacgaggagcgggacgacaccctgactatcctgctcaaagccaccctccttgcggtgtcgggtgtgtacccgctcagtatacccgcgaccctctttgtttggtacttttggcaaaagaaaaagcagcgctccggggtcctgtgggataccccctctccccccgaggtagagagggcggtgctagacgacggaatctaccgcatcatgcaacgcggcctgctgggccgcagtcaggtcggcgtaggtgtgtttcaggagaacgtctttcacaccatgtggcacgtaactcgaggcgccgtattaatgtatcaggggaagcgcctcgagcccagctgggcgtcggttaagaaggacctgatatcttacggtggaggttggcgtctgcagggctcatggaacaccggcgaggaagtccaggtgatcgcggtggagccgggcaaaaaccccaagaatgtccaaaccgcccccggaacttttaagacgccggagggtgaggtgggcgccatcgccctcgatttcaaacctgggacctcaggttcccccatagtcaatcgcgagggtaagattgtaggcctgtacggtaacggagtcgtgactacaagcggcacgtacgtgagcgcaatcgcgcaggcaaaagccagtcaggaagggccactacccgagatcgaggacgaagtgtttcggaagcgaaacctgaccatcatggacttgcaccccggcagcgggaagacacgtcgttacctgccggccatcgtccgggaggcgataaagcgtaagctgcggacgctgatccttgcgcccacgcgggtggtggcctctgagatggccgaggcactcaagggcatgcccatccggtaccagacgaccgctgtgaagagtgagcacacaggaaaggagattgtggacttaatgtgccacgcaacgttcacaatgcggctactctcccccgtgcgggttcctaactacaatatgattataatggacgaagcccatttcaccgaccccagctccatcgccgcccggggatacatcagcacgcgcgtgggcatgggggaggcggccgccatcttcatgaccgccacgccgccaggatccgtggaggccttccctcagtcaaatgcggtcatccaggatgaagaacgggatatccccgagaggtcttggaacagtgggtacgagtggatcaccgacttccccggcaaaaccgtgtggttcgtgccctccattaagtccggcaacgatattgccaattgtctccggaagaacgggaagcgcgtgatccagctgtcccggaagacgttcgataccgagtatcagaagaccaagaacaacgattgggactatgtcgttaccaccgacataagcgagatgggcgcgaactttcgcgccgaccgggttatcgacccgaggcgctgcctcaagcctgtgatcctgaaggacgggcccgaacgcgtgatcttggcgggccccatgcccgtgaccgtggcctccgccgcccagcggcgcggtcggatcggccgcaaccacaataaggagggcgatcaatacatctacatgggccagcccctcaacaacgacgaggaccacgcacactggaccgaagcaaagatgcttctggataacatcaacacaccagagggcatcatccccgcgctgttcgagccggagcgggagaagtccgctgccatcgacggggaataccgcctgcgcggagaggccaggaagacgtttgtggaactgatgcgcaggggcgacttaccggtgtggctgtcctacaaggtggcgtccgaagggttccagtactctgaccgccggtggtgcttcgacggagagcgcaacaatcaggttctggaggagaacatggacgtggagatctggactaaggaaggggagcgtaagaagctccgcccccggtggttagacgcacgaacctattcggatcctctggccctccgggaatttaaagagttcgccgctggccgccgatcggtgtctggggacctgatctcggagatcggcaagttaccgcaacacctaacccagcgcgcgcagaacgcgttggacaaccttgtgatgttgcacaactcggaacagggcggacgagcctaccgccatgccatggaggagcttcccgacaccatcgagacgttaatgttactggcgctgatagctgtactaacaggaggggtaactctgttcttcctgagcggacgggggctaggcaagacctccattggactactgtgcgtcatggccagctccgtcctcttgtggatggcaagcgtcgagccccattggattgccgcaagtatcatactggagtttttcctcatggtcttgctgataccggagccggatcgacagcggacgccacaggataaccaactagcatacgtggtgatcgggttgctgttcatgattctcaccgtcgccgccaacgagatgggtttgctggagaccacgaagaaggacctcggcattgggcacgtagccgtagagaaccaccaccatgcaacgatgctggatgtcgacttacaccccgcgtctgcctggaccctgtacgccgtggccaccaccataatcacgcctatgatgcgccacacaatcgagaatacaactgcgaacataagcctgacggctatagccaaccaggcggctatactgatggggctcgataaaggatggcctatctccaagatggatatcggcgtgccgctattagcgctcgggtgctactcccaggtgaaccccctgacactgaccgccgccgtgctcatgctggtggcgcactatgccataattggccctggtctgcaggccaaggcaacccgcgaggcccaaaaacgcacggccgccggcataatgaagaaccccaccgtagacggtatcatagcaatcgacctcgaccccgtggtttacgacgccaagttcgaaaaacagctggggcagatcatgttactcatcctgtgtaccagccagatcctgctcatgcgcaccacttgggctctctgtgaatccatcaccttagccaccggccccctgaccaccctgtgggaggggagcccaggcaaattctggaatactaccatcgcggtgagcatggccaacatcttccgggggtcctacctggccggcgccggcctcgccttcagcctcatgaagtccctcgggggcgggcgccggggaaccggagcccagggcgagacattaggagagaagtggaagcgccagctgaatcagctgagtaaaagtgagttcaatatctataagcggtccggaattatggaggtggaccgcagtgaagcaaaagagggtctcaaaagaggggagacaacccgccacgccgtgtcgcggggaacggccaagctgcgctggttcgttgagcgaaatctggtgaaacccgaagggaaggtgatcgacctgggctgcggccgcgggggctggtcatactattgcgcgggattgaagaaagtcacggaagtgaaggggtacacaaagggcgggcccggccacgaggagcccatacctatggccacgtacggttggaacctggtcaagttgcattcgggcaaggacgtcttcttcaccccacctgagaagtgcgacacgctgctatgcgacatcggggaatccagccccaatccgacgatcgaagagggtcgcaccctcagagtgctcaaaatggtagaaccctggcttaggggtaaccagttctgtatcaagatcctgaacccctacatgccttcggtcgtagagaccctcgagcagatgcaaagaaagcacggaggcatgctggtgcggaacccgcttagtcgaaactccacccacgaaatgtactgggtgagctgcggaacgggcaacattgtatccgccgtaaacatgaccagccggatgttactaaatcgatttaccatggcccaccgaaagcctacctacgagcgggacgtggacctgggggcaggcacgcggcatgtggcggtggaaccagaggttgccaacctggacatcatcggccagcggatcgaaaacatcaagcatgagcacaaatccacctggcactatgacgaagacaatccctataagacctgggcgtaccacgggtcctacgaagtgaagccatccggcagcgctagctccatggtcaacggggtagtgaagctgctgaccaagccatgggacgtgatcccaatggtaacacagattgccatgaccgacaccacgcccttcggccagcagcgggtgttcaaagagaaagttgacacgcgtaccccgaaggcgaagagggggaccgcgcagatcatggaggtgaccgcacggtggctctggggcttcctgagccgcaacaagaagccccggatctgcacgagggaagagtttacccggaaggtgcgctcgaacgccgctataggagcggtcttcgtagacgagaaccaatggaacagcgccaaagaagccgtggaggacgagaggttctgggacctggtccaaaaggagcgagaactccacaagcaagggaagtgcgcaacctgcgtgtacaacatgatggggaagagggagaagaaactcggggagttcggcaaggctaaggggtctcgtgccatctggtacatgtggctgggcgcccggtttctagaattcgaagccctgggctttatgaatgaggaccactggttcagccgcgagaactccctgagcggggtggagggcgagggcttgcataaactgggctacatcctgcgcgacatctccaaaatacccgggggcaacatgtacgccgacgacaccgctggttgggatacgcgcataactgaggacgatctccagaacgaagccaagatcaccgatatcatggagccggaacacgccttactggctacttcgatcttcaagctcacatatcagaacaaggtcgtgagggtacaaagaccagccaagaacgggaccgtaatggatgtgatttctagaagggaccaacgcggcagcgggcaggtgggcacctacggcctgaacaccttcacgaatatggaggctcagctgatcaggcagatggaatccgaggggatctttctccccagcgaactggagacccccaacctggcggaacgcgtcctagactggctggagaagtacggggtggaacggttaaagaggatggcgatatccggagacgactgcgtggtcaagccgattgacgaccgattcgccaccgccctcacggcattaaacgacatgggaaaggtgcgcaaggacatcccccagtgggagccgagcaagggatggaacgactggcagcaggtcccattttgctcccatcattttcaccaactgataatgaaggacggccgggaaatcgtcgtgccatgccgtaatcaagacgagctcgtgggtcgggccagggtaagccagggagccggctggagccttcgggaaacagcctgcctggggaagtcctatgctcaaatgtggcagctcatgtacttccatcgtcgcgacctgcgactggcggccaacgccatatgctcagccgttccggttgactgggtacccaccagccggaccacatggagcatccatgctcatcaccagtggatgacgacggaagacatgctgagcgtatggaaccgcgtgtggatcgaggagaatccctggatggaagacaagacacacgtgtcctcgtggggcgacgtgccttacttaggaaagagggaggaccagtggtgcggctccctgatcggtcttactgcccgcgctacttgggcctctaacatccaggtggccatcaatcaggtcaggcggcttatagggaacgagaactacctggactacatgaccagtatgaaaaggttcaagaatgaaggcgaccccgagggggcactttggtga

SEQ ID NO: 24562 - RNA, 9879 nt, synthetic construct
  misc_feature 1..9879: note = derived and/or modified CDS sequence (opt11) from DENV-1__EU482482__SS-prME
  source 1..9879: mol_type = other RNA
agcgtgaccatgttgctgatgttgatgcccaccgccctggcgttccacctcactactcgaggaggggagccacatatgatcgtcagcaagcaggaacggggcaagagcctcctgttcaagaccagtgccggggtaaacatgtgcactctcatcgcgatggacctgggcgagttatgcgaagatactatgacctacaagtgcccccggatcacggagaccgagcctgatgacgtggactgctggtgcaacgccactgacacctgggtcacctacgggacatgcagccagacgggcgaacaccggcgggacaagcggagcgtggccctggcgccccacgtgggtctggggctggagacccggacagagacgtggatgagctccgagggagcttggaagcagatccagcgggtagagacgtgggccctccggcaccccggattcaccgtgatcgccttattcctcgcccacgcgatcggaaccagcatcacccagaaggggatcattttcatccttttgatgttagtgacgcccagtatggccatgcgatgcgtcggcatcggtagccgcgacttcgtggagggcctctccggtgccacctgggtggatgtggtgcttgagcacgggagctgcgtaaccacaatggcgaaggacaaacccacgttagatattgagttgctgaagactgaagtaactaaccccgccgtgctccggaagctctgcatcgaggcgaagatctccaacaccacgaccgacagccgctgcccgacccagggcgaggccaccctggttgaggagcaggatgccaattttgtatgccggcgtacattcgtggataggggctgggggaatggctgcggtttattcgggaaggggtccctcatcacgtgcgctaagtttaagtgcgtgaccaagctagagggcaagatcgtccagtacgagaatctgaagtattccgttatagtgacggtccacacgggcgaccagcaccaagttgggaatgagtccactgagcacggaaccacagccaccatcacgccccaggcgccgaccaccgagatccagctaaccgactacggggctctgacgcttgactgcagcccccgcacgggcctcgacttcaacgagatggtcttactcaccatgaaagagaaatcgtggctcgtgcacaagcagtggttcctggacctgccactcccctggacgagcggtgccagcacctcccaggagacctggaatcggcaggacctgctggtgaccttcaagacggctcacgctaaaaagcaggaggtcgttgtgcttggcagccaagagggcgcgatgcacacggccctgaccggagcgaccgagatccagacctccggcacgaccaccatctttgctggtcacttgaagtgcaggctcaagatggataaactgaccctgaaaggcatgagctacgtcatgtgcacgggctccttcaagctcgaaaaagagcttgccgagacgcagcacggcaccgtactggtgcagataaagtacgagggcacggacgcgccctgcaagatccccttcagcactcaggacgagaagggggtgacccagaacggccggctgatcaccgccaacccgatcgtaactgacaaggagaagcccgtgaacatcgaggccgagccgcccttcggggaatcctacatcgtcatcggtgccggcgagaaggcgctgaagctgagctggttcaagaaaggatcctctataggaaagatgttcgaagccacggcccgcggtgcgcggaggatggccatcctgggcgacaccgcgtgggactttgggtccatcggcggcgtgttcacctcagttgggaagctcgtccatcagatcttcggtaccgcctacggtgtgctgttctccggagtgagttggacgatgaagattgggatcggagtcctgctcacctggctgggtctgaactcccgcagcacctccctcagcatgacttgcatcgccgtggggctggtgacgctctacttaggcgtcatggtccaggccgactcggggtgcgtgatcaattggaagggccgggagctgaaatgcggaagcggcatcttcgttaccaacgaggtgcacacctggactgagcagtacaagttccaggctgacagcccgaagcggctgtccgcggcaatcggtaaggcgtgggaggaaggggtgtgcggcatccggtcggctacccgcttggagaacataatgtggaagcagatcagcaacgagctgaaccatatcttactcgaaaacgacatgaaattcacggtcgtggttggggatgttgccggcatcctggcgcagggtaagaagatgatcaggcctcaacccatggagtacaagtacagctggaaatcgtggggaaaggccaaaatcatcggcgctgacgtgcagaacaccactttcatcatcgacggtcccaatacgccggagtgccccgacgaccaacgcgcttggaatatctgggaggtggaagactacggtttcggaatcttcacaaccaacatctggctgaaacttcgggacagctacacccaggtgtgcgaccatcgcctgatgtccgcggccatcaaagattcaaaagccgtgcacgccgacatgggatattggatcgagtcggagaagaacgagacctggaagctcgcccgggcgagcttcatcgaggttaagacatgcatttggcccaagtcccacactctctggagcaacggcgtcctcgagtccgagatgatcatccccaagatctacggtggcccgatcagccagcacaattaccggcccgggtacttcacgcagaccgccggcccctggcacctgggaaaactcgagctggatttcgacctttgcgaaggaacgaccgtggtggtcgacgaacactgcggcaaccggggcccgtccctgcgtacgacaacggtgaccggcaagataatccacgagtggtgctgccggagttgcacactgccgcccttgcgctttagaggggaggacggctgttggtacgggatggagatccgccccgtgaaggaaaaagaagagaacctcgtcaaatcgatggtgagcgccggaagcggcgaagtcgactccttctcgctgggcctgctctgcatctcgatcatgattgaggaggtcatgcggagccgctggtcccggaagatgctgatgaccggcacactggcggtatttttcctcctgatcatgggtcagctgacatggaatgatctcattcgcctgtgcattatggtaggggctaacgcgagcgaccgcatggggatgggcaccacgtaccttgcccttatggcaacgttcaaaatgcggccaatgttcgccgtcggcctgttatttcgcagactcacttccagggaggtgttattactcaccatcggcttgagccttgtggcctctgtcgagttacccaactctctggaagagttaggcgatgggctcgcgatgggtatcatgatcctgaagctgctcaccgacttccagagccatcaactgtgggccacactgctcagcttaaccttcataaagaccacattctccttacactatgcctggaagaccatggccatggtactctcaatcgtctccctctttcccctgtgcttgagcaccacgagtcagaaaacaacttggctccccgtgcttctcggcagcctggggtgcaagccgctgaccatgttcttaatcgcggagaacaagatctggggcaggcgctcctggcctctgaacgagggtatcatggccgttggtatagtgtcaatcctactctcttccctgctgaagaacgacgttcccctcgcggggcccctgattgccggcggcatgttgatcgcctgctacgtgatcagcggttcctctgcggacctcagcctggagaaggccgccgaagtcagctgggaggaggaggccgaacactcgggcgcatcccataacatcctggttgaagtgcaggacgatgggaccatgaagatcaaggacgaggagcgggatgacacactcaccatcctgctgaaagctacgttgctggccgtctccggcgtctacccgttgtctatccccgccacgcttttcgtgtggtatttctggcaaaagaaaaagcagaggtccggggtgctgtgggacacccccagccctcctgaggtcgaacgggccgtgcttgacgacggtatctatagaatcatgcaaagaggcctgctagggcgctcccaggtcggcgtgggagtgttccaggagaacgtcttccataccatgtggcacgtgacgcggggcgccgtgctgatgtaccaagggaagcgcttagagccaagctgggcgagcgtcaagaaggacctcatcagctacgggggtggctggcggctgcagggctcgtggaacaccggggaggaggtccaagtcatcgccgtcgaacccggcaagaacccgaagaacgtgcagaccgcccctgggaccttcaagacgcccgagggggaagtgggcgctatcgccctggatttcaagcccgggaccagcggctcccccatcgtgaacagggaagggaaaatcgtaggcctctatggcaacggagtggtcaccaccagcggcacgtacgtgtcagcgatagcccaggccaaggcctcccaggaggggccgctgccggaaatcgaggacgaggtgttccggaagcggaacttgaccatcatggacctccaccctggcagcgggaaaacgcggcgctacctgccggcgatcgtccgggaggccatcaagcgtaagctgcgcaccctgatcttagcacctacgcgggtagttgcttccgagatggctgaagctctgaagggaatgcccatcagataccagaccaccgccgtcaagtcagagcatacgggtaaggagatcgttgacctcatgtgccacgccacgttcacaatgcggctgctgtccccagttcgcgtgccgaactacaacatgatcatcatggacgaggcccatttcaccgacccgagctccatcgccgcgcgggggtacatctccacccgcgtaggcatgggggaggctgctgctatcttcatgacggccactccgcccggctccgtggaggcgttcccacagtctaacgccgtcattcaggatgaggagcgggacatccccgaaaggagttggaacagcggatacgaatggatcacagacttccctgggaagaccgtatggttcgtgccctcgatcaaaagcgggaacgacatcgctaactgcctccggaaaaacgggaagagagtaatccaactgtcgcggaaaacgttcgataccgagtaccaaaagaccaagaataacgattgggactacgtggtaaccacggacatcagtgagatgggggcgaatttccgcgcggaccgggtcatcgaccccagacgttgcctaaagcccgtgatcctcaaggacgggcccgagcgcgtgatcctggcgggccccatgccggtcaccgtggccagcgccgcccaacggcgcgggcggataggccgcaaccacaacaaagagggagaccagtatatctacatggggcagccattaaacaacgatgaggaccacgctcattggaccgaggccaagatgcttctggacaacatcaatacgccggagggcattatccccgccctgttcgagccggagcgcgagaagtccgccgccatcgacggggagtaccggctccgcggagaggcgcggaaaacgttcgtcgagctgatgcgcagaggggacctgccggtgtggctatcctataaagtggccagcgaaggcttccagtacagcgataggagatggtgcttcgacggcgagcgcaacaaccaggtccttgaggagaacatggatgttgagatctggacgaaggaaggggaacggaagaagctgcgaccccggtggttggacgcccgtacgtactccgaccccctagccctgcgggagttcaaggagttcgccgcgggccgccggagcgtatccggggatctcatcctggagatcggcaagttgccgcagcacctcacccagcgcgcccagaacgccctggacaatctggtaatgctccacaacagtgaacaaggagggagagcctaccgccacgcgatggaggagctgcccgacacgatcgaaacccttatgctccttgccctcatcgccgtgctcaccggcggtgtgaccttgttcttcctgtccgggcgggggttgggcaagaccagtataggcttactgtgcgtcatggccagcagcgtgcttctatggatggcctccgtggaaccccattggatcgcggccagcattatcctggagttcttccttatggtcctgctaattcccgagccagatcgccagcggacgccccaggacaaccagctagcctatgtggttatcggcctgctgttcatgatcttaaccgtcgccgccaacgagatgggcctgttggagaccacgaagaaggacctcgggatcggccacgtggcggtggagaaccaccaccacgccgccatgcttgacgtcgacctccaccccgcctccgcatggaccctctatgcagtcgccacgaccatcatcacccccatgatgcgccatacgatcgagaacaccactgcaaacatctccctgaccgccatcgctaatcaggcggcgatcctgatggggctcgacaaagggtggcccatctctaagatggatatcggcgtgccccttttggccctcgggtgctacagccaggtcaaccccttgaccctgaccgccgcagtgctcatgctggtggcccactacgccatcatcggccctgggctgcaggccaaggcgacaagggaagcgcagaagcggaccgccgctggcatcatgaaaaacccgacggtcgacggtatcgtggcgatagacctcgaccccgtggtttacgacgccaaattcgagaagcagttagggcaaattatgctgctcatcctgtgtacctctcagattctgctcatgcggaccacctgggcgttgtgcgaaagcattacgctggccactggccccctcacgaccctgtgggaggggtcgccgggcaagttctggaacacaaccatcgccgttagtatggctaacatctttcgggggagctacctggctggagctggcctggccttcagcctgatgaaaagcctcgggggcgggcgccggggaaccggcgcccagggtgagaccttgggggagaagtggaagcgccagcttaaccagctttccaagagcgagttcaacacctataagcggtccggtatcatggaggtggaccgcagcgaggctaaagagggcctcaaaagaggggaaacgaccaagcacgcagtgtcgcgcggaacagccaagttacggtggttcgtggaacggaacctggtcaagcccgaagggaaagtcatcgacctgggctgtggccgcgggggctggagctactactgcgctgggctcaagaaggtgacggaggtgaagggttacaccaagggtggccccggccacgaggaaccaatcccgatggccacctacgggtggaaccttgtaaagctgcactccggcaaggacgtgttcttcatcccgcccgagaagtgcgacaccctcttatgcgacattggggagagctccccgaacccgacgatcgaggaaggccgtaccctacgcgtactcaagatggtagagccctggctgcgaggtaaccaattctgtatcaagatactgaacccctacatgcccagcgtggtagagacgctagagcagatgcaacggaagcatggcggcatgctggtccgcaacccgctgtctagaaacagcactcacgagatgtactgggtgtcctgcgggaccgggaatatcgtatcggccgtcaacatgacgtcccgcatgttgcttaaccggtttaccatggcgcatagaaagcccacgtacgagcgcgacgtggacctgggtgccggtacccggcacgtagcagtcgagccagaggtggccaacctcgacatcatcgggcagcgcatcgagaacatcaagcacgaacacaagagcacgtggcactacgacgaggacaacccctataagacctgggcctaccacgggtcttacgaggtgaagccgagcggctccgcgagctccatggtcaacggggttgtcaagctgctgaccaagccctgggacgttatccccatggtgacccagatagccatgaccgacactaccccttttggccagcagcgtgtctttaaggagaaggtagacacccgcacgcccaaagccaagagggggaccgcccagatcatggaggtgaccgcaaagtggctctggggcttcctatcccgcaataaaaagccccggatctgtacccgcgaggagttcactcggaaggtccggagcaacgcagctattggcgcagtcttcgtggacgagaaccagtggaactccgccaaggaggcggtcgaggatgagcggttctgggacctcgtgcaccgagagagggagctccataagcaggggaaatgcgcgacgtgcgtgtacaacatgatgggcaagcgggagaagaagctgggggagttcgggaaggcaaagggaagccgggccatctggtacatgtggctgggagcccgcttcctagagttcgaagcgctgggcttcatgaacgaagaccactggttcagccgggagaacagcctgtccggtgtagagggcgaggggctccacaagctgggctacatcctccgcgacatcagcaagatccccggtggcaacatgtacgccgacgacaccgccggatgggacacccgcatcacggaggacgacctccagaacgaggcccgcattaccgacataatggagccggagcacgcactgctagcgaagagtatcttcaagctcacgtatcagaacaaggtggtacgcgtccagagaccagccaagaacggtaccgtgatggacgtgatcagccgccgggaccagcgcggctccgggcaggtcggcacttatggcctgaacacattcactaacatggaggcccagctgatcaggcagatggaaagcgaggggatcttttcccccagcgagctcgagaccccaaacttagccaagcgcgtgctagactggctcgagaagtacggtgtggagcggctgaagcgcatggcaatctccggggacgactgcgtagtgaagccgattgacgaccggtttgcgacggccctgactgcacttaacgacatgggcaaggtgcgcaaggacatcccccaatgggaacccagcaaggggtggaacgactggcagcaggttccgttctgttcgcaccacttccaccagctaatcatgaaggacggtcgcgagatagtcgtgccctgtcgcaaccaggacgagctggttggccgagcccgcgtgtcacaaggggccggctggtccctccgtgagaccgcatgcctggggaaatcgtacgcacagatgtggcagcttatgtacttccaccggcgggatctccgcctggccgccaacgccatatgcagcgccgtgcccgtggactggatccccacgtcccggacgacctggtccatccatgcccaccatcagtggatgacaaccgaagacatgctgtcagtgtggaaccgcgtctggatcgaggaaaacccctggatggaggacaagacacatatcagctcctggggcgacgtcccgtacctcggcaagcgcgaggaccagtggtgcggttctctaatcggcctgaccgcccgggccacctgggcgaccaacatccaggtggccatcaaccaggtgcgccgcctcatcgggaacgagaattacctggactacatgacctccatgaaacgcttcaagaacgagagcgaccccgagggcgccctgtggtga

SEQ ID NO: 24563 - RNA, 9879 nt, synthetic construct
  misc_feature 1..9879: note = derived and/or modified CDS sequence (opt11) from DENV-1__EU482485__SS-prME
  source 1..9879: mol_type = other RNA
agcgtgactatgctgctcatgctgatgcccaccgcgctggccttccacctgaccacccggggcggggagccccacatgatcgtgagcaagcaggaacggggcaagagcctgctatttaaaacctcggccggggtgaacatgtgcacgttaatcgccatggacttaggggagctctgcgaggacaccatgacgtataaatgcccccggatcactgagaccgagcccgacgacgtggactgctggtgcaacgccacagacacctgggtgacatatgggacgtgctcgcagacgggcgagcatcggcgcgacaagcgctccgtggccctcgcgccccacgtaggcctagggctggagacccggaccgagacctggatgagctccgagggcgcctggaagcagatccagcgtgttgaaacgtgggcgttacgacaccccgggttcaccgttatcgccctgttcctggcgcacgcgattggtacctccatcacccaaaaggggattatcttcatactgctgatgctggtaaccccaagcatggccatgcggtgcgtcggcattggctcccgggacttcgttgaagggctctccggcgccacttgggtagacgtcgtgctggagcacgggtcctgcgtgaccaccatggcgaaagacaagccaacactggacatcgaactcctgaagaccgaggtcaccaaccccgccgttctccggaagctctgtatcgaggcgaagataagcaacacaacgaccgactctcggtgcccgacccaaggtgaagcaaccctggtagaggagcaggacgccaacttcgtgtgccggagaacgttcgtggaccggggatgggggaacggctgcggtctgttcggcaagggttccctcatcacgtgtgccaagttcaaatgcgtcaccaagctagagggcaagatagtccagtacgagaaccttaaatacagcgtaatcgtgaccgtccacacgggggaccagcaccaggtggggaacgaatccaccgagcatggcactaccgccaccatcacgccccaggcgcccacgactgagatccaactgaccgactacggggccttaacgctggattgtagcccccgcacaggattagatttcaacgagatggttcttctgaccatgaaagaaaagtcctggctcgtgcacaaacaatggttcctggacctgcctctcccttggaccagcggtgccagcacgtcccaagaaacgtggaaccggcaggacctgctggtcactttcaagacagcgcacgctaaaaagcaagaggtcgtggtgctcgggagccaggaaggcgcgatgcatacggccctgaccggagccaccgagatccagacctccggtaccaccaccatattcgctggacacctgaaatgtagactcaagatggacaagcttaccttgaagggcatgtcatacgtcatgtgtacgggatccttcaagctcgagaaggaggtggcggaaacgcaacatggcaccgtgttggtccagataaagtacgagggcaccgacgcgccctgcaagatcccgttctcaacgcaggatgagaagggggtaactcagaacggccggctgatcacagccaacccgatcgtcacggacaaggagaagccggttaacatcgaagctgaaccgcccttcggcgagtcctacatagtgatcggcgcgggggaaaaggcgctgaagctcagctggtttaagaaggggtccagcataggaaagatgttcgaggctacggcccgcggtgcccggcgcatggcgatcttgggcgacaccgcttgggactttgggtcaataggcggggtattcacctcggtcgggaagctggtacaccaaatcttcggcaccgcttacggtgtcttattctcaggcgtcagctggacgatgaagattgggatcggcgtgctactaacctggttgggcctgaacagccggagcacctccctcagcatgacgtgcatcgccgttgggctcgtaacgctatacctgggcgtcatggtacaagccgactccgggtgcgttatcaactggaagggccgtgagcttaagtgcggcagcggaatcttcgttaccaacgaggtgcatacctggacagaacagtacaaattccaggccgacagtccgaagcggctctccgcggccattggcaaggcctgggaggaaggggtttgtggcatccgatcagccacccgcctggagaacatcatgtggaagcagatctccaatgaactcaaccacatcctgctggagaacgacatgaagttcaccgtggtagtcggagacgtcgccggcatcctcgcgcaggggaagaaaatgatcagaccacaacccatggagtataagtatagctggaagtcctggggcaaggccaagatcataggagccgacgtgcagaacactacattcatcatcgacgggcccaacacgcccgagtgcccggatgaccagagggcttggaacatctgggaggttgaggattatggctttgggatcttcacgacgaacatctggctgaagctgcgggacagttacacccaggtatgcgatcaccggctgatgtccgcagccatcaaggactcgaaggccgtacacgcagacatgggatactggatcgagtccgagaagaacgagacctggaagctagcccgggccagcttcatcgaggtcaaaacgtgcatctggcccaaatcgcacaccctgtggagcaatggtgttctcgagtccgagatgatcatccccaaaatctacggggggccgatcagccagcacaactatcgcccagggtacttcacccagaccgccggcccttggcacctggggaagctggaattggacttcgacctctgcgagggcacgaccgtggtcgtggacgaacactgcggcaaccgggggccttcactgcgcactacaacggtcacgggcaaaattatacacgagtggtgctgtcggagctgcacccttccaccactccgcttcaggggagaggacggctgctggtacggcatggagattcgcccagtaaaggagaaggaggagaacctagttaaatccatggtgagcgctgggagcggcgaggttgactccttttccctcggcctgctgtgtatcagtatcatgatcgaagaggtgatgcggagccgttggtccaggaagatgctcatgaccggcaccctggccgtgtttttcctgctcatcatgggacagctaacgtggaacgacctgatccgtctgtgcatcatggtcggcgccaacgcgagcgaccgcatggggatgggcaccacgtacctggccctgatggccaccttcaagatgcggcccatgtttgccgtggggttactgttccgccgattgacctcccgcgaggtgctcctgctgaccatcgggctatcgctggtggcctccgtggagctgcccaatagcctcgaggaattgggcgacgggctggctatgggaatcatgatcctcaagttactgaccgacttccagtcccaccagctctgggccacgctcctgagtctcaccttcatcaaaaccaccttctccctgcattatgcctggaaaacgatggccatggtgttgtcgatcgtgtcactcttccctttatgcttgagcaccacctcccagaagacgacttggctccccgtgttactgggctcgctcgggtgcaagccgctgaccatgttcttaatagctgagaacaaaatctggggcaggcgcagctggcctcttaacgaggggattatggccgttggaatcgtgagcatcctgttaagctctttgctgaagaacgacgtgcccctagccgggccattgatagccgggggaatgctgatagcttgttacgtcatcagcgggagttctgcggacctatctctcgagaaggccgccgaggtgagctgggaagaggaggctgagcattccggcgccagccacaacatattagttgaggttcaagatgacgggaccatgaaaataaaggacgaggaacgggacgatacgctgaccatcctcttaaaggcgacgttactcgccgtgtctggcgtgtacccgctgtcgatccccgccaccctgtttgtttggtacttctggcagaagaagaagcagcgctccggggtgctctgggacacccccagcccgcccgaggtggggcgggccgtcctggatgacggcatatatcgcatcatgcagcggggtctgctgggccgctcccaggtaggcgtgggcgtcttccaggagaacgtgtttcacactatgtggcatgtcacacgcggcgccgtgctgatgtatcagggaaagcgactcgagcccagctgggcgtccgtgaagaaggacctcatatcctacggcgggggatggcgattacagggctcatggaatacgggcgaagaggtgcaggtcatcgccgtggagcccgggaagaaccccaaaaatgtgcagaccgcccccggaaccttcaagactcccgagggagaggtcggcgccatcgccctggactttaagcccggcaccagcgggtcccccatcgtaaatcgcgagggcaagatcgtgggcctgtacgggaatggtgtcgtcaccaccagcgggacgtacgttagcgcgatcgcccaagccaaagcctcccaggagggtccactcccagaaatagaggacgaagtctttcgtaaaaggaacctgaccatcatggacctgcaccccgggagcggcaagaccaggagatacctgcccgcgatagtgcgggaagcgattaagcgcaagctgcgcaccctcatcctcgcacccacgcgggtagtcgcctccgagatggctgaggcactcaaaggcatgcccatccgctaccaaacgacggccgtcaagagcgaacacaccggaaaagagattgtggacctgatgtgtcatgccacgttcaccatgcggctcctcagtccagtacgtgtgcctaactacaacatgatcatcatggacgaggcccacttcactgatccctcgtccattgccgcccgggggtacatcagcacccgagtcggtatgggcgaggccgcagcgatcttcatgacggccacgcctcccgggtccgtcgaggccttcccgcagagcaacgccgtgatacaggacgaagagagagacatccccgagcgttcctggaacagcggttacgagtggataaccgacttcccgggaaagaccgtgtggttcgtcccctccatcaagagtgggaacgacatcgccaactgcctgcgcaagaacggcaaaagggtgatacaactctcccgaaagacgttcgacacagagtaccagaagaccaagaacaacgattgggactacgtggttaccactgacatctcagagatgggcgccaacttccgcgcggaccgggtgatagacccgcgccggtgcctgaagcccgtgatactgaaggacggacctgagcgcgttatcttggctgggcctatgccggtgacagtcgcatccgccgcacaacggcgcggcagaataggccgcaaccacaacaaggagggagaccagtatatctatatgggccagcctctgaacaacgacgaggaccacgcgcattggaccgaggccaagatgttacttgataacatcaatacaccggagggaataatacccgctcttttcgagcccgaacgcgagaagtccgccgccatagacggcgagtaccggctgaggggggaggcgcggaagacgttcgtggagctcatgcgcaggggagacctgcctgtgtggctgtcctacaaggtcgcctctgaggggttccagtacagcgaccgtcggtggtgcttcgacggagagcgcaacaaccaagttctcgaggagaacatggatgtggagatctggaccaaagagggggagcggaagaagctgcgaccccggtggctggacgcccgcacgtacagtgaccccctagccctgcgagagttcaaggaattcgccgcggggcgccggagcgtctccggcgacctgatcttagagatcggcaagttgccgcagcacctcactcagcgcgcccaaaacgcactcgataacttggttatgctgcacaacagcgagcaaggcggccgggcctaccgacacgccatggaggagttgccggacacgattgaaaccctgatgctgctggcccttatcgcggtgctcactggtggggtcaccctcttcttcctttccggacgcggcctggggaagaccagcatcggcctgctttgtgtgatggcctcttcggtgctgctctggatggcatccgttgagccccactggatcgcggcttcaattatattggagttttttctgatggtgctgctgatccccgagccggaccgacaacggaccccacaagacaaccagctggcctacgtggtcatcggcctcctgttcatgatcttgactgttgccgccaacgagatgggacttctggaaaccaccaagaaggacctgggcatcggtcacgtggcggtcgagaaccaccaccacgccgccatgctcgatgtggatctccatccagcctcagcctggacgttgtacgcggtggccacgaccatcataaccccgatgatgcgccatacgatcgaaaacactaccgccaacatttcactcaccgccatcgcgaaccaggccgccatcctcatgggcctggataagggctggcccatctcaaagatggatatcggcgtccccctccttgccctgggctgctactcacaagtgaatccgctcacgctgaccgccgctgttctaatgctcgtagcccactacgccatcatcgggcccggtctgcaggccaaggccacccgcgaggcccagaagcggaccgcagccggaatcatgaaaaaccccacagtggacggaatcgtcgccatcgatttggaccccgtcgtatacgacgccaagttcgaaaagcagctcggtcaaatcatgttactgatcttatgcacctcacagattttattgatgagaaccacctgggcgctttgcgaatcgatcaccctagccaccggtcccttgacgaccctttgggaggggtccccggggaaattctggaacacgacgattgccgtgtctatggctaacatattccggggctcctacctggccggcgcagggctcgccttcagtctcatgaagtcgctgggcgggggccgccgggggaccggcgcccagggcgagaccctgggggagaagtggaaacgccagcttaaccagctgtccaagagcgagttcaatacgtacaaacggtccggcatcatggaagtcgacaggtccgaagccaaggaggggcttaagcgaggcgaaaccaccaaacacgcggtgtccagggggaccgcgaagctgcgttggttcgtggagcgcaatttggtcaaaccggaaggcaaggtaatcgacttaggctgcgggcggggtgggtggtcctactattgcgccggcctgaaaaaggtgacggaggtcaaggggtacaccaaaggcggcccagggcacgaggagcccattccgatggccacctacggttggaacctcgtgaagctgcactcaggcaaggacgtgttttttataccgcccgagaagtgcgacaccttgttgtgcgacatcggtgagagctctcccaatcctacgatagaggagggcaggaccttgagggtcctgaagatggtggagccctggctccgcggcaaccagttctgcatcaagatcttaaatccatacatgccgagcgtcgtcgagaccctggagcagatgcaacgtaaacacggcgggatgttggtgcgcaacccgctgtcccggaacagcactcacgagatgtattgggtctcctgtgggaccgggaacattgtctccgccgtgaatatgacttcccgcatgttgctcaaccgcttcacaatggcgcataggaagcccacatacgagcgcgatgtcgacctcggcgccggaacccggcatgttgccgtagagcccgaggtggccaacctcgacatcatagggcagcgcatcgaaaacatcaagcacgagcacaagtctacttggcactacgacgaagacaacccctacaagacttgggcgtaccacggatcctacgaggtcaagccgagcgggtccgcaagcagcatggtaaatggcgtcgtgaagcttctgactaagccctgggatgttatccccatggtcacccagatcgccatgacggacaccacccccttcgggcagcagcgggtcttcaaggaaaaggtagacacccgtacgccaaaggcgaaacggggcaccgcccagatcatggaggttaccgccaaatggctgtggggcttcctctcccgcaacaagaagccccgtatctgcaccagggaagagttcactcggaaggtgcgatctaacgcggcgatcggggccgtgttcgtcgacgagaatcagtggaactcggccaaagaggcggtggaggacgagagattttgggatctagttcaccgcgaacgcgagctgcacaaacagggcaagtgcgcgacctgcgtctacaatatgatgggcaagagggagaaaaagctgggcgagtttgggaaggccaagggcagccgggctatttggtacatgtggctaggggcgaggttcttagagtttgaggcgctcgggttcatgaacgaggatcactggttctcccgggagaacagcctgtcaggcgtggagggggagggcctgcataagctcgggtacatcctgcgcgacatcagcaacatccccggcggaaacatgtatgcagacgacaccgccggatgggacacccggatcacagaggacgacctgcagaacgaggcccgcataaccgacatcatggaacctgagcatgccctcctggcgaaatccatctttaaactgacctatcagaacaaagtggtaagagtgcagcggcccaccaagaatggcactgtcatggacgtcattagtcgcagggaccagagggggtccggtcaggttggcacctacgggctcaatacttttaccaacatggaggcccagctgatacggcagatggagagtgaaggcattttcagcccctcggagctggagacgccaaacctcgctgagcgcgtactggactggctggaaaagtacggggtcgagcggctcaagcgcatggcaatatccggcgatgattgcgtagtcaagccggtagacgaccgcttcgccaccgcgctgaccgcgctgaacgatatggggaaagtacgcaaggatatccctcagtgggaacccagcaaaggctggaacgactggcagcaggtccccttctgctcccaccactttcatcagctcatcatgaaggacggccgtgagatcgtcgtgccatgccgcaaccaggatgagctggtcggtcgggcccgggtcagccagggggccgggtggagcctgcgggagaccgcttgccttggcaaatcctatgcgcagatgtggcagctgatgtatttccacagacgggacctgcgccttgccgccaatgccatctgcagcgcggtccccgtggattggattccgacgtcccgtaccacttggagcatccacgcccaccatcagtggatgaccacggaggacatgctgtccgtctggaatcgagtgtggatcgaggaaaacccctggatggaggataaaacccacatttcttcctggggcgacgtaccgtacctgggcaagcgtgaggaccagtggtgcggcagcctcatagggctcactgcgcgggcaacctgggccacaaacatccaagtcgcgataaaccaggtgaggcggctaatcggcaacgaaaactaccttgactacatgacaagtatgaagcgcttcaaaaacgagagcgacccagagggagccctgtggtga

SEQ ID NO: 24564 - RNA, 9879 nt, synthetic construct
  misc_feature 1..9879: note = derived and/or modified CDS sequence (opt11) from DENV-1__EU482486__SS-prME
  source 1..9879: mol_type = other RNA
tcagttaccatgttgctgatgttgatgcctaccgccttggccttccatctcactaccagagggggcgagccccacatgatcgttagcaagcaggagcggggcaagagcctactcttcaagaccagcgcgggggttaacatgtgtactctcatcgctatggacctgggagagctttgcgaggacacaatgacctacaagtgccctcgtataaccgaggtggagccggacgacgttgactgctggtgcaacacgaccgacacctgggtgacctacgggacctgcagccagacgggcgagcacagacgcgacaagcggtccgtggcgttagcgccgcacgtcggcctcgggctggagacccgggcagagacctggatgtcctcggagggcgcgtggaagcagatccagaaggttgagacctgggccctcagacaccccggctttacggtgatcgccctgttcctcgcccacgcgataggcaccagcatcactcagaaggggatcatctttatcctcctgatgctggtaaccccatccatggccatgcgctgcgtgggtataggcagccgggactttgtggaggggctatcaggggccacttgggtcgacgtggtcctagagcacggctcctgcgttaccacaatggcgaaggacaagccgaccctggatatcgagctactgaagacggaggtgaccaaccccgcagtgctgcgcaagctatgcatcgaggcgaagatctccaacaccactaccgattcaaggtgccccacccaaggcgaagccaccctggtcgaggaacaggacgccaacttcgtctgtcgccggacctttgtggacaggggctgggggaacggctgcgggctttttggcaagggctccctaatcacgtgtgccaagttcaagtgcgttacaaaactggagggcaaaatcgttcagtacgagaacctgaagtactcagttatcgtaacggttcacaccggcgaccagcaccaagtggggaatgagagcacggagcatggcactaccgccaccatcacgccccaggcacccacgagcgagatacaactcaccgactacggggcgctgacgctggactgcagcccccgcactggcctcgatttcaacgagatggtgcttctcacgatgaaagaaaagtcgtggctcgtacacaaacaatggttcctggacctgcccttaccctggaccagcggggcctccactagccaggagacctggaaccgccaggacctgctggtgacgttcaagaccgcccacgccaagaagcaggaggtggtggtcctcggcagtcaagagggcgctatgcacactgccttaacaggggccacagaaatacagacgtctggcacaaccacaatattcgcagggcacctgaagtgtcggctcaagatggataagctgacgttaaagggcatgtcgtacgttatgtgcaccgggctttttaagctggaaaaggaagtggccgagacccaacacggcacggtattggtgcaaatcaagtacgagggaaccgacgcgccatgcaagatcccattcagcacccaggacgagaagggggtgacgcagaacggacgcctgataacagcaaacccaatcgtcacggacaaggagaagcccgtgaacatcgaggccgagccgccgtttggcgagtcatatatagtgatcggcgccggcgagaaagcattgaaacttagctggttcaagaagggttccagcataggtaagatgttcgaggccaccgcccgcggggcacgccggatggccatactgggcgacacagcctgggactttgggagcattggcggagtattcacgagcgttgggaagctcgtccaccagatcttcgggacggcatacggtgttttattctccggtgtgagttggacgatgaagatcggtatcggtgtgctgctcacctggttgggactgaactcccgatcgacaagcctcagtatgacctgtatcgcggtcgggctcgttaccctgtacttaggtgtaatggtccaagccgattccgggtgcgtgatcaactggaagggcagggagttgaagtgcgggagtgggatattcgtcactaacgaagtccacacgtggaccgagcagtataaattccaagccgatagcccgaagcggctctctgcggctatcggaaaggcatgggaggaaggggtgtgcggcatccgctccgccacccgactcgagaacataatgtggaggcaaatttcgaacgagctgaatcacatcctgctcgagaacgacatgaaattcaccgtcgtggtgggcgatgtcgtcggcatccttgctcaagggaagaagatgatacggccgcagcctatggagcacaaatatagctggaagagttggggcaaagcgaagatcataggcgccgatgtacagaacaccacgttcatcatagacgggcccaacacgccagagtgccccgacgaccagcgcgcatggaatatctgggaggtggaagactacggtttcgggatcttcaccaccaacatttggctgaaactcagggattcgtacacacaggtctgcgaccaccgcctgatgtccgccgcaatcaaagactcaaaggcagtgcacgccgacatggggtactggatcgaatccgagaagaacgaaacatggaaacttgcccgggccagcttcatcgaggtaaagacctgcatctggcccaagagtcacactctctggagcaatggcgtcctggaatccgagatgataatccctaagatatacgggggccccatttctcagcacaactaccgccccgggtacttcacgcagactgcgggtccctggcacttggggaaacttgaacttgatttcgacctgtgcgaaggcacgacggtggtggtcgatgagcactgcggcaaccggggtccatccctccgaacgacaacggtgacaggcaagatcattcatgagtggtgctgccggtcctgcacgctaccgccccttcgctttaagggggaggacggctgttggtacggcatggagatccggcctgtaaaggagaaggaggagaacttggtgaagtcaatggtttccgccggcagcggcgaagtagattcattcagtctggggctgctctgcatatcaatcatgatcgaagaggtcatgcggtcgcggtggtcccggaagatgctgatgacgggaacactcgccgtctttttcctcctgataatggggcagcttacctggaacgaccttatccgtagttgtattatggtgggcgccaatgcatctgaccggatggggatggggacgacctatctggctctgatggccacattcaagatgcgcccgatgttcgctgttggcctcctgttccggcgactgacctcccgtgaggtgctcctgttaacgattgggttgtcccttgtagctagcgtcgagcttcctaattccctggaggaactgggcgacggcctggcgatgggaatcatgatcctcaaactgttaaccgattttcagtcgtaccagttgtgggcgacgcttctgtccctcaccttcattaaaacaaccttcagcctccactacgcctggaagaccatggccatggttctgtctatagtgagcctcctgcccctgtgcctctccacaacgtcgcaaaagaccacctggctgcccgtccttttaggctccctggggtgcaaaccgttgaccatgttcctcatcgccgagaacaagatttggggccgcaagagctggccccttaacgagggtatcatggctgttggcatcgtctctatcctgctttcaagcctcctgaagaatgacgtcccattagccggacccctgattgccggcggcatgctgatcgcctgctacgtgatatcggggtcctccgcagacctcagcctagagaaagcggcagaggtaagctgggaggaagaggcggagcacagcggagcttcgcacaacatcctggttgaggtgcaggatgacggtactatgaagatcaaggacgaagagagggatgacaccctcaccattctgttgaaggctaccctcctggcggtctctggcgtatacccgctgagtatccccgccaccctcttcgtgtggtatttctggcagaagaagaagcagagaagcggggtcttatgggatacgcccagccctcccgaagtggagcgcgcggtgttggacgacggcatttaccgtattatgcagcgcggcctactcgggcgcagccaagtgggcgtgggcgtctttcaagagaatgtattccacacgatgtggcatgtaacccggggcgccgtgctgatgtaccagggtaagcgcctggagccctcctgggctagcgtcaagaaggacctcatctcatacggcggcgggtggcgtctgcagggcagctggaacaccggggaggaggtccaagtgatcgcagtcgagcccggtaagaaccccaagaacgtgcagacggctcccgggaccttcaagacacccgagggcgaggtcggcgcaatcgctctggatttcaagcccgggaccagcggcagccccatcgtcaatcgagagggaaagatcgtggggttatacggcaatggggttgtcacgactagcggaacctacgtttccgccatcgcacaagccaaggctagccaggaagggcctctgcctgaaatcgaggacgaagtattccggaagcgcaacttaaccataatggatctgcatcctggtagcggtaaaacacgtcgctacctgccggccattgttcgggaggcgataaagcgcaagttacgtacactcatactggcaccgactagagtggtggccagcgagatggccgaggcactgaaagggatgcccatccgctaccaaaccacggcggtcaagtccgagcacaccggtcgtgaaatcgtagacctcatgtgccatgctaccttcacaatgagactgctgagccctgtgcgcgtgcccaattacaatatgatcatcatggatgaggcccacttcacggatccatctagcatcgccgcccgcgggtacatctccacccgagtgggcatgggggaagctgccgccatcttcatgaccgcgacgccacccgggtctgtagaagccttcccgcagtccaacgcggtcatccaggacgaggagcgagacattcccgaacggagctggaacagcgggtacgagtggatcacggatttcccggggaagaccgtatggttcgtgccctctatcaagtccggtaacgacatcgccaactgtcttcgcaagaacgggaagcgggtcatccagttgagtcgcaagaccttcgacaccgagtatcagaagacgaagaacaacgactgggactacgtcgtcaccaccgacatctccgagatgggagccaacttcagagctgaccgcgtaatcgacccgcgtcgctgcttaaagcccgtgatcctcaaggacggccccgagcgggtcattctggcgggcccgatgccagtgacagtggcaagtgcggcccaaagacgggggcgcatcggccggaaccacaacaaggagggagaccagtatatttacatggggcagccactgaacaacgacgaggaccatgcccactggactgaggccaagatgctcctggacaacatcaataccccagagggcatcatcccggccctgttcgaacccgagcgcgaaaaatcagctgccatcgacggggagtaccgactccgtggcgaagcgcgcaagaccttcgtcgaattgatgagaagaggggatctacccgtgtggctgagctacaaggttgcaagcgaggggttccaatatagcgatcggagatggtgcttcgacggtgagcggaacaaccaggtcctggaagagaatatggatgtagagatctggaccaaagaaggggagcgtaagaaacttcggccgcgttggctcgacgcccggacgtacagcgatcccctggccctgcgcgaatttaaagagttcgccgcgggccggcggtccgtatcgggggacctcatcctagagatcggaaagctgccccagcacctcacccagagagcgcagaacgccctggacaacttagtcatgcttcacaactccgagcagggcgggcgcgcataccgacacgcgatggaggaactacccgacaccatcgagacccttatgctgttagcgcttattgccgtgcttactggcggtgttacactgttcttcctgagcggccgcggcctcggaaagacctccatcggcctcctgtgcgtaatggccagcagcgctttgctctggatggctagcgtcgaaccccactggatcgcggcatctatcatcttggagttcttccttatggtattactcatcccagaaccggacaggcagcggacgccgcaggacaaccaacttgcctatgtcgtgatcgggctgctgttcatgatcctcaccgttgctgccaacgagatgggcctgctcgaaactaccaagaaggacttaggcatcggacatgtcgcggtggagaatcatcaccacgccaccatgctggacgtggacttacacccggcatctgcctggacgctctacgccgtcgcgacgaccattatcacccctatgatgcgtcataccatcgaaaatactaccgcgaacatctccttaaccgccatagcaaatcaggccgcgatcctgatgggcctggataagggctggccaataagtaagatggacattggcgtccccctgctggccctcgggtgctactcccaggtgaatcccctgaccctgacggccgccgttctgatgctggttgcccactacgcaatcatcggtcctggactgcaagcaaaggccacgcgcgaagcccagaagcgcaccgcggccggaattatgaaaaaccccaccgtggatggcatcgtcgctatcgacctcgaccccgtggtttacgacgccaagtttgaaaaacagttaggccagatcatgctgctcatcctgtgtacgtcccagatcctgctcatgcggacaacctgggcactgtgtgaatccatcaccttggcgacaggtccgctcacgaccctgtgggaggggagccctggcaaattctggaataccacaatcgccgtctccatggccaacatattccgcggtagctacctagccggcgcgggcttagcctttagcctgatgaagtccctcgggggcggcagacgcgggacgggggcccaaggcgaaaccctaggcgaaaagtggaagcggcaactcaaccagttgagcaagtccgagttcaacacgtacaagaggtcggggatcatggaagtggaccggtccgaggcaaaggagggcctccgccgcggggaaacaaccaaacatgccgtgagccgcggcaccgcgaagctgcgttggttcgtcgaacgcaacctggttaagcccgaaggaaaagtgatcgacctcggctgcgggcgcggagggtggagctactactgcgccggactcaagaaggtaacagaagtgaagggctacacgaagggcggccctggccacgaagaacccattccgatggccacatacgggtggaacctggtgaagttgcactccggcaaggacgtcttcttcatcccgcccgagaagtgcgacaccctactttgcgacatcggagagtcatcgcccaacccaaccatcgaagagggacgcacgctgcgggtgcttaagatggtagagccctggctgcgcgggaaccagttttgcatcaagatcttaaacccctacatgccctccgtggtggagacactcgagcagatgcaaaggaagcacggcggcatgctggtcaggaacccgctgagccggaactctacccacgagatgtactgggtttcatgtgggacaggcaacattgtttcagccgtgaatatgacaagccggatgctcctgaaccgctttacaatggcccacaggaagcccacctacgagcgggacgtcgatctaggcgcggggacgcgacacgtcgccgttgaacccgaggtggctaacctcgacattattggtcagcgcattgagaacatcaagcacgaacacaaatccacctggcactacgacgaagacaacccctacaagacgtgggcctatcatgggagctacgaggtgaaaccgtcgggcagcgccagctccatggtcaatggggtggtgaaactgctgaccaagccatgggacgtcattcccatggtgacccaaatagcgatgaccgatacgactcccttcggccagcagcgggtattcaaggagaaggtcgacacccgaacaccgaaggccaagcggggcactgctcagatcatggaggttaccgcccgctggctctggggcttcttatcgcggaacaagaagccccgaatctgtacccgggaggagtttactcgaaaggtacgtagcaacgccgcaatcggcgctgtcttcgtggacgagaaccaatggaacagcgccaaagaggccgtggaggacgaaaggttctgggacctggtccaccgggagcgtgagttacataagcagggaaagtgcgctacatgcgtgtacaacatgatgggcaagagagagaagaagctgggggagtttggtaaagccaaggggtcccgcgccatatggtatatgtggctaggcgcccggttcctcgagttcgaggccctggggtttatgaacgaagaccactggttttcacgcgaaaattccctcagtggtgtggagggcgaggggctccacaaactgggctacatactgagggacatctcaaaaatacccgggggcaacatgtacgcggacgacactgccggttgggacactcgcatcaccgaggacgacttacagaatgaagcgaaaatcacggacataatggagccagagcacgcccttctggccacctccatctttaagctcacctaccagaacaaggttgtgcgcgtgcaacggcccgcgaggaacggcacggttatggacgtgatctcccggagggaccaacggggcagcggccaagtaggtacgtatggcctgaacaccttcacgaacatggaggcccagttgatacgacagatggagtccgaggggatattcagcccctcagagcttgagaccccaaatcttgccgagcgggttctggattggctagaaaagcacggcgtggaacgcttaaagagaatggccatcagcggggacgactgcgtagttaagccgatcgatgaccgtttcgccacggccctatccgctctcaatgatatgggcaaggtgcgtaaagacatcccccagtgggagcccagcaaggggtggaacgactggcagcaagtccccttctgttcccaccatttccaccagttgataatgaaggacggccgcgagatagtcgtgccatgtcggaaccaggacgagctagtgggacgcgcccgcgtcagtcagggagccggctggagcctccgcgagacagcctgccttgggaagtcgtatgcccagatgtggcagctcatgtacttccaccgacgggacctccggctcgccgccaatgccatctgctccgcggttcccgttgactgggtccccacgtcccgcaccacgtggtcaattcacgcccaccaccagtggatgacaaccgaggacatgctgagtgtttggaaccgcgtgtggatcgaagagaacccgtggatggaggataagacacatatcagctcatggggcgacgtcccgtacctcggaaagcgggaggaccagtggtgcggcagcctgatcggcttaacggcccgcgcaacctgggcaacgaacatccaagtggcgatcaatcaggtgcggcgcctcattgggaacgagaactatctggactacatgacctctatgaagcggttcaaaaacgactcggaccccgaaggcgcactctggtaa

SEQ ID NO: 24565 - RNA, 9879 nt, synthetic construct
  misc_feature 1..9879: note = derived and/or modified CDS sequence (opt11) from DENV-1__EU482487__SS-prME
  source 1..9879: mol_type = other RNA
agcgtgaccatgctgctcatgttgatgcccacagcgctggctttccacctcaccacccggggcggggagccccacatgatcgtgagcaagcaggagcggggtaagagcctgctgttcaagaccagcgctggagtaaacatgtgcaccctcatcgccatggaccttggagagctgtgcgaggacaccatgacgtacaagtgccctcggatcactgaaacagagccagatgacgtggactgctggtgcaacgccacggacacctgggtgacgtacgggacttgtagtcagaccggcgagcacagaagagataagcggtctgtggccctcgcgccccatgtgggcctggggctggaaaccaggactgagacctggatgagttccgagggcgcctggaagcaaatccagcgggtcgaaacgtgggccctccggcaccccgggttcaccgtgatagccctgtttctggcgcacgccatcggcacctcgatcacacagaagggtatcatcttcatcctactgatgctggtgactccatccatggccatgcggtgtgtcggcatcggctcccgcgacttcgtagaggggctctccggcgcgacttgggtggacgtcgtgctggagcacggtagctgcgtgaccaccatggccaaggacaagcccacgctggacatcgaactcctgaagaccgaggtcaccaaccccgccgtcctgaggaagctctgcatcgaggccaagatcagcaacaccacaaccgacagccgctgcccgacgcagggcgaggccactctggtggaggagcaggacgcaaacttcgtctgtcggcgtacgttcgtggaccggggctggggaaatggctgcggactcttcggcaaggggtcactcatcacgtgcgcaaagttcaagtgcgtgacgaagctggagggtaagatcgtccaatatgagaatctgaagtatagcgtgatagtgactgtgcacacgggcgatcagcaccaggtggggaacgaatccaccgagcatggcaccaccgccaccatcacgccccaggcgcccaccaccgaaatccagctgacagactacggtgccttaacgttggattgcagccctcgcaccggattggacttcaatgagatggtcctgctgacaatgaaggaaaagtcctggcttgtccacaaacagtggttcctggacctgcccttgccctggacctcaggggccagcacttcccaggagacctggaatcggcaggatctgttagtgaccttcaaaacggcccacgccaaaaagcaggaggttgtagtgctcggaagccaagagggcgcgatgcacacggccctgacaggggccaccgagatccagacctcaggcacgaccaccatcttcgcagggcacttgaagtgccgcttaaaaatggacaaactaaccttgaagggcatgagttacgtcatgtgcacggggtcctttaagctcgagaaggaagtggccgagactcagcacgggaccgtcctggtccagatcaagtacgagggcaccgatgcgccctgcaagatccccttcagcacccaggacgagaagggggtgacccagaacggtcggctgataaccgccaacccgatcgtgaccgacaaggaaaagccagtcaacatcgaggccgaaccgcctttcggggagtcctacatcatcataggcgccggagaaaaggcgttaaaactatcatggttcaagaaggggtcaagcataggcaaaatgttcgaggcgacggcccggggggcccggcgcatggcgatcctcggcgacaccgcgtgggatttcgggtccatcggcggcgtgttcacaagcgtaggtaagctggtccaccagatcttcggcaccgcctacggggtgttattttcaggtgtttcttggacgatgaaaatcggaatcggcgtccttcttacttggctcggtctgaactcccgctccacgtccctcagcatgacctgtatagcagtgggcctcgtgacgctgtacctcggcgtcatggtgcaggcagactccggttgcgtgatcaactggaagggcagggagcttaagtgcggaagcggtatattcgttacgaacgaggttcacacgtggactgagcagtacaagttccaggccgacagcccgaagagactgtcggcggccatcggcaaggcctgggaggagggggtgtgcggaatccggagcgccacccgcctggagaacatcatgtggaagcagatctccaacgagctcaaccatatcctgctagaaaacgacatgaaattcactgtagtggtgggggacgtcgccggcattcttgcgcagggaaagaagatgatccggccccaacccatggagtacaagtacagctggaagtcctggggcaaagctaagattattggcgccgatgtgcagaacaccaccttcataattgatggtcctaatacacctgagtgcccggatgatcaacgcgcctggaatatctgggaagtggaggactacggctttggcatcttcacgaccaatatctggttgaagctgcgggacagccacacccaagtctgtgaccaccgcctcatgtctgcggcaatcaaggacagcaaggccgtgcacgccgacatgggctattggattgagtcggccaaaaacgagacatggaagcttgcgcgggccagcttcatagaggtgaagacgtgcatctggcccaagtcacacaccctgtggagcaacggcgtcctggagtccgagatgatcatcccgaagatatatgggggcccaatcagccagcacaactacaggccggggtacttcacccagaccgccggaccctggcacctggggaagctggaactcgacttcgacctgtgcgaggggacgacagtggtggttgacgaacactgcggtaacagagggccgtctctgcgcactaccacggtgacaggtaagatcatccatgagtggtgctgccggagctgcaccctgccgcccctacgcttccgcggggaggacggctgctggtacgggatggagatccgcccagtgaaggagaaggaggagaacttagtcaagagcatggtgagcgcgggaagcggggaggtggactcgttcagcctcggacttctgtgcatctccatcatgatcgaagaggtcatgcggtctcgttggtcccggaagatgctcatgaccggcacgctggccgtgtttttcttactcattatggggcaattgacctggaacgacctaatccgcctctgtatcatggtgggcgcgaacgcgtcggacagaatggggatgggcacaacctatttggccctgatggccacgttcaagatgcggcccatgttcgccgtcggcctcctgttcagacgcctgacatcacgggaggtgttactgttgacgatcgggctcagcttagtggcctcggtcgaactacccaacagcctcgaggagctgggcgacggactggccatgggcatcatgatcctcaagctgctgaccgattttcagagccaccagctctgggcgacgctcttaagcctcaccttcatcaagaccaccttctccctgcactacgcatggaagacgatggcgatggtgctgagcatcgtctccttattccccctctgcctgagcacaacctcgcagaagaccacgtggctccccgtgctcctgggcagcctgggctgcaaaccgcttaccatgtttctaatcgccgaaaataaaatctggggcagacgctcctggcccctcaatgaagggatcatggccgtgggcatcgtcagcatactcctgagctccctcctgaagaacgacgtacccctggccgggcccctcatcgctggcggtatgctgatcgcgtgctacgtaatctccggcagcagcgccgacctgtcactggagaaagccgccgaagtcagctgggaggaggaggccgagcactccggcgcgagccacaacattctggttgaggtgcaggacgacgggacaatgaagatcaaggacgaggagcgtgacgacacccttaccatcctcttgaaggccacgctcctcgcagtcagcggcgtgtaccccctgagcattcccgccacgctcttcgtgtggtacttctggcagaagaagaaacagcgctccggggtcctctgggacacccccagcccgcctgaggtcgagagagccgtgctggacgacggcatatatcgcatcatgcagcgcggcttgctagggcgctctcaagtcggcgtgggggtgttccaggagaacgtctttcataccatgtggcacgtgacgcggggcgcggttctcatgtaccaaggcaagcgcctggaacccagctgggccagcgtcaagaaggatttgattagctacggcggtgggtggcggctgcagggatcctggaataccggggaggaagtccaggtgatcgcggtcgagcctggcaagaacccgaaaaatgtgcagaccgccccagggaccttcaagacgcctgagggcgaggtcggcgcgattgcactggactttaaacccgggactagcggctcacccatcgtaaacagagaggggaagatcgtgggactgtacggcaacggggtggtcaccaccagcgggacttacgtgagcgccattgcgcaggcaaaggcgtctcaggaaggaccgttgcccgaaatcgaggatgaggtctttcggaagaggaacctgaccatcatggacctgcacccaggcagcgggaagacacgtcgctacctccccgccatcgtccgggaggcaatcaagcgcaagttgcgaactctgattctcgcccccacgagggtggtggcatcggagatggcggaggccctgaagggcatgcccatccgctatcagacgaccgccgtcaagagcgaacacaccggcaaggaaatcgtggacctgatgtgccacgccacgttcaccatgcggctcctatcccccgtgcgggttccgaactacaacatgataattatggacgaagcccactttacagacccatcgtccatcgccgcccgaggatatatcagcaccagagtcggcatgggggaggccgcagccattttcatgactgcgacgccgcccggctccgtggaggccttcccacagagcaacgccgtcatccaagacgaggaacgagatatccccgagcgctcctggaacagcggatatgagtggatcacagactttcccggcaagaccgtgtggttcgtgccctccatcaagagcggcaatgatatcgccaactgtctccggaagaatggtaagcgcgtgatccagctcagccggaagacgtttgacaccgaataccagaaaactaaaaataatgactgggactacgtggtgaccacagacatcagcgagatgggggcgaacttccgcgctgatcgggtgatagacccgcgacggtgcctgaagcccgtgatactaaaggacggtccagagcgcgtgattctggccggccccatgccggtaaccgtggccagcgcggcgcagcggcgagggcggatcgggcggaaccacaacaaggagggcgaccagtacatctacatgggccagccgctgaacaatgacgaggaccacgcccactggaccgaggcgaagatgctactcgacaacataaacacccccgaggggataatccccgccctattcgagccggagcgcgagaagagcgccgcgatcgacggggagtaccggctgcgcggcgaggcccggaagacgttcgtcgagctcatgcgccggggagatctgcccgtgtggttgtcctacaaggtggcctctgagggcttccagtactcggaccgccggtggtgtttcgacggcgaacgcaacaatcaggtcctcgaagagaatatggacgtggagatctggaccaaggagggggagaggaaaaagctacgcccacggtggctggatgcccgcacatactccgaccctctagccctgcgggaattcaaggagttcgcagccggacgccggagcgtgtctggggacctcattctcgaaatcggcaagctgccgcaacacctaacccagcgggcccagaacgctctggacaacctggtcatgctgcacaattccgagcagggcgggcgggcttaccgccacgccatggaggaactccccgacacgatcgagaccttgatgttgttggccctgattgccgtgctgaccggcggggttaccctgttcttcttatccggacgggggctcggcaagactagcataggcctcctttgtgtcatggcgtcgagcgtgttgctctggatggcatccgtggaacctcactggattgccgcaagcatcatcctggagttcttcttaatggtactcctgatccccgagccggataggcagcggacgccacaggacaaccagctggcctatgtcgtgattggtctcctgtttatgatcctgacagtcgccgcgaacgagatgggcttgttagagaccaccaagaaagatctggggattggccacgccgccgtggagaaccaccaccacgccgccatgcttgatgtggacctgcaccccgcttccgcctggacgctgtacgccgtagccactaccatcatcactccgatgatgcgccacacgatcgagaatactactgccaacattagcctcacggcgatcgccaaccaggccgcaatcttaatggggctggataagggatggcccatctccaagatggatattggcgtgcccctcctggcgctgggatgttacagccaggtgaacccccttacgctgaccgccgcagtcctgatgctcgtggcgcactatgcaatcatcggcccagggctgcaagcgaaggccacccgcgaggctcagaagcggaccgcggccggcatcatgaagaaccccacggtggacggaatcgtagcgatagacctggaccccgtcgtgtacgacgcaaaattcgagaaacagctcggccagatcatgcttctgatcctctgcacctcgcaaattctgctgatgcgtaccacctgggccctctgcgaaagcatcacgctggccaccggcccgctgaccaccctctgggaggggtccccgggcaagttctggaacacgacgatcgccgtcagcatggcaaacatcttccgggggtcctacctggccggcgccggcctggccttctctctaatgaagtccctcgggggcgggaggagaggcacaggggcgcagggtgagacgttgggtgaaaagtggaagcgtcagctcaaccaactgtcaaagtcggagttcaacacgtacaagcggagcgggatcatggaggtggaccgcagcgaggccaaggagggcctgaagcgcggggagactaccaaacacgccgtgtcccgtggcacagccaagctccggtggttcgtcgagcgcaacctggtaaaaccggaagggaaagtcatcgacctgggctgcggccgcgggggctggtcatactactgcgccgggctaaagaaagtcacagaggttaagggctacaccaagggcggccctggacatgaggaacccattcccatggcgacctacggctggaacctcgtcaagctgcactccggcaaggacgtgttttttatacccccggagaagtgcgacaccctgttgtgcgatatcggagagagctccccgaacccgacgatcgaggagggccgcaccctgcgggtgcttaagatggtggagccctggctccgcggtaaccagttctgcatcaagatcctcaacccctacatgcccagcgtcgtggagacgctggagcagatgcagcgcaagcacggcggcatgctcgtgcgaaacccgctgtcccggaacagcacccatgaaatgtattgggtctcctgcggtaccggcaacatcgtatcagctgtgaacatgacgtcccgcatgctcctcaaccgttttaccatggcgcacaggaagcctacctacgaaagggatgtcgacctgggggccggtacccggcacgtggccgtagagcccgaggtcgccaacctggacatcatcggccaaaggatagagaacataaaacatgagcacaagtctacgtggcattatgacgaagacaatccctacaagacctgggcatatcacggctcctacgaggttaagccgagcggcagcgccagcagcatggtgaacggggtagtaaagctcctgaccaagccctgggacgtcatccccatggtgacccaaatagctatgacggacaccacccccttcggccagcagcgagtgttcaaggagaaggtcgacacccgcactccgaaggccaagcgcgggaccgcgcagattatggaagtaaccgccaagtggctgtggggcttcctaagccggaacaagaagccccggatttgcacccgcgaggaattcacgcggaaagtgcgctctaatgccgccatcggcgcggtctttgtggacgagaatcaatggaactctgcaaaggaggccgttgaggacgagcgcttctgggatctggtccaccgtgagcgcgaactgcacaagcaggggaagtgcgcgacctgcgtgtacaatatgatgggcaaacgcgagaagaagctaggggagttcgggaaggccaaagggagccgggcgatctggtatatgtggctgggcgcccgcttcttagagtttgaagccctcggattcatgaacgaggaccactggttttcgagggaaaactctctgtccggagtggagggcgaaggtctacataagctcggctacatcctgcgcgacatcagcaagatccccggaggaaacatgtacgccgacgacaccgccggctgggacacccgtatcactgaggacgatctgcagaacgaagcgaggataaccgacatcatggaaccggagcacgccctcctggccaagtcaatcttcaagttgacctaccagaacaaggtcgtacgcgtgcagcggccagccaagaacgggaccgtcatggacgtaatctctcgccgggaccaacgtggctccggtcaggtggggacgtatggcctcaatactttcaccaacatggaggcgcagctgatccggcagatggagtcggagggcatcttcagtcccagcgagttagagacccccaacctcgcggagcgcgtcctggactggctaaagaaatatggggtggaacggttaaagcgcatggccatctccggggacgactgcgttgtcaagccgatcgacgaccgatttgccacggcgctgacagcgctgaacgatatgggcaaagtacgcaaggacatcccccaatgggagcccagcaaggggtggaacgactggcagcaagtccctttctgctcccatcactttcatcagctcattatgaaagacggccgggagattgtggtgccgtgccgcaaccaggatgaactggtgggccgagctagagtaagccagggggccggctggagcctgcgggagaccgcctgcctcgggaagtcctacgcccagatgtggcaactgatgtacttccaccgcagagacttacgcctcgcggctaacgccatctgcagcgctgtaccagtggactggatcccgacctcacgaacgacctggagtatccacgcgcaccatcaatggatgaccaccgaggacatgctgtcagtttggaaccgcgtgtggatagaggagaacccatggatggaggacaagacccacatcagctcctggggggacgtcccatatctgggtaaacgcgaggatcagtggtgcggctccctgatcggccttaccgcgagagccacctgggccaccaatatccaagtcgccatcaaccaggtgcgccggctgatcgggaacgagaactacctcgactacatgacatcaatgaagcgcttcaagaacgaaggcgaccccgagggggccctttggtga

SEQ ID NO: 24566 - RNA, 9879 nt, synthetic construct
  misc_feature 1..9879: note = derived and/or modified CDS sequence (opt11) from DENV-1__EU482488__SS-prME
  source 1..9879: mol_type = other RNA
agcgtcaccatgcttctcatgttgatgcccaccgccctcgcatttcacctcacgacccgggggggggaaccccacatgatcgttagtaagcaggagcggggcaaaagcctgctgttcaagactagcgccggagtgaacatgtgcaccctcatcgccatggacctgggtgagctgtgcgaggataccatgacctacaagtgtccccggatcaccgaggcagagcccgacgacgtggactgctggtgcaacgccaccgacacgtgggtgacctacgggacctgtagccagacgggcgagcaccgtcgggataagcggtccgtggctctagcgccccacgtgggcctgggactggagacgcgcaccgagacttggatgtcttcggagggcgcttggaagcagatccagcgggtagagacctgggccttgcgccatcccgggttcaccgtgatcgccctgttccttgcgcacgcgataggcaccagcatcacgcagaaggggatcatcttcatcctcctaatgttagtgaccccctccatggccatgcggtgcgtcggcatcggctctcgcgactttgtggaggggttgtcaggcgccacgtgggttgacgtcgtgttggagcacgggagctgcgtgacgaccatggccaaggataagcccaccttagacatagagctcctaaagacggaggtgaccaatcccgctgtgctgcggaagctctgcatcgaggccaaaatctccaacacgacaacggattctcgctgcccgacccagggggaggccacccttgtggaggagcaggacgccaacttcgtctgccggcgcaccttcgtggacaggggctggggaaacggctgcgggctgttcggcaaggggtccctgatcacttgcgccaagttcaaatgtgtgaccaaactggagggcaaaattgtccagtatgaaaacctgaagtacagcgtgatcgtgaccgtccacactggtgaccagcatcaggtgggaaacgagtccacggagcatggcacaaccgcgaccatcacgccccaggctcccagtaccgagatccagttaaccgactacggggcgctgacactggactgcagcccccggaccggcctcgactttaacgagatggtgttgctgacgatgaaagagaagtcctggctcgtgcataaacagtggttcttagatctgccgctcccctggactagtggagcgtccacaagccaagagacgtggaaccggcaggacctgctcgtgacgttcaaaacggcccacgcgaagaagcaagaggtggtggtgctcggatcccaggagggcgctatgcacaccgccctgaccggggccacggagatccaaaccagcggcaccaccacgatctttgccgggcacctgaagtgtcgcctcaagatggataagcttacccttaagggtatgagttacgtcatgtgcacggggtcgttcaagctcgaaaaggaggtcgcggaaacacagcacggcacggtgctggtccagattaagtacgagggcaccgacgccccctgcaagattcccttctccacgcaggacgagaagggggtgacccagaacggacggctgatcacggccaacccgatagtgaccgacaaagagaagcccgtcaatatcgaggctgagccgcccttcggggagagctacatcgtgatcggcgctggcgagaaagcccttaagctctcctggttcaagaaggggtcctccatcgggaagatgttcgaggccaccgccaggggggcacggcgcatggcgatcctgggtgacaccgcctgggacttcgggagcatcggaggcgtgttcacgtccgtcgggaagctggtgcaccagatcttcggcacagcctatggggtgctgttcagcggtgtttcctggactatgaagatcgggatcggggtgctgctgacctggctgggcttaaatagccgcagcaccagcctaagcatgacttgcatcgccgtggggctagtcacactatacctgggcgtgatggtgcaggccgatagcgggtgcgtcataaactggaagggccgggagttgaaatgtggaagcgggatcttcgtaacaaacgaggtgcacacgtggaccgaacagtacaagttccaggcggactccccgaagagactgagcgccgcgatcggcaaagcttgggaggagggggtttgcggcatccggtccgcgacccgactggagaacatcatgtggaagcagatctccaacgagctcaaccacatcctgctggagaacgacatgaagctcaccgttgtggttggggacgtggcgggcatcttggcccagggaaagaagatgatccgacctcagcccatggagtacaagtactcctggaaatcctggggtaaggccaagatcatcggcgccgacgtgcagaacactacgttcatcatagacgggcccaacaccccggagtgccccgacgaccagcgcgcgtggaacatctgggaggtcgaggactacggcttcgggatcttcacaaccaacatctggctgaagctccgggactcatatacccaggtgtgcgaccaccgcctgatgagcgccgccatcaaggattccaaggccgtgcatgccgatatgggctactggatcgagtcagagaagaacgagacatggaagcttgcacgggcgtccttcatcgaggtcaagacttgcatctggcctaagagccacaccctctggtccaacggcgtgctggagagcgaaatgatcatcccaaagatatacggcggcccgatctcccagcacaactaccgccccgggtatttcacccaaaccgcggggccctggcacctgggaaaactcgagcttgacttcgacctgtgcgagggcaccaccgtcgtcgtggatgagcactgcggcaaccggggtccgagcctccgcacgacgacagtgaccgggaagatcatccatgagtggtgctgtcggagctgcacgctgcccccactgcgcttcaagggggaggacgggtgctggtacgggatggaaatccggccagtcaaggagaaggaagagaacctcgtcaagagcatggtgagcgctggctccggcgaggtcgactcattctccctggggcttctctgcatctccatcatgatcgaggaggtgatgcgctctcggtggagcaggaagatgcttatgaccggaaccctggccgtgttcttcctcctgattatgggacagctgacctggaacgacctaatccggttatgcatcatggtcggtgcgaatgcctccgaccgcatggggatgggcacaacctatcttgccctcatggctaccttcaagatgcgcccgatgtttgccgtgggcctgctgttccggagactgaccagccgggaggtgctgctcttaacgatcgggctgtccctggtcgcgagcgtggagctcccgaactccctggaggagctgggcgacgggctcgccatgggcatcatgatcctgaagctgttaacagacttccagagccatcagctttgggccaccctgttatccctgacctttatcaggacgaccttcagcttgcactacgcctggaaaaccatggcgatggtcctctccatcgtgagcctgttccccctctgcttgtccacaacgagccagaagaccacctggctgcccgtcttactcgggtccctaggatgcaagccactcaccatgttcctcatcgccgagaataagatctggggccgcaaaagctggccgctgaacgaggggatcatggccgtcggtatcgtgtcgatcctgctctccagccttcttaagaatgacgtgcccctcgcggggccccttattgccggcggcatgttaatcgcgtgctacgtcatctccgggagctccgccgaccttagcctggagaaggccgccgaggtgtcctgggaggaggaagctgagcacagcggcgcttcgcataatatcctggtggaggttcaggatgacgggactatgaagattaaggatgaggagcgcgacgacacactcaccatactcctgaaggcaacccttctggccgtgagcggtgtgtacccactttccatacccgcaaccctgttcgtctggtacttctggcagaagaagaagcagagaagcggggtgctttgggatacgcccagcccgccagaggtagaacgcgccgtccttgacgacggcatctaccgaattatgcaacgcggcctcctcgggcggagccaggtcggcgtgggtgtctttcaggagaacgttttccacaccatgtggcacgtgacccgcggcgcggtcctgatgtaccagggtaagcggctggagccgagctgggccagcgtgaagaaggatctcatctcctacggcgggggttggcgcctgcaaggcagctggaatacaggggaggaggtgcaggtcatcgccgttgaacccggcaaaaaccccaagaatgtgcagacggccccagggaccttcaagacctccgaaggcgaggtcggcgctatcgcgctggacttcaagcccggaaccagcggctccccgattgtgaacagggagggtaagattgtgggcctctacggcaatggggtcgtgacgacctccggaacctacgtgagcgccattgcccaggccaaggcgtcacaggaagggccactgccggagattgaggatgaggtcttccgcaagcggaacttgaccattatggaccttcaccccggcagcggaaagacgcgccggtacctgcccgccatcgtgcgcgaggctatcaaacggcgcctgcgcacgctcatcctggccccgacccgggtggtcgcctccgaaatggcggaggcgctgaagggcatgcctatccgctaccagaccacggccgtgaagagcgagcataccggcaaggagatcgtggacttgatgtgccacgccactttcactatgcggctgctgtcccccgtccgcgtgcccaactataacatgataatcatggacgaggcccacttcacggacccgagctccatagcggcccgggggtacatcagcacccgcgtgggcatgggggaggccgctgcaatcttcatgacggcgacgcccccaggcagcgtagaggccttcccccagtcgaacgccgtgatacaggacgaggagagagacatcccggaacgctcctggaacagcgggtatgagtggatcacggacttccccggcaaaactgtgtggttcgtcccctccatcaagagcggcaacgatatcgccaattgtcttcggaagaacgggaagcgagtgatccagctatccagaaagaccttcgacacggaataccagaagacgaagaacaacgactgggactacgtggtcaccaccgacattagcgagatgggagcaaacttccgcgccgaccgggtgatcgacccccgccggtgcctgaaaccggtgatattaaaagacgggcccgagcgcgtaatccttgccggccccatgcccgtgaccgttgcctccgccgcacagcggcgcgggaggatcggccgcaaccacaacaaggagggagaccagtacatctacatggggcagccgctgaataacgacgaagaccacgcccactggacggaggccaagatgctcctggacaacataaatactcccgagggaatcatccccgccctgtttgagcccgagcgcgaaaagagtgccgcgatagacggggagtacaggctgcgcggggaagcccggaagacctttgttgagctaatgcgccgcggggacctgccggtatggctctcttacaaggtcgcctccgagggcttccagtacagcgaccgccggtggtgcttcgatggcgagcgcaataatcaagtgctggaggaaaacatggacgttgaaatctggactaaggagggggagcggaagaagctgcgcccccgatggctcgacgcccgcacgtactccgatcccctggccttgcgggagttcaaggagttcgccgccggccgccggagcgtctccggcgatctcatcctggagatcggcaagctgccccagcacttgacccagcgcgcgcaaaacgcccttgacaacctggttatgctccacaacagcgagcaaggagggcgggcttaccgccacgcaatggaggaactgccagacacgatcgagaccctgatgctcctggccctgatcgcggtgttaacgggcggggtcaccctgttcttcctgtcaggccggggattaggcaagacctctatagggctgctgtgcgtgatggcctccagcgtgctcctgtggatggcgtccgtcgaaccccactggatcgccgctagcatcatcttggagtttttcctcatggtgctgttgatcccggaacccgaccgccagcggacgcctcaggacaaccagctcgcgtacgtcgtgatcggcctgctgttcatgatcttgaccgtggccgcgaacgagatgggcctgctggagacgaccaagaaagacctcggcatcggacatgtggccgtcgagaaccaccatcacgccgccatgctggacgtggacctgcaccccgccagtgcgtggacattatatgccgtggccaccacgatcatcacgcccatgatgcgtcacaccatcgagaacaccacggccaacatctctctcaccgccattgccaaccaagccgcaatcctgatggggctcgacaagggctggccgatatccaaaatggacatcggcgtccccctgctggccctagggtgttatagccaggtcaaccccctgaccctgaccgcggccgtcctcatgctggtagcccactacgctatcattggcccaggcctccaggccaaagcgacgagggaggctcagaagcgaaccgccgccggcattatgaagaacccgaccgtagatgggatcgtcgccatcgacctcgacccggtcgtttacgacgcgaagttcgagaaacagctgggccagatcatgctgctcatcctttgcaccagtcagatattactcatgcggacgacctgggccctgtgtgagagcatcaccctggccacaggtcctctcaccaccctgtgggaagggtcccccggcaagttctggaacaccacgatcgcagtgagcatggccaatatcttccggggcagctatttagcgggcgccggccttgccttctccctgatgaagtccctcgggggggggcgtcgggggaccggagcccagggtgagaccctcggcgagaaatggaagcgccagctgaaccagctgtccaagagcgagttcaacacctacaagcggtccgggatcatggaggtcgatagaagcgaggcgaaggagggccttaagcgcggggagaccacgaagcacgccgtttcccgcggaaccgccaagctgcggtggttcgtggaacggaacctggttaagccggaggggaaggtgattgatctcggatgcggtcgcggcggatggagctactattgcgccggcctgaagaaggtgaccgaggtaaaggggtacaccaagggcggccctggccacgaggagccgatccccatggccacgtacggatggaacctggtgaagctgcattccggaaaggacgtgttcttcatcccgcccgagaagtgcgacaccctcctttgcgacatcggggagagctcccccaaccccaccatagaggagggccgcaccctgagagtcctaaagatggtggagccctggttacgcgggaaccaattctgcattaagatcctgaatccctacatgcccagcgtagtcgagacgctcgagcagatgcagcggaagcacggaggcatgttagtgcgcaaccccctgtcccgtaacagcacccacgagatgtattgggtgagctgcgggaccggcaacattgtctcggccgtgaatatgacctcccgcatgctcctgaacagattcaccatggcccaccggaagcctacgtacgagcgcgacgtagatcttggggccgggacccgacacgtcgccgtcgagcccgaggtggccaacctcgacatcatcggccagcgcatagagaacattaagcacgagcacaagagcacctggcactacgacgaggacaacccctacaagacctgggcataccatgggtcttacgaggtcaagcctagtggcagcgccagtagcatggtgaatggggtcgtgaagctcctgacgaagccgtgggacgtgatccccatggtgactcagatcgccatgaccgacaccacgcccttcggccaacagcgggtgttcaaggaaaaagtggatacccggacccccaaggccaagcgggggacagcacagatcatggaggtcacggcaaagtggctttggggattcctgtcccgcaacaagaagccgcgaatctgtacccgcgaggaatttacccgtaaggtgaggagcaacgcggccattggcgccgtgttcgtcgacgaaaaccagtggaattccgccaaagaggccgtggaggacgagcggttctgggacctggtgcatcgcgaacgggagcttcacaagcaggggaagtgtgcgacctgcgtctataacatgatgggcaagcgcgaaaagaagctgggggagttcggcaaagccaaggggagccgggccatatggtacatgtggctgggcgcgcgcttcctcgagttcgaggccctggggttcatgaacgaggaccactggttttcccgcgagaactcactatccggtgtcgaaggcgaagggctccacaagctgggctacatcttacgcgacatcagtaagatccccggtggcaacatgtacgcggacgacacggccggctgggacacccggataacagaagacgacctccagaacgaggcgaagatcaccgacatcatggagcccgagcatgcgctgctggccaagtccatcttcaagctcacgtaccagaacaaggtggttcgcgtgcaacgcccggccaagaacgggaccgtaatggacgtcatcagcagaagggaccaacggggatccggccaggtgggcacctatggcctgaacaccttcacgaacatggaggcccagttaatccgccagatggagagcgaggggatcttctcccccagcgagctcgagacccccaacctggccggccgggtgctggactggctcgaaaaacacggggtcgaacgcttgaagcggatggcaatcagtggcgacgactgcgtagtgaaacccatcgacgaccgtttcgcgaccgccttaaccgccctcaacgatatggggaaggtccgaaaggacatcccgcagtgggagcccagcaagggctggaacgactggcaacaggtccccttctgcagccaccacttccaccaactgatcatgaaggacgggcgcgagatcgtagtcccctgccggaaccaagatgagctggtggggcgcgcccgcgtgtcccagggcgcggggtggagcctccgcgagaccgcttgcctgggcaagtcctacgcccagatgtggcagcttatgtacttccaccggcgcgacctccggctcgccgcgaacgccatctgcagcgcggtcccagtggactgggtgcccacttcccgtactacctggagcatccacgcccaccatcagtggatgacgaccgaggacatgctgtccgtctggaaccgtgtgtggatcgaggagaacccctggatggaggataagactcacgtgagctcctgggaggacgtaccctacctcggtaagcgcgaggaccagtggtgcggcagcctgatcggcctgactgcccgcgcgacgtgggctaccaacatccaggtggcgataaaccaggtgagacgcctccttgggaacgagaactatctggactatatgacttccatgaagcggttcaaaaacgagagcgacccggaaggcgccctgtggtga

SEQ ID NO: 24567 - RNA, 9879 nt, synthetic construct
  misc_feature 1..9879: note = derived and/or modified CDS sequence (opt11) from DENV-1__EU482489__SS-prME
  source 1..9879: mol_type = other RNA
tccgtcaccatgctgctcatgctcatgcccaccgcgctggccttccacctcactacccggggcggcgaaccccacatgattgtgagcaagcaggagcggggcaaaagtttactgttcaaaacctccgcaggcgtgaacatgtgcacgctgatcgctatggacttgggggaactgtgcgaggacaccatgacctacaagtgcccacggatcaccgagacagagcctgacgacgtggactgctggtgtaacgcaacggacacctgggtgacgtatgggacctgctcccagacgggcgagcaccggagggacaagcggtcagtggccttagcgccccatgtgggcttaggactggaaacccgcaccgagacctggatgagctccgaaggcgcgtggaagcagatacagcgggtcgagacgtgggccctccggcaccccgggtttacactgatcgcgctgtttctcgcgcacgcgatcggcaccagcatcacccagaaagggatcatcttcatcctgctcatgctcgtaacgccctccatggctatgcggtgcgtcggcatcgggtcgcgcgacttcgtcgagggcctgtccggcgccacttgggtggacgttgtcctggagcacgggagttgcgttaccaccatggccaaggacaagcccacgctcgacatcgaactgctaaagaccgaggtgacaaacccggccgttctccgtaagctttgcatcgaggcgaaaatctccaataccacgaccgacagccgctgcccgacccagggtgaagccaccctggtggaagagcaggacgccaactttgtatgccgacgcacgttcgtagacaggggttggggcaacggctgcggcctgttcggcaagggatccctgattacttgcgccaagttcaagtgcgtaaccaagctggagggcaagatcgtgcaatatgagaatctcaagtactcagtcatcgtaaccgtacatacgggcgaccagcaccaagtcgggaatgagtccactgagcacggaaccacggccaccatcacgccccaggcgccaaccaccgagatacagctgactgactacggcgccctgacgctcgactgcagcccccgaacgggcctggacttcaacgagatggtgctgctcaccatgaaggaaaagtcttggctggtccacaagcagtggttcctggacctacccctgccctggaccagtggggccagcacgtcacaagagacctggaatcggcaagacctgcttgtgacattcaagaccgcacatgctaagaagcaggaggtggtcgtactgggctcgcaagagggagcgatgcacacggccctgacgggcgccacagagatccagacctccggcacgaccacgatcttcgccgggcacttgaaatgccggctgaagatggacaagcttacccttaagggcatgagttacgtgatgtgcacggggtccttcaagttagaaaaagaactcgccgagacccagcatggcacggtcctggtgcagatcaagtacgaaggtactgatgctccctgcaagataccctttagcacgcaggacgagaaaggggtgacccaaaacggcagacttatcaccgccaacccgatcgttaccgacaaggagaagccagttaacattgaggccgagccgcccttcggggagagttacatagtgatcggcgccggcgagaaagcgctgaaattgagctggttcaagaaggggtccagcataggcaagatgtttgaggctacggcccgtggcgcgcggcggatggcgatcctcggcgacacagcgtgggattttggttctatagggggtgtcttcactagcgtggggaagctcgttcaccaaatcttcggaaccgcctacggcgtcctgttctccggcgtgtcttggacgatgaaaatcgggataggcgtgctcctgacctggctaggcctcaattcccgcagcacctccctaagcatgacatgcatcgccgttggcctggtgacgctctacctaggcgtcatggtccaggccgactcagggtgcgtgatcaactggaagggacgcgagctgaagtgcggaagcggcattttcgtgaccaacgaggtccatacctggaccgagcagtacaagtttcaggctgacagcccgaagcgcttgtccgcggctatcggcaaggcttgggaagagggggtatgcggtatccggtctgccacaaggctagagaacataatgtggaagcagatttccaacgagctgaaccacatcctcctcgaaaacgatatgaagttcacggtggtcgtaggggacgtagcagggatcctcgctcaggggaagaagatgatcaggccccagcctatggagtataaatacagctggaagtcctggggcaaggctaagatcatcggagccgacgtccagaacaccacattcatcatagacggccccaacacgccagagtgccccgacgatcagagggcctggaacatctgggaggtggaggactacggattcggcatcttcacgacgaacatctggctcaagctgcgggatagctacacccaggtgtgcgaccatcgcctgatgtccgcggcgatcaaggatagcaaggccgtccacgctgatatgggctactggatcgaatctgagaagaacgagacctggaagctagcccgggctagcttcatagaagtcaagacgtgtatatggcccaagtcgcacaccctctggagcaacggcgtgttagagtccgagatgatcatacccaagatctacggtggcccaatcagccagcacaactaccgccctgggtacttcacacagacggccggcccctggcacctcggaaagctggagctggacttcgacctatgcgagggcacgaccgtggtggtagacgagcactgtggaaaccgcgggccctcgctgcgcaccaccacggttaccggcaaaatcatacacgagtggtgctgccggagctgtaccctgcccccactgcgcttccgcggagaagacggctgctggtacggtatggagatccgccccgtgaaggagaaggaggaaaacctggtcaaatccatggtctcggccggctcaggcgaagtggacagttttagcctggggctcttgtgcatctccatcatgatcgaagaagtgatgcgcagccgctggagtcggaagatgctgatgaccggtacgctcgcggttttcttcctgctcatcatgggacaacttacctggaacgatctgatccgcctatgcatcatggtgggcgccaacgcaagcgaccgcatggggatgggcacgacatacctcgccctgatggccactttcaagatgcggccgatgttcgccgtcggcctcctcttccgccggcttacatcgcgggaggtcctactcttaaccatcggattaagcctagtggcctccgtggagctgcccaatagccttgaggaactcggcgacggactggctatggggattatgatcctgaagctcctgaccgacttccagtcccaccaactgtgggccacgctcctgagcctgaccttcatcaagaccacgttttccctccattacgcatggaagacgatggcaatggtactctcaattgtgagcctgttccctctctgtctgagcaccacctctcagaagaccacgtggctgcccgtcctcctgggctccctgggctgcaaacccttaaccatgttcctgatcgcggaaaacaagatctggggtcggagatcctggcccctgaacgaggggatcatggccgtcggcatagttagcatcctgctgtcgtccctgctaaagaatgatgtccccttagccgggccactcatcgcaggcggcatgctcatcgcctgctacgtgattagtggatccagcgcggacctctccctggagaaggcggccgaagtgtcatgggaggaggaggcggagcactccggcgcgagccacaacatcttggtcgaggtacaggacgacggcaccatgaagataaaagacgaggagcgggacgacaccctgacaatactgctcaaggcgaccttattagctgtgtcaggcgtttacccgttgagtatccccgccaccctgttcgtctggtacttctggcaaaagaagaagcagcgcagtggggtgttgtgggacaccccctcgcctccagaggtcgagcgagccgtcctggacgacggtatctatcgtatcatgcagaggggcttactgggtcgctcacaggtgggtgtcggggtgtttcaggagaacgtgttccacaccatgtggcacgtcacgcggggagccgtgttaatgtaccagggcaagcgcctcgagccctcatgggcatccgtgaagaaggacctgatctcgtacggcggcgggtggcgtctgcagggctcctggaacacaggagaggaggtgcaggtgatcgccgtcgagcccggcaagaaccccaagaacgtgcagactgcgccggggacctttaagacaccagagggcgaagtgggcgccattgccctcgacttcaagcccgggaccagcggctcccccatcgttaatcgcgaggggaagatcgttggcctatacggcaacggggtagttaccactagtggaacgtacgtgtccgcgatcgcgcaggctaaggcctctcaggaggggccgctccccgagattgaagacgaggtgttccgcaagcgtaatctcaccatcatggacctgcaccccggctctggtaagacccgccgctacctgccggcgatcgtgcgggaggccatcaagcgcaagcttcgcaccctcatactggcccccacgagagtcgtggcctccgaaatggcggaggccctgaaggggatgcctatcaggtaccaaacgaccgccgtcaaaagcgaacacacaggcaaagagattgtcgacctgatgtgtcacgctacgttcaccatgcggctgctcagtcccgtgcgcgtgccgaactacaatatgattatcatggacgaagcccactttactgacccctcctccattgcagctcgcgggtatatctccacccgggtcggaatgggggaagccgccgccatcttcatgacggccactccgcccggttccgtagaagcgttcccgcagagcaacgctgtgatccaggacgaagagcgggacatccccgagcggtcctggaacagcggatatgagtggatcaccgattttcccggcaagaccgtatggttcgtgcccagcataaaaagcggcaatgacatagccaattgtctgcggaagaacgggaagcgagttatccagttgtcccgcaaaacgttcgacacggaataccagaagaccaagaacaacgactgggactacgtcgtgaccacggatatcagcgagatgggcgccaacttccgcgcggatcgggtgatcgacccccgccggtgccttaagcccgtcatcctgaaggacggaccggagcgtgtgattctggccggacccatgccagtgaccgtagcatccgccgcccagcggcgtgggcggatcggccgtaaccacaacaaggagggcgatcagtacatctatatggggcagccactgaacaacgatgaggaccatgcgcactggactgaggcgaagatgctgctggacaacataaacaccccagagggtatcatccccgccctcttcgagccggagcgcgaaaagtccgcggccatcgacggagagtacaggctacgcggcgaggcgaggaagacgttcgtagagctgatgcgccgcggtgacctccccgtctggctgtcctacaaggtggccagcgagggttttcagtacagcgatcgccgttggtgcttcgacggagagcgcaacaatcaggtcctggaggagaacatggacgtcgagatttggaccaaagaaggggaacggaaaaagctccgcccccggtggctggatgcccgcacctactccgatcccctagccctccgggagtttaaggagttcgcggcgggccgccggtcagtgtccggggacttgatcctggagatcggcaagctcccgcagcacctgacccaacgcgcacagaacgccttagacaacctcgtcatgctgcacaacagcgagcagggggggcgggcctaccgccacgcgatggaagaactgcccgatacgatagaaacgctaatgttactggccctcatcgccgtactaaccgggggggtgacgctgttcttcctctccggccggggtctgggtaaaacctctatcgggttactatgtgtaatggcctcctctgtcctgctttggatggcctccgtagagccccactggatcgcggcgagcatcatcctcgagttcttcctaatggtgctgctcatccccgagccggatcgccagcggacgccccaagacaatcaactggcctacgtcgtgatcgggctactcttcatgatcctcaccgtcgccgccaacgagatgggtctgctcgagactaccaaaaaggacctggggatcggccacgtcgcggtggagaatcaccatcacgctgccatgctggacgtcgacctgcaccccgcatcagcgtggacgctgtacgcggtggcaacgacgatcatcaccccgatgatgcggcacacgatcgagaacaccaccgccaacatatcccttactgccatcgctaaccaagcggccatcctcatggggctggacaaagggtggcccatctcaaagatggatattggcgtgcccctcctagccctggggtgctacagtcaggtaaaccctctgactctcactgccgcggtcctgatgctggtggcccattacgccatcatcggaccggggctccaagccaaggcaacccgcgaggctcagaaaaggactgccgcgggcatcatgaagaacccgacggtggacgggattgtcgccatcgacctggaccccgtagtgtacgacgccaagttcgaaaaacagctcggccagattatgctcctgattctctgcacctcacagatcctactgatgcgaaccacctgggccctttgcgaaagcatcacgctcgcaacggggccccttaccaccttatgggaagggtccccgggtaaattctggaatacgaccatcgcagtcagcatggccaacatattcaggggctcatacctcgcaggcgcgggcctggccttcagccttatgaaatccctcgggggggggcgacggggtaccggtgcccagggggagactctaggggagaaatggaagcgccagctgaaccagctctccaagagcgagttcaacacttacaaacgatccgggatcatggaggtggaccgcagcgaagccaaagagggcctgaagcgcggcgaaaccaccaagcacgcggtatcccgtggcacggctaagctgcgttggtttgtggagcgcaatctggtaaagcccgaggggaaagtgatcgacctcggttgcggccggggcggatggagctactactgcgccgggctaaagaaggtcacggaggtgaagggatacaccaagggcggacccggccacgaggaaccgataccaatggccacctacgggtggaacctggtgaaactccactccggtaaggatgtcttctttatccctccggaaaagtgcgataccctcctttgcgatatcggcgagagctctcctaaccctacgatcgaagagggaaggacattgcgggtgctgaaaatggtggagccctggttgcgcgggaatcagttctgcattaagatcctcaacccctacatgcccagtgtcgtcgaaaccctggagcagatgcagcggaagcacggaggcatgctggtacgcaacccgctctcccgcaattccacccatgagatgtactgggtctcctgcgggaccggcaacattgtgagcgccgtaaatatgacgtcccgcatgctgctgaaccgcttcaccatggcgcaccgaaagcccacgtacgagcgcgacgtcgaccttggcgccggaacccggcacgtggcagtggaacccgaggtcgccaatctggacataattggccagcgcatcgagaacattaagcacgagcacaaatccacctggcactacgacgaggacaacccttataagacctgggcataccacgggtcgtacgaggtgaagccgagcgggtccgcgagcagcatggtgaacggggtcgtgaaactgctcaccaagccctgggacgtcatccccatggtcacccagatcgccatgacagacaccacccccttcggccagcagcgggtgttcaaggagaaggtcgacaccagaacgccgaaagcaaaaagagggaccgcccagatcatggaggtcactgccaagtggttatgggggttcctgtcccggaacaagaagccccggatctgcacccgcgaggagtttacccggaaggtgaggtcgaacgctgccatcggcgccgtttttgttgacgagaaccaatggaattccgctaaagaagcggtggaggatgagcgtttctgggacctcgtccacagggagcgggagctccacaagcaagggaagtgcgcgacctgcgtgtacaacatgatgggcaagcgagagaagaagctgggagaattcggaaaggccaaagggagccgggccatatggtacatgtggctcggcgcccgtttcctggagttcgaggcactgggcttcatgaatgaagaccactggttctcccgcgagaactcgctctccggtgtggagggcgaagggttgcacaagctgggctatatcctgcgcgacatctctaagattccggggggcaacatgtacgcagatgacaccgctggctgggacacccggatcacggaggatgatctacagaacgaggcccgcatcaccgacatcatggagccggagcacgccctgctcgccaagtcgatctttaaactgacataccagaacaaggtcgtgcgcgtacaacggcccgccaagaacgggaccgtcatggatgtgatctcacgccgggaccaaagaggctccgggcaggtcgggacgtacggcctaaacacctttacgaacatggaagcccagttaatcagacagatggagagcgagggaatcttctcccccagcgaactagagacccccaatctggccgaacgcgttttagattggctggagaagtacggcgttgagcgcctgaaacgcatggccatctcgggggacgattgtgtggtgaagccgattgatgaccggttcgcgacggcattaaccgccctgaacgacatggggaaggtgcgcaaggatatcccgcagtgggaaccgagcaagggttggaacgactggcagcaggtccccttttgcagccatcactttcatcagctgatcatgaaggatgggcgggagatcgttgtgccgtgccggaaccaggacgaactcgtgggccgtgctcgcgtctcgcagggtgcgggctggagcttgcgcgagaccgcgtgcctgggcaaatcctacgcgcagatgtggcagctcatgtatttccatcgccgcgatctgagactggccgctaatgcgatctgctccgccgtgcccgtggactggatccccacatcccggaccacctggagtatccacgcccaccaccagtggatgactacagaagacatgctctccgtctggaacagggtgtggatcgaggagaatccctggatggaggacaaaacgcatatctcgagctggggggatgtaccgtacctggggaagcgcgaggaccagtggtgcggcagcctgatcggtctcaccgcgcgggcaacctgggcgacaaacatccaggttgcaatcaaccaagtgcggcgactgatcgggaacgagaactatttagactatatgacctcaatgaaacgcttcaagaacgagtcagatcccgagggcgccctctggtga

SEQ ID NO: 24568 - RNA, 9879 nt, synthetic construct
  misc_feature 1..9879: note = derived and/or modified CDS sequence (opt11) from DENV-1__EU482490__SS-prME
  source 1..9879: mol_type = other RNA
tcagtaaccatgctgctcatgctgatgcccaccgcactagcgttccacctcaccacccggggcggggaaccccacatgatcgtaagcaagcaggaacggggcaagagcttactgtttaagaccagcgccggggtgaacatgtgcaccctcatcgcaatggacctcggcgagctctgcgaggacaccatgacctataagtgcccccggatcacggagaccgagcccgacgacgtggactgctggtgtaacgccaccgacacctgggtgacctacgggacgtgctcacagacgggcgagcatcggcgggataaaaggtccgtggccttggcgccccatgtgggactaggcctggagacccgcacggaaacctggatgagctccgagggggcctggaaacagattcagcgggtcgaaacttgggccttacgtcaccccgggttcaccgttatcgccctgttcctggcccacgcgatcgggaccagcataacacagaaggggatcatcttcatcctcctgatgttggtgacgccctccatggccatgagatgcgtgggcatcggctcacgggacttcgtggaagggttatccggcgccacctgggtggacgtcgtgctcgagcacgggagctgcgttaccaccatggccaaggacaagcccacgctggacatcgaactcctgaagaccgaggtcaccaatcccgccgtgctgcggaagctatgcatagaggcgaagatatccaacaccacgaccgacagccgctgcccgacccagggagaggccaccttagtcgaggagcaggacgccaacttcgtctgccgtcgcacgttcgtggaccggggatgggggaacggctgcggactgtttggcaaggggtcactcataacctgcgccaagtttaagtgtgtgaccaagctggagggcaagatcgtccaatacgagaatctgaagtatagcgtgatcgtgactgtccatacgggagaccagcatcaagtgggcaacgaatctacggagcacgggaccaccgccaccataacgccccaggcgcccacgactgaaatccagctcaccgactatggggccctgacgctggactgctccccacgcaccggactagacttcaatgagatggtactgctgaccatgaaggagaaatcctggttggtgcataagcaatggttcctggacctgccactcccctggaccagtggagctagcacgtcccaagagacctggaaccggcaggacctgttggtgacttttaaaaccgcccacgcaaagaagcaggaggtcgtggtgcttggcagccaggagggggcgatgcacacggcgctgacaggtgccactgagatccaaacttccggcacaaccaccatatttgccgggcatctaaagtgccgcctcaagatggacaaacttacgctgaagggtatgtcctacgtcatgtgcacggggtccttcaagctcgagaaggaggtcgccgagactcaacacggcaccgtgctggtccaaatcaagtacgagggtacagacgctccctgcaagatacccttctccacgcaggacgagaagggggtgacccagaatggccggctgatcaccgctaatccaatcgtgaccgacaaggagaagccggtcaatatcgaggccgagcctcccttcggcgagtcctacatcacgattggagccggcgagaaggcgctgaaactgagctggttcaagaaagggtccagcatcggcaaaatgttcgaggccaccgcccgtggtgcccggcgcatggccatcctgggggacaccgcctgggacttcgggtccatcggtggcgtgttcacaagcgtgggaaaacttgtccaccagatcttcggcacggcctacggggtgctgttctcaggcgtaagctggaccatgaaaatcggtatcggagttctgctgacttggctcggactgaactcccgctcgacctccttaagcatgacatgcatcgcggtggggctcgtgacactgtacctgggggtcatggtacaggctgattccgggtgtgtgatcaactggaaaggccgcgagctcaagtgtgggtcaggcatcttcgtcacgaacgaggttcacacatggaccgagcagtacaaattccaggccgacagcccgaagcggctctcagctgccataggcaaagcctgggaagagggggtgtgtggcatccgcagcgccacgaggctggagaacatcatgtggaagcagatcagcaacgagcttaaccacatcctgctggagaatgacatgaagttcaccgtcgtggtgggcgacgtagcgggtatcctcgcccaggggaaaaagatgatccggccacaacccatggaatacaagtacagctggaagtcctggggcaaggccaagatcataggtgcagacgtacaaaacacaaccttcatcatcgacgggccgaacacgcccgagtgccccgacgaccagcgcgcctggaacatctgggaggtggaggactacggcttcggcatcttcaccactaacatatggctgaagctgcgggactcatacacccaggtctgcgatcaccgcctcatgtctgcggcaattaaagacagcaaagcggtccacgccgacatgggctactggattgagtccgagaagaacgagacttggaagctggcccgagccagcttcatcgaggtgaagacctgcatctggccaaagtcccacacgctgtggagcaacggcgtcctcgagtccgagatgataatccccaagatctatgggggcccgataagccaacacaactaccgccccgggtacttcacccaaacggcgggcccatggcacctggggaaactggaactggacttcgacctgtgcgaaggtaccactgtggttgtcgatgagcattgtggtaaccgtgggccgtccctgcgcaccacgaccgtgaccggcaaaatcattcacgagtggtgctgtcggtcatgcaccctgccgcccctccgcttccgcggggaggacggctgttggtacgggatggagatcaggcccgtgaaagagaaggaggagaatctggtcaagagtatggtgagcgccggcagcggcgaggttgactcattcagcctcgggctgctgtgcatctccatcatgatcgaggaggtcatgaggtcccgctggtcccgtaagatgctaatgacgggaacgctcgccgtgtttttcctgctcatcatgggtcagttaacatggaacgacctgatccgcctctgcatcatggtaggagccaacgcgtcagaccgcatggggatgggcacgacatacttggcactcatggccaccttcaagatgcggccgatgttcgcagttggcctcctgttccgacggctgacctcccgcgaggtgctcctgctgaccatagggctcagcctggtagcctccgtcgagttgcccaattctctagaggagctgggcgacgggcttgcaatgggtataatgatcctcaagttactgacggacttccagtcccaccagctctgggccaccctgcttagcctaactttcattaaaaccacgttctccctgcactacgcctggaagacgatggccatggtgctgagcatagtctctctcttccccctgtgcctgagcaccacctcccagaagacgacctggttacccgtgctgttgggcagcctagggtgcaaaccgctgaccatgttcttaatcgcggagaacaagatctggggccggagatcttggcccctcaacgaagggatcatggccgtgggcatcgtcagcatcctgctgtcctccctgctgaagaacgacgtgccactggccggacccctaatcgcgggcggcatgctgatagcctgttatgtgatcagtgggtccagcgcggacctgtcccttgagaaggccgccgaggtcagctgggaggaggaggccgagcactccggagcaagccacaacatcctggtggaggttcaggacgacgggaccatgaagatcaaggacgaggaacgagacgacacgttaactatcctactgaaagctaccctgctcgctgtcagcggcgtgtacccgctttcaatccccgcaaccttattcgtgtggtatttctggcaaaagaagaaacagcggtccggggtcttatgggatactcccagcccgcccgaagtcgagagggccgtcctagacgatggcatataccgcataatgcagcggggcctcttagggcgctcccaggtcggtgtgggggttttccaagagaacgtcttccacacgatgtggcacgtaaccagaggggctgttctgatgtaccaggggaagcgcttagagcccagctgggcgtctgtcaagaaggacctgataagctacggcggcgggtggcggctccagggctcctggaacaccggggaggaagtccaggttatcgccgtagagcccggcaagaaccccaagaacgtgcagacagcccccgggacgttcaagacccccgagggcgaagtgggcgccatcgccctagacttcaaacccgggacctcaggctcacccattgtcaatcgcgaggggaaaatcgtggggctatatggcaacggtgtggtcaccacgtcgggcacgtacgtgagcgcgatcgctcaggccaaggcttcccaggaaggaccgctccccgagatcgaggacgaggtgttccggaagaggaacctgacgatcatggacctgcacccgggctctgggaagacccgtcgctacttaccggcgatcgttcgggaggccatcaaacgcaaactccgcactctgattctagcccccacacgggtggttgcctcagagatggccgaggcgcttaagggcatgcccatccgctaccagacaaccgccgtcaagagcgagcacaccggcaaggagattgtggacctgatgtgccatgccaccttcaccatgcggctcctatcccccgtgcgcgtcccgaactacaacatgatcatcatggacgaggcccacttcaccgaccccagctccatcgcggctcgcgggtatatcagcacgcgcgtcggcatgggggaggctgccgccatctttatgacagcgacgccgccgggatccgtggaggcgttcccacagagcaatgcagtcatacaggacgaggagcgtgacattcccgagcgctcctggaacagcgggtacgagtggatcaccgattttcctggtaaaacggtttggttcgtgccctccattaagtcaggcaatgacatcgccaactgcctgcgcaagaacgggaagcgtgtgatccaactctcccggaagacctttgacaccgagtaccagaagaccaagaataatgactgggactacgtggtgacgactgacatctcggaaatgggcgccaatttccgcgcggaccgtgtaatcgacccccgccggtgcctaaagcctgtgatcctaaaagacgggcccgagcgcgtgatcctcgccggacccatgccggtcaccgtggccagtgccgctcagcggcgcgggcggattggcagaaatcataataaagagggcgatcagtacatctacatggggcagcccctgaacaatgacgaggaccatgcgcattggaccgaggcaaagatgttactcgacaacatcaacacgcccgagggcatcatcccagcgttgttcgagccggagcgcgagaagtctgcagccatagacggagagtacagactacgcggcgaagctcggaagaccttcgtagagctcatgcggcgcggtgacctcccggtgtggcttagttacaaagtggccagcgagggctttcagtacagcgaccgccggtggtgcttcgacggagagcgcaacaaccaggtcctcgaggagaacatggacgtggagatctggaccaaagagggggagcgtaagaaactccgcccccggtggttggatgcccgcacctactctgatcccctcgccctgagagagttcaaggagttcgccgccggccgccggtccgtgagtggggacttgatcctcgagattggaaagctgccgcagcacctaacgcagcgcgcacagaacgccctcgacaacctggtcatgctgcataacagcgagcagggcgggcgggcctacagacacgcaatggaggagctccccgacaccatagagaccctgatgctgttggcgctgatagccgtgctgaccggaggggttaccctctttttcctgtccggacgggggttaggcaagacgagcatcggcctcctgtgtgttatggccagtagcgtcctgctctggatggcctccgtggaaccccactggatcgcagcgagtattatcctggagttcttcctgatggtcttgttgatccccgagccggatcgccagcggacgccccaggacaaccagttagcctacgtggttatcgggctgctgttcatgatactgacggtcgccgccaacgagatgggcctcctagagaccaccaagaaggaccttggaatcgggcacgtggcggtagagaatcaccatcacgccgccatgttggacgtcgacctgcaccccgcctccgcctggaccctatatgcggtggccaccactataatcactccgatgatgcgtcacaccatcgaaaacaccaccgccaatatcagcctcacggccattgccaaccaggccgcaatccttatggggctggacaaaggatggcccatctccaagatggatatcggcgtgcccctcctggccctggggtgctactcccaggtcaaccccctcacactgacggccgcggtcctcatgctagtggcccattacgccatcataggccctgggctgcaggccaaggccacccgcgaggcgcagaagcggacggccgctggcatcatgaaaaaccccacagtggacgggatagtggccatcgacttggacccagtggtctacgacgccaagttcgagaagcagctcggccagatcatgctactgatcctctgcacctcccagatactgttgatgagaaccacgtgggcactttgtgagtctattaccctggccactggccccttaaccacgctctgggaggggtccccgggcaagttctggaacaccacaatagccgtgtccatggccaacatctttagagggtcctacctcgccggcgcgggcctggccttcagccttatgaaatcccttgggggcgggcgcagggggacaggggcccagggcgagacgctgggcgagaagtggaagcgtcagctcaaccaactgagtaaaagcgaatttaacacctataaacggagcgggatcatggaggtggaccgcagcgaggccaaggagggcctgaagcgcggggagaccaccaagcacgccgtctcccgcggcacggccaagctccgttggttcgtggagcgcaacctggtgaaacccgaaggtaaggttatcgacctgggctgtggtagagggggctggtcatactactgcgccgggctgaaaaaggtgaccgaggtgaagggctataccaagggcggccccggccatgaggagcccatccccatggctacctacgggtggaacctcgtcaagctgcactccggcaaggacgtgttctttatcccgcccgagaaatgcgacacgctgctctgcgacatcggggagtcttcccccaatccgactatcgaggaggggcgcacgctgcgggtgctgaagatggtggagccgtggctacgcgggaaccaattctgcatcaagatcttgaatccctacatgcccagcgtcgtggaaacccttgaacagatgcaacggaaacatggtggtatgctagtccgtaatccgctgtcccgaaatagcacgcacgagatgtactgggtgtcctgcgggacaggcaacatcgttagcgccgtcaatatgacctcccgcatgttattgaaccgcttcacgatggcgcaccggaagcctacctacgagcgcgacgtagacctaggggccggtacgagacacgttgccgtcgagcccgaggtggccaacctggatatcatcggccagaggatagagaacatcaagcatgaacacaagagcacctggcactacgacgaggacaacccgtataagacctgggcctaccacggttcctatgaggtgaagccgagcggatctgcgagcagcatggtcaacggggtggtcaagctcctaaccaaaccctgggacgtgattcccatggtgacgcagatagctatgaccgacaccacccccttcggccagcagagagtcttcaaagagaaggtggacacccgcactccgaaggccaagcgggggacggcccagatcatggaggtgaccgccaagtggctgtggggcttcctctcccgcaacaagaagcccaggatctgcacgcgcgaggagttcactcggaaggtgcgcagcaatgcggccataggagcggtgttcgtggacgagaaccagtggaacagcgccaaggaagctgtggaggacgagcggttctgggacctggtccatcgtgagcgggaactccacaagcaggggaagtgcgcgacgtgcgtgtacaacatgatgggcaagcgtgagaagaagctgggagagttcggtaaggcaaaggggagcagagccatatggtatatgtggctgggcgcccgcttcctcgagttcgaagctctcggcttcatgaatgaggaccattggttctcacgggagaacagcctttctggtgtagagggcgaggggctacacaaacttggttacatcctacgcgacatctcaaagatccccggaggcaacatgtacgctgacgacaccgccggctgggacacgaggatcaccgaggatgaccttcagaacgaagctagaatcactgacattatggagccagagcacgctttgctggcgaagtcaatatttaagttaacctaccaaaacaaggtggtacgcgtccagcggcccgccaaaaacgggacggtcatggacgtgatcagccgccgggaccagcggggctccgggcaggtcgggacctacggcctcaacaccttcacaaacatggaagcccagctgatacggcagatggaatcggaggggatcttctcccccagtgagttagagacgcccaacctcgccgagagagtgttagactggctggagaagtacggtgttgagcggctcaagcgcatggccatatcaggggacgattgcgtcgtgaagcccatcgacgaccggttcgcgaccgctttaaccgccctgaacgacatgggcaaggtacgcaaggatatcccccagtgggagccctctaaggggtggaacgactggcaacaggtccctttctgctcccaccacttccaccaattaattatgaaggatggccgggagatcgtggtgccttgccgcaaccaggacgagctggtgggccgagccagagttagccagggggccggctggagcctgcgagagacggcctgtctcgggaagtcctacgcccagatgtggcagctgatgtatttccaccgccgtgacttacgcctagccgccaacgcgatctgcagcgctgtgcctgtcgactggatccccacgtcccgaaccacttggagtatccatgcccatcaccagtggatgacgacagaggatatgctgtccgtgtggaaccgcgtgtggatcgaggagaacccatggatggaggacaaaacccatatcagctcctggggagacgtaccgtacctgggaaaacgtgaggatcagtggtgcgggtccctcatcggcctgaccgctcgggccacctgggcgacaaacattcaggttgccatcaatcaggtgaggcggctgatcgggaatgagaattatctcgactatatgacctcaatgaagcgcttcaagaacgagagcgatccggagggagccctgtggtga

SEQ ID NO: 24569 - RNA, 9879 nt, synthetic construct
  misc_feature 1..9879: note = derived and/or modified CDS sequence (opt11) from DENV-1__EU482491__SS-prME
  source 1..9879: mol_type = other RNA
tcagtcaccatgctacttatgttgatgccgacagcacttgccttccacctgacaacacgtggcggggaaccacacatgatagtctcgaaacaggaaagggggaaaagtctactattcaaaacgtccgcaggggtaaatatgtgcaccttgatagccatggacctaggcgagttctgtgaagataccatgacctacaaatgcccgcgaataaccgaagcagaaccggacgatgtcgactgctggtgcaatgcaacagacacatgggtgacctacggcacatgcacgcaaataggggagcaccgacgggacaaacgatcagtagcgctcgcgccgcacgtgggcctaggcctagaaactcgaaccgagacatggatgtcatcagagggggcgtggaagcagatccaaagggtggagacttgggccctgcgtcaccctggatttacggtcatagcactctttctagcacacgcgatcggaacaagcataacacaaaaagggatcatttttatcctactcatgctagcaactccctcaatggcaatgcgatgcgtcgggatcggcagccgggacttcgtagaaggcctcagtggagcgacgtgggtcgacgtggtcctggagcacggctcgtgcgtgactacgatggccaaagacaagccaaccttagacattgaactgctgaaaacggaagtaaccaacccggcagtactacggaaattatgtattgaagctaaaatttcgaacaccacaacggacagtagatgtccgacgcaaggggaagccacactcgtagaagaacaggacgcaaacttcgtctgtaggcgcacattcgtggatagaggttggggcaatggatgcggtcttttcggcaaaggaagtctcataacatgcgcaaaatttaaatgcgtaaccaagctcgaaggaaaaatcgtccaatatgagaacctgaaatacagcgtcatcgtcacagtccacacaggcgaccaacaccaagtagggaatgagtcaacagaacatggaacaatcgccactatcacaccacaagccccctccacagagatacagctaacggactacggagctttgacactagactgtagcccaagaacaggcctcgactttaacgagatggttttactcaccatgaaagaaaagtcttggctggtccacaaacaatggttcctagaccttcctctaccctggacctcaggagccagcacgagtcaagagacgtggaatcgacaagacttattggtcacgttcaagaccgctcacgcgaagaaacaagaggtggtggtgctcggctcgcaggaaggggcaatgcacacagccttgacaggagcgacggaaattcaaacttcagggaccacgactatcttcgctggccacctcaagtgccgactaaaaatggacaaactgacattaaggggtatgagctatgtgatgtgcacagggagctttaaacttgaaaaagaagtagcagagacacaacatgggacagtcctagtgcaaatcaagtatgagggtactgatgccccatgcaaaatacctttctccacccaagacgagaaaggagtaacacagaacgggcgactaataacggccaatccgatagtcaccgataaagaaaaaccagtgaacattgaagcagaacccccattcggggaaagttatatcgtaatcggcgccggagaaaaggctttaaaactgagttggttcaaaaagggctcctccatcggaaaaatgttcgaagcaaccgcacgcggggctcggagaatggcgattctgggcgacacggcatgggatttcggatcaattgggggcgtattcaccagcgtaggcaagctagttcaccagatattcggcaccgcctatggagtgctattcagcggcgtaagctggacaatgaaaatcggtatcggggttctacttacatggctaggcctaaacagccgatcgaccagtctgtccatgacgtgtatcgcagttggtcttgtgacactgtatctcggagttatggttcaagcagatagcggctgcgttatcaactggaaaggtagagagctaaaatgcggctctggtatcttcgtaaccaacgaggtacacacctggacggaacagtacaaattccaagccgactctccaaaacgactgagcgcagccataggcaaagcatgggaagaaggcgtctgcggcatacggtctgctaccagactggaaaacataatgtggaaacaaatcagcaatgagctaaaccacatcctacttgaaaatgacatgaaactgacggtcgttgtaggtgatgtggcaggtatacttgctcaaggtaagaaaatgataagaccccagccgatggaatataaatactcatggaaaatttgggggaaggctaaaataataggggcagacgtccagaacacaacattcatcatagacggaccaaatacacccgagtgtccagacgaccagcgtgcatggaacatatgggaagtagaggactatggattcggcatcttcactaccaatatttggctcaagctgcgagattcgtacacacaagtatgcgaccatagactcatgtccgcggccataaaagatagcaaagctgttcatgcggacatggggtactggatcgaaagcgagaaaaacgaaacatggaaacttgctcgcgcctcatttatcgaggtaaaaacgtgcatatggcccaagtcgcataccctgtggagcaatggcgtcctcgagagcgaaatgatcatcccgaaaatctacggaggccccatttcacaacacaactatagacccggatactttacgcaaaccgccggcccctggcacctcggtaagctcgaactagacttcgacctgtgcgaggggacaaccgtagtcgtcgatgaacactgcgggaacaggggaccgtcactcagaacgaccaccgtaacaggtaaaatcatccacgaatggtgctgccgctcctgcacgctaccgccattgcgcttcaaaggggaagacggatgttggtatggaatggaaatcagaccagtaaaagagaaagaagaaaacctcgtgaaaagcatggtctcggccggcagcggtgaagtggatagcttcagcctcggcctcctctgtatctccattatgatagaagaggtgatgcgcagccgatggagccgaaagatgctgatgactgggaccctagctgtattcttcctgctcataatgggacaactgacatggaacgacctaatccgtctgtgtataatggtgggtgctaacgcttcggatcgaatgggtatgggcacaacctaccttgccctaatggcgacgttcaaaatgcggccgatgttcgcggtgggactactatttagacgcctaacttcccgcgaggtccttctcctaacgatcgggctctctctggttgcgtcagtggaacttccaaacagcctcgaggaactcggcgatggactagcaatggggataatgatactaaaactactaacggacttccagagccatcaactctgggcgacacttctttctctgacattcatccgaacaacattttcactgcactatgcgtggaaaacaatggcgatggtgctcagcattgtcagcctcttccctctgtgtctatccacgacaagccagaaaacaacttggctacccgtactcctgggctcgttaggatgtaaaccccttacaatgttcctaatagcagagaataagatttggggacgaaagagttggccgctaaatgaaggaataatggcggtcggtatagtgagcatactcctaagcagcctcctaaagaacgatgtcccacttgccggccctctaatagcaggagggatgttaatagcttgctatgtaatttcaggaagctccgcggacttaagcctggagaaagccgcggaggtaagctgggaagaggaggcagagcattccggtgcaagccataacattcttgtagaagttcaagatgacggaaccatgaaaataaaagacgaggagcgcgacgataccctaacgatcctactcaaggctacactcctcgcggtcagtggagtctacccactctccatccctgcaacactcttcgtctggtatttctggcagaaaaagaagcagcgatccggagtactatgggacacaccaagtccgccagaggtagaacgcgcagtactcgatgacggaatctaccggataatgcagagaggcttgctcggacggtcacaagtgggtgtcggagtgttccaggaaaatgtatttcataccatgtggcacgtgacacgaggcgcagttctaatgtatcagggcaaacgcttagaaccctcctgggcatcagtcaaaaaggatttgattagttacgggggtggctggagattacaggggagctggaataccggcgaagaagttcaagtcatcgctgtcgaacctggcaaaaacccgaaaaacgtacagaccgctccagggacatttaaaacaagtgagggtgaggtgggcgcaatagcgctcgacttcaaaccgggcacaagcggatcgccaatcgtaaacagagagggtaaaatcgtcggactctacggcaacggtgtcgttacaacctcgggaacatacgtttccgctatagctcaagcaaaagcaagccaagaaggacccctgccagaaatagaggatgaagtattccgcaagcggaacctcactatcatggaccttcacccgggctccggcaaaacgcgccgatacctacccgccattgtaagggaagcgataaaacgccgtctacgtacacttattctggctccaacccgagtagtcgccagcgaaatggcggaggccctgaagggtatgccaatccgatatcagacaaccgctgtcaagagtgaacacacagggaaagaaatagtagacctaatgtgccacgctaccttcacgatgcggctcctctcacccgttcgagtgcccaattacaacatgataatcatggacgaggcccacttcacggatccaagctccatagcagcccgcggctatatctccacgcgagtaggcatgggagaggccgcagctatcttcatgacggctacgcctccaggctccgtcgaggcttttccccaatctaacgctgtcatccaagacgaagaacgcgacataccggaacgatcatggaacagcggatatgaatggataactgacttccccggcaagacggtatggtttgtcccgtcgataaagagcggcaatgatattgcaaactgccttcgaaagaatggaaaaagagtcatccagctgagcagaaaaacatttgacacagaataccagaagactaaaaacaatgattgggattacgtagtcacaactgacatatccgagatgggagcgaactttcgagccgaccgagtcatcgacccccgacgttgcctgaagcccgtcatactcaaggacggacccgaacgggtaatcctagcgggtccaatgcccgtaacagtagcaagcgcagcacaaagacgtggacgcataggacggaatcataataaagagggggaccaatatatttatatggggcagccactaaataatgatgaagaccacgcccactggacagaagcaaagatgctgttggacaacataaatacccccgagggaatcattccagcactatttgaaccagaacgcgagaagagtgcagcgatagacggggagtaccggctccgcggtgaggccaggaaaaccttcgtggagcttatgaggcgcggagacctcccggtatggttgtcttacaaagtcgccagcgaagggttccaatacagcgatcgtcgatggtgcttcgacggcgaacggaacaaccaagtcttagaagaaaacatggacgtcgagatatggacgaaagaaggcgagagaaagaagttaagaccgaggtggctcgacgcacgaacctattccgacccgcttgcgctcagggagtttaaggagttcgcagcagggcgacgcagcgtcagcggggacctgatccttgaaataggcaagctcccccagcacctcacccaacgggcccagaacgccctcgacaacctagtaatgctacataacagtgagcaaggagggcgcgcataccgacatgccatggaggaattaccagatacaatagagaccctgatgttgcttgcactaatcgctgtactcaccgggggagtcaccctattctttctatcgggacggggcctaggcaagaccagtatagggctgctttgcgtaatggccagctcggtgttactgtggatggcctcggtagagccccactggatcgcagcgtcgattatactcgagttcttcctgatggtattactaataccggaaccagaccgccagagaacgccgcaagacaaccagctggcgtacgtcgtgataggactgctattcatgatattgacggtcgcagcaaacgaaatgggtcttctagaaaccaccaaaaaggacctgggtatcgggcacgtggcggtcgaaaaccatcaccacgccgctatgctagacgttgacctacacccggccagtgcgtggaccctgtacgcagtcgctactacgatcatcacgccaatgatgcgtcatacaatcgagaacacgacggcgaacatatcgctgaccgccattgcaaaccaagcggcgatactcatgggactcgacaaaggctggcccatatcgaagatggacatcggtgtaccgctactcgcgctggggtgttacagccaagttaaccccctgacattgacggccgcggtgctaatgctcgttgcacactacgcaataataggcccaggactgcaagcgaaagcgacgagagaggcacaaaagcggacagcggccgggattatgaagaatcccacggtagacggcatagtggcaatcgacctcgaccccgtcgtctatgacgcaaagttcgaaaaacaactagggcaaatcatgctgctgatcctctgcacttcccagatcctcttgatgcggacgacctgggccctctgtgaaagcatcaccctcgcgacgggtccgctgacaaccctatgggagggatcccccggcaaattctggaataccaccatcgcggtttcgatggccaacatcttccgggggtcctacctagccggcgcaggcctcgcgttcagtcttatgaaaagcctcggaggcggcagacgaggtacaggcgcacagggagaaacattgggagaaaaatggaaaagacagttaaaccaactctccaagtccgaatttaacacatacaaacgcagcggaatcatggaggtggaccgttccgaagcgaaggaaggcttaaaaaggggcgagacgacaaagcatgcagtctcccgcggaacggccaaactccgctggttcgtcgagaggaatctagtcaagcccgaagggaaggtaatcgatttaggatgtgggcgtggagggtggtcatattactgcgcaggactcaagaaggtaaccgaggtgaaaggctacacaaagggtggcccggggcatgaggagccaatcccgatggccacctatgggtggaaccttgtgaagctgcactcaggaaaggatgtgttcttcattccaccggaaaaatgcgacaccctgctatgcgacatcggagagtcctccccaaacccaacgatcgaagaaggtaggaccctgcgagtactcaaaatggtggagccttggctgcgaggcaatcagttctgtataaaaatactaaacccctacatgcccagtgtcgtagaaaccttagagcagatgcagcgcaagcacggcgggatgctcgtacgaaatcccctgagcaggaactccacgcacgaaatgtactgggtatcctgtggcactggcaacattgtgtcagccgtgaatatgaccagcaggatgctcctgaataggttcacaatggcacacaggaaaccgacgtacgaacgcgacgtagacttaggcgccggcacgcgacacgtggccgtagaaccggaagtcgcaaatctagacatcatcgggcaacgaatagaaaacatcaaacacgaacacaaatcgacctggcactacgatgaagataacccctacaagacctgggcctatcacgggagttacgaagtcaaacccagtggctccgcttccagcatggtcaacggagtcgtcaaactactcacaaaaccctgggatgtcatacccatggtcacgcagattgccatgaccgacaccacaccgttcggacaacagcgggtgtttaaggagaaagtcgacacacgcacaccgaaagcgaagcgcggaaccgcgcaaataatggaggtcaccgccaaatggctgtggggctttttatcaagaaacaaaaagcccaggatctgcacacgagaggagttcacgcgaaaggtcaggagcaacgcagcaatcggagcggtcttcgtggacgaaaatcaatggaactccgccaaggaggcggttgaggatgaacgcttttgggatctggtgcatcgagaacgtgaactacacaaacaaggcaagtgcgcaacctgcgtctataatatgatggggaaacgcgagaagaagttgggagaatttgggaaagctaaagggtcgcgcgcgatctggtacatgtggctcggagcgaggttcctcgagttcgaagcactcggctttatgaacgaggaccattggttctctcgcgaaaacagtttgtccggtgtagaaggagagggactacacaagttggggtacatactgagagacatcagcaaaataccaggaggaaacatgtacgcagacgacacggcgggttgggacacgcgcataaccgaagacgacttacagaatgaggctaaaatcacggacattatggagccggagcatgccctactagccaaatcaatctttaaacttacgtaccaaaacaaggtggttcgagtccaaagacccgccaagaatggaacggtgatggatgtaataagtcgtagggaccaacgtggatccgggcaagtcggaacctacggattgaatacctttaccaatatggaagcacagctgatcaggcagatggaatctgaaggaatttttagcccgagcgagctagaaacgccaaacctggcaggccgcgtcctcgactggctagagaagcacggtgtcgaacgactaaaacgaatggccatcagcggggatgactgtgtcgttaaaccgatcgacgaccgctttgcgacagcactcacagccctaaacgacatgggaaaggtacgaaaggacataccgcaatgggaaccctcgaaaggatggaacgactggcaacaagtcccgttctgcagccaccattttcaccagctcatcatgaaggatggccgagagatagtggtcccttgccggaaccaagacgaactggtcgggcgggcaagggtgagtcaaggagccggttggtccctaagagaaactgcgtgcctgggaaagagctacgcacaaatgtggcaactcatgtattttcacagacgcgacctcagactggccgccaacgctatctgcagtgccgttcccgtggactgggtgccaacgagccgtacgacgtggtcgatccacgcccaccatcaatggatgaccaccgaagatatgctatcagtttggaaccgcgtatggatcgaggagaatccatggatggaagacaaaactcacgtatcatcatggggagatgtcccctacctcggaaaacgcgaagatcagtggtgtgggtcgctcattggactcacggcacgagccacttgggctacaaatatacaagtcgctataaatcaggtaagaaggcttctaggtaatgagaactacttagactatatgacaagcatgaagcgcttcaagaatgaaagcgatccggaaggagcgctatggtga

SEQ ID NO: 24570 - RNA, 9879 nt, synthetic construct
  misc_feature 1..9879: note = derived and/or modified CDS sequence (opt11) from DENV-1__EU482493__SS-prME
  source 1..9879: mol_type = other RNA
tcggttactatgcttctcatgctgatgcctaccgctcttgctttccacctgacgaccagaggaggggaacctcacatgattgtatcgaaacaggaacgggggaaatctctgctgttcaaaacctcagctggggtgaacatgtgcaccctcatcgcaatggaccttggagaactgtgcgaggacaccatgacatacaaatgccctcggatcactgaaacagaacccgatgacgtggactgttggtgcaacgcgactgacacctgggtgacatatggaacctgctcccagacgggcgagcatcggcgggataagcgcagcgtggctctcgctccccatgtgggcctcggcctggagacccgcactgagacctggatgtccagcgagggcgcctggaagcagatccaacgggtcgaaacgtgggccctcaggcatcccggctttacggtgatcgcgctattcttggcccacgctattgggacctctatcacccagaaggggatcatctttatcctgctgatgttagtgacgccctccatggccatgaggtgtgtcgggatcggcagccgcgacttcgtggaggggttatccggcgccacctgggtagatgtcgtactggaacacgggtcttgtgtgaccaccatggcaaaggacaagccgacgttggatatagaattactaaagaccgaggtgacgaaccccgccgtactgcggaagctctgcattgaggcaaagatatccaacaccacgaccgactcacgctgtccgacccagggcgaggcgactctcgtggaggagcaagacgccaacttcgtctgtcgtcggacattcgtggaccgcggctgggggaacggctgcggtttgttcggcaaagggtccctcatcacgtgcgccaagttcaaatgtgtgaccaagctggagggcaagatcgtccagtacgagaacctgaagtacagcgttatagtgacagttcacacgggcgaccaacaccaggtggggaacgagtccaccgagcacggtactaccgcaactatcacgccccaggcgcctaccacggagatacagttgaccgactacggcgccctaacgctagactgcagcccccgcacgggcctcgacttcaacgagatggtcctcctgacaatgaaggagaagtcctggctcgtgcacaagcagtggtttttggacctgccccttccctggacctccggggccagcacttcccaggagacctggaatcggcaggacctgctagtgacctttaaaaccgcccacgcgaagaagcaggaagtcgttgtactcggcagccaagagggcgcgatgcacactgccttgaccggggctaccgaaatccagacatccgggacgaccaccatcttcgccgggcacctgaagtgccgtctcaagatggataagctcaccctgaagggcatgtcttacgtaatgtgcacggggtcctttaagctggagaaggagctggccgaaacccagcacgggaccgtcctggttcagatcaagtacgaaggtacggacgcgccctgcaaaatccccttcagcacccaggacgagaaaggggtcacgcagaacgggcgactgataaccgccaacccgatcgtaacggacaaggaaaagcccgtgaacattgaggcggagccacccttcggggaatcttacatcgtcattggcgctggggagaaggcccttaagctgtcttggttcaagaaagggtcttctatcggcaagatgttcgaggctaccgcccgcggggcccggaggatggcaatcctgggcgacaccgcgtgggatttcgggtccatcggcggcgtgttcacctcagttgggaagctcgtgcaccaaatcttcggcaccgcatacggggtactgttctccggcgtaagctggaccatgaagattggcatcggcgtcctgctcacctggctgggcttgaactcccgctccacctccctcagcatgacgtgtatcgccgtggggctagtgacgttgtacctcggtgtcatggttcaggccgactccgggtgcgtgataaactggaagggccgggaactaaagtgcggaagcggaatcttcgtgaccaatgaggtgcacacctggacagagcaatacaagtttcaggccgacagccccaagcgcctatccgctgcaatcggcaaggcctgggaggagggggtgtgcggcattcgtagcgcgacccgcctcgagaacatcatgtggaagcagatctcaaacgagctgaatcatatcctcctcgagaacgacatgaagttcacggtcgtggtgggagatgtcgccgggatactggcacagggaaagaagatgatcaggccccagccgatggaacacaaatactcctggaaatcctggggcaaggctaaaatcatcggcgccgatgtgcagaacacgaccttcattatagacggtcccaatactccggaatgcccggatgaccaacgcgcctggaatatctgggaagtagaggactatgggttcggtattttcacgaccaacatctggctgaagctgcgggacagctatactcaggtctgcgaccatcgcctcatgtcggcggctataaaggacagcaaggccgtgcacgccgatatgggctattggatcgagtctgagaagaacgagacctggaagctggcccgggcgagcttcatcgaggttaagacgtgcatctggccaaagtcccacaccctctggagcaacggcgtcctggaatctgagatgattatccctaagatatacggagggccgatcagccagcacaactaccgaccggggtactttacccagactgccggcccgtggcatcttgggaaactcgaacttgatttcgatctgtgcgagggaacaaccgtcgtcgtcgacgagcactgtggcaaccgggggccgagcctccgcacaactacggtgaccggcaagattatccatgaatggtgctgccggtcttgcaccctgccgcctttaagattcagaggggaagatggctgctggtacggtatggaaatccggcctgtgaaggaaaaagaggaaaacctggtcaaaagcatggtcagcgccggtagcggggaagttgattccttcagcctggggctgctctgcatctccataatgattgaggaggttatgcggagccggtggtcccggaaaatgttaatgaccggaactctagccgtcttcttcctcctaatcgtgggccagttaacctggaacgacttgatccgcctatgtatcatggtcggcgccaacgcgagcgaccggatgggaatgggcaccacctacctcgccctcatggccacgtttaaaatgcggccgatgttcgccgtcggcttgctttttcgtagactcacaagccgtgaggtcttgctgctgacaatcgggctgagcctagtcgccagtgtggaactccccaattcgttagaagaactgggggatggactcgcgatgggcataatgatcctgaaactgctcacggactttcaaagtcaccagctctgggccacactgctcagcttgaccttcatcaaaaccaccttctctctgcactacgcttggaagactatggccatggtcctcagcgtggtgagtctattcccgctgtgtctctctacaacgtcccagaagactacatggctgcccgttcttcttggcagcctaggttgcaagccgttaactatgttcctaatcgcggagaacaaaatctggggcagacgctcctggccgctgaatgaagggataatggccgtgggcatagtgtctatcttactgagctccctactgaagaacgatgtaccgctcgccgggccgctgattgccggcggcatgctgatcgcatgctacgtcatcagcggttccagcgcagacctatcccttgagaaggccgccgaagtgtcttgggaggaggaggccgagcactccggtgccagccacaacatcctagttgaggtgcaggacgatggcactatgaagattaaagatgaggaacgggacgataccctcaccatcttgctgaaagccactctcctagctgtgtccggtgtctaccccctgagcatccctgcgacactcttcgtttggtacttctggcagaagaagaaacagcgctccggggtgctgtgggatacaccaagcccacccgaggtcgaacgggccgtgctggacgacggcatctacaggatcatgcaaaggggcctgcttgggcgctcccaagtcggggtaggggtgttccaggagaatgtattccacaccatgtggcatgttacgcgaggtgccgtgctgatgtaccaggggaagcgactggagcccagctgggcttcagtgaagaaggacctcatcagctacgggggcgggtggcgcctgcaggggtcctggaacaccggggaggaggtccaggtgatcgccgttgagcccgggaagaatcccaagaatgtccagacggcccccggcaccttcaagacgccggagggggaggtgggagcgatcgccctggacttcaagccgggaaccagcggctcccccatcgtgaaccgagagggtaaaatcgttggtctgtatggcaacggggtggtcaccacttccgggacctacgtcagcgccatcgcgcaagccaaggcctcccaagaggggccgttacctgagatcgaggacgaggtcttccggaagcgcaacctgaccatcatggacctccatcccggctcggggaaaacccggcgctacttaccggcgatcgtgcgggaagccatcaagcgtaaactgcgaaccttgatccttgccccaactcgggtcgttgccagcgaaatggccgaggcgctcaaaggcatgcccatccgctaccagactaccgcggtcaagagcgagcatacaggtaaggaaatcgtcgacctcatgtgccacgccacgttcaccatgaggctactttcccccgtgagagtaccgaattacaatatgatcatcatggacgaggcccactttaccgaccccagctccattgccgcgcgggggtacatctcgacaagggtcgggatgggggaggctgccgccatattcatgaccgccacacccccaggcagtgtggaggctttcccacaaagcaacgccgttatccaagatgaggagcgggacattcctgagagatcctggaacagcggttatgagtggatcaccgacttccccggcaagacggtatggtttgtaccctccatcaagagcggaaacgatatcgccaattgcctcaggaaaaacgggaagagagtgatccaactaagtcgcaagacgtttgacaccgagtatcagaagacaaagaataatgactgggactacgtggtgactacggacatcagcgaaatgggcgccaactttcgcgcggatcgggtgatcgacccacgccgctgccttaagcccgtcatcctcaaggacgggccagagcgcgtgatcttggccggtcctatgccggtcacggtggcatccgcagcgcagcggcgcgggagaattggcagaaaccataacaaagaaggcgaccagtatatctacatggggcagccactgaataacgacgaggatcacgcgcactggacagaggccaagatgctcttagacaacatcaataccccagaagggattatccccgctttattcgaaccggagcgtgagaagagtgcagcaatcgacggggagtaccggctacgcggcgaagcccggaagacattcgtagaactaatgcgccgcggggacttgcccgtgtggctctcgtacaaagttgccagtgagggattccagtatagcgacagacggtggtgtttcgacggcgagagaaacaaccaggtactagaagagaacatggacgtcgagatctggactaaggaaggggagcggaagaaactgcgcccgaggtggcttgacgcgcgaacttattccgacccgttagccctgcgagagttcaaggagtttgccgctggacgccggtcggtgtccggggaccttatcctggagatcggcaagctgccccagcacctgacgcagcgcgcgcagaacgcgctggacaatctagtgatgttacacaacagcgagcagggtggtcgggcctatcgccacgcgatggaggagctccccgacacgatcgagactctgatgctcctggctctgattgccgtactgacgggcggggtgaccctgttcttcctgtccggccggggactcggcaagacctcaatcgggcttctgtgcgttatggcttccagcgtcctcctgtggatggccagcgtcgagccgcactggatcgcggccagcatcatacttgagttcttcttgatggtgctgttaatacccgagccggatcgacagcgcacaccccaagataaccagctcgcttacgtcgtcatagggctgctgttcatgatcctaacagttgcagcaaatgagatgggcctcctggagacaaccaagaaggacctcgggataggtcacgtcgcggtggagaaccaccaccacgccgccatgctcgatgtggacctgcatcccgccagtgcttggacgctctacgcggtggccaccaccatcatcactccgatgatgagacataccatcgagaacaccacagccaacatcagcctgaccgccatcgccaaccaagctgccatcctgatgggattagacaagggctggccaatctcaaagatggatatcggcgtgcccctcctggccctcggatgctatagccaggtgaaccctctgactctgaccgccgcagtcctaatgcttgtagctcattacgccatcataggccccggtctgcaggctaaggctactcgtgaggcgcagaagcggactgccgccggcatcatgaagaacccaaccgtggacgggatcgtcgccatcgaccttgaccccgtcgtctatgacgcaaagttcgagaagcagttaggccagataatgctcttaatcctgtgcaccagccagatcttactcatgcgtaccacttgggcgctgtgcgagtccattacactggctaccggccctctcaccacactgtgggagggctcgcctggtaaattctggaacacgaccatcgccgtcagcatggcgaacatattccgcggaagttacctggcgggcgctggcctcgccttctccctgatgaagtccctcgggggcgggcgcagggggaccggtgcacagggtgagaccttgggtgaaaaatggaagcgccagctgaatcagctctccaagagcgagttcaacacgtacaaacggagtgggatcatggaggtggatcgcagcgaggcgaaggagggcctcaagcgtggggagactaccaagcacgctgtgtccaggggcaccgcgaagctgcggtggttcgtcgagcgcaacctggttaagcctgagggcaaggtaatagacctcggatgcggcaggggcggctggagctactactgcgccgggctcaagaaggtcactgaagtaaagggctacaccaaagggggccccggccacgaggagccgatacctatggcgacgtacgggtggaatcttgtgaagctgcattccggcaaggacgtcttcttcataccccctgaaaagtgcgacacactgctgtgcgatataggggaaagttcccctaacccgacgatcgaggaaggccgcacccttcgggtgctcaagatggtggaaccttggcttcgcgggaaccaattctgtatcaaaatcttaaacccctacatgccctctgtcgtggagaccctcgagcaaatgcaacgtaaacacggcgggatgctggtacggaacccgctttcccgcaacagcacccacgagatgtattgggtgagctgcgggaccggcaacatcgtgagcgccgtaaacatgacatcccggatgctcctaaaccgctttaccatggcgcaccggaaacccacctacgagcgcgacgtggaccttggggccgggactcgccacgtggcagtcgagcccgaagtcgccaacctcgacatcatcggtcagcgcatcgagaacatcaagcacgaacacaagtcaacctggcactacgatgaggacaacccttacaaaacctgggcctatcatgggtcctacgaagtaaagccgtctgggagtgcgagcagcatggtcaacggggtggttaaactgctgacgaaaccctgggacgtcatccccatggtgacgcagatcgccatgacagatactacccccttcggtcagcagcgggtgttcaaggagaaggtcgacacgagaacgccgaaagcgaaacgggggaccgcccagataatggaggtgaccgccaagtggctctggggattcctgtcccgcaacaagaagccccgtatctgcacccgcgaggagttcacgagaaaggtgagaagcaacgcggccattggtgccgtcttcgtggacgagaaccagtggaacagtgcaaaggaggctgtggaggacgagcgtttttgggacttggtccaccgcgagcgggaactgcacaagcagggtaagtgtgcgacctgcgtgtacaacatgatgggcaaacgggagaagaaactgggggagttcggcaaggccaaggggagccgggccatctggtacatgtggctgggcgcccgtttcctagagtttgaagctctgggtttcatgaacgaggaccactggttctccagagagaacagcctctccggtgtggagggcgaggggcttcacaaattggggtacatattgcgcgacatctccaagattccagggggtaatatgtacgccgatgacaccgcaggctgggacacccggattactgaggacgatctccaaaacgaggcgcgcataaccgacattatggagccggagcacgcccttttggcgaagtccatcttcaagctcacctaccaaaacaaggtagtgagagtgcagcgccccgccaagaacgggacggtcatggacgtgatcagtcgtcgggaccaaaggggatccggccaggtagggacgtacggtctgaacaccttcacaaacatggaggcccagcttatcaggcaaatggagagcgaggggatcttcagtccatctgagctcgaaacccccaatctggcagagcgcgtcctcgactggttagagaagtacggcgtggagcgattgaagcgcatggcgatctcaggagatgattgtgtggttaaaccgatcgatgaccggttcgcgacggccctgactgccctcaacgatatgggcaaggtgcgcaaggatatcccacagtgggaacccagcaaggggtggaacgattggcaacaagtccccttttgctcccaccatttccaccagctgatcatgaaggatgggcgagaaattgtggtaccttgtcgcaaccaggacgaactggtgggacgcgccagagtcagccagggagcagggtggagcttgcgggagactgcgtgcctagggaagtcctacgcccagatgtggcagctgatgtacttccaccgtcgggacctgcggctggccgcgaatgcaatttgttcggcggtgcccgtggactggatccccacctcccgaacgacctggagcatccacgcacaccaccaatggatgacgacggaggacatgttatccgtctggaaccgcgtgtggattgaggagaacccctggatggaagacaagacgcacatatcttcctggggagacgtgccgtacctcggcaagcgcgaggaccagtggtgcggcagcttgatcggactgacggcccgggctacctgggcaaccaacatccaggtcgccatcaaccaggttcgccggcttatcgggaacgagaattacctggactatatgacctccatgaagcgtttcaagaacgagagcgaccccgagggggccctatggtag

SEQ ID NO: 24571 - RNA, 9879 nt, synthetic construct
  misc_feature 1..9879: note = derived and/or modified CDS sequence (opt11) from DENV-1__EU482494__SS-prME
  source 1..9879: mol_type = other RNA
tccgttaccatgctgctaatgctgatgccgaccgcacttgcctttcacctcacgacacgggggggggaaccacacatgatcgtgagcaagcaggaacggggtaagtctctgctgttcaagaccagtgctggggtgaacatgtgcacgctcatcgccatggacttgggcgagctgtgcgaggacactatcacttacaaatgccctcgcatcaccgagaccgagccggacgacgtggactgctggtgcaacgccacagatacctgggttacgtacgggacctgctcacaaaccggcgagcatcgtcgtgacaaacggtccgtggcactcgctccccacgtgggcctgggattggaaacgcggaccgagacctggatgagctccgagggcgcatggaagcagatccagcgggtcgaaacgtgggccctccgccatccgggttttaccgtgatagccctgttcttggcccacgcgatcggtactagcatcacccagaaggggatcatctttattctcctgatgctggccacgccctccatggccatgcggtgcgtggggatcggctcacgtgacttcgtggaagggctttccggcgccacttgggtggatgtggtcctggaacacgggagctgcgttaccaccatggccaaagacaagcccacgctggacatcgagctactgaaaaccgaggtgaccaaccccgctgttctgcggaagctctgcatcgaggcaaagatctccaataccacgacggacagcaggtgccccacacagggcgaagcgacgctggtagaagagcaggatgcgaacttcgtgtgccgacgaacattcgtcgaccggggctggggaaacgggtgcggactgttcggcaagggttccctaataacgtgcgctaagttcaagtgcgtaactaaactcgagggcaagatcgtccaatacgaaaacctcaagtatagtgtcatcgtgaccgtgcacaccggcgaccagcaccaggtggggaacgagtcaacagagcatggcactaccgcgaccataacgccccaggcccccacgacagagatccaactcacggactatggagccctgacgctggattgcagcccaaggaccggactcgattttaatgagatggtgctgctgacaatgaaggagaagtcctggttagtccacaagcagtggttcctggacctgccgttaccatggaccagcggggcctcaacgtcccaggagacctggaacaggcaagacctcctggttaccttcaagactgcccacgcgaagaaacaagaggtggtcgtgctcggaagtcaagagggtgctatgcacacggctctcaccggggccaccgaaatccagacctccggcacgaccacaatcttcgcagggcacctaaaatgtcgccttaagatggataagcttaccctacgaggaatgtcgtatgtgatgtgcacgggctccttcaagctcgaaaaggaggtcgctgagacccagcacggcactgtattggtacaaatcaagtacgagggcaccgatgctccctgcaagataccattcagcacgcaggacgagaagggggtcacgcaaaacggccgcctgattaccgccaacccgatcgttacagacaaagaaaagcccgtcaacatagaagcagagccgccattcggggaatcctacatagtcatcggcgcgggcgagaaggccctgaagctgagctggttcaagaaaggctccagcatcggtaagatgttcgaggccacggcccgcggggcccgtcgaatggctatactgggggacaccgcctgggacttcggctccatcggaggcgtgttcacatcagtgggtaagcttgtccatcaaatcttcggcactgcctacggggttctgttctccggcgtgtcttggacgatgaaaattgggattggcgtactgctgacttggcttggccttaactcgaggtcgacctccttaagtatgacctgcatcgccgtagggctcgtgacgctgtacctaggcgtcatggtgcaggccgattccgggtgtgtaataaactggaaggggagagagctcaaatgcgggagcggcatcttcgtcaccaacgaggtgcacacctggaccgagcagtacaagttccaggcggacagcccaaagcgattgtcagccgcaatcggcaaggcctgggaggagggtgtgtgcggcattcgctccgccacccggctggaaaacatcatgtggaagcaaatatctaacgagctcaatcacatactgctcgagaatgacatgaagtttactgtcgtcgtgggggacgttgcggggatcctcgcccagggcaagaagatgatccgccctcagccgatggaacacaagtacagctggaagtcctggggcaaagccaagatcattggcgcagacgttcaaaacaccaccttcatcatcgacgggccaaatacccctgaatgccccgacgaccagcgggcttggaacatctgggaggtggaggactacggcttcggtatcttcacaaccaacatctggctgaagctgcgagacagctacacccaggtatgcgaccataggctcatgtccgccgccataaaggacagtaaggccgtgcacgcggacatgggctactggatcgagtccgaaaaaaacgaaacatggaagctggcgcgcgccagtttcattgaggtgaagacgtgtatttggccgaagtcacacaccctatggtcaaacggcgtcctagagagtgagatgatcatacctaagatctacgggggacctatctcacagcacaattacagacccggctacttcacccagaccgcaggcccctggcacctggggaagctggaactcgactttgacctgtgcgaaggcacgaccgtggtggtcgatgagcactgtggtaaccgcgggccgtcgttacggaccaccacggtgaccggaaagatcatccacgaatggtgctgccgcagctgcaccctgccgcctctccggtttcgtggggaagacggatgttggtacggaatggagatcaggcccgttaaggaaaaagaggagaatctagtcaaatccatggtgagcgccggctcaggtgaagtggatagtttcagtctcggactgctgtgcatttccatcatgatcgaagaagtcatgcgcagccggtggagccgcaagatgctcatgaccggcacgctggccgtgttcttcttactaatcatgggtcagctgacctggaacgacctgatccgtctctgtatcatggtgggcgcgaacgccagcgaccggatggggatgggtactacctacctggccctaatggctacgtttaagatgcgaccaatgttcgccgtcggtcttctgttccggcgactgacctcccgggaagtgctcttactgactatcgggctcagcttggttgcgtcggtcgaactgcccaacagcctcgaggagctgggcgacggactggcgatgggcatcatgatcctgaagctgctgaccgacttccagtcccaccagctatgggccacgctgctgagcctaacgttcatcaagaccacttttagtctgcactacgcctggaagaccatggcaatggtgctctcaattgtctccctcttcccactgtgcctgagcacgacctcccagaaaaccacgtggctccccgtgctgctgggaagcctcgggtgtaagccgctgactatgtttctgatcgcagagaacaaaatctggggccggcggtcctggccattgaacgaggggatcatggccgtaggcatcgtctcgatactgttgtcttccctgctgaagaacgacgttcccctggccggtcccctcatagccggcggcatgctgattgcgtgctacgtgatcagcggaagcagcgcagacctgtccctcgagaaggccgctgaggtctcatgggaagaggaggccgagcactcgggcgccagccataacatactggtcgaagtgcaagacgacgggacaatgaaaataaaggatgaagagcgcgacgacacgctgaccatcctcttgaaagccacgctgttggccgtctcgggagtgtaccctttatctataccggccacgctcttcgtgtggtacttctggcagaagaaaaagcagcgaagcggggtcctgtgggacaccccgagcccacccgaggtcgagcgcgccgttctcgatgacggcatctatcggatcatgcagaggggtttactggggcgcagccaagtcggagtgggtgtgttccaggagaacgtcttccacaccatgtggcacgttacgcgcggcgccgtgctcatgtaccaggggaaacggctggaacccagctgggcctccgtgaagaaggacttgatcagctacggcggagggtggcgactccagggctcctggaacaccggcgaagaggtccaggtgatcgccgtcgagcccggaaagaatcccaaaaacgtgcagacagcccccgggaccttcaaaacacccgagggagaggttggcgccatcgctctggacttcaagcccggtacttcgggctcccctatcgtaaaccgggaggggaagatcgttggactatacggcaacggggtggtcaccaccagcggcacatacgtgtcggccattgcccaagccaaggcgagtcaagaggggccgctgcccgagatcgaggacgaggtcttccgcaaacggaacctgaccataatggaccttcatcccggcagcgggaagacccgccgttacctcccggcaatcgtcagagaagctatcaagcgtaagttgcggaccctgatcctcgccccgacgcgagtggtggcttcagagatggcggaggcactgaagggaatgcccatccggtatcagacgaccgctgtcaagagcgagcacactggcaaagaaatcgtggaccttatgtgtcacgctacgttcactatgcgcctcctgtcccccgtgcgtgtcccgaactataacatgataatcatggatgaggctcactttaccgacccaagctccatcgcggcccgcgggtacatctctacccgggtgggcatgggggaagccgccgcgatcttcatgacagcgacgccgcccggctccgtggaagccttcccgcagagtaacgccgtcatccaggacgaggagcgggacattcccgagcggtcgtggaactcaggttacgagtggatcaccgacttccccggcaagaccgtatggttcgtgccctccatcaagtccggcaatgacattgctaactgtttgcgcaagaacggtaagcgtgtcatccagcttagccgcaagactttcgacaccgaataccagaagaccaaaaacaacgactgggactacgtggtgaccacggacattagcgaaatgggggcgaacttccgcgccgaccgcgtaattgacccgcggaggtgcctgaagcccgtaatactgaaggacgggcccgaacgggtgatactcgccggccctatgccggtaaccgtagcctccgcagctcaacgtcgcgggcgcatcggtaggaaccacaacaaggagggcgaccagtacatctatatggggcagcccctgaacaacgacgaggatcacgcgcactggacggaggccaaaatgctgctcgacaacatcaacacccccgaaggcatcattcccgccctcttcgagcctgagcgggagaagtctgccgcgatcgacggtgagtaccgcctacgcggcgaagcaaggaagacgttcgttgaattaatgcgccgcggtgacttgcccgtatggctgtcgtacaaggttgccagcgaggggttccagtactcggaccggcgctggtgcttcgacggcgagcgtaataaccaagtcctcgaggaaaacatggacgtggagatctggaccaaggagggcgagcgcaagaagctgcggccccgctggctggacgcccgaacgtactccgaccccctagccctgcgtgaattcaaagaattcgccgccgggcggcgctctgtctccggggacctgattctcgaaataggcaagctcccgcagcacctcacccagcgggcccagaacgcccttgacaacctggtaatgctgcacaacagcgagcagggagggcgtgcgtataggcacgccatggaggagctccccgacacgatcgagactttgatgctactcgctctgatcgccgtgctgacaggaggggtgaccctcttcttcctgtccggccgcgggctgggcaagactagcatcggcctcctttgcgttatggcctccagtgtgttactctggatggcgagtgtggaaccccactggatcgccgcttcgatcatcctggagttcttcctgatggtcctcttaattcctgaaccggaccggcagcggaccccccaggacaaccagctggcctacgtggttattgggcttctgttcatgatcttgaccgtagccgcaaacgaaatgggcctgctggagaccacgaagaaggacctggggatcggccatgttgccgtagagaaccaccaccacgctgctatgctggacgtcgacctgcaccccgcctcagcctggacgctgtacgccgtagccaccacgatcatcaccccaatgatgcgccacacgatcgagaacacaactgcaaacatctcgctcacggccatcgctaaccaggcggcgatcttgatggggctggacaagggctggcctatatccaagatggacatcggcgtacctctcctggcgctcggatgctacagccaggtcaaccccctaacgctgaccgccgccgttctgatgctagtggcccattacgccattatcggcccggggctacaggcaaaggcgacccgagaggcgcagaaacgcaccgccgcaggcatcatgaaaaaccccacggttgacgggatcgtggctatcgacctagatcccgtggtctacgatgccaagttcgagaaacagctcggccagatcatgctgctgatcctttgcacgtcccagattttgctgatgcggaccacatgggccctctgcgaatcgatcacccttgccaccggccccctgactaccctatgggagggatcgcccggcaagttctggaacactaccatcgccgtaagcatggccaacatatttcgggggtcctacctggcgggcgccggcctcgccttctcactcatgaaatccctagggggcgggcggcgagggaccggcgcccagggggagacactgggcgagaagtggaagcggcagctaaatcagctgtccaaaagcgagtttaacacatacaagcgcagcgggataatggaagtggaccggagcgaagcgaaggagggccttaaaaggggggaaacgacaaagcacgccgtatcccggggcaccgcgaaactccgctggttcgtcgagagaaacctggttaagcccgagggcaaggtcatagacctcggctgcggcagagggggctggtcctattactgcgcaggactgaaaaaggtgacggaggtgaagggctacaccaaaggcggacctggccacgaggagccaataccgatggcaacatacgggtggaacttggtgaagctgcattctggtaaggacgttttcttcatcccccccgaaaagtgcgatacgctgctctgcgacataggggaaagctcgcccaacccaacgatagaggaagggcggaccctgcgggttttaaagatggtggagccctggctacgggggaaccaattctgcatcaagatcctcaacccctacatgccttctgtagtagaaaccttagagcagatgcaacgcaagcacggtgggatgctcgtacggaaccctctctccaggaactctacccacgaaatgtattgggtttcctgcggaactgggaacatcgtgtctgcggtcaacatgacgtcccgcatgctcctcaaccggttcaccatggcccaccgcaagcccacatacgagcgggatgtggatttaggcgcgggcacccgacacgtggccgtcgaacctgaggtggctaaccttgacatcataggccagcggatagagaacatcaagcacgagcacaagagcacctggcactatgacgaagacaacccatataagacctgggcgtaccatggatcttatgaggtaaagccgagcggtagcgccagctcaatggtcaacggggtcgtaaagctccttaccaagccctgggacgtcatccccatggtgacgcagatcgccatgacggacaccacccccttcggtcaacagcgcgtattcaaagagaaggtcgacacccgtactccgaaagcaaagcgcgggaccgcacagatcatggaagtgaccgctaagtggctttggggcttcctatcccggaacaagaagcccagaatttgcaccagagaggaattcacacgcaaggtccggagcaatgctgctataggggccgtcttcgttgatgaaaaccagtggaattccgcgaaggaagccgtcgaagacgagcgcttttgggacctggttcaccgtgagcgagagctgcacaaacaggggaagtgcgcgacctgcgtgtacaatatgatgggcaagcgagagaagaagctaggggaattcgggaaggccaaaggaagccgcgccatatggtacatgtggctgggggcgcggttccttgagttcgaggccttaggctttatgaacgaggaccactggttctctcgtgagaacagcctttctggggttgagggagaggggttgcacaagctcggctacatcctgcgggacatcagcaagattccaggggggaacatgtacgccgacgacaccgccggctgggataccagaatcacggaggatgacttacagaatgaggcccgcatcactgacatcatggaacctgagcacgccttgctggctaagtccattttcaagcttacctaccagaacaaagtcgtgcgggttcagcgccccgccaagaacgggactgtgatggacgtcatctcgagacgcgaccagcgggggtcagggcaggtcggtacctatggactaaataccttcaccaacatggaggcccagctgattcgccagatggagagcgaagggatcttctccccctccgagctggagacccccaatctcgccgagcgggtcttggactggctcgagaagtacggcgttgagagactaaagcggatggctatctcgggcgacgactgcgtcgtgaaaccgatcgatgaccgcttcgccaccgctctgaccgccctgaacgacatgggcaaggtgcgtaaggacatcccccagtgggagccatcaaaggggtggaacgactggcagcaagtcccattctgcagccaccatttccaccaactcattatgaaggatggcagagaaatagtggtcccgtgccgcaatcaggacgagctggttggccgcgcccgggtcagccagggtgccggctggtccctgcgcgagactgcctgtctcggaaaatcctacgctcaaatgtggcaactgatgtatttccacaggcgcgacctgcggctagccgcgaatgccatctgtagcgccgtgcccgtcgattggattcccacttctaggactacctggagcattcacgcccaccatcagtggatgaccaccgaggatatgttgagtgtgtggaacagagtgtggatagaggagaacccctggatggaggacaaaacgcatatctcctcctggggtgatgtcccgtacctggggaagcgtgaagatcaatggtgcggttcactcatcggcctgaccgccagggcaacttgggccaccaacatccaggtagccatcaaccaagtgcggcgcttaatcggcaacgagaactacctcgactacatgacgagtatgaagaggttcaagaacgagagtgaccccgagggcgcattgtggtag

SEQ ID NO: 24572 - RNA, 9879 nt, synthetic construct
  misc_feature 1..9879: note = derived and/or modified CDS sequence (opt11) from DENV-1__EU482495__SS-prME
  source 1..9879: mol_type = other RNA
agcgtgacgatgctacttatgctgatgcccaccgctctagcttttcatctgacgacgcgaggaggggaaccgcatatgatagtcagtaaacaggaaaggggcaaaagcctcctgttcaaaacgtctgcgggggtcaacatgtgcactcttatagccatggacctgggagaactatgcgaggatacgatgacatataagtgtccacgaatcacggaagtagagcccgacgacgtcgattgttggtgcaacactaccgacacctgggtgacttacggcacatgtagccaaacaggggaacacagacgggacaaaagatcagtagcactcgcaccccatgtaggcctagggctggaaacacgcgcagagacttggatgagctcggaaggagcctggaaacaaatacaaaaggtcgagacctgggcgctccggcacccgggctttacagtcatagcactcttcctcgcccacgcaatcgggacatcgatcacacagaagggtataatatttatactgctaatgctggtcacaccctccatggcaatgagatgcgtaggaatcggaagccgagacttcgttgagggcctatcaggggcaacctgggtagacgtggtgctcgaacacggctcctgcgtaaccacaatggctaaagacaaaccaactttggatatagaactgttaaaaaccgaggtgacgaatccggccgtcctgcgaaaactatgcatagaagcgaagatttccaacacgacaactgactcgaggtgcccgacccaaggggaagccaccctggtggaggaacaggatgctaacttcgtatgcagaagaacattcgtggatcgagggtggggaaatggatgcggcctcttcggaaaaggatcgctaataacctgcgcaaaattcaaatgtgtcacaaaattagaaggcaagatagtccaatacgaaaatctcaaatacagcgttatagtcacagttcacaccggagatcaacatcaagtaggaaacgaaagcaccgagcacgggaccacagccacgataacaccccaagctccaacaagtgaaatacaactaacagattacggagccctcaccctagactgctcacctagaacaggtttagatttcaacgaaatggtgctattaacaatgaaagaaaaatcgtggctggtacacaagcaatggttcctagacctaccactgccatggacatccggggcctcaacatcccaagaaacgtggaaccgtcaggacctgcttgtgacattcaaaacagcacacgccaagaaacaggaagtagtggtccttggcagccaagagggggccatgcacacggccctcactggtgccaccgagattcaaacaagcggcacaaccacaatcttcgccggtcacctaaaatgccgcctcaaaatggacaagctgacgctcaaaggaatgtcatacgtaatgtgtaccggactcttcaaactcgagaaagaggtagcggagactcaacacggaactgttttagtacagattaaatacgaaggaaccgacgcaccatgcaagattcccttcagcacacaagatgaaaaaggagtgacccagaacggacggctcattacggctaatccaatcgtcacggacaaagaaaaaccggtgaacatagaagccgaacctcccttcggcgagagctacatcgtcatcggagctggggaaaaagccctaaaactctcctggttcaagaaaggcagcagcatcggtaaaatgttcgaggccactgcgcgtggggcccgcaggatggcgatcctgggggataccgcgtgggatttcggcagcatcgggggagtcttcacaagcgtaggaaagctagtacaccaaatattcggtacagcgtacggagtgctattctcaggagtgagctggacaatgaagatcggcatcggagtactcctgacctggctcgggctaaattccagatccacgagtctttcgatgacatgcatcgccgtaggcctagtaaccctgtacttgggtgtcatggtgcaagcagactctggatgtgtcattaactggaagggacgggaactgaaatgcggaagtgggatattcgttacaaacgaggttcacacgtggactgagcaatataaatttcaggcggactcgccaaaacggctatcggcggcgatcgggaaagcatgggaagaaggtgtatgcggtatccgttcagcgacacgcctcgagaacataatgtggcgccaaattagtaatgagctaaaccatattctcctcgaaaacgacatgaagttcacagtggtcgtaggcgacgtcgtcggcatacttgcccaaggcaagaagatgattagaccacagccaatggaacataagtactcatggaaaagctggggaaaagccaagataatcggcgcagacgtccaaaacacaacatttataattgatgggccgaatacccccgaatgccccgatgatcagagagcctggaacatatgggaagtggaggattacggttttgggatatttacaactaacatatggctcaaattacgggacagctacactcaggtttgcgaccatcgccttatgtctgcggctatcaaagactccaaggcggtccacgcagatatgggctactggattgagagcgagaaaaatgaaacctggaaactggcccgcgccagcttcattgaagtaaaaacgtgcatatggccaaaatcccacacattatggagtaatggcgtgctggaatcggaaatgatcataccaaaaatatacgggggccccatttcacaacacaactaccgtcccggttacttcacacaaaccgcaggaccatggcacctcgggaagctagaactggacttcgacctctgcgaagggacgaccgtcgtagtggacgagcactgcggaaaccgcggcccaagtcttcggacgaccacggtgacgggcaaaataattcatgaatggtgctgtagaagttgcacactcccaccccttcggtttaaaggagaagacggatgctggtacggaatggaaatacggcccgtgaaagaaaaggaggaaaatctggttaaatcaatggtatccgcgggctcgggagaagtcgactcattctccttaggactattgtgtatctctatcatgatcgaagaggtgatgcgctcccgatggtcacgaaaaatgcttatgacgggcacgctcgcagtgttcttcctgctgattatggggcagctcacgtggaacgacttgatacgcagctgcataatggtaggcgcaaatgcctcagaccgaatgggcatgggcactacatatttggccctgatggcgacattcaagatgcgtccaatgttcgcggtggggctactgtttaggagactgacttctcgagaagtgttactcctaacaattggcctgtcactcgtggcgtcagtcgaattgcccaattctctagaggagctaggggacggccttgcaatggggattatgatcctaaagctattaacagacttccaatcctatcaactctgggctacgctgctttcgctcacttttatcaaaaccactttttcactccactatgcatggaaaacaatggcaatggtgctgagtattgtctcgttattgccgttatgcctaagtaccacgagtcagaaaacaacttggctaccagtcctactcggcagcctagggtgcaagcccctcacgatgttcctgatagcagaaaacaagatttgggggcgtaagtcatggccattaaacgagggaataatggcggtcggaattgttagtatcctactctcatcattactaaagaacgatgttcccctcgcaggtcccctcattgcgggcggcatgcttatcgcgtgctacgtaatctctggctcatccgcagatctctcgctagaaaaggcggccgaggtatcatgggaagaggaagcggaacactctggagcgagtcacaacatacttgtcgaggtccaagacgacggaaccatgaaaatcaaagacgaagaacgggacgatacactaacaatactactgaaggccacactgctagcagtgagtggagtatacccactcagcatcccagccacgctctttgtctggtacttctggcagaagaagaaacagcgcagtggagtgctatgggacacaccatcaccgccagaggtggaacgtgctgtgctcgatgacggcatatacaggatcatgcaaagaggccttctaggacgttcgcaagtgggcgtaggcgtgttccaagagaacgtgtttcacaccatgtggcacgtgacgcgaggcgcagtactgatgtaccaaggaaaacggctggaaccgtcctgggcgtccgtcaagaaagatctgatcagctatgggggaggatggcgcctccaaggatcctggaacacgggcgaggaagttcaggttattgccgtagagccagggaagaaccccaagaatgtgcaaaccgccccggggaccttcaaaacgccagagggagaagtcggggcgatagccctagacttcaagcccggcacaagtggatcccccatcgtcaaccgagagggaaaaatagtaggcctatacggaaacggagtcgtgactacaagcggcacgtacgtaagcgcgatagcacaagcgaaggcgagtcaagagggacccctaccggagattgaagacgaagttttcagaaagaggaaccttacgataatggacctacaccccggcagtggaaaaacccgacgatacttacctgccattgtcagggaagcaataaagaggaagttaagaacgttaatactggccccaacccgcgtcgtagccagcgaaatggccgaagcgttgaaagggatgccaatcagatatcagacaacagcggtaaagtctgagcacacgggacgcgagatcgtggacctcatgtgccatgcgaccttcacaatgcggctccttagcccggtgagagtcccgaactacaacatgatcatcatggacgaagcccatttcaccgacccatcatcgatcgccgccagaggatacattagcacgcgcgtaggcatgggcgaggcggccgcgatcttcatgacagcgacacccccgggaagtgtggaagcctttccgcaatcaaacgccgtaatccaagacgaggagagggatataccagaacgttcctggaactctggctacgagtggataacggatttcccaggcaagaccgtgtggttcgtacctagtatcaagagcggcaacgacatagccaactgtctccggaaaaacgggaaaagggtaatccaattaagccggaagaccttcgatacagaataccagaagaccaaaaacaacgactgggactacgtagtaacgacggacatctcagaaatgggggccaacttccgagcagatagggtgatcgacccaaggcggtgcctaaaaccggtcatcctaaaagacggtcctgaacgagtcatactagcaggaccgatgccagtgaccgtagcatcggccgcccaaagacggggccggatcgggcgtaatcacaacaaggagggggatcaatacatttacatgggacaaccattaaataacgatgaagaccacgcccactggaccgaagccaaaatgctcctcgacaacataaacacaccagaaggaatcatcccagcactgtttgagccggaacgagaaaaatccgcagccatagacggcgaatatcgcttgcgcggggaggcccgcaagactttcgttgaactaatgaggagaggggacctaccagtctggctctcttataaagtggcctcggaaggattccaatacagcgaccggcgctggtgcttcgacggcgaacgaaacaaccaagtattagaagaaaacatggacgtcgaaatatggaccaaagaaggcgaacgaaagaaactgcgcccacggtggctagacgcccgaacgtatagcgacccactcgcactgcgagagttcaaagagttcgcagccggcaggagatcagtatctggtgatctgatattagagataggaaaactgccacaacacttgacgcagcgcgcacagaatgccctcgataacttagtcatgttgcacaactccgagcaaggagggcgcgcgtacaggcacgctatggaagaacttcccgacacgatagagactctgatgctcctagcgctaatcgccgtcctcaccgggggtgttacactcttcttcctatctgggcgtggcctaggcaaaacaagcattggtctgctatgcgtcatggcatcgagtgccctgctatggatggcctcggtagagccccactggatagcggcttccataatactcgagttcttcctcatggttcttcttatccccgagccagacaggcaacgaactccacaggataatcaattagcgtatgtggtcatcggtctgctgttcatgatcctcactgtggcagccaacgaaatgggactactcgaaactacgaagaaagaccttggcatcgggcatgtagcagtcgagaaccatcaccacgcaactatgcttgacatcgacttacaccccgcgagcgcatggactttatacgccgtagctaccacgattatcacgcccatgatgcgccacaccattgaaaacacaacagcaaacatctctctgacagctatagccaatcaagcagcgatattaatgggactcgataaaggctggccaatcagtaaaatggacataggcgtccctttacttgcactgggatgctactcccaagttaacccactgacactgacggccgccgtactgatgctggtggcgcactacgcaatcatcgggccaggactacaagcaaaggcgacgcgagaagcacagaaacgcacagcggctggcatcatgaaaaacccgaccgtagacggcatcgtagcgatcgacttggacccagtcgtctacgacgcaaaattcgaaaaacagctgggacaaatcatgctgctcatactatgcacgagccagatcttactgatgcgtacaacttgggccctatgcgaatctataactctggctacgggacccctaacaacactatgggagggaagccccgggaagttctggaatacgacgatcgcagtgtccatggccaacatattccgaggttcttacctagcgggggcggggctagctttttccctgatgaaaagtctaggagggggccggcgggggactggggcacagggggagactcttggagaaaagtggaaaaggcaactaaaccaactgagcaagtcggagttcaatacctacaaacgcagcggaatcatggaggtcgacagatctgaggcaaaggaagggcttcgccgaggcgaaacgacaaagcacgcagtgtcgcgcggtacagcgaaactcaggtggttcgtcgaaagaaatctcgtgaaaccggaaggcaaagttatcgatctaggatgcggccgagggggatggagctactactgcgccggcttaaagaaagtaacagaagtgaaaggctacactaaaggaggaccagggcacgaggaaccaatcccgatggccacgtacgggtggaatcttgtcaaactccacagtggcaaagacgtctttttcataccacccgaaaaatgtgacactcttttgtgcgatatcggagaatcaagcccgaacccaaccatcgaagaaggaagaacgctgagggtactcaagatggtcgaaccctggttaaggggaaaccagttctgcataaaaatcctcaatccatatatgccaagcgttgtcgagacactggagcagatgcaacgaaaacacggaggaatgttggtcagaaacccactctccagaaactccacgcacgaaatgtactgggttagctgcggtacgggcaacatagtgtcagcggtcaatatgacatcacgcatgctattaaatcgcttcacaatggcacaccggaagccgacttatgaacgcgacgtagacctcggggcaggcacaagacatgtggctgtcgagccggaagtagccaacttagacattatcggacaacgcatcgaaaacataaagcatgagcataaaagtacctggcactatgacgaagacaatccatacaaaacctgggcctaccacggctcatatgaggtaaaaccatctggatcggcatcaagtatggtcaacggcgtggtcaagctactgacaaagccgtgggacgtaatccccatggtaacgcaaatcgcgatgacagacaccaccccattcggacaacaaagggtgtttaaagagaaggtggacacccggaccccaaaagcaaaaagaggaaccgcccaaatcatggaagtgactgcgcgatggctgtgggggtttctcagtcgaaataagaagccccgtatctgtacacgagaggagttcacgagaaaagtccggtcgaacgccgccatcggggccgttttcgtagacgagaatcagtggaacagtgctaaagaagcggtggaagatgaacgcttctgggatctcgtccatcgtgaaagagaattacacaaacagggaaagtgcgctacatgcgtctacaacatgatgggaaaaagggaaaagaagttgggagagttcggaaaagccaaaggcagccgcgcaatatggtatatgtggctcggggcaaggttcctggagttcgaagccctgggtttcatgaacgaagaccattggttttcgcgcgaaaactccctgtctggggtggaaggggaaggcctccacaaactagggtacatactgagggacattagcaagatccctggcggtaatatgtacgcagatgatacagccggctgggacacgcggataacagaggacgatctacaaaacgaagctaaaattaccgacatcatggagcctgagcatgccctactcgccacgtccatattcaaactgacgtatcaaaacaaagtcgtacgggtacaacgcccggcccgaaacggaaccgtaatggacgtaattagtcgcagagaccaaagagggagtggtcaggtgggcacttatgggctgaatacattcacaaacatggaagcccaactgataagacagatggaaagcgagggaatatttagcccctcagagctggaaaccccaaacttggcggaacgagtactggattggttagagaaacacggggtagaacgacttaagcggatggcgatcagtggagacgactgtgtcgtcaaaccgatcgatgaccgtttcgcaacagcactatcggctctcaacgacatggggaaagtacgaaaagacatcccgcaatgggagccaagcaagggttggaacgactggcaacaagtcccgttctgttctcaccactttcaccaactgataatgaaggatggtcgcgaaatagtagtcccatgccgcaaccaagacgaactggtaggccgggcaagagtctcgcagggggccggatggtcgttgcgggaaacggcatgtctcgggaaaagctacgcacaaatgtggcagctaatgtacttccacaggcgagacctacgactagcggcgaacgcaatatgcagtgcggtgcccgtcgactgggtacccaccagccggacaacctggagcatacacgcgcaccatcagtggatgaccaccgaggatatgctctccgtatggaacagggtatggatagaggaaaatccctggatggaagataaaactcacataagcagctggggcgacgtgccataccttggcaaacgagaggaccagtggtgtggttcactcataggcctaacggcccgcgctacgtgggctactaacatacaagtggccattaaccaggtacgtaggctaatcggaaatgaaaactatctcgattacatgacatccatgaaacgtttcaaaaacgactcagaccccgaaggagcactatggtaa

SEQ ID NO: 24573 - RNA, 9879 nt, synthetic construct
  misc_feature 1..9879: note = derived and/or modified CDS sequence (opt11) from DENV-1__EU482496__SS-prME
  source 1..9879: mol_type = other RNA
agcgtgaccatgttgctcatgttaatgcccacggccctggccttccacctcaccactagaggcggggaaccccacatgatcgtgagcaagcaagagagaggtaagagcctgctgttcaagaccagtgccggggtgaacatgtgcaccctcattgccatggacctgggcgagctttgcgaggatacaatgacctacaagtgcccccggatcactgagacagagccagacgatgtcgactgctggtgcaacgccactgatacctgggttacctacgggacgtgctcccagacgggcgagcaccgtcgggacaagagatccgtggccttggcgccccacgtggggctggggctggagacccgcaccgagacgtggatgagctccgagggagcctggaagcagatacagcgggtagagacctgggccctccggcaccccgggtttaccgtgatcgctctgttcctggcccatgcgatcggtaccagcatcacccagaaggggataatcttcatccttctgatgctggtgacaccctccatggctatgcggtgtgtcggcatcggctcacgagactttgtggaggggctgtccggcgctacctgggtagacgtcgtgctggagcacgggagctgcgtgaccacgatggcgaaagacaagcccacattggacatcgaattgctgaagaccgaggtcaccaaccccgcagtcctacggaagctctgcattgaggcgaagatctccaacaccacgaccgacagccgctgccctacccagggcgaagccaccctggtggaggaacaagacgccaacttcgtgtgccggcgcacgttcgtggaccggggttgggggaacggatgcgggctgttcggcaaggggtcactaataacttgcgcgaaattcaaatgcgtgacaaagctggagggcaagatcgtccagtatgagaacctgaagtatagcgtgatcgtgaccgtacacacgggagaccagcaccaagtagggaatgagtccaccgagcacggcaccactgcaaccatcacgccccaggctccgaccaccgagatccagctcaccgactatggcgccctcacgcttgactgcagcccccgcaccggccttgactttaacgagatggtcttactgaccatgaaggagaagtcatggctcgtgcataaacaatggtttctggaccttcccctcccctggacctctggggccagcacgtcgcaggagacctggaaccggcaagatctcttggtgaccttcaagacagctcacgccaagaaacaggaggtcgtcgtgctgggcagccaggagggcgctatgcacacggccctgaccggggctaccgagatccaaacctccggcactaccaccattttcgctgggcatctaaagtgccgcctaaagatggacaaactgaccctaaagggcatgtcttatgtgatgtgcacggggtcctttaaacttgaaaaagaggtggccgagacccagcatggcacggttctggttcagataaagtacgaaggcactgacgcgccctgtaagatccccttcagcacgcaagacgagaagggggtgacccaaaacgggcggctgataactgccaaccctatcgtgaccgacaaggagaagcccgtcaacatcgaggccgagccgcccttcggggagtcatacattatcatcggtgcgggcgagaaggctctcaagctcagctggttcaagaaagggtccagcattggcaagatgtttgaagccacagcccgcggagcacgtcgaatggccatcctgggagataccgcgtgggacttcgggtccatagggggcgttttcaccagcgttgggaagttggtccaccaaatcttcggcaccgcctacggggtgctgttctccggcgttagctggacgatgaagatcggtatcggcgttctgctgacctggctgggtctaaattcccgcagcaccagcctttccatgacctgcatcgccgtcggactcgtgaccttgtacctgggcgtcatggtgcaggccgactcggggtgtgttatcaactggaagggtcgggaactcaagtgcgggagcggcatcttcgtcaccaacgaggtgcacacctggactgagcaatacaaattccaggctgacagcccgaagcgcctctccgcggcaatcggaaaggcctgggaggagggggtttgcggcatccggagcgccacccgcctggagaacatcatgtggaagcagatatccaacgagttgaaccatatccttcttgagaacgacatgaagttcacggttgtcgtcggggacgtagccggcatcctcgcgcaaggtaagaagatgatacgtccccaaccaatggaatacaagtacagctggaagtcatggggcaaggccaagataattggcgccgacgtgcaaaataccacgttcatcatagacggccccaacaccccggagtgccccgacgaccagcgcgcctggaacatctgggaggtggaggactacgggtttggtatttttacgaccaacatctggctgaagctcagggactcctacacccaggtctgcgaccaccgactcatgtctgcggctatcaaggatagcaaggccgtacacgccgacatgggctattggatcgagtctgagaagaatgagacttggaagctagcccgggcgagcttcatagaagtgaagacgtgcatctggcccaagtcacacaccctgtggagcaacggcgtcctcgagagcgagatgattattccgaaaatatacgggggccctatcagtcagcacaactatcgaccaggatatttcacccagacagccggcccttggcacctggggaagttggagctggacttcgacctgtgcgagggcacgacagtggtggtggacgagcactgcgggaatcggggcccatccctgcgcaccacgacagtaaccggcaagataatccacgagtggtgttgccgaagctgcaccctgccgccgttacgcttccgcggggaggacggctgttggtacgggatggagatacgccccgtcaaggagaaggaagagaaccttgtgaagtccatggtgagcgccggcagcggggaggtggactcattcagcctcgggctgttgtgcatctccatcatgatcgaggaggtcatgcggagcagatggtcccgtaaaatgctcatgaccggcacgctggctgtgttcttcctgctgattatgggacagctaacctggaacgacctgatacgcctctgcataatggtgggagccaatgctagcgaccgcatggggatgggcaccacctatctggccctgatggccacgttcaagatgcggcccatgtttgccgtcgggttactgttccgccggttgacgtcccgcgaggtcctcttactaaccatagggctcagcctggtggcgtccgtcgagctgcccaacagcctcgaggagctgggcgacgggctggccatgggcatcatgatcctcaagctgctgaccgatttccagagccatcagctctgggccacgctcctgtccctcacattcatcaagaccacgttcagtctgcactacgcctggaagaccatggccatggttctgagcatcgtctccttgttccccctgtgcctgagtacaacctcccagaagaccacgtggctccccgtgctgctgggctccctcgggtgtaagccgctgactatgttcctgatcgcggagaacaagatctgggggcggcgctcctggccactgaacgaggggatcatggccgtgggcatcgtcagcatcctcttgagctccctccttaagaacgacgtgccacttgcggggccgctcatcgccggcgggatgctgatcgcctgttacgtgatctctgggtccagcgcggacctgtccctcgaaaaagccgccgaggtcagctgggaggaggaggccgaacactctggcgcctcccacaacattctggtggaagtgcaggacgatgggacgatgaagatcaaagacgaggaacgggacgacaccctgaccatcctcctgaaggccacgctgctcgcggtctccggcgtgtaccctctgagcatccccgccaccctgttcgtatggtacttctggcagaagaagaagcagcgcagcggggtcctatgggacaccccctcgccgcccgaggtggagcgggccgtcctggacgacggcatctaccgcatcatgcagcggggcctgctggggcgctcccaagtcggcgtgggcgtgttccaggagaacgtcttccacaccatgtggcatgtaacgcggggcgcagtgctcatgtaccagggtaagcgcctggaacccagctgggcgagtgtcaagaaggacctgatcagctacggcggtgggtggcggctccaggggagctggaacaccggggaggaggtccaggtaatagcggtcgagcccggcaagaaccccaagaacgtgcagactgccccgggtaccttcaagacgcccgagggcgaggtgggagccatcgctctcgacttcaagccggggacctcaggctcccccatcgtcaaccgcgagggcaagatcgtggggctgtacggtaacggcgtggtcacaactagcgggacgtacgtgtctgcgatcgctcaggccaaagcctcgcaagagggtccgctccctgagattgaggatgaggtgttccggaaacgaaacctgaccatcatggacctgcaccctggctctgggaagacacggcgctacctccctgctatcgtgcgggaggcaattaagcgaaagctgcggacactgatactcgcccccactcgggtggtggcctccgagatggccgaggcgctgaaaggcatgcccatccgctaccagaccaccgctgtcaagagcgagcacaccggcaaggagatcgtggacctgatgtgccatgccacgttcactatgaggctcttgagccccgtgcgcgttcctaactataacatgataatcatggacgaggcccatttcaccgaccccagctccatcgcagcgcgggggtacatcagcacacgcgtgggcatgggtgaagcggccgcaatcttcatgactgcgacgcctcccggctccgtagaggcgttcccgcagagcaacgccgtcatacaggacgaggaacgggacatcccggagcgctcttggaactcgggatatgagtggatcaccgacttccccggtaagaccgtttggtttgttccctccatcaagtccggcaatgacatcgccaactgcctacggaagaatgggaagcgcgtcattcaattgtcccggaagacgtttgacactgagtaccaaaagacgaagaacaacgattgggactatgtggtgaccacggacatcagcgaaatgggcgcgaacttccgcgcggacagagtcatcgaccctaggcggtgcctgaaacccgtaattctaaaggacgggcccgagcgcgtgatactcgccggccccatgccggttacagttgccagcgccgcgcagaggcgcgggaggatcggccgcaatcacaacaaagagggcgaccagtacatctacatggggcagcccctaaacaacgacgaggaccacgcccactggaccgaggccaaaatgcttctcgacaacataaacacacccgagggcatcatccccgcactgttcgagccggagcgcgagaagtccgccgccatcgacggggagtaccggctgcgcggagaggcgcggaaaacgttcgtcgagctaatgcgccgcggggatttacccgtgtggctgtcctacaaggtggccagcgagggtttccagtacagcgaccgccgatggtgcttcgacggtgagcgcaacaaccaggtcctcgaggagaacatggacgtcgagatctggaccaaggaaggggagcggaagaagttgcgccccagatggctggatgcccgcacttatagcgaccccctcgcccttagggagttcaaagagtttgccgcgggccgccgcagcgtgtccggcgacctgattctcgaaatcggtaagctgccgcagcatctgacccagcgcgcccagaatgcgctcgacaacttggtcatgctccacaacagcgagcagggcgggcgggcctaccgccacgctatggaggagctccctgacacaattgagaccctcatgttgctagccctgatcgccgtccttacaggcggggtaaccctcttcttcctgtccggccggggactgggcaagacaagtataggactgctgtgcgtcatggcctcctccgtgctcctctggatggccagtgtagagccccactggatagctgccagcatcatcctagagttcttcttaatggttctcctgattcccgagccagatcgccagcggacgcctcaggacaaccagttggcctacgtcgtgatcgggctccttttcatgatcctgaccgtcgccgccaacgaaatgggcttactggagaccacgaagaaggatctgggcatcggccacgttgcggtggaaaaccaccaccacgccgccatgttagacgttgacctgcaccccgcgtccgcatggacgctgtacgcggtggccaccaccatcatcacgccgatgatgcgccatacaatagagaacaccaccgccaacatctccctcaccgccatcgcgaaccaggcggccatcctgatgggtttagacaagggctggccgatatccaagatggacatcggcgtgcccctcctggccctggggtgctacagccaggtcaatcctctcacgctgaccgccgcggtgttaatgctcgtggcccactacgccattatcggcccggggctgcaggcgaaggcgacacgcgaggcgcagaagcggaccgccgcaggcatcatgaagaaccccacggtcgatgggatcgttgcaatagacctggaccccgttgtctatgacgccaagttcgagaagcagctcggccaaatcatgctgctgatactctgcacctcacaaatcctgctgatgcgaaccacctgggctctctgtgagagtatcacgcttgcaaccggacctctgaccaccctttgggaggggtcccccgggaagttttggaacacgaccattgccgtcagcatggctaacattttccggggttcctatctggccggcgccggcctcgcattctcactcatgaagtccctcggaggagggcgcagggggaccggagcccagggggaaacactgggagagaagtggaagcgccagctcaaccagctatccaagagcgagttcaacacttacaaacgtagcgggatcatggaggtggaccgctccgaggccaaagagggcctgaagcgcggtgagaccaccaagcatgcggtcagtcgcggaaccgctaagctccggtggttcgtggaacgtaacttagtgaagcccgagggcaaggtgatcgacctgggctgtgggcgaggaggctggagctactactgtgccggcttaaagaaggtgactgaggtgaagggctacacaaaaggtggacccggccacgaggaaccaatccccatggccacctacgggtggaaccttgtcaagttacatagcggcaaggacgtgttcttcatcccgccagagaagtgcgacaccctcctctgcgacatcggggagagttcccccaacccgacgatcgaggaaggccgcacactgcgcgtgctgaagatggtcgagccctggctccgcgggaatcagttttgcatcaagatcctgaatccctacatgccgagcgtggtcgagaccctggagcagatgcagcggaaacacggcggcatgctcgtccgcaatccgctgagtcggaacagtacccacgagatgtactgggtttcctgcgggacgggcaacatcgtgagcgccgtgaacatgacgtcccgcatgttactcaatcgattcacaatggcccaccggaagcccacatacgagcgcgacgtggacctgggggccggcacccggcatgtggccgttgagcccgaggtggcaaacctggacattatcggccagcgcattgagaacatcaagcacgaacacaaaagcacttggcactacgacgaggacaatccatacaaaacgtgggcctaccatggatcctacgaggtgaagccgagcggctccgcgagctcaatggtcaacggggtggtgaagctcttaaccaagccctgggacgtgatccccatggtgacccagatcgccatgacggacaccacccccttcggccagcagagagtcttcaaggagaaggtggatacccgcacgccgaaagccaagagagggaccgcccagattatggaagttacggccaagtggctgtggggcttcttatccaggaacaagaagccccggatttgcacgcgagaggagttcactcggaaggttcgctcaaatgcggcaatcggcgctgtatttgttgacgaaaaccagtggaactccgccaaggaggcggtcgaggatgagcggttctgggacctggtgcaccgcgagcgcgagctgcacaaacaagggaagtgcgctacctgcgtgtacaacatgatgggcaagcgcgagaagaagttaggggagttcggcaaagccaaggggagccgagccatctggtacatgtggctaggcgcgcgcttcctggagttcgaggctctgggctttatgaacgaggaccattggtttagccgggagaacagcctgtccggggtggagggcgaggggctgcacaagctgggctacatccttcgggatatcagcaaaattcccggaggcaacatgtatgccgacgataccgccggatgggacacccgcataacggaagacgacctgcagaacgaagccagaatcaccgacatcatggagccagagcacgctctcctggcaaagtccatctttaagctgacataccagaacaaggtggttcgtgtccagcggcccgcgaaaaacgggaccgtgatggacgtgatcagcagacgggaccagcgcggctccgggcaggtaggcacgtacggtctcaacaccttcaccaacatggaggcacagctgatcaggcagatggagtccgagggtatcttctcccccagcgaactggaaacccccaatctagccgagcgcgtgctggactggctgaaaaagtatggcgtcgagcggctcaagcggatggccatatccggtgacgactgcgtcgttaaaccgattgacgacagattcgcgactgcacttactgccctgaatgacatgggcaaggtccgcaaggacattccccagtgggagccgagcaaagggtggaacgactggcaacaggtccccttctgctcccaccacttccaccagctgatcatgaaggatggtcgcgaaatcgttgtgccgtgcaggaaccaggacgagctagtcggtcgggcccgagtttcacagggggctggatggagcctgcgggaaaccgcgtgtctcggcaagtcctatgcccagatgtggcagctgatgtacttccatcgccgggacctgcggttggccgcaaacgcgatctgcagcgccgtgcccgtcgactggatcccgacatcccggacaacttggtcgatccacgcccatcaccagtggatgaccaccgaggacatgttgtcggtgtggaaccgcgtgtggatcgaggagaatccctggatggaagataaaacgcatatcagcagttggggtgacgtcccctaccttgggaaacgcgaggaccaatggtgcggcagcctcattggcctgaccgcgcgagccacttgggcgaccaacatccaggtggccataaaccaggtgcgacggttaatcggtaacgagaattacctcgactatatgacctccatgaagcggttcaagaatgagagcgatcccgagggcgccttgtggtga

SEQ ID NO: 24574 - RNA, 9879 nt, synthetic construct
  misc_feature 1..9879: note = derived and/or modified CDS sequence (opt11) from DENV-1__EU482497__SS-prME
  source 1..9879: mol_type = other RNA
agcgtaactatgctgttgatgctgatgccaacagcactggcctttcacctgactacccggggaggggagccccacatgatcgtctcaaagcaggagcggggcaagagcctgctgttcaagacctcggccggcgttaacatgtgcaccctcatcgccatggacctcggcgaactgtgcgaggataccatgacctacaaatgccctaggatcaccgagacggagccagacgacgtggactgttggtgcaacgccacggacacttgggtcacctacgggacctgtagccagacgggagagcatcggcgcgacaagcggtccgtggccctcgctccacacgtggggctagggctggagactcgcaccgagacctggatgtcgtccgagggagcgtggaagcagatacagcgggtggaaacgtgggccctccgccatcccgggttcaccgtaatcgccttattcttagcacatgctatcggtaccagcatcacccagaaagggattatcttcattctgctaatgctcgtgacgccctcgatggcaatgcggtgcgtcggcattggctctcgcgacttcgtggaagggctttccggtgcgacctgggtggacgtcgtgctggagcacgggagctgtgtgaccaccatggccaaggacaagcccacgctggacatagagctcctgaagaccgaggtaactaatcccgccgtcctgcggaagttgtgcatcgaggcgaagatatccaacaccacgaccgactcgcggtgccccacccagggcgaggctaccctggtggaagaacaggatgccaacttcgtctgccggcgcaccttcgtggatcggggctgggggaacggctgtgggctatttggcaaagggtccctcatcacctgtgcgaagttcaagtgcgtgactaagctggagggcaagattgtccagtacgagaacctgaagtacagcgtgatcgtgaccgtccacacgggcgaccaacatcaggtggggaacgagtcgaccgaacacggcaccaccgcgaccattacgccccaagcgcccaccaccgaaatccagctcaccgattacggggcactgacgttggattgcagcccccgtaccgggctcgacttcaatgaaatggtcctgctgaccatgaaggaaaagtcctggctggtgcacaagcaatggttcctcgacttgcccttaccctggaccagcggggctagcacctcgcagggcacctggaatcggcaggacctgctcgtgaccttcaagaccgcacacgccaagaaacaggaagtcgttgtgttaggcagccaggagggggcgatgcatacggccctgaccggcgccaccgagatccagacctcgggcaccaccaccatctttgccggccacctgaagtgtaggctcaaaatggacaaactaaccctgaaaggtatgagctacgtgatgtgcactggctcctttaagttagaaaaggaggtggctgagacccagcacggcaccgtgctagtccagatcaagtacgaggggaccgacgccccatgtaagatcccattcagcacgcaggacgagaaaggcgtgacacagaacgggcggctaattaccgcgaacccgattgttaccgataaggagaaacccgttaacatagaggccgagccgcccttcggcgagagctatatagtgatcggcgccggagaaaaggcgctgaaactcagctggttcaagaagggttccagcatcggtaagatgtttgaggccacggcccgcggcgctcggcgcatggccattctaggtgacaccgcgtgggatttcggctcaattggcggggtgttcaccagcgttggtaagttggtacaccagatcttcgggaccgcatacggcgtacttttctccggtgtcagctggacgatgaagatcggcataggcgtgctactcacctggctcgggctgaactctcgcagcacctccttaagcatgacctgtatagcggtagggctggtcactttatacctgggggtcatggtgcaggccgattcaggatgtgtcatcaattggaaagggcgggagctcaaatgcggcagcggcatcttcgtgacgaatgaggtgcatacctggaccgagcaatacaaattccaggccgatagcccgaaacgcctgtctgccgccatcggtaaggcctgggaggagggtgtgtgtggcatccggagcgccactcgcctggagaacattatgtggaagcaaatttccaacgagctcaaccacatactgctggagaacgacatgaagttcaccgtagtggtcggcgatgtggccgggatccttgcgcagggcaagaagatgatccggccccaacccatggagtacaagtacagctggaaatcgtggggcaaggccaagatcattggggccgacgtgcagaacaccaccttcatcatagatgggcctaacaccccggagtgtcccgacgaccagcgcgcctggaatatctgggaggtggaagactacgggttcggcatcttcacgaccaacatctggctgaagttgcgggacagctatacccaggtgtgcgaccaccgcctcatgtctgcggctatcaaggactcaaaggcagtgcacgctgacatgggctattggatcgagtcagagaaaaacgagacctggaagctagcccgcgcgagcttcatcgaggtaaaaacgtgtatctggccaaagtcccacaccttgtggagtaacggggtgctagagtccgagatgatcataccgaagatctacggtgggcccatcagccagcacaattaccgccctggatacttcactcagaccgctgggccgtggcacttgggcaagctggagcttgacttcgacctgtgcgagggtacgaccgtggtcgtggacgagcactgcgggaaccggggccctagcctgcgcaccacgactgttaccggaaagataatacatgagtggtgctgccggtcatgcaccctgccacccctccgcttccggggcgaggacgggtgttggtacggcatggaaatccgacccgtcaaggagaaggaggagaacctggtcaaatccatggtgagcgccggctccggtgaggttgactccttcagcctcggcctgctgtgtattagcataatgatcgaggaggtgatgcggagccgctggagccggaagatgctcatgaccgggactctggctgttttcttcctgctcatcatgggccagcttacctggaatgatctgataaggttatgcattatggtgggtgccaacgctagcgaccgcatgggcatgggcaccacctacctggcccttatggccacgttcaaaatgcggccgatgttcgctgtggggttgttattccgccggctgacctctcgcgaggtgctcctactgaccatcgggctcagcctggtggcctctgtggagttaccaaacagcctcgaggagttaggggacggcctggccatgggcatcatgatcctcaagctgctcaccgatttccagtcccaccaactctgggccacgctgctgagcctcaccttcatcaaaaccaccttctctctacactacgcctggaaaacgatggcaatggtcctgagcatcgtgtccctttttccattatgcctatcaactacgtcccagaagaccacgtggttacccgtgctgctggggagcctcggctgcaagccgctgaccatgttcctaattgccgagaacaagatctgggggcgccgctcctggccgcttaacgagggcataatggccgtaggtatcgtgagcatactgctgtccagcctactgaagaatgacgtgccactcgcaggcccccttatcgctggcgggatgctaatcgcctgctacgtcatctcagggtccagcgcggacctgagtctcgagaaggccgccgaggtgagctgggaagaggaggcggagcattccggcgccagccacaacatcctggtagaagtccaggacgacggcaccatgaaaatcaaggacgaggaacgggacgacacactgaccatcctactgaaagcgacgctgttggccgtgtccggggtgtacccgctgagcatccccgcaaccctgtttgtgtggtacttctggcaaaagaagaaacagcgctccggcgtcctctgggatacacccagcccacccgaggtagaacgggcagtcctggatgacggcatttaccgcattatgcaacggggtttgctaggacgctcccaggttggggtgggtgtcttccaggagaacgtgttccacaccatgtggcatgtgacgcgaggtgccgtccttatgtaccagggcaagcgcctggagccgagctgggcgtccgtgaagaaggatcttatctcatacggcgggggctggcggctccagggtagctggaatactggcgaggaagtgcaggtcattgctgtggagcccggtaagaatcccaagaacgtgcagaccgccccaggcaccttcaaaacgcccgagggcgaggtcggggccatcgccctggactttaagcccggcaccagcggttcacccattgtgaaccgcgagggaaagattgtgggtctctatgggaacggcgttgtcactacaagcgggacgtacgtctctgccatcgcccaggcgaaggcctcccaggagggcccactccccgaaatcgaggacgaggtgttccgcaagcgtaacctgaccatcatggacctgcacccggggtccggcaagacccgtcgctacctaccagcaatcgtccgggaggccatcaagcgcaaattgaggaccctgatcctcgcgcccacgcgggtggtggcgtccgagatggctgaagcattaaagggaatgcccatccgatatcagactaccgcagtgaaatcagagcacaccgggaaggagatcgttgacctgatgtgccacgccacctttaccatgcggctcctctcccccgtacgcgtccccaactacaacatgataatcatggacgaagctcacttcacggaccccagttccatcgccgcgcggggctacataagtactcgcgtggggatgggcgaggccgccgccatcttcatgaccgccacgccgcccgggtcagtagaggcgttcccgcagagtaacgcagtcatacaggacgaggaacgcgacatccccgagcgctcgtggaacagtggctacgagtggatcaccgacttccccgggaagactgtctggtttgtcccctccatcaagagcgggaacgacatcgcaaactgcctgagaaagaacggcaagcgcgtgatacaactctccaggaagacgttcgacaccgagtatcagaagaccaagaacaatgactgggactacgtggtcaccacggacatcagcgagatgggagccaacttccgcgcggatcgggtgattgatcccagaaggtgtctcaagcccgtgattctgaaagacgggccagagcgcgtcatcctcgccggtcctatgccggtgaccgtggcctccgccgcccagcggcgtggccggataggcaggaaccacaacaaagagggggaccagtacatctacatgggacagcccctgaacaacgacgaggaccacgcgcactggaccgaggccaaaatgctattagataatatcaatacccccgaggggattatcccagctctgttcgagccggagcgcgagaaaagtgccgccatagacggggagtaccggctgcgcggggaggcacggaagaccttcgtggaactcatgagacgtggtgacctaccagtgtggctgtcctataaagtcgcctctgagggctttcaatacagcgaccggcggtggtgcttcgacggggagcgcaacaaccaggtgctcgaggaaaacatggacgtggagatctggaccaaggaaggcgagcgaaagaagctgcgcccccggtggctcgacgctcgcacctattcggatccgctcgcactgcgggagttcaaggagttcgcggcggggcgccgtagcgtctccggcgatctcatcctcgaaataggcaaacttccacagcacctgactcagcgcgcacaaaacgccttagacaacctagtgatgctgcacaacagcgagcaagggggccgggcctatcgccacgcgatggaagaactccccgacacaatcgagaccttaatgctgcttgcactgatcgccgttctgacgggcggcgtgaccctcttcttcctgtccgggcggggcctgggtaagacatcaatagggctcctttgtgtcatggcctccagcgtactgctttggatggcctccgtcgagccacactggattgcggcatccataatcctagagtttttccttatggttctactgatccccgagccggaccgccagcggacgcctcaagacaaccagctggcctacgtggtcattgggcttctgttcatgatcctgaccgtagctgcaaacgaaatggggctactggagacgactaagaaggacctgggcatcgggcacgtggcggtggaaaaccaccatcacgcagccatgctcgacgtggatctacatcccgcttccgcctggaccctgtacgcggtggcaaccaccataatcaccccaatgatgcgacatacgattgagaacacaactgccaatatcagcctcacggccatcgcgaatcaggcggccattctgatgggcctcgacaagggctggcccatctccaaaatggatattggggtccccctccttgccctgggctgttactcccaagtgaaccccctcacactcaccgccgcggtgctgatgctcgtcgcccattatgccatcataggcccgggcctgcaggccaaggccacccgcgaggcgcagaaacggacggccgccggtattatgaagaaccccacggtcgatggcatcgtcgcaattgacctggacccggtcgtgtatgatgcgaagttcgaaaagcagctgggccagatcatgctgctgatcctctgcacctctcagatcctgctgatgcggaccacctgggcgctctgcgagagcatcacacttgccaccggacccctaaccacactctgggagggctccccggggaagttttggaacacgaccatcgctgtgagcatggccaacatcttccggggctcctacctagccggcgcggggctggcgttcagcttaatgaagtccctgggcggagggcgccgcgggaccggagctcaaggcgaaaccttgggggagaagtggaaacgccagctcaatcaactgagcaagagcgagttcaatacgtacaagcggtccggcatcatggaggtcgatagaagcgaggccaaggaggggcttaagagaggggagaccactaagcacgcggtttctcgcggtacggccaagctccggtggttcgtagagcgcaacctggtgaaacccgagggcaaggtgatcgacctgggatgcgggcggggcgggtggagctactactgcgccggcctgaagaaagtgaccgaggtcaaagggtacacgaaaggcggcccagggcatgaggagcctattccgatggccacatacggctggaacttagtaaagctgcatagtggaaaggacgtgttcttcatcccgccggagaagtgcgacacgctgctctgcgatattggcgaaagtagccccaacccaacgattgaggaggggcgcaccctgagagtcctgaagatggtcgagccctggctccggggtaatcaattctgcatcaaaatcctcaacccctacatgccctccgtagtcgagactctggaacagatgcagcggaagcatggcggcatgcttgtgcgcaatcccctgtcccggaacagtacccatgagatgtactgggtgagttgcggcaccggtaatatagtctcagcggtgaacatgacgagccgcatgctactcaaccggtttacgatggctcaccgcaagcccacctatgagcgcgatgtagatctgggcgccggcacccgtcatgtcgctgttgagcccgaagtggccaacctggacatcattggccagcgcatcgagaacatcaagcacgagcacaagagcacgtggcactacgacgaggacaacccctacaagacctgggcctatcatggttcctacgaggtcaagcctagcgggagtgctagcagcatggttaacggcgtcgtgaaactccttaccaagccttgggacgtgatccccatggtcacccaaatcgcaatgacggacaccaccccctttggccagcagagagtcttcaaggagaaggtggacacccgaacgccgaaggctaagagagggaccgcccagatcatggaggtgactgctaagtggctatggggttttctgtctcgcaacaagaagccgcggatatgcacccgcgaggagttcacacggaaggtgagaagcaacgcggcaatcggagctgtattcgttgacgagaatcagtggaactccgccaaggaggcggttgaagatgaacggttctgggacctggtgcaccgcgagcgggagctgcacaagcagggcaagtgcgcgacctgcgtctacaacatgatgggaaagcgcgagaagaaacttggagagtttgggaaggctaagggcagccgggccatctggtacatgtggctgggcgcccgatttctcgagttcgaggccttagggttcatgaacgaggaccattggttttcccgggagaactccctgtctggcgtcgagggggagggcttgcacaagctgggctatatcctgcgcgacatcagcaagatcccgggcgggaacatgtacgcggacgacacagcgggctgggacacccggatcacggaggacgacttacagaacgaggcccgcatcaccgacaccatggagccggagcacgcactcctggcgcgctccatcttcaagctgacctaccagaacaaggtcgtcagagtgcagcggcccgctaaaaatggtacggtgatggacgtcatctctaggcgcgaccagcgggggtccggccaggtaggcacctacggtctcaacacctttacaaacatggaggcccagctgatcagacagatggaaagcgagggcatcttctcgccaagcgagttggagacgcccaacttagccgagagggtgttggattggctggagaagtacggggtggaacgccttaagcggatggccatatccggcgacgactgcgttgttaagccgatcgacgatcgctttgcgactgccctgaccgccctcaacgacatggggaaggtccggaaggatatcccacagtgggagcccagcaagggatggaacgactggcaacaggtccccttctgctcgcaccactttcaccagctcatcatgaaagacggccgcgagatcgtggtcccgtgtcggaaccaggacgagctggtggggcgcgcccgggtgagccaaggagccgggtggagccttcgcgagaccgcgtgcttgggcaagagctatgcgcaaatgtggcaactgatgtacttccatcggcgcgacttgcggctcgcggccaatgcgatctgctccgccgtccccgtggactggatccccacgtccaggaccacctggtcgatccacgctcaccaccagtggatgaccaccgaggacatgctttccgtgtggaaccgcgtctggatcgaggagaacccgtggatggaggacaagacccacatctcctcctggggcgatgtgccttacctggggaagcgtgaagaccagtggtgtggcagcctcatcggcctgactgcacgcgccacctgggctacaaacatccaggttgccataaatcaggtccgccgcctgatagggaatgagaactacttggactacatgacctccatgaagcggtttaaaaacgagagcgacccggagggggccctgtggtaa

SEQ ID NO: 24575 - RNA, 9879 nt, synthetic construct
  misc_feature 1..9879: note = derived and/or modified CDS sequence (opt11) from DENV-1__EU482499__SS-prME
  source 1..9879: mol_type = other RNA
agcgtgacgatgctattaatgctgatgcccaccgcgttagccttccatctcacgacccgcgggggagaaccccacatgatagtgagcaaacaggagcgggggaagtccctgctgttcaagaccagcgccggggtgaacatgtgtacgttaatcgccatggacctgggcgagctgtgtgaggacaccatgacatacaaatgccctcggatcacagagaccgagcccgacgacgttgactgctggtgcaacgccacggacacctgggtcacctacggcacctgcagccagacgggcgagcatcggcgggacaaacggtccgtcgccctcgcgccccacgtgggactggggcttgagacacgcaccgagacctggatgagctccgagggagcctggaagcagatccagcgcgttgagacgtgggccctacggcatcctgggttcacggtgatcgccctgttcctggcccatgcgattgggaccagcattacccagaaggggatcatcttcattctccttatgttagtgacgccctccatggccatgcggtgcgtcggcatcggtagccgcgacttcgtggaggggttgtccggagcaacgtgggtggacgtcgtgttggagcacgggagctgcgtaaccaccatggcaaaagacaagcccactttagacatcgaactcctgaagaccgaggtcacaaaccctgccgtgctgcggaagttatgcatcgaagcgaagatttccaacaccacgacggatagtcgttgcccgacccaaggcgaggccactctggtggaggagcaggacgccaacttcgtttgcaggcgcacattcgtagatcgggggtgggggaacggttgcgggctgttcggcaaggggtcccttatcacgtgtgctaagttcaagtgtgtgaccaaactggagggaaagatcgtacagtacgagaacctgaaatacagcgtgatagtaaccgtccacacgggcgaccagcaccaggtggggaacgagtctaccgagcatggcaccaccgcaaccataacaccccaggcgccgaccaccgagatccaattgacggactacggggccctgacgttggactgcagtccaagaaccggcctcgatttcaacgagatggtcttgctgaccatgaaggagaagtcttggctcgtgcacaagcagtggtttctggacctccccctcccctggaccagtggggcgagcacatctcaggagacatggaaccggcaggatctgctggtgaccttcaagaccgctcacgctaagaagcaagaggtcgtcgtactcggctcacaggagggcgcgatgcacacggcgctaaccggggccaccgaaatccagacctccggcacgaccaccatcttcgccgggcatctaaagtgccgcctcaagatggacaagctgaccctgaagggcatgagctacgtcatgtgcacggggtcattcaagctcgaaaaggaggtagcagagacccaacatggcacggtgctggtgcagatcaagtacgagggcaccgacgctccctgtaagatccccttctcgacgcaagatgagaagggggttacccagaacggccggttaattaccgccaatccgatcgtgaccgataaggagaaacccgtcaacatagaggccgagccgccgtttggggagtcctacataatcatcggtgccggtgagaaggcactgaagctcagctggttcaagaaggggtccagcatcgggaagatgttcgaagccacggcccgcggagctcggcgcatggccatcctgggcgacaccgcttgggacttcgggtcgatcggcggagtgttcactagtgtggggaagctggtccaccagatcttcggcaccgcctacggggtgttgttcagcggcgtatcgtggacgatgaagatcgggatcggtgtcctgctaacctggctcggactgaactcccgcagcacctccctgagcatgacttgcatcgccgtggggttggtgacgttatacctcggtgtaatggtgcaagccgatagtgggtgcgtaattaactggaaaggccgggagttaaagtgcgggagcggcatcttcgttaccaacgaggtccatacctggaccgaacaatacaagttccaggccgattcaccgaagcgcctgtccgctgccataggaaaagcctgggaagagggggtgtgcggcatcagaagcgccacacggctcgagaacatcatgtggaagcagatatcaaacgagctaaaccacatcctgctggagaatgacatgaagttcacggtcgtagttggggacgtcgccggtatcctcgcgcaagggaagaagatgatccggccccagcccatggagtacaaatatagctggaagtcctggggcaaggccaagatcatcggcgcggacgtccagaataccactttcatcatcgatgggcccaatacaccggaatgccccgacgatcagcgcgcctggaacatctgggaggtcgaggactacggtttcggtatcttcacgaccaatatctggctaaaactgcgggatagccacacccaggtctgtgaccaccgcctcatgtcggctgccatcaaggacagcaaggccgtgcacgccgacatggggtactggatcgaatccgagaagaacgagacctggaagctggcaagagcgagcttcatcgaagtgaagacgtgcatttggccgaagtcccacaccctgtggagcaacggggtcctcgagagcgagatgattatcccgaagatctatgggggcccgatcagtcagcacaactaccgccccgggtacttcacccaaacagccggaccttggcacctgggaaagctggagctcgacttcgacctgtgcgagggcacgacggtggttgttgacgagcactgcggtaaccgggggccgtccctgagaaccaccacggttaccggcaaaataatacacgagtggtgttgtaggagctgtactcttccgccgctccgcttccggggggaggacggatgctggtacgggatggagatccgtcccgtgaaggagaaagaggaaaacctagtaaagtctatggttagcgccggcagcggagaagtggactcgttcagcctcgggctgctgtgcatttccattatgatcgaggaggtcatgcggagccgctggagccggaagatgctcatgaccggcacgctggccgtgttcttccttttaatcatggggcagttaacctggaatgatctgatccgcctctgcatcatggtgggcgcgaatgcgagcgaccgcatggggatgggcaccacatacctggccttaatggccacgttcaaaatgcgaccgatgttcgccgtcggcctcttgttccgccggctgacctccagagaggtgctcctgctgaccatagggctcagtctggttgcctccgtagaactgcccaactctctcgaggagctaggtgacgggctggcgatgggcatcatgatcctcaagctactgaccgacttccagagccaccagctctgggccacgctgctatctctcacctttattaagaccactttctccctgcactacgcgtggaagacaatggcaatggtcctaagcatagtctccctcttccccctgtgtctgagcaccacatcccagaaaacaacgtggctccccgtgcttttaggcagcctcggttgcaagcccttaaccatgttccttatcgcggagaataagatctggggccggcgttcctggccactcaacgaggggatcatggccgtgggtatcgtcagcatcctgttaagctccctcctgaagaacgatgtgcccctagccgggcccctcatagccggcggcatgctgatcgcctgctacgtgatcagtggatcctcagcggatctgtccctcgagaaggccgccgaagtctcgtgggaggaggaggccgagcactccggcgccagccacaacatcctggtcgaggtccaggacgacgggaccatgaagatcaaggatgaggagcgggacgacaccctgaccatactcctgaaggctacgctgctcgctgtctccggcgtgtacccccttagcatcccggccacccttttcgtatggtatttctggcagaaaaagaagcagcgctcaggggtcctctgggacacccccagcccgccagaggtcgagcgggcagttctcgacgacggcatctaccgaatcatgcagagggggctgttagggcggtctcaggtaggcgtgggggtgttccaggaaaacgtgttccacaccatgtggcacgtgacgcggggcgccgtgctaatgtaccaagggaaacgcttggagccctcttgggcgagcgtcaagaaggacctgattagctacggcggcggttggcgcctgcaaggctcttggaacacaggggaggaggtccaggtcatcgctgtggagcccggcaaaaacccaaagaacgtgcagaccgctcccgggaccttcaaaacgcccgagggcgaagtaggcgccattgccttggacttcaagcccggtaccagcggctcgccaatcgtgaacagagaggggaagattgtcggcctgtatggcaacggggtggtcacaacctctggcacctacgtttctgcgatagctcaggcgaaggcctcccaagaggggccattaccagaaatcgaggacgaggtgttcagaaagcgtaacctgaccatcatggacctgcatcccgggtcaggcaagacccggcgctacctgccggcgatcgtccgggaggccatcaagcgcaagctgcgcaccctaatcttggcccccacgagagtcgtggcaagcgagatggccgaggcgctgaagggcatgcccatccgctaccaaactacagccgtaaagagcgagcacaccggcaaggaaatcgtggacctgatgtgccatgccacgtttacgatgcggcttctgtcccccgttagggtccctaactacaacatgatcatcatggatgaagcccacttcaccgacccctcatccatagccgcgcgggggtatatcagcacccgcgtcggcatgggggaggcagccgctatcttcatgactgccacgcccccaggctcggtggaagcgttcccgcagagcaacgccgtgatccaggacgaggagcgcgacatccccgaacgctcctggaacagcgggtacgagtggatcaccgactttcccggtaagaccgtgtggttcgtgccttccattaagtccggcaacgacatcgccaactgcctgcgtaaaaacgggaaacgcgtcatccagctctcccggaagacattcgacactgaataccaaaagaccaagaacaatgactgggactacgtggtgaccacagatatcagcgagatgggcgccaacttccgcgctgaccgggtcatagatccgcgcagatgcctgaagcccgtaattctgaaagacgggcccgagcgtgtcatcctcgcgggcccaatgccggtcacggtagcctccgcggcccagcggcgcgggcgcatcggccgcaaccacaacaaggaaggcgaccagtacatctacatggggcagccgttgaacaatgatgaagaccacgctcactggacagaggcgaagatgctgctcgacaacatcaatacacccgagggcatcatcccggccttgttcgagccggagcgcgaaaagtccgcggccatagatggcgaataccgcctacgcggcgaggcccggaagacgttcgtcgagttaatgcgccgaggtgacctgcccgtgtggctttcctacaaggtcgccagcgaggggttccagtactcggacaggcggtggtgctttgatggcgagcgcaacaaccaggtgttagaggagaatatggacgtggagatatggaccaaggaaggtgagcggaagaagctgaggccccggtggcttgacgcccgcacctactccgaccccctcgctctgcgggagttcaaggaatttgccgcgggcaggcggagcgtgtccggggatctgatccttgagatcggcaagctgccgcagcacttgacccagcgcgcccagaacgccctagataacctggtcatgctgcacaacagtgagcagggcgggcgggcctaccgccatgcgatggaggagctccccgacacgatcgagacccttatgcttttggccctgatcgccgtgctgaccggcggggttaccctcttcttcttatccggacggggcttgggaaaaaccagcatcggactcctttgcgtaatggcctccagtgtgctgctctggatggcctccgtggagccacactggattgcagcctcaataatcctagagttcttcctgatggtcctactgatccccgagccggacaggcagcggacgccccaggacaaccagctggcctacgtggtgatcgggctcctatttatgatcctgacagttgccgccaacgagatggggcttctggagacaaccaagaaggacctggggatcggccacgtggcggtggagaaccaccaccacgccgccatgctcgacgtcgatctgcaccccgcctccgcgtggacgctgtacgcggtggccaccaccatcattaccccgatgatgcgccacacgatcgaaaacaccaccgccaacatcagcctaaccgccatcgccaaccaggcggccattctcatggggctggacaaaggctggcccatctccaaaatggacatcggagtgccactcctggcattggggtgctattctcaggtcaacccgctcaccctgaccgccgctgtacttatgctcgtcgcccactacgccatcatcggcccggggcttcaggccaaggccaccagagaggctcagaagaggaccgcagcaggcatcatgaagaatcctaccgtcgacgggatcgttgccatcgacctggatcccgtggtgtacgacgccaagttcgagaagcagctcggacagatcatgttgcttatcctctgcaccagccagatcctgctaatgcgcaccacctgggcgttatgtgagtccatcactctggcaaccggcccgctgaccaccctctgggagggatctccggggaagttctggaacacgaccatcgccgtgagcatggccaatatcttccggggaagctacctcgccggcgcgggcctcgctttcagcctcatgaagtcactcgggggcgggcgccgggggaccggggcccagggcgagacgttaggcgaaaagtggaagcggcagctcaatcaactgtctaagtcagagttcaatacgtacaagaggtccgggatcatggaggtggaccgaagcgaggccaaggagggcctgaagcggggtgaaactaccaagcatgcggtttcgaggggcaccgcgaagctccggtggttcgtagaacgaaacctggtgaaacccgaggggaaagtcattgacctgggctgtggccgcggaggctggagctactactgcgccgggctcaagaaggtgacggaggtgaaaggctacaccaaaggcggccccggccacgaggagcccatcccgatggccacatacgggtggaatctcgttaagctgcacagtgggaaggacgtcttcttcattccgcccgaaaaatgcgacactctgctctgcgacattggggaaagctcacccaacccaacaatagaagagggccgaaccctgagggtgttgaagatggtcgagccctggctccgcggcaaccagttctgtataaaaattctgaacccctacatgcccagcgtggtggaaaccctggagcagatgcagcggaagcacggcgggatgctcgtacgtaacccgctgtcccgtaactcaactcatgagatgtattgggtgagttgcgggaccggcaacatcgtgagcgccgtcaacatgacgtccagaatgctgctcaacagattcacgatggcacaccggaagcccacttacgagcgcgacgtggacctgggggccggcacccgccacgtggccgtggaacccgaggtggcgaacctggacatcatcgggcagcgcattgaaaacattaagcacgagcataaaagcacatggcattacgatgaagacaacccgtacaagacgtgggcgtaccacgggtcctacgaggtgaagccgagcgggtccgcgtcttcgatggtcaacggggtggtcaagctcctgacaaagccctgggatgtgatcccgatggtgacccagatcgccatgacagacaccacccccttcggccagcagcgggtcttcaaggagaaggtcgacaccaggaccccgaaggccaagcgggggaccgcccagatcatggaagtcacagcaaaatggctgtggggcttcctctcccgcaacaaaaaaccccgaatctgtacccgcgaggaattcacccggaaggtccgcagcaacgcggccattggagcggtattcgtggacgagaaccagtggaactccgccaaggaggcggtggaagatgagcggttctgggacctggtgcaccgcgagcgggaactgcacaaacaagggaagtgcgcgacctgcgtgtacaatatgatgggaaagcgcgaaaagaagctcggtgagttcggcaaagccaaggggagtcgggccatctggtacatgtggctgggcgcaaggttccttgagttcgaggcgttagggttcatgaacgaggaccactggttcagcagagagaactcgctatctggggttgagggcgaggggctgcataaactcggctatattctacgcgacatctctaaaatacccggcggcaacatgtatgccgacgacaccgccggctgggacaccaggatcacggaagacgacctgcagaacgaggcgcggatcaccgacataatggagccggagcacgctctattggcaaaatccatctttaagttaacctatcaaaacaaggtggtgcgtgtgcagcggcccgccaagaacgggaccgtcatggatgtcattagtcgccgggaccaaaggggttccgggcaggtcggaacgtatgggctcaacacgtttaccaacatggaagctcagctgatccgacagatggagagtgaggggattttctcccccagcgagctcgagacccccaatctcgccgagcgcgtgctggactggcttaagaaatacggtgttgagaggctcaagcgcatggccatctccggggacgattgtgttgtgaagccgatcgacgaccgatttgcgactgccctgaccgccctgaatgacatgggcaaggtgcgcaaggacatcccccagtgggagcccagcaaggggtggaatgactggcaacaggtccccttctgttcccatcacttccaccaactcattatgaaagacggtcgggagatcgtggtgccgtgccgtaaccaggatgagctggtaggccgggcacgtgttagccaaggggccggctggagcctgcgggagacggcgtgcctcggcaagagctacgcccagatgtggcagctgatgtacttccaccgccgggatctgcgcttagccgccaacgcgatatgtagcgccgtacccgtcgactggatccccacctccagaacaacttggtcgatccacgcgcaccaccagtggatgaccaccgaggacatgctgtccgtatggaacagagtgtggatcgaagagaacccctggatggaggacaaaacgcatatcagctcctgggaagatgtcccttacctgggaaagcgcgaggatcagtggtgcgggagcctcatcggcctgacagcccgggccacctgggcgacgaacatccaggtcgctattaatcaggtccgccggttgatcggtaacgagaactacctcgactatatgacctccatgaagcgctttaaaaacgagggggaccccgagggcgcactatggtga

SEQ ID NO: 24576 - RNA, 9879 nt, synthetic construct
  misc_feature 1..9879: note = derived and/or modified CDS sequence (opt11) from DENV-1__EU482500__SS-prME
  source 1..9879: mol_type = other RNA
agcgtgaccatgttgttgatgctgatgcccaccgccctggcctttcatctcaccacccggggcggagaaccccacatgatcgtaagcaaacaagagcggggcaaaagcctgctgttcaagacctcagccggggtgaacatgtgtactctcatcgccatggacctcggcgagctgtgcgaggacactatgacctacaagtgtccccggataaccgagaccgagcccgatgacgtggactgctggtgcaacgccacggacacctgggtgacctatgggacctgctctcaaacgggtgagcaccgccgcgacaagcggtccgttgccctcgcgccgcacgtgggtttggggctggagacacgcaccgaaacctggatgtcctccgagggtgcctggaaacagatccaacgggttgaaacctgggctttacggcaccccgggttcaccgtgatcgcactgttcctggctcacgcgatcggcacaagtatcacacagaaagggataatcttcatcctccttatgctcgtgacgccctctatggccatgcggtgcgtaggaatcggaagccgcgatttcgtggaggggctgtccggggccacttgggtggatgtcgttctggagcatgggagctgtgtgaccaccatggcaaaggacaagcccacgcttgacatcgaactcctgaagaccgaggtcactaaccccgcagtactgcgcaagctctgcatcgaggcgaaaatatccaacacgaccaccgactctcgctgcccgacccagggtgaggccaccctggttgaggaacaggatgcaaatttcgtatgccggcgcacgttcgtggaccggggctggggtaacggctgcgggttgttcggtaaggggtcccttattacgtgtgccaagttcaagtgcgtgacaaaactggagggcaagatcgtccagtacgagaacctgaagtactcagtcatcgttactgtccacactggggatcaacatcaggttgggaacgaatccaccgaacacgggaccaccgccacaattacgccgcaggcgcccaccaccgagatccagttaacagactacggggcattgacgctggattgttctccccgaaccggattagactttaacgagatggtcctgctgaccatgaaggaaaagtcatggctcgtgcataaacagtggttcttggacctgcctctcccctggacttcaggggccagcacgtcacaggagacctggaaccggcaggacttactcgtgacatttaagaccgcccatgctaagaagcaggaggtggtggtgctcggcagccaggagggcgcgatgcacaccgcgctgaccggggccaccgaaatccagaccagcggaacgaccaccatctttgcaggccatctgaagtgccgcctcaagatggacaaacttacactaaaaggcatgagctacgtcatgtgcacgggatccttcaagctcgagaaggaggtcgccgagacccagcacggcacggtacttgtgcagattaagtacgagggcacggacgcgccctgcaaaatacccttctcaacgcaggacgagaagggagtgacccagaacggccggctgatcaccgccaaccctatcgtcaccgacaaggagaagcccgtcaacatcgaggcagagccgcccttcggggaatcctatatcattatcggcgccggcgagaaggcgctgaagctctcctggttcaagaaggggtccagcatcgggaagatgttcgaagctactgcccgaggggcaaggcgaatggcgatactgggcgacaccgcgtgggatttcgggtccatcggcggcgtgttcaccagcgtagggaagctggtccaccagattttcggcacagcctatggcgtactgttcagtggcgtgagctggacgatgaagataggcatcggcgtgctgctgacctggctcgggttaaactcacgctctaccagcctgagcatgacctgcatcgctgtgggcctcgttacactgtacctgggcgtcatggttcaggccgattccgggtgcgtgatcaattggaagggccgggagcttaagtgcggatcgggcatcttcgtcaccaacgaggtgcacacctggaccgagcagtacaagttccaggctgatagcccgaagcgtctgtccgcggctatcgggaaagcctgggaggaaggggtatgcggcatcaggagcgccacacgcctggagaatatcatgtggaaacagataagtaacgaacttaatcacatcctactggagaacgatatgaagttcaccgttgtggtgggggacgtcgcaggcatactcgcgcaggggaagaagatgatccggccgcagccaatggagtacaagtactcgtggaagtcctggggcaaagccaagataatcggcgcggacgtgcagaacaccaccttcatcatcgacggacccaacaccccggagtgtcccgacgaccaacgcgcttggaacatctgggaagtggaggactacggtttcggcatcttcacgaccaacatctggctgaagctacgggactcacacacccaagtttgcgaccacaggctcatgtcagctgctatcaaggactctaaggcggtgcacgccgacatgggctactggatagaatcggagaagaacgagacctggaagctggctcgggccagtttcatcgaggtgaagacgtgcatctggccaaaatcccacactctgtggagcaacggcgtattagagtccgagatgatcatccccaagatttatgggggcccaatctcccagcacaattatcgccccgggtacttcacccaaactgcgggcccctggcacctggggaagctggagctcgactttgatctttgtgagggcacaaccgtggtagtcgacgagcattgcggcaaccgggggccgtccctgcgcaccacaacggtaacagggaaaatcatccacgagtggtgctgccggagttgcacactgccacccctaagattcagaggggaagacggctgttggtacggaatggaaatccgccccgtgaaggagaaggaggaaaacctggtcaagtcaatggtaagcgccggcagcggagaggtggactccttctcgctcgggctgctatgtatctcaatcatgatcgaggaggtcatgcggagccgctggtcccggaagatgctcatgactggcacgctggccgtgttcttcctgctcataatggggcaactgacctggaacgacctgatacgcctctgcatcatggtgggtgccaacgcgtcagataggatggggatgggcaccacctacctggcactgatggcaacgttcaagatgagaccgatgtttgctgttggcctcctctttcgccggctgacctcccgcgaggtgctcctgctcaccatcgggctcagcttagtagcctccgtggagctgcccaatagcctcgaagaactgggcgacggcttagcgatgggcatcatgatcctcaagctactgaccgactttcagtcacaccagctctgggccacgcttctgagcctcacattcatcaagaccaccttcagtctgcactacgcctggaagacaatggccatggtgctgagcatcgtttccctcttccccctgtgcctgtccaccacttcccagaagaccacgtggctccccgtgctcttgggcagtttggggtgcaaaccactgaccatgttcctgatcgcggagaataagatctggggccgccgttcctggcccttgaacgaggggatcatggcggtggggatcgtcagcattctcctgagctcgcttctcaaaaacgatgtgcccttggccgggccgctcattgctggcggcatgctaatcgcctgctacgtgatctcagggtcatccgcggacctgtccttggagaaagccgctgaagtgagctgggaggaggaggccgagcactccggcgctagccacaacatcttggtcgaggtgcaggacgatgggaccatgaagatcaaggacgaggagcgggacgataccctaaccatcttgctcaaagcgacgctgctcgccgtcagtggcgtgtacccgctgagcatccccgccacgttatttgtgtggtacttttggcagaaaaagaaacagcgttccggagtcctctgggacacccccagcccgcccgaggtggagcgggctgtgctggatgacggcatttatcgcatcatgcagcggggactgctggggcgctcccaggtcggcgtgggggtgttccaggagaatgttttccatacgatgtggcacgtgacccggggcgccgttctcatgtaccaggggaagcgcctggagcctagctgggcatcagtcaagaaagacctgatctcgtacggcggcggttggcggttacaggggagttggaacaccggggaggaggtacaggtaatcgccgtcgagccaggcaagaaccccaaaaacgtgcaaaccgcccccgggaccttcaaaacacccgagggggaggtgggcgccatcgcccttgacttcaaaccagggacgagcggcagtcccatcgtcaatcgcgagggaaagatcgttggcctttacggcaacggggttgtcaccacctctggcacgtacgtgagcgcgatagcccaggccaaagcctcccaggaggggcctctccctgagatcgaggatgaggtgttccgaaagcgaaatctgaccatcatggacctgcaccccggctccggcaagaccagacgctacctccccgcaatcgtccgtgaggccataaaaaggaagttgcgcacactgatcctcgcacctacccgggtcgtggcctccgagatggccgaggctctgaagggcatgcccatcagataccaaaccaccgccgtcaagagcgagcataccggcaaggagatcgtcgacctgatgtgccacgccacgttcacgatgcgactcttgtccccggttcgtgtccctaactacaacatgatcatcatggacgaggcccacttcacggaccctagctccatcgccgctcgggggtacatatcgaccagggtgggcatgggagaggccgcggccatcttcatgacggccacaccacccggctccgttgaggcgtttccgcagagcaacgccgtaatacaggatgaggaacgggacatccccgagcgctcctggaacagcgggtacgaatggataaccgacttccctggcaagactgtgtggttcgtgccctcaatcaagagcggcaacgacatcgccaattgcttgcggaagaacgggaagcgcgtgattcagctgtcacggaagaccttcgatactgaatatcagaagaccaagaacaacgactgggactacgtggtgaccacggatataagcgagatgggcgctaacttccgcgcagatcgggtcatcgacccccgccggtgcctgaaaccagtgatcttaaaggacgggccggaaagggtgatcctggccggccccatgccggtaaccgtggcctccgcggcccagcgccgcgggcgtatcggccgcaaccacaataaggagggggaccagtacatctacatggggcaacccctgaataacgacgaagatcacgctcactggaccgaggcgaaaatgcttctcgacaacatcaacactccagaggggatcatcccagcactgttcgagcctgaacgcgagaagtctgcagccatcgacggagagtacaggctgaggggcgaggcgaggaagacgttcgtcgagttgatgcggcgcggagacctccccgtgtggctgtcctacaaggtggcgagtgaaggcttccaatactcagatcgccggtggtgttttgatggcgagcgcaacaaccaggttctcgaggagaacatggacgtcgagatctggaccaaggagggggagcggaagaaacttcgccccagatggctggacgcgcgcacctactccgaccccctcgcactgcgggagttcaaggagttcgccgcgggcagacggagcgtctccggggatctgatcctagagattggcaagttaccgcagcatctgacgcaacgagcccagaacgccctcgacaacctggtgatgctgcataatagcgagcaaggcggccgcgcctatcgtcacgccatggaggagctccccgacacgatcgagaccctaatgctgttagcactgattgccgtgctgaccggcggggtgaccctcttctttctgtccggccggggactgggcaagactagcatcggcctcctctgcgtcatggcctcctcggtgctgctctggatggcttccgtggaaccccactggattgctgccagcatcatcctggagttcttcctgatggtcttactcattccggaaccggaccgtcagcggacgccccaggacaaccagctggcctacgtcgtaatcgggctactcttcatgatcctcaccgtcgccgccaacgagatgggcctccttgagaccaccaagaaggacttagggatcggacacgtagcggtggagaaccatcaccacgcagccatgcttgacgtcgatctgcatcccgcttccgcctggacgctgtacgctgtggccaccaccatcatcactccgatgatgcgccacaccatcgaaaacacaactgcgaatatcagcttgaccgccatcgccaaccaggccgccattctcatggggcttgacaagggctggcccatctcgaagatggacatcggcgtccccctactggcgctggggtgctactctcaggtcaaccccctcacgctgaccgctgcggtgctgatgctcgttgcgcattacgcaatcattggccccgggctgcaggccaaggccacgcgcgaggcacagaagcggaccgccgccggcatcatgaagaaccccacggtcgacgggattgtggccatagacctggacccggtggtatatgatgccaagttcgagaagcagctcggccagattatgctgctgatcctctgcacctcccaaatcctgcttatgcgcaccacctgggcgttgtgtgagagcatcactctggccacgggccccctgactaccctgtgggagggttcgccgggcaaattctggaacactaccatcgccgtgagcatggcaaacatctttcgggggtcctacctggcgggagccggcctggcgttctcactcatgaagtcactcgggggcggtaggcggggaacgggggcccagggggagaccctgggcgagaaatggaaacgccaattgaaccagttatccaagagcgagttcaacacgtacaaacggagtgggatcatggaggtggaccgcagcgaagcaaaggagggactgaagcgcggggagacaaccaagcacgccgtgtcccgcggtaccgccaagctccggtggttcgtggagcgcaacctggtgaagcctgaaggcaaggtcatagacctgggctgcggtcgcgggggctggagctattactgcgccggcttgaagaaggtgacggaggtgaagggctataccaagggtggcccgggccacgaggagcccatccccatggcaacctatgggtggaacttggtaaaactgcacagcggcaaggacgttttctttatcccgcccgagaagtgtgacaccctgttatgcgacataggggaaagctcccccaacccgacgatagaggagggacgcacgctccgggtgctgaagatggtcgagccctggctcaggggtaaccagttctgcatcaagatccttaacccatacatgccgagcgtggtggaaacactggaacagatgcagcggaagcacggtgggatgctcgtgcgcaatcctctgtcccggaacagcacccatgagatgtactgggtctcctgcgggactggcaacatagtgagcgccgtcaacatgacgtcccgtatgcttctcaaccgctttacgatggcccaccgtaagcccacctatgaacgcgacgtggatctgggcgccggaacccggcacgtggctgtcgaacctgaaatcgccaacctggacatcatcggacagcgcatcgagaacatcaagcacgagcacaaaagcacgtggcactacgatgaagacaacccctataagacctgggcctaccacggatcctacgaggtgaaaccgagcggctccgcgagcagcatggtgaacggggtcgtgaagttactgaccaagccctgggacgtcatcccgatggtgactcaaatcgccatgactgacacgacccccttcggccagcaacgggtgttcaaggagaaagttgacactcgcacaccgaaggccaaacggggaacggcccaaatcatggaagtgactgccaagtggctttggggtttcctctccaggaacaagaagccccgcatctgtaccagggaggagttcacgcgaaaggtgagaagtaacgctgctataggcgccgtcttcgttgacgaaaatcagtggaacagcgccaaagaggctgtggaggacgaacgattctgggacctggtccacagagagcgtgagttacataaacaggggaaatgcgcgacctgcgtctacaacatgatgggcaagcgcgagaagaagctcggggagtttggcaaagctaaagggtcacgggccatatggtatatgtggttgggcgcccgctttttggagtttgaggcgctcggctttatgaacgaggatcattggttctcacgcgagaacagcctgtcaggggtggagggtgaagggctgcataagctcggatacatcctgcgcgacattagcaagatccccggtggtaatatgtatgccgatgatacagcgggctgggacactcgcattacggaggatgacctgcaaaacgaagctcgcatcaccgacatcatggaggccgagcacgcactcctggccaagtccatcttcaaactgacctatcaaaacaaggtggtgagggtacagcggccggccaaaaacgggaccgtcatggacgtgatcagccgcagggaccaacgcggttccggccaggtcgggacgtacggcctgaatacgtttaccaacatggaggcgcagctgatccggcagatggaaagcgaagggatcttttcgccctcagaacttgaaacaccgaacctggccgagcgcgtcctggactggctggagaagtacggcgtggagcggcttaaacgcatggcaatttccggggacgactgcgtcgtaaagcccatagacgaccggttcgccactgcattgaccgccctaaacgacatgggcaaagtgcggaaggacatcccgcagtgggagccctcgaagggctggaacgactggcagcaggttcccttctgctcccaccacttccaccaactcatcatgaaggacggccgggagatagttgtgccctgccgaaaccaggacgagctggtcggacgcgctcgcgtgagccaaggggcgggatggtctctgagggagaccgcgtgcttaggcaaaagttatgcccagatgtggcagctgatgtatttccatcgcagagacctgaggctagcggctaatgcaatttgcagcgccgtgccagtggactggatccccacctccaggacgacctggagcatccacgcccaccaccagtggatgaccacagaggacatgctatccgtatggaaccgggtatggatcgaggagaatccctggatggaggacaaaacgcacatctcgagttggggtgacgtaccctacctggggaagcgcgaggaccaatggtgtggcagccttatcggccttaccgcccgggcgacctgggccacaaatatccaagtggccattaaccaagtgcgccggttaatcgggaacgaaaattacttagactacatgacctctatgaagcgcttcaagaatgaaggcgacccggagggggctctgtggtaa

SEQ ID NO: 24577 - RNA, 9879 nt, synthetic construct
  misc_feature 1..9879: note = derived and/or modified CDS sequence (opt11) from DENV-1__EU482501__SS-prME
  source 1..9879: mol_type = other RNA
agcgtaactatgctgttaatgctgatgccaaccgctcttgctttccatctcaccaccagaggcggggaaccccacatgatcgtctccaagcaggagcggggtaagagcctcctgttcaagaccagcgcaggggtaaacatgtgtaccctcatagccatggacctgggcgagctgtgcgaggacaccatgacctacaaatgcccccggatcaccgagacggagcccgacgacgtagactgctggtgcaatgctacggacacctgggtcacttacgggacctgcagccagactggcgagcaccggcgcgacaagaggtccgtggccctcgcgccgcatgtgggccttgggctggagaccagaaccgagacctggatgagctccgagggcgcctggaagcaaatccaacgggtggagacatgggccctccgccaccccggcttcaccgtcatcgccctgttcctggcacacgcgatcggtacctcgatcacccaaaagggtataattttcattctcctgatgctggtcacaccctccatggccatgcggtgtgtcggcatcggttctcgcgactttgtagagggcctctcaggagccacatgggtggacgtcgttcttgagcacggctcctgcgtgaccacaatggcgaaggacaagcccacattggacatcgagttgctgaagaccgaggttactaacccggccgtgctccggaagctctgtatcgaggcgaagatttccaatacaacgaccgacagtcgctgcccgacccagggcgaagccaccttagtggaggagcaagacgccaatttcgtgtgccggcgtacgtttgtcgaccggggctgggggaacggctgtgggctgttcggcaaggggtccctcatcacatgtgctaaattcaagtgcgtgaccaaactggaggggaagatagttcagtacgagaacctgaagtatagcgtgatcgtcaccgtccatacgggcgaccagcaccaagtggggaatgagtctaccgaacacggcaccacagctaccatcacgccccaggcgcccaccaccgagattcagctcaccgactacggggcattgacgctcgactgcagcccccgcacaggcctcgatttcaatgagatggtcctgctgactatgaaagagaagagttggctcgttcacaagcagtggttcctggacctgcccctcccctggaccagcggggcatctacgtcacaagaaacttggaaccggcaggacctgctagtgacctttaagaccgcccacgccaagaaacaagaggtcgtggtgctgggcagccaggagggggcgatgcacacggccctcaccggggctaccgagatccaaacctctggcacgacaaccatttttgccgggcaccttaagtgccgccttaagatggacaagctcacactgaagggcatgagctatgtcatgtgcacgggatcctttaaactcgagaaggaggtcgccgagacccagcacggcacagtgctggtccagatcaaatacgagggcaccgacgcaccctgcaagatccctttctcgacccaggacgagaagggagtgacccagaacggccggctgatcacggctaacccgatcgtgactgacaaggagaagcctgtcaacattgaggccgagcctccctttggcgagtcctacatcgtgatcggagccggcgagaaagcgctgaagctaagttggttcaaaaaagggtccagcataggtaagatgtttgaggccaccgcccgcggggcccgcaggatggccatcctgggcgacactgcatgggacttcggatccatcggcggcgtgttcaccagcgttgggaagttagtgcaccagatcttcggcaccgcgtatggggtcctcttttctggggtcagctggacgatgaagatcgggatcggcgtgctgctgacctggcttggactgaattcccgttccacctccctgagcatgacttgcatcgccgtggggctcgtaactctttacctgggcgtgatggtgcaagcggactccgggtgcgtaatcaactggaaaggccgggaactcaagtgtgggagtggcattttcgtgaccaacgaggtgcacacctggactgagcagtataaattccaagccgattcaccgaagcgcctgtcagcggccatcgggaaggcctgggaggagggtgtctgcggcatccggagtgccacccggttagagaacatcatgtggaagcaaatctctaacgagctcaaccacattctgttggagaacgatatgaagttcactgtggtcgtcggggacgtggccggcatcctcgcgcaagggaagaagatgatccggccccagccaatggagtacaagtactcgtggaagtcctggggcaaggccaagatcatcggggccgacgtgcagaacacaaccttcatcatcgatgggccgaatactccggagtgtcccgacgaccagagagcctggaacatctgggaggtagaggactacggcttcgggatcttcacgaccaacatatggctgaagctgcgggacagctatacccaagtgtgcgaccacagactcatgagcgcggccatcaaggactcgaaggccgtgcatgcggacatgggctactggatcgagtccgagaagaacgaaacttggaagctggcccgggcgtcctttatcgaggtcaagacctgcatctggccgaagtcccacacgctgtggagcaacggcgtcctcgagtcagagatgataattcccaagatctacgggggtccgatcagccagcataactaccgtcccgggtacttcacccaaaccgcaggcccctggcatctggggaagttagaactcgacttcgacctgtgcgagggcacgaccgtggtggtagacgagcactgcggcaaccgggggccgtcacttcgtaccaccacggtgaccggcaagatcattcacgagtggtgctgccggagctgcacactgccgcccctgcgcttcagaggcgaggacggctgctggtacgggatggagatccgacctgtcaaggagaaggaggagaacctggtgaagtccatggtgtcggccggcagcggcgaggtcgacagcttcagcctcgggctgctctgcatctccatcatgatagaggaggtgatgcggagcagatggtcccgaaagatgctcatgaccggcacgttggccgtgttcttcctgctcatcatgggtcagctgacgtggaacgacctgattcgcctctgcatcatggtcggcgcaaacgccagcgaccgcatggggatggggactacctatctggccttaatggctaccttcaaaatgcgtccaatgttcgctgtagggttactgttcaggagactgacctccagagaggtgctcctgctgaccatcgggttgagcctggtcgcctccgttgagctgcccaactcgctcgaggagctcggggacgggctcgcgatggggatcatgatactcaagctgttgaccgactttcagtcacaccagctttgggccacgctgctgtctctgacctttatcaagaccaccttcagtttacactatgcttggaagacgatggccatggtcctgagcatagtgagcctcttccccctgtgcttgtccaccacgtcccagaagacaacgtggctccccgttctgctgggtagcttagggtgtaagccgttaaccatgtttctgatcgcggagaacaagatctggggtcggcggtcctggcccctcaacgaaggcatcatggcagtcggcatcgtgagcattctcctgtcttcgctcctgaagaatgacgtgcctcttgccgggcccctcatcgccggcggcatgctgatcgcctgttacgtcatcagcgggtcgagcgcggacctgtccctcgagaaggcggcggaggttagttgggaggaggaagccgagcactccggcgccagccacaacattctggtggaggtccaggacgacgggaccatgaagatcaaggatgaggagcgggacgacaccctgaccatcctactcaaggccacgctgctcgccgtttccggcgtctacccgctgtcgatccccgccactctgttcgtctggtacttctggcagaaaaagaagcagcgctcaggggtgctctgggacacccccagcccgcccgaggtgggccgggccgtgctggacgacggcatctatcggatcatgcagcggggtctgctgggccgcagtcaggtgggggtaggcgtcttccaggagaacgtgttccacaccatgtggcacgtgacacgcggagccgtcctcatgtaccagggcaagcgactggagccatcgtgggcgtccgtgaagaaggatctgatcagctacggcggggggtggcggctccaggggtcctggaacaccggcgaggaggtacaggtaatcgccgtggaacccggcaagaatcccaagaacgtgcagacggcaccgggcaccttcaaaacgcccgagggcgaggtgggggcgatcgcgctggatttcaagcccggcaccagcggctcccccatagttaaccgcgaaggcaagatagtgggactgtacggtaacggcgtcgtgaccaccagcgggacgtatgtgagcgcgatcgcccaggccaaggcctctcaagagggtccgctccccgagatcgaagacgaggtatttcggaagcgcaacctgaccataatggacttacaccccgggagcggaaagactcgtcgctacctcccagcgatcgtgcgggaggccataaagcgcaagctgcgcacccttatattggcgcccacgcgtgtggtcgcttccgagatggccgaggcgctgaagggcatgcccatcaggtaccagactaccgcagtcaagagcgagcacaccggcaaggagatcgtggatctgatgtgtcacgcgacgttcaccatgcgtttactatcgcccgtccgcgttccgaactacaatatgatcatcatggacgaagcccatttcaccgatccaagctccatagccgcgcggggctacatttcgacacgcgtggggatgggggaggccgccgccatcttcatgacggccacgccgcccgggagcgttgaggcgttcccgcagagcaacgctgtgattcaagatgaggagcgtgacatccccgagagatcctggaacagcggctatgagtggatcaccgactttccgggcaagaccgtctggttcgtcccctcgataaagagcgggaatgacatcgccaactgcctgcggaagaacggcaagcgcgtcatccagttatcccggaagacgttcgacaccgaatatcagaaaaccaagaacaacgattgggactacgtggtcaccacggacatcagcgagatgggggccaacttccgcgcggatcgggtgatcgacccgaggaggtgcctgaaaccggtgatcctcaaggacggcccagagcgtgtaattttagccgggcctatgccggtaaccgttgcctccgccgcgcaacggagaggccggatcggccgcaaccacaacaaggagggagaccaatatatctacatgggccaacccctgaataacgatgaagaccacgcgcactggaccgaggccaagatgctgctcgacaacatcaatactcccgaagggatcatccccgccctgttcgagccggaacgcgagaagtccgcggccatcgacggcgagtaccggttacgcggcgaggcgcgtaagacgtttgtggagctcatgcgccggggggacctgcccgtgtggctgtcctacaaggtcgcgtccgagggcttccagtatagcgaccgccgttggtgcttcgacggggaacgcaacaatcaagtgctggaggagaacatggacgtcgagatttggaccaaggagggagagcggaaaaagctgcgccctcggtggctggacgcccgcacctactccgaccccctcgccctccgggaattcaaggagttcgcagcggggcgacggagtgtgtccggcgacttaatcctcgagataggcaaactaccgcaacacctgacccagcgtgcccagaacgccctcgacaatctggtgatgctgcacaacagcgaacagggtgggcgtgcctatcgtcacgcgatggaagagctccccgacacaatcgagactctgatgctgcttgccctgattgccgtgctgaccgggggcgtcacactcttcttcctgtctgggcggggcctggggaagaccagcatcgggctcctctgcgttatggcctccagcgtgctcttatggatggcctccgtcgagccccactggatcgctgccagcatcatccttgaattcttcctgatggtgttgctgatcccggaaccggacagacagcggacgccccaagacaaccagctggcctacgtggtcatcggcctcctgttcatgatcctgactgtggctgccaacgagatggggctcctggagaccacgaagaaggacctgggcatcgggcacgtggcggtcgagaatcaccaccatgcagccatgctcgatgtggacctgcacccggcctcggcctggacgctgtacgcggtggcgaccacgattattacccctatgatgcgccacacgatcgaaaacaccacagccaacataagcctcaccgccatcgccaaccaggcggccatcctcatgggcctcgacaagggctggcccatctccaagatggacataggggtccccctactggccctgggctgttacagccaagtgaacccattgacgctgactgctgcggtactgatgctggtcgcccattatgccatcattgggccgggcctccaggccaaagccacacgcgaggcgcagaaacggaccgccgccgggatcatgaagaacccgacggtggacggaatcgtggcgatagacctagaccccgtggtgtatgatgccaagttcgagaagcaactgggccagataatgcttctgatcctctgcacctctcagatcctgctgatgcgcaccacgtgggcgctctgcgaaagcatcaccctggccaccggtcccttaactactctctgggagggctccccgggaaagttctggaacacgaccatcgccgtgagcatggccaacatcttccgcggctcctacctggccggcgcggggctggcgttctcactcatgaagtccctcggcgggggccgccggggtaccggagcccagggagagaccctgggtgagaagtggaaacgacaacttaaccagctgtccaagtccgagttcaacacttacaagcgatccggtatcatggaagtagaccggagcgaggccaaggaggggttaaagcgcggggagaccaccaagcacgccgtgtcccgcgggaccgccaaactgcggtggttcgtagagcgcaacctggtcaagcccgagggcaaggtaatcgacttaggctgcgggcggggcggctggagctactactgcgccggcctgaagaaagtgacagaggtgaaggggtacaccaagggcggcccagggcatgaggagcccatcccgatggctacctacggttggaacctcgtgaaactgcacagcgggaaggacgtgttcttcataccgccagagaagtgcgacacgctgctctgcgacatcggcgagagctcgcccaacccgacgatagaggaagggcgtaccctgcgggtcctgaagatggtggagccgtggttacgcggcaaccagttctgtataaagatcctcaacccctacatgcccagcgtagtcgagacgctggagcagatgcagaggaagcatggcgggatgctcgtcaggaacccgctgtcacggaacagcacccacgagatgtactgggtgtcctgcggcaccggcaacatcgtctcagcagtgaatatgacgtcccgcatgcttctcaaccgtttcaccatggcgcaccggaagcccacctatgagcgcgacgtggacctgggagccggaactaggcatgtcgccgtagagcccgaggtggccaaccttgacatcatcggccagcgcattgagaacatcaagcacgagcacaagagcacgtggcactatgacgaggacaacccctataagacctgggcctaccacggctcctatgaggtcaaacccagcgggtccgccagctctatggtgaacggagtcgtcaagctcctgactaagccctgggacgtgatccccatggttacccagatagccatgacggacaccacacccttcgggcaacaacgggtgttcaaagagaaagtggacacacgaacaccgaaggctaagcggggcacagcccagattatggaagtaaccgcgaagtggttgtggggcttcctctcccgcaacaagaagcccagaatctgcactcgcgaagaattcacgcggaaggtaaggagcaacgcggccatcggggccgtgttcgtagacgagaaccaatggaactcggccaaggaggcagttgaagatgagcggttctgggatctggtacatcgcgagcgggaactccataagcagggaaagtgcgcaacctgcgtctacaacatgatggggaagcgcgagaagaagctcggcgagttcgggaaagccaaaggctcacgggccatctggtacatgtggctgggggcacgctttctggaatttgaggcgctgggattcatgaacgaggaccactggttctctcgggaaaacagcctgagtggcgtggagggagagggactacacaaactagggtacatcctgcgcgacatcagcaagatccccggcggcaacatgtatgccgacgacacagcagggtgggacaccaggatcacggaggatgacctgcaaaacgaggcccgcatcacggacatcatggaaccggaacacgccttattagcaaagagtatattcaaacttacctaccaaaacaaggtggtccgagtgcaacggcctgccaagaatggcaccgtgatggacgtcattagccgccgggaccagcgcggctccggacaggttggtacatacgggcttaacaccttcacgaacatggaagcgcagcttatccggcagatggaaagcgaggggatattctcccccagcgagctggagacccccaacctagccgagcgcgttctggactggttagagaaatacggagtcgagcggctcaagcgcatggctatctccggggatgattgcgtggtaaaaccgatcgacgatcggttcgctacggccctgaccgccctgaacgacatggggaaggtcaggaaggacattccccagtgggagccaagcaaaggctggaacgactggcagcaagtgcccttttgttcccaccattttcaccagctcatcatgaaggatggtcgggaaatcgtggtcccgtgccgcaaccaagacgagctggtgggacgcgccagggtgagtcaaggcgccggttggagcctgcgtgagaccgcgtgcctcggcaagtcctacgcccagatgtggcagttgatgtactttcacaggcgagatctgcgcctcgccgcaaatgcgatctgtagcgccgtccccgtggactggatacccacctcacggacaacatggagcatccacgcccaccaccagtggatgacgaccgaggacatgctgtctgtttggaatcgcgtatggatcgaggagaacccctggatggaggacaagacgcacatcagctcatggggcgacgtgccgtatctgggcaagcgcgaggaccagtggtgcggatctctgatagggctgaccgcccgcgccacctgggcgacgaacatacaggtggccataaaccaggtcagacggctgatcggcaacgagaattacctcgactacatgacctccatgaaacgcttcaagaacgagagcgacccagagggggcgctgtggtaa

SEQ ID NO: 24578 - RNA, 9879 nt, synthetic construct
  misc_feature 1..9879: note = derived and/or modified CDS sequence (opt11) from DENV-1__EU482504__SS-prME
  source 1..9879: mol_type = other RNA
tctgtaacgatgcttctaatgctaatgcccacggcactggcgttccatctcaccacgagaggtggggaaccccacatgattgtgagcaaacaagaacgtgggaaaagcctcctgtttaaaacgagcgcgggcgtaaacatgtgtaccctcatagcaatggacctaggagaattatgcgaagatacaatgacgtacaaatgcccccgcatcaccgaaaccgaacccgacgatgtcgattgctggtgtaacgcgacagacacatgggtaacctacgggacgtgctcgcagacgggcgaacaccgaagagataaacggagcgtcgcgctagctccccacgtcggcctaggactggagacacgaacggaaacttggatgtcatcggaaggggcgtggaaacagatccagcgcgtcgagacctgggccctcaggcaccctggtttcaccgtaatcgcgctgttcctcgcacacgccatcggaaccagcatcacacagaaagggatcatcttcatcctactaatgcttgttactccgtccatggcgatgcggtgtgtagggatcggatcacgggattttgttgagggactctccggagccacgtgggtggacgttgtactagagcacggatcatgtgtgacaacgatggccaaagacaaaccgactctagatatagagctcctgaaaacagaagtaacgaatccagccgtcctaagaaaactatgcatcgaagcaaagatttccaatacaaccacggacagccgatgcccaacacaaggggaagcgaccctggtagaagaacaagatgcaaacttcgtgtgtcggcgcacgttcgtcgaccgggggtggggaaacggctgtggactcttcgggaagggaagtttaataacctgtgcgaaattcaaatgcgtgacaaaactcgaaggaaagatcgtacagtacgaaaacctaaaatactccgtaatcgtaaccgtacacaccggggaccagcatcaagtcgggaacgagtcgaccgagcacggaacaaccgctacaatcacgccccaagctcccacgacggaaatccagctaaccgactacggggcgctgacactggattgctcaccgcgaacgggcctcgatttcaatgaaatggtcctacttactatgaaggagaaatcctggttggtgcacaagcagtggttcttagacctacccctcccgtggacgtcgggcgccagcacctcacaggaaacgtggaaccgtcaggacctgctagtgacatttaaaacagcgcacgcgaaaaagcaagaagtggtagtgctcggatcgcaggaaggagcaatgcacacagccctcacaggtgccacggagatacagacatcgggcacaaccaccatcttcgcggggcacctgaaatgccgcctaaaaatggataaacttacactcaagggcatgtcatacgtcatgtgcactgggtcttttaaactagaaaaagaggtcgccgaaacgcagcacggaacggtacttgtccaaataaaatacgagggaacagacgcaccgtgcaaaatacctttcagtacgcaagatgagaagggcgtcacacagaacgggcgactaatcacggcaaaccccatagtcacagataaagaaaagcctgtaaacatagaagctgaaccacctttcggagaatcgtatatcgttatcggagccggtgaaaaagcgttaaaattgagctggttcaagaaaggatcgtccatcggaaaaatgttcgaagcaactgcgaggggcgcgagaagaatggccatactaggcgacaccgcttgggacttcgggtcgatcggtggagtgtttacgtccgtcggaaaactcgtgcatcaaatcttcggaacggcatacggcgttctattcagcggcgtctcgtggaccatgaaaattgggataggagtcttactcacgtggttagggttgaacagcaggtctacatccttaagcatgacatgcatcgcagtgggactcgtcacgctataccttggggtaatggtccaagcggactcgggctgtgtcattaactggaagggaagagagctaaaatgtgggagtggaatattcgtcaccaacgaagtgcacacatggacagaacaatacaagttccaagccgactcaccaaaacggctatccgcagcaatcggcaaggcctgggaagaaggcgtttgcggaataagaagtgcgacacgactcgagaacattatgtggaaacagatttcgaatgaattaaaccacatcttactggagaacgacatgaaattcaccgtagtagtcggagatgtcgccggaatactcgcgcagggaaagaaaatgattcgcccccagccgatggaatacaagtatagctggaaaagttggggaaaagccaagattatcggagcggacgtgcaaaatactaccttcataatcgacggccccaacacgccagagtgcccagacgatcagcgcgcctggaacatctgggaagtagaagactatggatttgggatctttacaaccaacatctggctgaaactacgagactcctatacccaagtatgcgaccacaggttaatgagtgccgcaatcaaagatagtaaggccgtacacgcagacatggggtactggatagagtcagagaaaaatgaaacgtggaagctagcccgagcgtcctttatagaggtaaaaacgtgcatatggccgaagtcccacacattatggtcaaacggagtcctggaatccgaaatgataatccctaaaatctacggcgggccaatctcgcaacacaattaccgaccgggctacttcacgcaaacagctggcccctggcacttgggaaaacttgagctggacttcgacctgtgcgagggcacaacggtagtggtggatgagcactgcggcaaccgaggaccctccctacgaaccacaaccgtgacagggaagatcatccatgaatggtgctgtagatcgtgcaccttgccacccctgaggttcagaggagaggacggctgttggtatggaatggaaataagaccagtgaaagaaaaggaagagaacctcgtaaaatccatggtctctgcgggaagtggtgaggttgacagcttcagcctgggactcctttgcatctcgataatgatcgaggaagtaatgcgaagtaggtggtccagaaagatgttaatgacaggcacgctcgcggtattcttcctcctaataatgggccaactaacatggaatgatctaataagactatgcataatggtaggcgcgaacgcatctgatcggatgggtatgggaacgacatatctggctctcatggctacctttaagatgcggccgatgttcgcggtaggcctcctgttccgacgcctcacgagcagagaggttctattactcaccatcgggcttagtctagtagccagcgtggagctcccgaacagccttgaagaactgggggacggtctagcgatgggtattatgatcctgaaactgttaacagacttccaaagtcaccagctctgggtaacgctcctcagcttgacattcataaagacgaccttttcgctgcactatgcttggaagacaatggcaatggtgctatcaatagtcagcctcttcccactatgcctatcaacaaccagccaaaagacgacctggctgccggtcctgctagggtctctgggctgcaaaccattgacaatgtttctcatagcagaaaataaaatatgggggcgcagaagctggccattgaacgagggaattatggccgtcgggatagtctccatcttattatcgtccctcctcaaaaacgacgtaccactagcgggaccgcttatagcaggcggcatgttgatagcctgctatgtgataagcgggagcagcgcagacttatcactggaaaaagcagctgaagtaagctgggaggaagaagcagaacattcaggagctagccacaacatcctagtagaagtccaagacgacggaacgatgaagataaaagacgaggaacgcgatgacactctcaccatactcctaaaagccactctactcgcagtatctggggtctaccccctaagcattccggctaccctattcgtgtggtacttctggcaaaagaaaaagcaaagaagtggagtcctgtgggatacgccgagtccgcccgaagtagaacgcgcagtgttggacgatgggatctatcgaatcatgcaacgaggcctgttggggcggtcgcaagtgggggtgggggtattccaagagaatgttttccataccatgtggcacgtaacaagaggggccgtactcatgtaccagggtaagcggctcgaaccgtcttgggcaagcgtgaagaaagacctaataagttacggcgggggatggaggctccagggctcttggaatacgggtgaagaggtacaagtcatagccgttgaaccagggaagaaccctaagaacgtacaaactgcccccggtacgttcaaaacacccgagggagaagtcggagcgatcgctttggacttcaagccaggaactagcgggagcccgatagtcaatcgggagggcaaaatagtcggattatacggcaacggagtagtcacaacatccggcacctatgtaagtgcaatcgctcaagcaaaagcctcacaagaagggcccttacctgagatagaggacgaagtctttagaaaacggaacctcacgatcatggacctccaccccggctctggaaaaactagacggtatctgcccgccatcgttcgggaagcaatcaaacgtaaactcaggacactgatccttgctccgacccgagtggtcgccagcgaaatggcggaggcgttgaaaggcatgccaataagataccaaacgacagcagtaaagtccgagcacaccggaaaagaaattgtggacctcatgtgtcatgcgacatttacaatgagactgctatcaccggtaagggtgcccaactacaatatgatcatcatggatgaggctcactttacggaccctagttcaatcgcagcacggggctacatctcgacaagggtgggaatgggcgaagcggcagccatatttatgaccgctacaccacccgggtccgtcgaggctttccctcaaagcaacgcagtcatccaagatgaggaacgggacattccggagaggtcgtggaactcggggtacgaatggataaccgacttccctgggaagacagtctggtttgtccccagcatcaagtctgggaatgacatcgcaaactgcctacgcaagaacgggaaacgagtaatccaactcagccggaaaacgttcgacaccgaataccagaagactaaaaacaacgattgggactatgtcgtaactaccgacattagcgaaatgggagctaacttcagagccgatagggttatagatccgcgcagatgcctcaaaccagtaatattgaaagacggtcccgagcgggtaatactggcaggacctatgccggtcaccgtcgccagtgccgcacagaggcgaggccgtatagggcggaaccataacaaagaaggcgaccaatacatatacatgggacaaccattgaataacgacgaggaccacgcacactggacagaagcaaagatgctcctggacaatattaacacccccgaagggatcatcccagcactcttcgaaccagaacgagagaaaagcgctgctatcgatggggaataccggctaaggggagaagccagaaaaactttcgtggagttgatgaggcgcggagacctccccgtatggctcagctacaaagtggcaagcgaaggattccagtacagcgatcgccggtggtgcttcgacggagagagaaataaccaagttctagaggagaacatggacgtagagatttggacaaaggagggcgaacgaaagaaattgcggccgcggtggttagacgctcggacatatagcgatcccctggcactccgcgagttcaaagagttcgcagcgggaagacgctcggtctctggagatttaataagtgagataggcaagctcccacaacatcttacacaacgcgctcaaaacgcattagacaacctggtgatgcttcacaattcggaacaagggggacgtgcgtatcgccatgcaatggaagaactaccggacacaatagagactttaatgctgctagcactcatcgccgttctgaccggaggggtgaccctattctttctaagcgggcgcggcctcggaaagacgtccatcggactgctatgcgtaatggcctcctcagtactcctttggatggcatcagttgaaccacactggatcgccgccagtatcatattggagttcttcttaatggtccttctgatcccagagcccgaccgacagcgtacaccacaggacaaccagctagcctatgtggtgattgggctactcttcatgatactaacggtcgccgcgaacgaaatgggtttgctcgaaacaaccaagaaagacctgggaattggacacgtagccgtcgaaaaccaccaccatgccgctatgctggatgtagacctgcacccagcttctgcgtggacgttatacgcagtcgcaacgacgatcataacgccaatgatgcgtcacacgatcgagaacaccaccgccaacatctccctaacagcaattgctaaccaagcggcaatactgatgggcctcgacaagggctggcccatatcaaaaatggacataggtgttccccttttagcactgggatgttacagccaagtgaacccactcacgctcacagcagcggtcctaatgctggtggcccactacgcaatcatcggtccagggttgcaagcaaaggcaactcgcgaggcacaaaaacggacagcggcaggaattatgaaaaacccgacagtcgacggcatagtcgctatagacctggaccccgttgtctatgatgctaagttcgaaaaacagctagggcaaatcatgttactcatactatgtacaagtcaaatactcttaatgcgaaccacctgggccctgtgcgagagcataacactggcaaccggcccgctaacaacactatgggagggaagcccgggtaagttctggaacactactatcgccgtgagcatggcgaacatttttagggggagttacctcgcgggcgcgggacttgcgttttccctaatgaaatcactcggtggcggccgcagagggactggcgcacagggggaaaccctaggggaaaagtggaaacgtcaacttaaccagttaagtaagtcagagttcaatacctataaaagatctgggatcatggaggtggatcggagcgaagccaaagaaggactgaaacggggagaaactaccaaacacgccgtttccaggggcaccgcgaaattacgttggttcgtcgaacgaaatttagtgaagcccgagggcaaggttattgatctaggctgcggacggggcggctggagctactactgcgctgggttaaagaaagtaacggaagtgaaagggtacaccaaagggggaccgggccacgaggagcccatccccatggcaacgtacggctggaacctagtcaaactccactcgggcaaagacgtattctttataccacccgaaaaatgcgatacgctcctttgcgatatcggcgaatccagccccaacccaaccatcgaggaggggcgcacgcttagagtcctaaaaatggtggagccatggttaagggggaaccaattctgcatcaaaatcctgaacccgtacatgccatcggtagtagaaacactggaacaaatgcaaaggaaacatggcggcatgctagttagaaacccactctcgcgaaactcgacccacgaaatgtattgggtctcgtgcggcacgggaaatatcgttagcgcagtgaacatgacgtcacgaatgcttctaaacagattcacgatggcacaccgcaaaccgacgtacgagagggacgtcgacctcggggcggggacacggcatgtggccgtggagccagaagtagcgaatctcgatatcataggacaaagaattgaaaacattaaacacgaacacaaatctacgtggcactacgacgaagacaatccgtacaagacatgggcctaccacggcagctacgaagtgaaaccgtccgggagcgcgagctccatggtaaacggggtagtgaagctcctaacgaaaccctgggacgtaatacccatggtcacccaaatcgccatgaccgatactacaccctttgggcagcaacgcgtatttaaagagaaggtcgatacccggacgccaaaggccaagcgcgggacagcgcagatcatggaggtaaccgcgaagtggctatggggattcctgagcagaaacaagaaaccacggatctgtacgcgggaagagttcacccgaaaggtacgcagcaacgcggcaatcggagcagtattcgtagacgagaaccaatggaactcggccaaggaagcagtcgaggacgagagattctgggacctagtacaccgcgaacgcgagctgcataaacagggaaaatgcgctacatgcgtatacaacatgatgggaaaaagagagaaaaagctcggagagttcggcaaggccaagggctcacgtgcgatttggtatatgtggctcggcgcacgtttcctcgagttcgaggcccttgggtttatgaacgaagatcattggtttagccgcgaaaacagtctctcaggggtggagggagaaggattgcataaactaggatacatactcagagacataagtaaaataccgggcggaaacatgtatgccgacgacactgccggctgggacacccggatcacggaagacgatttacagaatgaagcccgaatcactgatataatggaacccgagcacgcgcttcttgcaaaaagcatctttaaactaacctaccagaacaaggtcgtgcgagtccagaggccagctaagaacggaacggtaatggacgtaatctcccgcagagaccaaagggggagcggacaagtcgggacatacggactcaataccttcaccaatatggaggcgcagctaatacgacaaatggagagtgaaggcatcttctccccaagtgaactcgagacaccaaaccttgccgaacgagttctcgattggttagaaaaatacggaatcgaaaggctaaaacgcatggccatatcgggtgacgattgcgtagtgaaacccatcgacgataggttcgcgaccgctttaacagccctcaacgacatgggcaaagtacgtaaggatataccacaatgggaaccatcgaaagggtggaacgactggcagcaagtccctttttgctcccaccacttccaccagctcataatgaaagacggaagggaaatagtagttccgtgccggaaccaggatgaactcgtcggcagagcccgagtaagccaaggcgctgggtggtccctaagagagaccgcatgcctagggaaatcatatgcgcaaatgtggcagttaatgtacttccatcgcagagacctacggctagccgcaaacgcgatctgttccgcagtcccagtagactggatcccaacatccagaactacgtggtccatacacgcccaccatcagtggatgacgaccgaggacatgctaagcgtatggaatagggtgtggatcgaagaaaacccctggatggaagataaaacgcatatcagcagctggggcgacgttccatatctgggtaaacgggaggaccaatggtgcggctccctcatcggcctcacggccagagctacctgggcaaccaacatacaagtcgccatcaaccaagtcagacggctgatcggcaatgagaactacctagactacatgacatcaatgaaacgcttcaaaaacgagagcgacccggaaggagccctttggtga

SEQ ID NO: 24579 - RNA, 9879 nt, synthetic construct
  misc_feature 1..9879: note = derived and/or modified CDS sequence (opt11) from DENV-1__EU482505__SS-prME
  source 1..9879: mol_type = other RNA
agcgtgaccatgctgctcatgctgatgcccacagcgctggccttccacttgacgacccggggcggggaacctcacatgatcgtgtccaagcaggagcggggcaagagcctgctgttcaagacatccgcgggggtgaacatgtgtaccctcattgccatggacctgggcgagttctgcgaggacacgatgacctacaagtgcccccgcatcaccgaagccgagcccgacgacgtggattgctggtgcaatgccaccgacacgtgggtcacctacgggacctgctctcagaccggggaacaccggagggataagcggtccgtggcattggcgccgcacgtgggcctggggctggaaacgcgcacggaaacctggatgagctccgagggagcgtggaagcagatacagcgggtcgaaacctgggctctgcgccatccggggttcacggtgatcgcccttttcctggcgcacgcgatcggaaccagcattactcagaaggggatcatcttcatcctgctcatgctggtgacgccctccatggccatgcggtgcgttggcatcggcagccgcgacttcgtggaggggctgagtggcgccacgtgggttgacgtcgtcctcgagcacggcagctgtgtgaccaccatggccaaggacaagccgaccctggatatcgagctgctcaaaacagaggtaacgaaccccgcggttctgagaaaactgtgcatcgaggccaagatctccaacaccaccacggacagccgatgcccgacccagggcgaagctaccctcgtggaggaacaagacgccaacttcgtatgccgccgcaccttcgtggaccggggatgggggaacggctgcgggctgtttggcaagggctccctgatcacgtgcgccaagttcaaatgcgtgaccaagctcgagggcaagaccgtccaatacgagaacctgaagtactctgtgatcgtgactgtccacacgggcgaccagcatcaggtggggaacgagtccaccgagcacggcaccaccgcgaccatcacgccccaggccccctcaaccgaaattcagctgacagactacggcgccctaaccctggactgcagccccagaacaggcctggacttcaatgaaatggtcctcctgacaatgaaggagaaggcctggctggtgcacaaacagtggttcttggacctgcccttaccatggacctcaggggccagcacatcccaggagacgtggaaccggaaagaccttctggtaacgtttaaaactgcccacgccaagaagcaggaggtcgtggtgctgggcagccaggagggagcaatgcataccgctcttacgggggcaaccgagatccagacctccggcaccacgaccatctttgcaggccacctgaaatgccgcctgaagatggacaagttgacgctgaagggcatgagctacgtcatgtgcaccgggtcctttaagctggaaaaggaggtggctgagacccagcacggaaccgtgctcgtacagataaagtacgagggcaccgacgcaccatgcaagatccccttcagcacccaggacgagaagggggtgacgcagaacggccggctgatcaccgccaacccgatcgtgaccgacaaggagaagcccgtcaatatcgaggcggagcccccgttcggggagtcctacatcgttatcggcgccggcgaaaaggcactgaagctcagctggttcaagaagggttccagtatcggcaagatgttcgaagccactgcccgcggggcacggcgtatggccatactaggggataccgcctgggacttcgggtccatcggcggcgttttcacctcggtcgggaagctggtacaccagatcttcggcacagcgtacggtgtgcttttctcgggcgtcagttggaccatgaaaatcgggatcggcgtattactgacgtggttaggcctcaattctcgcagcacctccctgtcgatgacctgcatcgccgtggggcttgtcaccctctatttaggtgtgatggttcaggcggactctgggtgcgtgatcaactggaagggccgggagctaaagtgcgggagcggcatattcgtgacaaatgaggtgcatacctggacggagcaatataagttccaggccgactcaccgaagcgcttgtccgccgccattgggaaggcctgggaggagggcgtctgcggaatccggtcagcgacacgcctggagaatatcatgtggaagcaaatttccaacgagctgaaccacatactcctggagaatgatatgaagttcaccgtggtggtcggcgacgtggccggcatactggcacaggggaagaagatgattcgcccacagcctatggagcataagtacagctggaaaagctggggaaaggccaaaatcatcggggcagacgttcagaacgcgacgttcatcatcgacgggcccaacaccccggaatgcccggatgaccagcgcgcctggaacatctgggaggtcgaggactacggattcgggatcttcaccaccaacatctggctcaagttaagggactcttacactcaagtttgcgaccacagactgatgtcggccgctattaaggacagtaaggctgtgcacgcagatatgggctattggatagagtccgagaagaatgagacctggaaactcgcccgagccagtttcattgaggtcaagacctgcatctggcccaaatctcatacgctgtggagcaacggcgttctggagtcggagatgattatccccaagatctacggcggtccgatcagccaacacaactaccgccccgggtacttcactcagaccgctggcccctggcacctcgggaagctggagttggacttcgacctctgcgagggcaccaccgtggtcgtggacgagcactgcggcaaccggggaccgtccttgcgcacgacaacggtgaccggcaaaataatccacgaatggtgttgccggagctgcacgctgccgcccctgcgcttcaagggtgaggacggctgctggtacggaatggagatccggcccgtcaaggagaaggaggaaaacctggtgaagtccatggtgagcgctggcagcggcgaggtggactccttcagcctggggctcctctgcatctccatcatgatagaagaagtgatgcgcagccggtggtcccgaaaaatgttgatgaccggcaccctcgccgtgttcttcctgctgatcatggggcagctcacctggaacgacctgatccggctatgcatcatggtcggcgccaacgccagcgatcgcatggggatgggcacaacgtacctcgccctaatggcgactttcaaaatgcggccgatgttcgctgtggggctcctgttccggcgcctgacgtcgcgcgaggtattactccttaccatcgggctgagcctcgtcgcttccgtggaactgcccaatagcctggaggagctcggcgacggactggcaatgggcataatgattcttaagttacttaccgacttccagtcccaccagctctgggcgaccctcctgagcctgacatttatcaagacgacattctctctccattacgcctggaagacaatggctatggtcctgtccatcgtctccctcttccccctctgtctaagcaccacgtcccagaagaccacttggttacccgtactcctgggcagcctggggtgcaagcctttaaccatgttcttgatagccgaaaataagatctggggtcgtaagagctggcccctgaacgagggaatcatggccgtcggcatcgtttcaatcctccttagctccctcctcaagaacgacgtgcccttagctggtccgctgatcgccggaggcatgctcatcgcctgctacgtcatcagcgggtccagcgccgatctgtccctggagaaggccgcggaggtgtcttgggaggaagaggcagagcactccggcgccagccataacatcctcgtggaggtccaagacgatggcaccatgaagatcaaggacgaggagcgggacgacaccctgaccatcctactcaaggctacactgttagccgtatccggcgtttacccgctctcgatccccgcgaccctgttcgtctggtacttctggcagaaaaagaagcagagatcgggggtcctgtgggacacgccctccccgcccgaggtggagcgggccgtgctcgacgacggcatctatcgaatcatgcagcggggcttactggggcgcagtcaggtgggcgttggggtcttccaggagaacgtgttccacaccatgtggcacgtgacccggggcgccgtcctgatgtaccaaggcaagcgcctcgagcccagctgggcttccgtgaagaaggacctgatcagctacggaggagggtggcggctgcaaggcagctggaataccggggaggaggtgcaggtcatcgcagtggaacccggcaagaaccctaagaacgtgcagacggcgcccgggacctttaaaaccagcgagggagaggtcggcgccatcgccctggacttcaagcccgggacctccggcagccccatcgttaaccgcgaggggaagatcgtgggtctgtacggtaatggggtcgtgacgaccagcggcacctacgtgtccgccatcgcgcaagccaaggccagccaggaggggccgctccctgagattgaagacgaggtcttccgcaagcggaacctcacgatcatggacctgcacccgggctccggcaagacgcggcgctatctgcccgccatagtgcgggaggccatcaagcgaaaactaagaaccctgatcctagcgccgacccgcgtggtcgccagcgaaatggccgaggccctcaaaggcatgcccatccgctaccaaaccacggctgtgaagtccgaacacaccggcaaggagatcgtggacctgatgtgccacgcgaccttcaccatgagactgttaagccccgtccgcgtgcccaattacaacatgataatcatggacgaggcccacttcacggacccgtcctcgatagctgcccgggggtacatctccactcgggtgggcatgggagaggctgcggcaatattcatgacagctactccgcccggcagcgtcgaggctttcccacagtccaatgcagtaatccaggatgaggaacgtgacattcctgagcgcagctggaactccggttacgagtggatcacggacttcccgggcaagaccgtgtggttcgtcccatcaataaagtccggcaacgacatcgctaattgcctgcggaagaacgggaagcgcgtgatccaactgtcacggaaaaccttcgacaccgagtaccagaaaactaagaacaacgactgggattacgtggtcaccaccgacatcagtgagatgggcgccaactttcgcgccgatcgggtcatcgacccgcgccggtgtttaaagcctgtgatcctgaaggacgggcccgagcgcgtcatactggccggccccatgcccgtgaccgtggcgagcgccgcccagcggcgcgggcggatcggccgcaaccacaacaaggagggtgaccagtacatctacatgggccagccgctcaacaacgatgaggaccacgcccactggacggaggccaagatgctgctggacaacatcaacacacccgagggcatcatccccgcactgttcgagcccgagcgggagaagtcagccgccatagacggggaataccgcttacgcggggaggcacggaagacattcgtagagctgatgcgccgaggggacctcccggtgtggttaagctacaaggtcgccagcgaggggttccagtactccgaccgccggtggtgttttgacggggagcgcaacaaccaggttctagaggagaacatggacgtggagatctggaccaaggaaggagagaggaagaagctccgcccccgttggctggacgcgcgcacttactcagaccccctggcactccgggagttcaaggagtttgccgccggccgccgatccgtctccggggacttaatactggagatcggcaagttaccccagcacctgacccagcgcgcgcagaacgctttggacaacctcgtgatgctgcacaactccgaacagggcggtcgggcctaccgccatgccatggaggaactgccggacaccatcgagaccctcatgctgcttgccctaattgcggtgctaacgggcggtgttacactcttcttcctcagcggccgggggctcggcaagacctccatcggactgctctgtgtaatggccagctccgtgctgctctggatggcctccgtcgagccccactggatcgcggcctccatcatcttagagttcttcctgatggtgctcctcataccagagccagaccgccagcggactccgcaggacaaccaattagcgtatgtggtcatcggcctgttattcatgatcctaaccgtggccgccaacgagatggggttattggaaacgaccaaaaaggacctggggatcggccacgtggccgtcgagaaccaccaccacgccgcgatgctagacgtagatctgcacccagccagcgcatggaccctgtacgccgtagcaaccacgatcatcacccccatgatgcgacacactatcgagaataccacggcgaacatatccttaacggccatcgcgaaccaggcggccatcctcatggggttggataagggctggccaattagcaagatggacatcggcgtccctctgctcgccctggggtgctactctcaggtcaatccgctgaccctcaccgccgccgtgctgatgctcgtcgcccactacgccatcattggtcccgggcttcaggccaaggctacacgggaggcgcagaagcgaaccgccgcaggaatcatgaagaatccaaccgttgacgggatcgtggccatcgacttggaccccgtcgtgtacgacacaaagttcgagaagcagctgggacagatcatgctcctgatcctttgcacgagccagatccttctgatgcggaccacctgggccctatgcgagtccatcaccctcgcgacgggccccttaaccactctgtgggaggggagccccggcaagttctggaacaccacgatcgccgtgtccatggcgaacatcttccgggggtcatacctcgccggcgccggcctcgccttcagcctcatgaagtcgctcgggggcgggcggcggggcaccggagcccagggcgagactctgggcgagaaatggaagcgccaactgaaccaactaagcaaatccgagttcaacacctacaagcggagcgggatcatggaggtcgaccggtcggaggcgaaggagggcctgaagcgcggggagacgaccaaacacgcagtgagccgcggcaccgccaagttgaggtggttcgtggagcgcaacctcgtgaagcctgaggggaaggtgatcgacctgggctgcggcagaggcgggtggtcctactactgtgccgggctgaagaaggtgaccgaggtcaaggggtacacgaagggtggccccggtcacgaggaacccatacccatggcgacctacggctggaacctggtgaagctccacagcggcaaggatgttttcttcattccacccgaaaaatgcgacactctgctatgcgatataggggagtctagccctaaccccaccattgaggagggccgcacgctccgggtcttaaaaatggtggagccgtggctgcgcgggaaccagttttgcatcaagattctcaacccttacatgccctcggtagtcgagacgctggagcagatgcagcggaagcacggcggcatgctggtgcgcaaccccctctctagaaattccacccacgagatgtactgggtgagctgtggcaccggcaacatcgtctccgccgtaaacatgaccagccgcatgctgctgaaccggttcacgatggcccaccgcaaacctacctacgaaagggacgtggacctcggggccggcaccagacacgtcgccgtggaaccggaggtggcgaacctggacataattgggcagcggattgagaacatcaagcacgagcacaagtccacctggcactacgatgaggacaatccgtacaagacgtgggcctatcacggaagctacgaggtcaaaccctccggaagcgcaagctccatggtgaatggggtcgttaagctgctcactaagccctgggatgtgatcccgatggtcacccaaatcgcaatgaccgacacgacccccttcggccagcaacgggtgttcaaggagaaggtggacacgcgcacccccaaggccaagcggggaacggcccaaattatggaggtcaccgccaagtggctgtggggattcctgagccgcaataagaagcctcggatctgcacccgcgaggagttcacccggaaggtgcgcagcaacgctgccatcggcgcggtgttcgtcgacgagaaccagtggaacagcgccaaggaggcggtggaggatgagcgtttctgggatctcgtgcaccgggagcgggaactgcacaagcagggaaagtgcgccacatgcgtatacaacatgatgggcaaacgcgagaagaagctgggggagttcggtaaggccaaagggtcacgggcgatttggtacatgtggctcggcgcccgcttcttggagttcgaggccctgggattcatgaacgaggatcactggttcaaccgggaaaacagcctctccggggtggagggcgagggactgcacaagctcggctacatcctccgcgacatctcaaagattcccgggggcaacatgtacgctgacgacacagccggctgggacacacgcatcacagaggacgacctgcagaacgaagcgaagatcacggacatcatggagcccgagcacgccctgttggccaagagtatctttaagttgacataccaaaacaaggtggtacgagtgcaaagaccggccaagaacgggaccgtgatggatgtcatcagccgccgcgaccagcgggggtcgggccaggtgggcacctacggtctcaacacgttcacgaacatggaggctcagctcatacgacaaatggagtcagaagggatcttctcccccagtgagctggagacccccaacctggcgggtcgggtcctcgactggctggagaagcacggggttgagcgcttgaagcggatggccatctccggcgacgactgtgtggtgaaacccatcgacgaccgattcgccacagcgctcaccgccctaaacgacatggggaaggtccggaaggacataccgcagtgggagcccagcaaggggtggaatgattggcaacaggtccccttctgctctcaccatttccaccagctgatcatgaaggacggacgcgagatcgtggtcccatgtcggaaccaagacgaactcgtggggagggcccgcgtgagccagggcgcagggtggagcttacgcgaaacggcctgtctggggaagtcctacgcccagatgtggcaactcatgtacttccaccggcgcgatctgagactggcggccaatgccatctgcagtgccgtcccagtggactgggtgcctacttcgcgcaccacgtggagcatacatgcccaccatcaatggatgaccaccgaggacatgttatccgtgtggaaccgggtgtggattgaggagaacccctggatggaggacaagacccatataagctcgtggggcgacgtgccgtacctgggcaaacgcgaggaccagtggtgcgggagcctgatcggactcacggctcgggccacctgggccaccaacatccaggttgccatcaatcaagtgcgccgcctgatcggtaacgagaactatctggactacatgacttccatgaagagatttaaaaacgaaatcgacccggagggcgccctatggtga

SEQ ID NO: 24580 - RNA, 9879 nt, synthetic construct
  misc_feature 1..9879: note = derived and/or modified CDS sequence (opt11) from DENV-1__EU482506__SS-prME
  source 1..9879: mol_type = other RNA
agcgtgactatgctgctgatgctgatgcccaccgccctagccttccacctcaccactcggggtggtgaaccccacatgatagtgagcaaacaggaacggggtaagagcctgcttttcaagacctccgctggggtgaatatgtgcaccttgatcgcgatggatctgggtgagctgtgcgaggacactatgacctataaatgcccgagaatcaccgagaccgagcccgatgatgtagactgctggtgtaacgcgacggatacctgggtaacctatgggacatgtagccagacgggcgagcatcggagagacaaacggtccgtcgccttggcaccccacgttggactcggtctggagacccgcaccgagacctggatgtccagcgagggcgcgtggaagcaaatccaacgggtggaaacctgggcactccgccaccccgggttcaccgtgatcgccctatttttggctcacgcgatcggaactagcatcacacaaaagggaattatcttcatcttgctgatgttagtaacgccctccatggcgatgcgttgtgtcggcatcggctcgcgggacttcgtcgaggggttaagtggcgccacttgggtagacgtcgtgctggagcatggttcatgcgtgaccaccatggccaaggacaagcccacgctggatatcgagctcctgaaaacagaggttaccaatcccgccgtccttcgaaagctctgtattgaagcgaagatctcgaacacaacgaccgacagccgttgcccgactcaaggcgaggccaccctggtggaggagcaggatgccaactttgtctgccggagaactttcgtggatcgaggatgggggaatggctgcgggctgtttggcaagggatccctcatcacgtgcgccaagttcaagtgcgtgactaagctggagggcaagatagttcagtacgagaatctgaagtacagcgttattgttaccgtacacaccggcgaccagcaccaagtggggaatgaatcaaccgagcacggcaccacggccaccattacaccccaggcgccgacaactgagatccagctgaccgactacggggcgctgacgctggactgtagccctagaaccggcctcgacttcaatgaaatggtcctgctgaccatgaaggagaagtcctggctagtgcacaaacagtggttcctcgaccttcccctcccctggacgtcaggagccagcacgtcacaagagacctggaaccgacaggacctgctcgtgacgttcaagacggcgcacgcgaagaagcaggaggtcgtggtgctcggcagccaggagggtgctatgcatacagccttaaccggcgccactgagatccaaacgagtggcacgaccaccattttcgctggacacctgaagtgccggctcaagatggacaagttgaccctgaagggaatgtcatacgtaatgtgcacaggctccttcaagttagagaaggaagtagccgagacacaacacgggacagtgctggtccaaataaagtacgaggggaccgatgcaccctgtaagatccccttcttaacgcaggacgagaaaggcgtaacccagaacgggcggttaatcaccgcaaaccctatcgtgaccgataaggagaaacccgtcaatatcgaggccgagccgcccttcggcgaatcgtatatcatcatcggcgcaggggaaaaagcccttaagctatcctggttcaagaaaggatcatccatcggcaagatgtttgaagccacggcccgcggggctcgccgcatggccatcctgggcgacaccgcgtgggacttcgggagcatcggtggcgtcttcacctctgtggggaagttggtccaccagatcttcggcaccgcttacggggtgttgttcagcggggtttcctggacgatgaaaatcgggatcggcatcctcctcacgtggcttgggttaaattcgcgctccaccagtctatccatgacctgcatcgccgtcgggctcgtgaccctgtacctcggcgtgatggttcaggccgacagtgggtgcgttatcaattggaagggacgggagctgaagtgtgggagtggcatctttgtgaccaacgaagttcacacttggaccgagcagtacaagttccaggcggacagcccgaaacgcctaagcgcggctatcggaaaagcatgggaggagggggtgtgcggcatcaggtccgcgacacgcctcgagaacatcatgtggaagcaaatcagcaatgagctgaaccacatcctccttgaaaacgacatgaagttcacggtggtcgtgggggacgtggccggaatactggcccaggggaaaaagatgatccggccacagcccatggagtacaaatactcgtggaagtcctggggcaaagccaagatcatcggcgcagatgtccagaacaccacgttcatcatagacgggccaaacactccggagtgccccgatgatcagcgtgcgtggaacatatgggaagtggaagactacggtttcgggattttcacgaccaacatctggctgaaactccgggactcctacacacaggtgtgcgaccaccgcctgatgagcgcggcaatcaaggactctaaggccgtccacgccgacatgggctattggattgagtctgagaagaacgagacctggaaactagcccgcgcgagctttatcgaggtgaagacgtgtatttggcctaaaagccataccctctggtccaatggtgtgctcgagtccgagatgatcatccccaagatatatgggggccctatctcgcagcacaactaccgccccgggtacttcacccagaccgcaggtccttggcacctgggcaagctcgagctggactttgatttatgtgagggcacaaccgtcgtggttgacgagcattgtggcaaccggggcccgtcactccgcaccaccacggtaaccggcaaaattattcatgagtggtgctgccggtcgtgcaccctaccgcctctgcgcttccgcggtgaggatggatgctggtacggcatggagatccgccccgtgaaagagaaggaggagaacctcgtcaagagtatggtgtccgccggctcaggggaagtggatagcttttccttagggctattatgcatttcgattatcatcgaggaggtgatgcggagccgctggagtcggaagatgctgatgaccggcacactggcagtcttctttcttcttatcatgggccaactgacttggaacgacctgatccggctgtgcatcatggtgggcgccaacgcgtccgaccgcatggggatgggtaccacgtatttggcgttgatggccacgtttaagatgcggccgatgttcgctgtgggcctgctgttccgccggctcacctcccgcgaggtactgctactcacaatcgggctgtccttggtggccagcgtcgagctccccaactccctggaggaacttggcgacggacttgcgatggggatcatgattctcaagctgctcaccgacttccagagccaccagctgtgggctacgctgctgtccttgacctttatcaagaccacctttagtctccactatgcctggaagacgatggctatggtgctctccatagtttctcttttccccctgtgcctctcaactaccagccagaaaaccacgtggttgcccgtcctgctcggcagtctcggctgcaaaccactcactatgttcctcatagcggagaacaaaatctggggacggcgaagctggccattaaacgaggggatcatggcagtcggcatcgtctccatcctcctcagcagcttactgaagaacgatgtcccgttagcggggccgttgatcgccggtggcatgctgatcgcgtgttacgtgatctccggtagctccgcggacctctcactggaaaaggccgccgaagtttcctgggaggaggaggcggagcactccggcgcatcccacaacatcttggtcgaagtgcaggacgatggcaccatgaaaatcaaggacgaggagcgggacgacaccttgaccatcctgttgaaggcaacgctcttagcagtgagcggtgtttaccccctgtccatacccgccaccctcttcgtatggtacttctggcagaagaagaaacaaagaagcggggtcctgtgggacacccccagcccgccggaggtcgagcgggcagtgttggacgacggcatctaccgaattatgcagcggggcctgctcgggcgcagtcaggtgggcgtcggtgtgtttcaggagaacgtgttccacactatgtggcacgttacacgaggggccgtgctgatgtaccaggggaagcgcctagagccctcttgggcgagcgtgaagaaggaccttatctcctacggcggcggttggcggcttcagggctcgtggaatacgggagaggaggtccaggtgattgccgtcgagcccggtaagaaccccaagaacgtacagacagcccccgggacttttaagaccccggagggcgaggtgggtgccatcgccctcgattttaagccggggacctccggcagccccatcgtgaaccgcgaggggaagatcgtcgggctctacggcaacggggtggtgaccacgagcggtacgtacgtcagcgctatcgcacaggccaaggctagccaggaggggccgctccccgaaatcgaggacgaggtgttccgtaagcggaacctgaccatcatggacttacaccccggctccgggaagacccggcgctacctgccggcgatcgtgcgggaggccatcaagcgcaaactgaggacccttatccttgcacccacgcgggttgtagccagtgaaatggccgaggcgctgaagggcatgccgatcagataccagacgacagctgtgaagtccgagcatacgggcaaggagatcgttgacctgatgtgccacgccacgtttacaatgcggctgttaagccccgtgcgtgtgcccaattacaacatgatcatcatggacgaggcccacttcacggacccgagtagcattgctgcgcgcgggtacatctccacccgcgttggcatgggtgaagctgcagccattttcatgactgctacgccacccggcagcgtggaggctttcccccagtcaaacgccgtgatccaagacgaggagcgcgatatccccgagaggagttggaatagtggctacgagtggatcaccgacttccccggaaagactgtctggttcgtgcccagcatcaagtccggtaacgacatcgcaaactgcctcaggaagaacggcaagagagtgatacagttaagcaggaagacgtttgacaccgaataccagaaaaccaagaacaacgactgggactacgtagtgaccacggacatctcggagatgggggccaacttccgcgccgaccgagtcatcgatccaagacgatgcctgaaacccgttatccttaaggacgggcccgaacgcgttatccttgccggaccgatgccggtaactgtcgcctcggccgcccaacgccgtggcagaatcgggcgcaaccacaacaaggagggcgaccagtatatctatatggggcagcctttaaacaacgacgaagaccatgcgcactggaccgaggccaagatgctcctagacaacatcaacacacctgagggcatcatccccgccctgttcgagcctgagcgcgagaagtccgcagccattgacggggagtaccgcttacgaggagaggcgcggaaaacgttcgtagaactgatgcgacgcggggacctgcccgtctggctttcctataaggtcgcctccgaaggcttccagtatagcgaccgccggtggtgcttcgacggtgagagaaacaaccaggttttggaggagaacatggacgtcgagatttggaccaaggaaggggagcgcaagaagctgcgacccagatggctcgacgcgcgcacctacagcgatcccctggccctgagagagttcaaggagttcgccgcaggccgccggagtgtttcaggcgaccttattctggagatcgggaagctgccacagcacctcacccagcgcgctcagaatgcactggacaacctggtgatgcttcacaatagtgagcaaggagggagagcctaccgccatgctatggaggagttaccggataccatcgaaacattgatgctactagcactgatcgccgtcttaaccggcggagtcacgctgtttttcttgagcggacgggggctcggcaagacctccatcgggttgctgtgcgtaatggcaagctccgtcttgctgtggatggcaagtgtcgagccccactggattgctgcctccataatcttagaatttttcttaatggtactgctgatccccgaaccggaccgccagaggacgccccaggacaatcagctcgcctacgtcgtgatcgggctgctgttcatgatcctcacggttgccgccaatgagatgggcctactcgagaccaccaagaaggatcttggtatcggccacgtcgcggtcgagaaccatcaccacgctgccatgttggatgtggacctacaccccgcctccgcatggacattgtacgcagtcgccactacaatcatcaccccgatgatgcgccacacgatcgagaacacaacagccaatataagcctgaccgccatagccaaccaagcggcgatattgatggggctcgacaagggctggcctatctcaaagatggacatcggggtgcctctgctcgcactcgggtgctactctcaggtgaaccccctcacgttgactgccgccgttctaatgctggtggcccactacgccatcatcggcccggggctgcaggccaaagcaacccgcgaggcgcaaaaacgcaccgccgccggcattatgaagaaccccactgtggacgggatcgtggccatcgacctcgacccggtggtgtacgacgcgaagttcgagaagcaacttggccagatcatgctacttattctgtgcactagccagatattgctcatgcgtaccacctgggcgctgtgtgagagcatcacgctggccaccggccccttaactaccctatgggaagggagcccgggcaaattctggaataccaccatagccgtctccatggctaacatctttcgggggagctacctggccggcgccggcctggctttttccctgatgaagtcattaggcggagggcgccgagggacgggtgcccagggcgaaacactcggcgagaagtggaagcgccaactcaaccagctgtctaaatctgagttcaacacctacaagcggagcggtatcatggaagtggacaggtccgaggccaaggagggcctgaaacgcggggagaccacgaaacacgctgtctcgcgcggaaccgctaagctgcggtggttcgtcgaacgcaacctggtgaagcccgaggggaaagtgatcgacctgggctgtggccgcggcgggtggagctactattgtgctggactaaagaaggttactgaggtgaaggggtataccaaagggggcccaggtcacgaggagccgattcccatggctacctacggttggaatcttgtgaagctgcactcaggcaaggacgtcttcttcatcccacccgagaagtgtgacaccctgctgtgcgatattggggagtccagccccaatccgacgatcgaggagggccgcaccctgcgagtgcttaagatggtggaaccctggttacgcgggaaccaattttgtataaaaattctcaacccctatatgccctccgtcgtcgagacactcgagcagatgcaaaggaaacacggcggaatgctggtaagaaacccgttatctaggaactccacccacgagatgtactgggtgagctgtggaaccggcaatatcgtgtcggccgtgaacatgacgtctcgtatgctcctcaaccgcttcacgatggcgcaccgtaaacccacctatgagcgtgacgttgaccttggggccggcacgcggcacgttgccgtggagccagaggtcgccaacctcgacatcattggccaacgcatcgagaacattaagcacgagcataaatcaacgtggcactacgatgaagacaacccttataagacctgggcctaccacggtagctacgaggtaaaaccgtccggtagcgcgtccagcatggtgaatggggtagtgaaacttctgaccaagccttgggacgtcatccccatggtgactcagatcgccatgacggacacaaccccgtttgggcaacagcgggttttcaaagagaaggtcgataccaggacgccgaaagccaaacgggggaccgcccaaatcatggaggtgacggccaagtggctctggggcttcttatcgaggaataagaaaccccggatctgcacacgcgaggagttcacccggaaagtgcgttccaacgcggccataggtgcggttttcgttgacgagaaccaatggaactccgctaaggaggcggtggaggacgaaaggttctgggacctggttcaccgcgagcgtgagctccataaacagggcaagtgcgcgacctgtgtatataacatgatgggcaagcgcgagaagaagctgggcgagttcggcaaggccaaagggtcccgtgccatctggtacatgtggctgggcgctcgcttcctcgagttcgaagcgctgggcttcatgaatgaggaccactggttctcgcgggagaacagtttatcgggtgtggaaggcgaggggctccacaaactaggctacattctcagagacatctccaagatcccagggggcaacatgtacgcagacgataccgctggctgggacacgcggatcaccgaggacgatttacagaacgaggcccgcatcactgatatcatggagccggaacacgccctgcttgccaagagcatcttcaaacttacttaccagaacaaggttgtgcgcgtgcaacggcccgccaagaatgggaccgtcatggacgtcatatcccggcgggaccagcgtggttcgggccaggtggggacgtacggcctgaacacgttcaccaacatggaagctcagctgatccggcaaatggagtccgaagggatctttagcccctccgagttagagactcccaatctggccgagcgcgtactagattggcttgagaagtacggagtggaacggctgaagcgaatggcaatcagcggggacgactgcgtggtcaagccgatcgatgaccggttcgcgacggcactgaccgcactcaatgacatgggaaaggtgagaaaagacataccccaatgggaaccctccaaggggtggaatgactggcagcaggtccctttctgttcacaccacttccaccagctgatcatgaaagacggtcgggagatcgtagtgccctgcaggaaccaggatgaactggtgggccgtgccagggtctcccagggggccggatggagtttgcgggagaccgcgtgcctgggcaagtcctacgcacagatgtggcaactgatgtacttccaccgacgggacctccgcctggccgcgaatgcgatatgctccgcggtgccggtagactggatccccaccagccgtacgacctggtccatccatgcccaccaccaatggatgacgaccgaggacatgctgtctgtctggaaccgggtgtggatcgaggagaatccctggatggaggacaagacgcatatatcaagctggggtgatgtgccgtacctcggaaaacgcgaggaccagtggtgcggcagcctgatcggcctgaccgctcgggccacctgggcgactaacatccaggtcgctatcaaccaggtgcgccggctcataggaaacgagaactatctggactacatgaccagcatgaagcgattcaagaacgagggcgaccccgaaggtgccctgtggtaa

SEQ ID NO: 24581 - RNA, 9879 nt, synthetic construct
  misc_feature 1..9879: note = derived and/or modified CDS sequence (opt11) from DENV-1__EU482509__SS-prME
  source 1..9879: mol_type = other RNA
agtgtgaccatgctgctgatgcttatgcccaccgccctggccttccacctcaccactcggggcggagagccccacatgatcgtcagcaagcaggagcggggcaagagcctgctgttcaagacctccgccggtgtgaacatgtgtaccctcatagccatggacctgggcgagttgtgcgaggacaccatgacatacaagtgcccccggataactgagaccgagcccgacgacgtagactgctggtgtaacgctacggacacctgggtcacctatgggacctgctctcagacgggcgagcaccgccgggacaagcggtccgtggcacttgcgccccacgtgggcctggggctagagacccgcacagagacctggatgagctccgagggcgcctggaagcaaatccagcgggtcgagacgtgggccctccggcaccccgggtttaccgtgatcgctctatttttggcccatgcgatcggcaccagcatcacccagaagggtattattttcatcctcctcatgctggtgacgccctcaatggccatgcggtgcgtcggcataggcagtcgggacttcgtggaggggctctccggcgcgacctgggtagatgtcgtcctggagcacgggtcgtgcgtgaccaccatggcgaaggacaagcccacgctggacatcgagctcctgaagaccgaggtcaccaaccccgccgtgctacggaagctctgcatcgaggcgaagatcagtaacaccacgacggactcacgctgccctacccagggcgaggcaacacttgtggaggagcaagacgccaacttcgtctgccggcgcacgttcgtagatcgggggtgggggaacggatgtgggctgttcggcaaggggtccctcatcacgtgtgccaagttcaagtgcgttaccaaactggagggcaagatagtccagtacgagaacctgaagtacagcgtgatcgtgaccgtccatacgggcgaccagcaccaggtggggaacgagtccaccgagcacggcaccaccgccaccatcacgccccaggcgcccaccaccgagatccagctcacagattacggggccctgacgctggactgcagcccacgcaccggcttagatttcaacgagatggtcctgctgaccatgaaggagaagtcctggctcgtgcacaagcagtggttcctggacctgcccctcccctggactagcggggctagcacgtcacaggagacctggaaccggcaggaccttctggtgacctttaaaaccgcccacgccaagaagcaagaggtcgtggtgctcggaagccaggagggcgcgatgcatacggccctgaccggggcgaccgagatccagaccagcggcacaaccaccatctttgcgggacacctgaagtgccgcctgaagatggacaagctgaccctgaaaggaatgagctacgtcatgtgcactgggtctttcaagctcgagaaggaggtggcagagactcagcacggcaccgtgctggtccaaatcaagtacgaaggcactgacgcgccgtgcaaaatccccttcctgacccaggacgagaagggggtgacccagaatggccgactgatcaccgcgaacccgatcgtgaccgacaaggagaagccagtcaacatcgaggccgagccacccttcggcgagtcctacatcatcatcggcgccggcgagaaggctctcaagctgtcctggttcaagaaggggagctccatcggcaagatgtttgaagccactgcccgcggggccagacgcatggcgatcctgggcgacaccgcgtgggacttcggatcaatcggcggcgtgttcacctccgccgggaagctcgtgcaccagatcttcggcaccgcctacggggtcctgttcagcggcgtgtcttggactatgaagatcgggattggcgtgttgttaacctggctgggcctgaactcccgttccaccagcttgtccatgacctgcatcgccgtcgggctggtgacgttatacctcggcgtgatggtccaggccgacagcgggtgcgtaatcaattggaagggccgggagctgaagtgtgggtctggcatcttcgtgaccaacgaggtccacacctggacagagcagtacaagttccaggcggacagcccgaaacgcctaagcgccgccatcggcaaggcctgggaagagggggtttgcggtatccggtccgccacccgcctcgagaatatcatgtggaaacagatctcgaatgagctcaaccatatcctgctcgagaacgacatgaagttcaccgtggtcgtgggggacgtggcgggcatcctggctcaggggaaaaagatgatccggccccagcccatggagtacaaatactcctggaagtcctggggcaaggccaagatcatcggggccgacgtccagaacaccaccttcatcatcgacgggcccaacaccccggagtgcccggacgaccagcgcgcgtggaacatctgggaagtggaggactatggcttcggaatctttacaactaacatctggctgaagctccgggactcctacacccaggtttgcgaccaccgcctgatgagcgccgccatcaaggactccaaggccgtccacgccgacatgggctactggatcgagagcgagaaaaacgagacctggaagttggcgcgcgcgtccttcatcgaggtgaagacgtgcatatggcccaagtctcacaccctctggtccaacggcgtgctggagagcgaaatgatcgtccctaagatctacgggggcccgatctcccagcacaactacagaccagggtacttcacccagaccgccggcccctggcatctggggaagctcgagttggactttgacctgtgtgaaggcacgaccgtagtggtcgacgagcactgcggcaacagagggcccagtctccgcaccaccacggtaacgggcaagatcatacacgagtggtgctgccggtcctgcaccctgccgcccctgcgcttccgcggagaggacggctgctggtacgggatggagattcgccccgtaaaggagaaggaggagaatctcgtcaagagcatggtttccgccggcagcggggaggttgacagcttctccctggggctactctgcatcagcatcataatcgaggaggtcatgcggtcccgctggagccggaagatgctgatgaccgggactctggccgtattcttcctcttaatcatggggcagctgacctggaacgacctcatccgcctgtgcatcatggtaggcgcaaacgcctccgaccgcatgggcatgggcaccacctacctagcactgatggcgacgttcaagatgcggccgatgttcgccgtcggccttctgttccgccggctgaccagccgtgaggtgctactgctcaccatcgggttgtccctggtagcgagcgtcgagctcccaaattccctggaagagctgggggatgggctcgccatggggatcatgatcctgaagctgctcaccgacttccagagccatcagctatgggcgacgctgctctccctaacattcattaagacaaccttcagcctgcactatgcctggaagacgatggcgatggtgctctcaatcgtcagcctgttccccctgtgcctctccaccacctctcagaagaccacgtggctgccagtgctgcttggctccctggggtgcaagccgctgaccatgttcctgatcgccgagaacaagatctggggacggcgcagttggcccttaaacgaggggatcatggccgtggggatcgtctccattctgctcagcagccttctgaagaacgacgtgcccctcgccgggcccttaatcgccggcggtatgttgatagcgtgctacgtgatctccggcagctccgccgacctcagcctggagaaggccgccgaggtctcgtgggaggaggaggccgagcacagcggcgcatcccacaacatcctggtggaggtgcaggacgacgggaccatgaagatcaaggacgaggagcgggacgacaccctcacgatcctgctgaaggctacgctcctggccgttagcggcgtgtaccctctgtccatccccgccaccctcttcgtgtggtacttctggcagaagaagaaacagcgctccggggtcctgtgggacacccccagcccgcccgaggtggagcgggccgtgctggacgacggcatctaccgtatcatgcaacggggcctactcgggcgatcacaagtcggcgtgggggtgttccaggagaacgttttccacaccatgtggcacgtgaccagaggcgcggtgctgatgtaccaagggaaacgcctggagccctcctgggcctctgtcaagaaggacttgatatcctacggcggcgggtggcggctgcagggctcctggaacaccggggaggaggtccaggtgatcgcggttgagccagggaagaaccccaagaacgtgcagaccgcgcccggtaccttcaagacgcccgagggcgaggtgggcgccatcgcgctggacttcaagcccggcacctccggcagccccattgtcaaccgggaggggaagatcgtcggcctctacggtaacggggtggttaccacctccggaacgtacgtgagcgccattgcccaggccaaggcgagccaggaggggccgctgcccgagatcgaggacgaggtgttccggaagcgcaacttgaccatcatggacctccacccgggctccgggaagacccggcgctacctgccggcaatcgtgcgggaggcgatcaagcgcaagttgcgcacattgatcctggctccaacgcgcgtggtggcctcagagatggcggaggccctgaagggcatgcccattaggtaccaaaccacagccgtcaaatccgaacacaccggaaaggaaatcgtggatctcatgtgccacgccacgttcaccatgcggctgctgtcacccgtgcgcgtcccgaactacaacatgatcatcatggacgaggcccacttcaccgacccctccagcatagcggccagggggtacatctccacgcgcgtgggcatgggcgaggccgccgccatcttcatgacggcgacgccgcccggctcagtggaggccttcccacagtccaatgccgttattcaggacgaggagcgggatatccccgagcgcagctggaactccggctatgagtggatcaccgacttccccggcaaaaccgtgtggttcgtgcccagcatcaagtccggaaacgacatcgccaactgcctccggaagaacgggaagcgcgtcatccagctgagccgtaagacgttcgacacagagtaccagaaaaccaagaacaacgactgggactatgtggtgaccacagacatctcagagatgggcgcgaacttccgcgcagaccgggtcatcgaccctcgcagatgccttaagcccgtgatcctcaaggacgggcccgagcgtgtgatactggccggcccgatgccggtcaccgtggccagcgccgctcagcggcgcgggcggatcggtcgcaaccacaacaaggagggcgaccagtacatctatatggggcaaccactgaacaatgatgaagaccacgcccactggacggaggccaagatgctgctggacaacatcaacactcccgagggcatcatccccgccctcttcgagccggagagggagaagtctgccgcgatcgacggggagtaccggctccggggcgaggcccggaagacgttcgtcgagctgatgcgccggggggacctacccgtgtggctcagctacaaggtggcctcggagggcttccaatacagcgaccgccgttggtgcttcgatggcgaacgcaacaaccaggtccttgaggaaaacatggacgtggaaatttggaccaaagagggggagcggaagaaactgcgaccccggtggctcgacgcgcgcacatacagcgacccccttgccctgcgggaattcaaggagttcgcggccggccgccgttccgtgagcggggacctcatcctggaaatcggcaagctgccgcagcacctcacccaacgcgctcagaacgccctggacaacctggtcatgctccacaactccgagcagggcggacgggcttatcgccacgccatggaggagctgcccgacacgatcgagaccctgatgctcctggccctgatcgccgttctcacaggcggggtgaccctgttcttcctgagcggacggggattaggaaagacctccatcggcctgctgtgcgtcatggccagctccgtgctcctgtggatggcgagcgttgagccccactggatcgccgcctccatcatcctagaatttttcctcatggtcttgctgatccccgagcctgaccgccaacggaccccgcaagacaaccaactcgcctacgtggtaatcggactgctgttcatgatccttaccgtcgccgcgaacgagatgggccttctggagaccaccaagaaagacctcgggatcggccacgtcgccgtagagaaccaccaccacgccgcgatgctggacgtcgacctgcacccggcatcggcgtggacgctctacgccgtggccaccaccattattaccccgatgatgcgccacacgatcgagaacaccaccgccaacatctccctgacggcaatcgcgaaccaggccgccatcctgatggggctcgataagggctggcccatcagcaagatggacatcggcgtgccccttctggccctcgggtgctactcccaggtcaaccccctgacgctgaccgcggctgtgctcatgctagtggcacactacgccatcatcggcccgggactgcaggccaaggcgacccgcgaggctcaaaagcggaccgccgccggaatcatgaaaaaccccacggtcgacgggatcgtggccatcgatctcgaccccgtggtctacgacgcgaagttcgagaagcagctgggccagatcatgctgcttatcctgtgcaccagccagatcttgctcatgcgcaccacgtgggccctgtgtgagtccattacgctggccaccggccccttgaccaccctgtgggaggggtcgccgggcaagttctggaacacgacgatcgccgtgtccatggccaacatattccggggaagctacctggcgggcgccggactcgccttctccctaatgaagtccctcgggggcgggcgccggggaaccggggcccagggtgagactctcggcgagaagtggaagcgccagctgaaccagctgagcaagtccgagttcaacacgtacaagcggagcgggatcatggaagtggaccgctccgaggcgaaggagggactcaagcgcggggagaccacaaagcacgccgtcagccgcggcaccgccaagctgcggtggttcgtggagcgcaacttggtgaagcccgagggcaaggttatcgacctgggctgcggccgcggcgggtggtcctactactgcgccgggctcaagaaggtgacggaagtgaaggggtacactaagggcggccccggccacgaggagcccatcccgatggctacctacgggtggaacttagtcaagctgcatagcggcaaggacgtgtttttcatcccgcccgagaagtgcgacaccctcctgtgcgacatcggggagtccagccccaacccgacgatagaggagggacgcaccctgcgggtgctcaagatggtcgagccctggctgcgcgggaaccagttttgcatcaagatcctgaacccctacatgccaagtgtggtggagaccctcgagcagatgcagagaaagcacggtggcatgctggtccgcaacccgctctctcggaactccacccacgagatgtattgggtgagctgcgggactggaaacatcgtgtccgcggtcaacatgacgagccgcatgctccttaaccgtttcaccatggcacaccggaagcccacctacgagcgcgacgtggaccttggcgccggcaccagacacgtcgccgtcgagcccgaggtggccaatctcgatattattggccagcgcatagagaacatcaagcacgaacacaagtccacgtggcactacgacgaggacaacccctacaagacctgggcttaccacggtagctacgaggtaaagccgtccggctcggcctccagcatggttaacggggtggtcaagctgctgacgaagccgtgggacgtgatccccatggtgacccagatcgccatgacggacaccacccccttcggccagcagcgggtcttcaaggagaaggtggacacccgcacgcctaaggccaagcgggggaccgcccagatcatggaggtgacggcgaagtggctttggggcttcctgagccgcaataagaagccccggatctgcacgcgcgaggagttcacacggaaggtccgctccaacgccgccatcggcgccgtgttcgtggacgagaatcagtggaactcggcgaaggaggcagttgaggacgagcggttctgggacctggtgcaccgcgagcgggagctccacaagcagggtaagtgtgcgacctgcgtgtacaacatgatgggcaagagagagaagaagctgggggagttcggcaaggcaaaagggtcgagagccatttggtacatgtggctgggcgcgcgctttctcgaattcgaggcactaggcttcatgaatgaagatcactggttcagccgcgagaactccttgagcggggtcgagggcgaggggctccacaagctgggctacatcctgcgcgacatctccaagatccccgggggtaacatgtatgccgacgacaccgccggctgggacactcggatcacggaggacgacctccagaacgaggcccgcattaccgacatcatggagccggagcacgcgctgctggccaaaagcatcttcaagctcacctaccagaataaagtggtgcgcgtacaacggcccgccaagaacggcaccgtgatggatgtgatttccagacgtgaccagcgcggcagcgggcaggtcggcacatacggcctgaacaccttcaccaacatggaggcccagctgatccggcaaatggagtccgaagggatcttctctccctccgagctcgagacccccaacctggctgagcgcgtgttagattggttggagaagtacggagtggaacggctcaagcgcatggcgatctcgggggacgactgcgtcgtgaagccgatcgacgaccggttcgccaccgcgctcacagccctcaatgacatggggaaggtgcgcaaggacatcccccagtgggagccctccaaggggtggaacgactggcagcaggtcccattttgcagccaccatttccaccaactgatcatgaaggatggccgtgaaatcgtggtgccatgccgcaaccaggacgagctggtcggccgggccagagtttcccaaggcgcgggctggagcctacgggagacagcctgcctggggaagagttacgcccagatgtggcagctgatgtacttccaccgccgggacctccgcttggccgcgaacgccatctgctccgccgtgcccgtcgactggatccccaccagccggacgacctggtccatccacgcccaccaccaatggatgacaaccgaggacatgctgtccgtgtggaaccgcgtttggattgaggagaacccctggatggaggacaagacgcacatctccagctggggcgatgtcccgtacctagggaagcgcgaggaccaatggtgcggctccctgatcggcctgaccgcccgggcgacctgggccaccaacatccaggtggccatcaaccaagtgcgccgactcatcggcaatgagaactacctggactacatgaccagcatgaagcgctttaagaatgagggcgaacccgagggcgccctgtggtga

SEQ ID NO: 24582 - RNA, 9879 nt, synthetic construct
  misc_feature 1..9879: note = derived and/or modified CDS sequence (opt11) from DENV-1__EU482510__SS-prME
  source 1..9879: mol_type = other RNA
agcgtcacaatgctcctcatgctgatgcccaccgctctggcctttcacctcacgacacgagggggggagccgcacatgatcgtgagcaagcaggagcgtggcaaaagccttctgttcaagacttccgcaggtgtcaatatgtgcaccttaattgctatggacttaggcgagttatgtgaggacacgatgacatacaagtgccctcgaatcacggaagttgaacccgacgacgttgactgctggtgcaataccacggacacctgggtaacatatggcacgtgctcgcagacaggagagcaccggcgagacaagcggagcgtggccttggcgccccacgtcggcctggggctggagactcgagctgagacttggatgagctccgagggcgcgtggaagcaaattcagaaggtcgagacctgggcccttcgacacccagggttcacggtgatcgctttgttccttgcccacgcgatcggcaccagcataacccagaagggcattatcttcatcttactgatgctggtcacgccctctatggccatgcgctgtgttggcatcggcagcagggactttgtggaggggctctccggagccacgtgggtcgacgtggtactggagcacgggagctgtgtaaccacaatggccaaagacaaacccactctagacatagagctccttcgcaccgaggtgaccaacccagccgtactgcgaaagctctgcatcgaggcgaagatatcaaacaccaccacggattccagatgcccaacccagggcgaagcaaccctggtcgaggagcaggatgctaactttgtttgccgcaggactttcgttgaccgtggatggggcaacggctgcggcctattcggaaaggggtccctgataacgtgcgccaagttcaagtgcgtcaccaagttagaggggaaaatcgtgcaatacgagaacctgaagtatagcgtgatcgtcactgtccacaccggagaccagcatcaagtaggcaacgagagcacggagcacggaactacggcgaccattacgccccaggcgccgacaagcgaaatccagctcaccgactacggagctctaaccctggattgctctcctcggaccggactcgacttcaacgaaatggtcctcctgactatgaaagagaagagttggctggtgcacaaacagtggtttctggacctgccactcccctggaccagcggcgcgtccacttctcaggaaacctggaaccggcaagacctgctggtgaccttcaagactgcccacgccaagaagcaggaggtcgtggtcctcggctcccaggaaggcgcgatgcatacggccctgacgggggcaacggagatccagacctcaggcactaccacgattttcgccgggcacctgaagtgccgcctcaagatggacaaactaacgctgaagggcatgtcctacgtgatgtgcacggggtcattcaagctagagaaggaagttgccgagacccagcacgggacagtcctggtccagatcaagtatgaagggactgacgcgccttgcaagatcccgttctccacccaggacggtaagggcgttacacagaacggacggctgatcactgccaacccgatagtcaccgataaggagaagcccgtcaacatcgaggcagagccgcctttcggcgagagctacatcgtgatcggcgccggggaaaaagctctcaaattgagctggttcaagaagggcagctctataggcaagatgttcgaagccactgcccggggggctcggcgaatggccatactcggcgacaccgcgtgggacttcggcagcattggcggggtatttacttccgtaggcaagctggtgcatcagatctttgggacggcctacggtgtcttgttcagcggggtgtcatggactatgaagataggcatcggcgtcctgttgacctggctcggtctcaacagccgctccacgagcctgtccatgacctgtatcgcggtgggcctcgtcacgctgtatttgggggtgatggtccaggctgatagcggttgcgtcatcaactggaagggtcgggagctgaagtgtggatctggaatatttgtcactaacgaggtccatacgtggaccgaacagtacaagttccaagctgactccccgaagcgcctatctgcagccatcggcaaggcctgggaggagggcgtatgtgggatccgctccgccacccgcctcgagaacataatgtggagacagatcagtaacgagctcaaccacatcctgctggagaacgacatgaagttcacggtggtcgtgggcgacgtggtcgggatactcgcgcaaggcaagaagatgattcgcccccaaccaatggagcacaaatattcctggaagtcctggggtaaggcaaagataatcggggccgacgttcaaaacaccaccttcatcatcgacggccccaacaccccggaatgcccagacgaccagcgggcctggaatatctgggaggtagaggactacgggttcggcatattcaccaccaacatctggctcaaactgcgcgactcgtacacacaagtctgcgatcatcggttgatgagcgccgctatcaaggactctaaggccgttcacgctgacatgggctattggatcgagagcgagaaaaacgaaacctggaaactagctcgagccagcttcatcgaggtgaagacttgcatctggcctaagagccacacgctgtggtccaatggagtcctcgagagcgagatgatcataccgaagatctacggtgggccgatatcccagcataactataggcccggctacttcacacaaaccgcggggccgtggcacttggggaaattggagctcgactttgacttatgcgagggcaccacagtggtagttgacgagcattgcggaaaccggggtccgagcctgcggaccacaaccgtgacggggaagatcatccacgagtggtgctgtaggtcctgtacgttgccccccctccggtttaagggcgaggacggttgctggtatggtatggagatacgccccgtcaaggagaaggaagagaacctcgtcaaaagcatggtgagcgcaggcagtggagaggttgatagcttctccctcggcctgctgtgtatcagcatcatgattgaggaggtcatgcggtcccgctggagcagaaagatgctcatgaccggcaccctggccgtttttttcctgctcatcatgggccagctgacttggaatgacctgatccgctcctgtatcatggttggggccaacgccagcgatcggatgggcatggggacgacctacttggcactgatggccaccttcaaaatgcggccgatgttcgcagttgggttgctgttccgcaggctgacatcccgcgaggtgctacttctgacgatcggactgagcttggtcgcatccgtagagctgcccaactccctggaagagctcggggatggcctcgcgatgggcatcatgatcctgaaactcctgaccgattttcagagctatcagctatgggccacgctcttgagcctgactttcatcaagacgacgttctcccttcactacgcctggaagaccatggccatggttctgagcatagtgtccctacttcccctatgcctgagcactacaagccagaaaaccacgtggctccccgtcctcttaggcagtcttggctgcaagccgctgactatgtttcttatagccgagaacaaaatctggggtcgtaagagctggcccctcaacgagggaatcatggctgttgggatcgtatccatactgctgagctccttgctgaagaacgacgtgcccctggctggcccgttgatcgccggcgggatgctgatcgcctgttacgtgatctcaggcagcagcgccgacctatccctcgaaaaggcggcggaggtctcatgggaagaagaggccgagcactccggcgcgagtcacaacatactggtcgaagtgcaggatgatgggacgatgaagatcaaagacgaggagcgcgacgataccttaaccatcctcctaaaggccaccttgctcgcggtatcaggggtgtacccgctgagcatcccagccacactattcgtatggtatttctggcagaagaagaagcagcggtcaggtgttctctgggacacacccagcccgcccgaggtggaacgcgccgtgctagacgatgggatctacagaatcatgcagcgcggcctgctaggccggtcccaggtcggggtgggcgtgttccaagagaacgtctttcacacgatgtggcacgtgacccgcggggccgtgctcatgtaccagggaaagagactggagccctcctgggcctccgtcaagaaagatctgatcagctacggcggcggttggcgcttgcaggggtcctggaacacgggtgaagaggtccaggtgatcgctgtcgagcccgggaagaacccaaagaacgtgcaaacggcacccggcacctttaaaacgccggagggcgaggtgggggccatcgccctcgacttcaagcccggcacctccggtagccccatcgtaaacagagagggcaagatagtgggactgtatggcaatggcgtggtcacgacctccggaacctacgtgagcgccatcgcgcaagcgaaggcctcccaggaaggcccgttgccggagatagaagacgaggtattcaggaaaaggaatctgaccatcatggaccttcaccccggaagcggcaagacgcgccggtatctccctgccatcgtccgggaggcgatcaagaggaagctacgaaccctgatcctggcccccacccgcgtggtggcctccgagatggccgaggccctgaagggcatgcccatacggtatcagacgacggcggttaagtctgagcacaccggacgcgagatcgtggacttgatgtgccacgccaccttcaccatgcggcttctgtctcccgtgagagtcccgaattacaacatgatcatcatggacgaggcccacttcacggatccgagcagcatcgccgcgcggggctacatttctaccagggtcgggatgggcgaggcggcggccatattcatgaccgctacgccgcccgggtccgtcgaggccttcccgcagtcaaacgcggtcatccaggatgaggagcgggacatcccagagcggagttggaacagcggatacgaatggattacggacttcccgggtaagactgtgtggttcgtaccttccatcaaaagcggaaacgacatcgctaattgcctacggaagaacggcaagcgcgtcatccagttgtcccggaaaaccttcgacaccgagtaccagaagacaaagaacaacgactgggactacgtggttaccactgacatcagtgagatgggcgctaacttccgggccgacagagtcatcgacccgcgccgctgccttaagcccgtgatcctgaaggatgggcccgaacgcgtcatcctagcggggcccatgccggtcaccgtcgcatccgccgcccagcggcgaggccggattggccgcaaccataacaaagagggtgaccagtacatctacatgggccagccgttaaacaacgacgaggatcatgcccactggacggaggcgaagatgctactggacaacatcaacaccccggaggggattattcctgccctgtttgaaccggagcgcgagaagtcagccgccatcgatggcgagtaccggcttcgcggcgaggcgcggaagacttttgtggaattgatgcgacggggcgatctgcctgtgtggctgagctataaagtggcctccgagggcttccagtactctgaccgccgatggtgctttgacggggagcgcaacaaccaggtcctggaagagaacatggacgtggagatttggaccaaggagggcgagagaaaaaagctgcggccacggtggctggacgcccgcacgtattcagatccgctagctttaagagagttcaaagaatttgccgcggggcgccggagtgtgtccggtgacctgatcctagaaataggaaagttaccgcaacacctgacacagagggcgcagaacgcgcttgataacctggtaatgctgcacaacagcgagcagggcgggcgggcctatagacatgccatggaggagctccccgacaccatcgagaccctcatgctgctcgcgctgatcgccgtgttaaccggcggcgtaaccctcttcttcctttccggacggggactgggaaagacctccatcgggctcctgtgcgtaatggcctcttcggccctgctttggattgcctccgtggagccccactggatcgcggccagcattatcctggaattcttcttaatggtattgttaatacccgagccggaccgccagcggacgccccaagacaaccagctggcttacgtggtgatcggcctgttatttatgattttaaccgtcgccgccaacgaaatggggttactggagacaacaaagaaagaccttgggatcgggcacgtcgcggtagagaatcaccaccatgcaacgatgttagacgtggacctccaccccgcctccgcctggaccctttacgccgtcgcgacaaccataatcaccccaatgatgcgccatactatcgagaacacgacggccaacatcagcctgaccgcgatcgccaaccaggccgctatcctcatgggcctggataagggctggccaatctccaagatggacatcggggtgcccctactcgccctgggctgctactcacaggtgaaccccctaaccctgacggcagccgtgctaatgctcgtggcgcactacgctatcatcggtccggggttacaggccaaggccacccgcgaggcccagaagcgaactgcggccgggatcatgaagaaccccaccgtagacggtatcgttgccatagatctggaccccgtggtgtacgatgccaagtttgagaagcaattaggacagatcatgctccttatcctctgcacgtcccagatcctcctgatgcgcaccacatgggccctctgcgagagcatcactttggcaacgggccccctcacaacgctttgggagggatccccggggaagttctggaacacgactatagccgtgagcatggccaacatcttcagaggtagctacctggccggcgccgggctggcgttctcccttatgaaatccctgggcgggggacgccgtgggacaggcgcccaaggggagaccctgggggagaagtggaagcgccaactcaaccagttgagcaagagcgagttcaacacctacaagcggtccggcatcatggaagtggatcgcagcgaggccaaggagggcttacggcgcggcgaaacgacaaagcacgccgtatcccgggggaccgcaaagttacgctggttcgtcgagcgaaacctggtgaagccggagggcaaggtgatcgatctggggtgcgggcgtggcgggtggtcttactactgcgcgggcctaaagaaggtcaccgaggtcaagggatatactaagggcggcccaggacacgaggagccaatcccgatggccacctatggatggaacctcgtaaaacttcattcaggtaaggacgtcttcttcatcccacctgagaagtgcgacaccctgctttgcgacataggagagagttcacccaaccccaccatagaggaggggcggacactgcgcgtgctgaagatggttgagccttggctccgaggcaaccaattctgcataaagatactgaacccgtacatgcccagcgtcgtcgaaaccctggagcaaatgcagcgcaagtacggcgggatgctcgtgcgcaatcctctgtcccgcaatagtactcacgaaatgtactgggtcagttgtggcactgggaacatcgtgtcagccgtgaacatgacgtcacgcatgctactcaaccggttcacgatggctcaccgcaagcccacttacgaacgcgacgtcgatctgggcgcgggcaccagacacgtcgctgtagagcccgaagtagccaatctggacattatcgggcagcggatagagaacattaagcacgaacacaagtctacatggcactacgacgaggacaacccctacaaaacgtgggcctatcacggttcttacgaggtcaagccctctggctctgcctcaagcatggtcaacggcgtggtgaagctcctgaccaagccgtgggacgtcatccccatggtgacccagatcgccatgactgacaccaccccctttgggcagcagcgggttttcaaggaaaaggtggatacccggactcctaaggccaagcgtggcacggcccagatcatggaggtgaccgcacgttggctgtggggatttctaagtcgcaacaaaaagccccggatctgtactcgcgaggagttcacccggaaggttaggagcaacgccgccattggggccgttttcgtggacgagaatcagtggaattcggccaaggaagccgtggaggacgagcggttttgggacctggtccaccgcgagcgggagcttcacaagcaggggaaatgtgcaacttgcgtgtacaacatgatggggaagcgcgagaagaagctcggcgagttcgggaaggcgaaggggtcccgtgccatctggtacatgtggctaggcgcccgcttcctagagttcgaagcccttgggtttatgaacgaggaccactggttctcccgggagaacagcttgtccggcgtagagggggaggggctgcacaagctcggatatatcctcagagacatcagcaaaatcccaggcggtaatatgtacgcggacgacaccgccgggtgggatacacgcatcactgaggatgacctgcagaatgaagctaaaattaccgacatcatggagccggagcatgccctcttagccacttccatcttcaagttaacttatcagaacaaggtggttcgggtgcagcgccccgccaagaacggcaccgttatggacgtgataagccggcgcgatcagcgggggtccggacaggtggggacctacgggctcaacacgttcactaacatggaagcccagctaataaggcagatggagagcgaaggcatcttctccccgtcggagttggaaacccccaatctcgccgagcgagttctggactggcttgagaagtacggcgtagagcgccttaagcggatggccatctctggcgacgactgcgtggttaaacccatcgacgaccgtttcgccacggcgcttaccgcactgaacgacatggggaaagtgcggaaggatataccccagtgggagcccagcaagggctggaacgattggcagcaggtccccttctgtagccaccacttccaccagctcatcatgaaggacgggcgcgaaattgtggtgccgtgccggaaccaggacgaattagtcggccgcgcccgggtctcacaaggggcaggatggagcctgcgcgagaccgcctgcctaggcaagtcctacgcgcagatgtggcagctgatgtacttccaccggcgcgacctaagactcgcagccaatgccatctgctctgctgtgcccgtggactgggttcccacctccagaacgacatggagcatccacgcccatcaccagtggatgacgaccgaagatatgctgtcagtgtggaaccgggtgtggatcgaggagaacccttggatggaggacaagacgcacatcagcagctggggcgacgtcccgtatctgggcaagcgggaagaccagtggtgtggcagcctcatcgggttaaccgcccgcgccacatgggccaccaacatccaggtggcgatcaaccaggtgaggcgtctgatcggcaatgagaactacctcgactacatgaccagcatgaagcggttcaagaatgaaagcgaccccgagggggcactgtggtga

SEQ ID NO: 24583 - RNA, 9879 nt, synthetic construct
  misc_feature 1..9879: note = derived and/or modified CDS sequence (opt11) from DENV-1__EU482511__SS-prME
  source 1..9879: mol_type = other RNA
agcgtgaccatgctgctgatgctgatgcccaccgccttggccttccatctcacaacccggggtggggagccacacatgatcgtcagtaaacaggagcgggggaagtcactgcttttcaagacgagcgccggtgtgaacatgtgcactctgatcgccatggacctgggcgaactgtgcgaagacaccatgacctataaatgcccccggatcacagagaccgaaccggatgacgtagactgttggtgcaacgccacagacacctgggtcacctatggcacttgcagccagacgggcgagcatcgtcgggacaagcggagcgtggcacttgccccccacgtcgggctggggctcgagacccgcacagaaacctggatgagcagtgagggggcctggaagcagatccagcgggtggagacctgggccctccggcaccccgggttcaccgtgatcgccctgttcttggcccacgccatcggcaccagcatcacccagaaggggattatctttatcctcctgatgctggtgacgccctccatggccatgcgatgcgtggggattggcagccgcgacttcgtggaggggctctcgggcgccacctgggtggacgtcgtactggagcacgggtcatgcgtgacaacaatggccaaggacaagcccacgctagacatcgagttactgaagaccgaggtcaccaaccccgccgtccttcggaaactctgcattgaggctaagatctccaataccacgacagacagccgctgccctacccagggagaggccaccctggttgaggaacaggacgcgaacttcgtctgcaggcgcacgttcgtggaccggggctgggggaacggctgcgggttattcggcaagggatccctcatcacctgcgctaagttcaaatgcgtaaccaagctagagggcaagattgtccagtacgagaacctgaagtactctgtgatcgtgactgtacacacgggggaccagcaccaggtggggaacgagtccaccgaacacggaaccaccgccaccatcacaccccaggcgcccacaaccgagatccaactcaccgactacggggccctgacgctggactgctcacccaggaccggcctcgactttaacgaaatggtactgctgactatgaaggagaagagctggttagtgcacaagcagtggttcctggacctgcccctcccctggaccagcggggctagcacttcccaggagacctggaaccggcaggacctgctggttaccttcaagaccgcccacgccaagaagcaagaggtcgtggtactcggcagccaggagggcgcgatgcacacggccctgaccggggccaccgagatacagacctccggcacgacaaccatcttcgccgggcacctgaaatgccggctcaagatggacaagctgaccctgaagggcatgagctacgtcatgtgtaccgggtccttcaagctcgagaaggagctggccgagacccaacacgggacggtgctggtacaaattaagtacgagggaaccgatgcgccctgcaagatccccttctccacccaggacgagaagggagtcacccagaacggccggctgatcaccgccaaccccatcgtaaccgacaaggagaaaccagttaacatcgaggccgagccgcccttcggagagtcttacatcgtcatcggcgctggcgagaaggcgttaaagctgagctggttcaagaagggctcctccatcggaaagatgttcgaggcaacggcccgaggagctcggcgcatggccatcctgggcgataccgcgtgggatttcgggagcatcggcggcgtgttcaccagcgtcggtaagctggttcaccagatcttcggcaccgcgtacggggtgctattctccggcgttagctggacgatgaagataggtatcggagtcctgctcacctggttgggcctaaattcccgcagtacctccctaagcatgacctgtatcgcggtggggctggtgaccttatatctcggcgttatggtacaggcggattccgggtgtgtgatcaactggaagggtcgtgagctgaagtgcggcagcggcatattcgtaacgaacgaggtgcacacctggaccgagcagtacaagttccaagccgatagcccgaagcgcctatccgcggccatcggcaaggcttgggaggagggtgtatgcggcatacggagcgccacgagacttgaaaacattatgtggaagcagatctctaacgagctgaatcacattctgctagaaaacgacatgaaattcacggtcgttgtcggggacgtagccggcattttggcgcaggggaaaaagatgatccgaccccagcctatggagtacaagtacagctggaagtcttggggcaaggccaaaatcatcggcgccgatgtccagaataccacattcatcatcgacggacccaatacgccggagtgccccgacgaccagcgcgcctggaacatctgggaggtggaggattacggtttcggcatattcacgaccaacatatggctgaagctccgggacagctatacacaggtctgtgatcaccgcctgatgtccgcggccatcaaggacagcaaagccgtgcacgcagatatgggctactggatcgagtcagagaagaacgagacctggaagctggcgagagcttctttcatcgaggtgaagacgtgcatatggcccaagtcccacactctctggagcaacggcgttctggaatccgaaatgataatccctaagatctacgggggcccgatgtcgcagcacaactaccgccccggttacttcacccagaccgccggcccctggcacctggggaagctcgagctggatttcgacctgtgcgagggcacgaccgtggtggtcgacgaacactgcggcaaccgtggtccttctctccgcactaccacggtgaccggtaaaatcatccacgagtggtgctgtaggtcatgcaccctgccgccgctgcgattcagaggcgaggacggctgctggtacgggatggagatccgccctgtcaaggagaaggaggagaacctcgtcaagtccatggtgagcgcaggcagcggggaggtggactccttctctctggggctgctctgcatctccatcatgatcgaagaggtaatgcggtcacggtggtcacggaagatgctgatgaccgggacgctggccgtattcttcctcctcatcatggggcagctgacctggaatgacctcatccgcctgtgcataatggtgggcgccaacgcgagcgaccgcatggggatgggcaccacctatctggccctcatggccacgtttaagatgcgaccgatgttcgccgttggcctccttttccgtcggctcacctccagggaagttctgctactcaccatagggctgagcctggtggcctccgtcgagttgcctaattcactggaggagctgggcgacgggctggcgatgggcatcatgatcttaaaactgctcactgacttccagtctcaccagctgtgggccaccctgctcagccttacctttatcaagaccacattttcactgcactacgcctggaagacgatggccatggtgctcagcatagtgtccctgttccccctgtgccttagtaccacttcgcagaaaaccacgtggttgcccgtgctactcggcagcctggggtgcaagccgttaactatgttcctcatcgcggagaacaagatatggggtcggcgatcctggcccctgaacgaagggatcatggctgtgggcattgtgagcatcttactcagctccctgttgaagaacgacgtgcccctagctgggcctctgatcgcaggcggcatgctaattgcgtgttacgttatcagcgggtcctccgcggacttatccctggagaaggcggccgaggtttcatgggaagaggaagccgagcacagtggcgccagccacaatatccttgttgaagtgcaggacgacgggaccatgaagatcaaggacgaggagcgcgacgataccttgaccatattactgaaggcgacgctcctagccgtttccggcgtgtacccgcttagcatccccgcaaccctcttcgtgtggtacttctggcagaagaagaagcagcgctccggggtcctatgggacaccccaagcccgcccgaggtggagcgggccgtgctggacgacggtatctacagaatcatgcagcggggccttctcgggcgctcccaggtcggcgtgggggtgttccaagagaacgtgttccacaccatgtggcacgttacgcggggcgccgtgctgatgtaccagggcaagcgactggaacccagctgggcgagtgtaaagaaggacctcatctcgtacggcggcgggtggcgtctccagggctcctggaacaccggtgaggaggtccaggtaatcgccgtcgagcccggtaagaaccccaagaacgtgcagaccgcccccggtaccttcaagacacccgaaggcgaggtcggcgccatcgccctggacttcaaacccggaaccagcggctcgcccatcgtcaaccgcgaggggaagatcgtgggcctctacggaaacggcgtggtcaccaccagcggcacatacgtgagcgcgatagcccaggccaaggccagtcaggagggacccttgcccgagatcgaggacgaggtcttccggaaacgcaaccttaccatcatggacctccacccaggaagcgggaagacccggaggtacctgccggcgatagtgcgggaggcgatcaagcgcaagctgcgcaccttgatcctggcccccacgagagtggtggcctccgaaatggccgaagcactgaagggcatgcccatccgctaccaaaccaccgccgtaaagagcgagcacactggcaaggagatcgtggacttaatgtgccatgccacgttcacgatgcgactgctgtcccccgtgcgcgtcccgaactataacatgatcattatggatgaggcccacttcactgatcccagctccatagccgcgagaggctacatcagcacacgcgtaggcatgggggaggccgccgcgatctttatgacggccactccgcccgggtccgtggaggcgttcccgcagagcaacgccgtcattcaggacgaggaacgggacatccccgagcgctcctggaacagcgggtacgagtggatcaccgactttcccgggaagaccgtgtggttcgtcccctccatcaagagcggtaacgacatcgccaactgcttacggaagaacggtaagcgcgtcatacaactgtcccgcaagacattcgacaccgagtaccagaagaccaagaacaacgactgggattatgtggtgacgacggacatctcggagatgggcgccaacttccgcgcggaccgagtcatcgacccgcggcggtgcctgaagcccgttattttaaaggacgggcccgaacgcgtgatcttggccggcccgatgccggtgaccgtggcctccgccgcccaacggcgcgggagaataggccgcaaccacaacaaggagggcgaccagtacatttacatggggcagcccctaaataacgatgaggatcacgcgcactggacagaggccaagatgctccttgacaacatcaatacccccgaaggcatcatccccgcgctgttcgagccggagcgcgagaagtccgctgccatcgacggcgagtatcggctccgcggtgaggcgagaaagacgttcgtcgagctgatgcgccgcggggacctgcctgtatggctctcctacaaagtggcctcagagggcttccagtatagcgatcgtcggtggtgctttgacggcgagcgcaacaaccaagtcctggaagaaaatatggatgtggagatctggaccaaggagggggagcggaagaagctgcgcccccgctggctcgacgcccgcacctactcggaccctctggccctgcgggagttcaaggagttcgccgcgggccgccggagcgtgtccggggacctgatcctagagattggaaagctgccgcaacacctcacccagagagcccaaaacgcgctggacaacttagtcatgctccataacagcgaacagggcgggcgtgcctaccgccatgcaatggaggaactgcccgacacgatcgaaacgctcatgctcttagccctcatcgcagtgctcaccgggggagtgaccctattcttcctgtcgggccggggactcgggaagaccagcatcggcctgctgtgcgtcatggccagttctgtgttattgtggatggcctccgtggagccccactggatcgcggccagcatcatcctggagtttttcctcatggtcttgctgatccccgagccggaccgtcagcgcacgccccaggacaaccagctcgcctacgtggtgatcgggttgctttttatgatcctgaccgtcgccgccaacgagatgggcctgctagaaaccaccaaaaaggacctcggtatcggccatgtggcggtagagaatcaccaccacgccgccatgctggacgtcgacctgcatcccgcctccgcctggacgctctacgcggtggccaccaccatcattacaccgatgatgcgccatacgatagagaacaccaccgctaacatcagcctgaccgcgatcgccaatcaggcggccatcctgatgggcctcgacaagggttggccaatatcaaagatggacataggcgtacccctgctagccctcgggtgctacagccaggtcaaccccctgacgctgaccgccgcggtgctcatgctggtagcccattacgcgatcatcggcccggggctgcaagcaaaggccacccgcgaggcgcagaagcggaccgccgccggtataatgaagaacccgacggtcgacgggattgtggccatcgatctggaccccgtggtctacgatgccaagttcgagaagcagctcgggcagattatgcttctcatcctgtgtacctctcagatcctgctcatgcgcacgacttgggcactgtgcgagagcatcacgctggccaccggccccctcaccaccctgtgggaggggtccccagggaagttctggaacaccactatcgccgtgagcatggcaaacatcttccgcgggagttaccttgcgggcgcgggcctggccttcagcctgatgaaaagcctcggaggcgggagacgggggactggggcgcagggagaaactctcggcgagaagtggaagcggcaactgaatcagctgtccaagagcgagttcaatacgtacaagcgctccgggataatggaagtggaccgcagcgaggccaaagagggcctcaagcgcggggagaccaccaagcacgcggtctcccgcggcaccgccaagctgcggtggttcgtggaacgcaacctggtgaagcccgaggggaaggtcatagacttgggctgcggcagggggggctggagctactactgcgcggggctcaagaaggtgacggaggtgaagggctacaccaagggcggccctggccatgaggaacccattccgatggctacctatgggtggaacctggttaaactgcactccggcaaggacgtgtttttcatcccgcccgagaagtgcgatacacttctgtgcgatatcggggaaagctcccccaatccaacgatcgaggagggcagaacactgcgtgtgctcaagatggtcgagccctggctgcgcgggaaccagttctgcataaagatcctgaacccctacatgccgagcgtggtggagacgctcgagcaaatgcaacgtaagcacggtggcatgctggtccgcaatcccctctcccggaacagcacccacgagatgtactgggtctcatgcggtaccggaaacatcgtcagcgctgtcaacatgacatcccgcatgctcttaaatcgcttcaccatggcgcaccggaagccgacatacgagcgcgacgtggacctgggggccggcacccgccacgtcgccgtcgagcccgaggtggccaatctagatatcatcggtcagcgaatagagaacatcaaacacgagcacaaaagcacgtggcactacgacgaagacaacccctacaagacctgggcctatcatgggagttacgaggtgaagcctagcggctccgccagcagcatggtaaacggcgtggtcaagctgctgaccaagccctgggacgtgatccccatggtgacccagatcgcgatgactgacaccactccctttggccagcagcgagtcttcaaggagaaggtggacacccgcacgccgaaggccaagcggggaacagcccaaatcatggaagtgactgccaagtggctctggggattcttatcccgcaacaagaaaccccggatctgcacccgtgaagagttcacgcggaaggtccggagcaacgcagccatcggagccgtttttgtggacgagaaccagtggaacagcgccaaggaggcggtcgaagatgaacggttctgggatctggtgcatcgcgagagggagctccacaagcaggggaagtgcgctacctgcgtgtacaatatgatgggcaagcgcgagaagaagctgggtgagttcggcaaggccaaagggtcacgggccatttggtacatgtggctgggcgcccgcttcctagaattcgaggcgttaggcttcatgaacgaggaccactggttttccagagagaacagcctgtccggggtcgagggcgaggggctccacaaactgggctacatcctgcgcgacatcagcaagattccggggggcaacatgtacgccgatgacaccgctgggtgggatacccggatcaccgaggacgacctccaaaacgaagctcgcattaccgacatcatggagccggagcacgccctactggctaaatccatcttcaagctcacataccagaacaaggtagtgcgcgtccagcggccggccaagaatggaaccgtgatggacgtgatcagtcgccgagaccagcgcgggtcagggcaggtgggcacgtacggcttgaataccttcaccaatatggaggcccagctgatccggcagatggagagcgagggtatcttttcacccagcgagctggagacccccaacctcgccaagagagttctggactggctcgagaagtacggagtggagcggctgaagcgtatggccatctccggcgacgattgcgtcgttaagccgattgacgaccgcttcgcgacggccctgaccgctctcaacgatatgggtaaggtacgcaaagacatccctcagtgggagcccagcaaagggtggaacgattggcagcaggtccccttctgctcccatcacttccaccagctgatcatgaaagacggccgggagattgtggtgccatgccgcaaccaggacgagctagtcggcagggctagggtgagccagggggccggctggagcctcagggagacggcgtgcctgggtaagagctatgcccaaatgtggcaactgatgtatttccaccgcagggacctacgcctggccgcgaacgcgatctgcagcgctgttcccgtcgactggatccccaccagccggacgacctggagcattcacgcccaccaccagtggatgaccaccgaggatatgctaagcgtgtggaaccgcgtgtggatcgaggaaaacccctggatggaggacaagacacatatcagctcctggggtgacgtaccgtacctcgggaagcgcgaggaccagtggtgcggcagcttaattgggttaaccgcccgagccacctgggctaccaacatccaggtggccatcaaccaggtacgccggctcattgggaacgaaaactacctggactacatgacctccatgaagcgcttcaagaacgagtcggaccctgagggcgcattgtggtga

SEQ ID NO: 24584 - RNA, 9879 nt, synthetic construct
  misc_feature 1..9879: note = derived and/or modified CDS sequence (opt11) from DENV-1__EU482513__SS-prME
  source 1..9879: mol_type = other RNA
agcgtcactatgcttttgatgcttatgccaaccgccctggcctttcacctaacgaccagaggaggggaaccacacatgatagtgagcaaacaggagcgtggtaagagcctgctgttcaagacttctgccggggttaacatgtgcaccctcatcgccatggacctgggcgagctgtgtgaggataccatgacttacaagtgcccccgaatcacggaaaccgagccagacgacgtggactgttggtgcaacgccacggatacatgggtcacctatgggacctgctctcagacaggggagcatcggcgggataaaaggagtgtggccttggctccccacgtcggcctaggtctggaaacgaggaccgagacttggatgtcttccgagggggcatggaagcagatccagcgagtcgaaacatgggctctccggcaccccgggtttaccgtgatcgccctctttttagcacacgcaatcggcacatctatcacccaaaaagggatcatttttatactcttaatgctggttactccctccatggccatgcgttgcgtcggaatcggcagccgtgacttcgtggagggcctctctggggccacatgggtcgacgtcgtgctggagcatgggtcgtgtgtcaccacgatggctaaagacaaacctacgctggatatagaactcctgaagacagaggttaccaaccccgccgtgctgcggaagctgtgcatcgaggcgaagatctctaacactacaaccgacagccgctgcccgacccagggcgaggccaccctggtggaggagcaggacgcaaacttcgtctgccgacgcacgttcgtggaccgtggctgggggaacggctgcggtttattcggcaagggaagtctcattacgtgcgcaaagttcaaatgcgttaccaagctcgaaggcaagatcgtgcaatacgagaacttaaagtatagcgtgattgtcaccgtccacacgggggatcagcaccaggtggggaacgagtccaccgaacacggcaccaccgcgaccatcactccccaagcccccaccaccgagattcagctcacagactatggggccctgacgttagactgcagccccaggacaggcctcgacttcaacgagatggttctgctgaccatgaaggaaaaatcctggcttgtccacaagcagtggttcttagacttaccactgccctggaccagtggtgcttccacgtcccaggagacttggaatcggcaggatttacttgtgacctttaagaccgcccatgccaagaagcaggaggttgtggtgcttggctcccaggagggcgcgatgcatacggccctgacgggggcaacagagatccaaacctctggaacgaccacgatctttgcagggcacttgaaatgccgcctcaagatggacaagctaacattaaagggcatgagctatgttatgtgcactgggtctttcaagctcgagaaagagctcgcagaaacgcaacacggcaccgtgctggtgcagataaagtacgagggcacggatgcgccctgcaagatacctttctcgactcaggatgagaagggtgtcactcagaatggccggctgatcacggccaatcctattgtgaccgacaaggagaagcccgtgaacatagaggccgagccacccttcggagagagttacatcgttatcggcgccggtgagaaggccctcaagctcagctggttcaagaaggggagcagcatcggcaagatgttcgaggcgacggctagaggtgcccgccgcatggccatcctgggagacaccgcgtgggatttcgggtcaataggcggagtcttcacctcagttgggaagttagtccaccagatcttcggcaccgcttacggggtgcttttttctggcgtcagctggacgatgaagatcgggatcggcgtgctgctcacctggttggggctgaactcccgctctacatccctcagcatgacttgcatcgcggtggggctagtgacactgtacctcggcgtcatggttcaggctgactccggatgcgtcatcaactggaagggccgtgagctgaaatgcgggagcggcatcttcgtgacaaacgaggtgcacacctggaccgagcagtataagttccaggcggactctccgaagcgcctgagcgcggctatcgggaaggcttgggaggagggggtgtgcggcatccggagcgccacccgactcgaaaacattatgtggaagcagatctccaacgaactgaaccacatactgctcgagaatgacatgaagtttacggtagtggttggggatgtagctggaatcctggcgcaagggaagaagatgatccgcccccagccaatggagtacaagtatagctggaaaagctggggcaaggccaagataataggcgccgatgtgcaaaataccacctttatcatcgacgggcccaacacccctgagtgtcccgatgaccagagggcctggaacatctgggaagtggaggactatggttttggcatctttacaacaaacatctggctgaaactccgggacagctacacccaggtctgcgaccaccgcctgatgtccgcggccatcaaagatagtaaagccgttcacgccgacatgggatactggattgagtccgagaaaaatgagacctggaagcttgcgcgggccagcttcatcgaagtgaagacgtgtatctggcccaaatcgcacacactctggagcaacggcgtcctggagtccgagatgattattccgaagatatacggtggcccgatcagccaacataactaccgcccggggtatttcacccagaccgcgggaccctggcacttggggaagcttgagctagatttcgacctgtgcgaggggacgacggttgtagtagacgagcactgcggaaatcgagggccatccctccgaaccaccacagtgacgggaaagatcatacacgagtggtgctgccggtcatgcactctgccgcccctgcgctttcgcggtgaagacggctgctggtacggcatggagatccgccccgtgaaagagaaagaggagaacctcgtaaagtctatggtgagcgccggtagcggcgaggtggacagtttttccctgggactgctctgcatcagtattatgatagaagaggtcatgcggtcgcgctggtcccggaagatgctcatgaccggcacactggccgtgttctttctgctgatcatggggcagctaacctggaatgatctcatacgcttatgcatcatggttggcgccaacgcgagcgatcggatgggtatgggaacgacctacttagcattgatggcgaccttcaagatgcgcccgatgtttgccgttggactgttattcagacggttaacttcacgtgaggtgctgcttctcacaatcggcctgagcctggtggcctcagttgagctgcccaactccctggaggaactcggggacggtctcgcaatgggcatcatgatactaaagttgttgacagactttcaatcccaccaactgtgggccacactgctgtcgctgaccttcattaagactacgttttcgctccactacgcgtggaagactatggccatggtgctgtccatcgtctcactgttccccctgtgccttagcacaacctcccaaaagactacgtggctgcccgtgctgctcgggagcctggggtgcaaaccgctaacaatgttcctcattgcggagaacaagatctggggccgtcgctcctggccgctgaacgagggcatcatggccgtgggcatcgtatccatcctgctcagttctttactgaagaacgacgtgcctctcgccggtccactgattgcaggcgggatgcttatcgcatgctacgtgatcagcgggtccagcgcagacctatcactggagaaggccgccgaggtctcatgggaggaggaagcggagcactccggagcatcgcataacatcctggttgaagtgcaggacgatgggaccatgaagatcaaggacgaggagagagacgataccttaaccatcctgctcaaggcgacactcttggccgttagtggtgtctatcctctgtcgattcccgcgaccctcttcgtatggtatttctggcagaagaaaaagcagcgcagcggagtcctctgggacaccccctcgccgcccgaagtggaacgagctgtactggacgacggcatctatcgcataatgcaacggggcctgctcggtcggtcccaggttggcgtgggggtgttccaggaaaacgtattccatacgatgtggcatgtgacccggggggccgtgctaatgtatcaagggaagagacttgagccctcttgggcgtccgtcaagaaggacctaatcagctatggcggcggctggcggctgcagggctcctggaacaccggggaggaggtccaggtgatcgctgtcgaacccggcaagaatcccaagaacgtgcagaccgcccctgggaccttcaagacgcctgagggcgaggtgggcgccatagccctggatttcaaacccgggacatccggcagccccatagtcaaccgtgaggggaaaatcgtgggcctttacggcaacggagtggtcacgacctctggtacctacgtgagcgcgatagcccaggcgaaggcctcccaggaggggccgctgcccgaaattgaagacgaggtatttcggaaacgcaacctgacaataatggacttacaccccggatcgggtaaaactaggcgctacctaccagcgatcgtccgggaagccattaaacgcaagctgcgcactttgattctggcccccacgcgggtggtcgcaagcgaaatggcggaagcccttaaaggcatgcccatccgctatcagaccaccgcggtcaaaagcgagcacactggcaaggagatcgtcgacctgatgtgtcatgcaacattcaccatgcggctcctgtccccagtgcgggtgccgaactataacatgatcatcatggacgaagcccactttaccgaccccagctccatcgccgcccggggttacatatccacccgggtgggtatgggggaagccgctgccatcttcatgacggccacgccgcctgggtctgtagaagccttcccgcagtcaaacgccgtcatccaggacgaagaaagagacatccccgagcgctcctggaattccgggtatgagtggataaccgatttccccggcaagaccgtgtggttcgtgccgtctattaaatcgggaaatgacattgcaaattgcctgcggaagaatgggaaaagagtcatccagctgagtcggaagactttcgacaccgagtatcagaaaaccaagaataatgactgggattacgtggtcacgactgacatctctgagatgggcgcaaactttcgcgcggaccgggtcatcgaccctcggagatgtctcaaacccgtgatattgaaggacggacccgagagggtgatactggccggtcccatgccggttaccgtggcctccgccgcacagcggagggggagaatcggccgtaaccacaacaaagaaggcgaccagtacatctacatgggccagcctcttaataacgacgaggaccacgcgcactggacagaagccaaaatgctcctggacaatataaataccccggagggtattatccctgcccttttcgagcctgagcgagaaaagtccgccgccatcgacggggagtaccggcttaggggagaagcccggaagacgtttgtcgagctgatgcggcgtggggacctacccgtgtggctctcctacaaggtcgccagcgagggatttcagtactcagatcgccgctggtgcttcgacggagagcgcaataaccaggtcctggaggagaacatggatgtggaaatttggaccaaagaaggggagcggaagaagttacgcccacggtggctcgacgcgagaacctactccgaccccctggccttgcgggagtttaaagagttcgccgcgggacgccggagcgtatctggagacctcatcctggagatcggcaagctccctcagcacctcacccagcgcgctcaaaatgccttggacaacctggtcatgctacacaactccgagcaaggcgggagggcataccgccatgctatggaggaattgcctgatacgattgaaactttaatgctccttgctctgatagcagtgctcactggaggggtcacgcttttcttcttgtcagggcgtggccttgggaagacaagcatcggactgctgtgcgtaatggcctccagcgtgctcctttggatggcctcggtggagccgcattggattgcggcaagcatcatccttgaattcttcttgatggtcctgcttatccccgagccggatcgccagcgtaccccccaggataaccagctcgcctacgttgttatcggtctgctgttcatgatcttaaccgtcgccgccaacgagatggggcttctggagaccactaagaaagacctcgggataggccacgtggcggttgagaaccaccaccacgccgctatgctagacgtcgacctgcaccccgcctcagcgtggacactgtatgcagtcgcgaccactatcatcaccccgatgatgcgacacacgatcgagaacaccacggccaacatcagcctgactgccatcgcaaaccaggcggccattctgatgggtttagacaagggctggcccatttccaagatggacatcggcgtgcccctgcttgctctcgggtgttatagccaggtaaacccccttacgctgaccgccgcggtactcatgctagtggcccactatgccatcattggtccgggactccaggccaaagccacccgcgaggcgcagaagcggacagccgcggggataatgaaaaaccccacggtcgacggaatcgtcgccatcgaccttgaccccgtggtctatgacgccaagttcgagaagcagttaggccagataatgctcctcatcctgtgcacctctcagattctgctcatgaggacaacctgggcgctgtgcgagagcataacgctcgccacgggccccctaacaaccttatgggaagggtccccgggcaagttttggaatacgacgatcgccgtgtcaatggcaaacatcttccggggctcctacctggccggcgcgggtctcgctttctcattgatgaaatccctcgggggtgggcgccgagggaccggggcacagggagagaccctaggtgaaaaatggaagcgccaactcaaccagctgagcaagagcgagttcaacacttacaagcggtccgggatcatggaggttgaccgctcggaggccaaagagggcctcaagcgcggggaaacgaccaagcacgcggtctcccgcggtaccgccaagcttcgttggttcgtggagcgaaacctggttaaacccgagggtaaggttatcgatctggggtgcggcagaggcgggtggtcgtactactgcgccgggctcaagaaggtgaccgaggtgaaaggttacacgaagggaggtccaggccatgaggagccaatcccgatggcaacgtacggatggaacctggtcaagctgcactccgggaaggacgttttttttatcccccccgagaagtgcgacaccttattgtgcgatatcggggagagctccccgaatccgactatcgaggagggcagaaccttgcgggtgttaaagatggtggagccctggctgcgtgggaatcagttctgcatcaagatcctaaatccatacatgcccagcgttgttgagacgctcgagcaaatgcagcgtaagcacggcggcatgctggtccgcaaccccctgtctcggaatagcacccacgagatgtactgggtctcctgcggcaccggaaatatcgtgtctgcagtcaatatgacgtcacgcatgctcctgaatcgcttcaccatggcacatcgtaagcccacctacgaacgcgatgtcgacctcggtgccggcactcggcacgtggctgtcgagcccgaggtggccaaccttgacatcatcggacagcgcattgagaacatcaaacatgaacacaaaagcacgtggcattacgatgaggataacccgtataagacctgggcttaccacgggagttacgaagtcaaacctagcggcagcgccagttcgatggtgaatggggtagtaaagctgctgaccaaaccttgggacgttatcccgatggtgacccagatcgctatgacggacacaacccccttcggccagcaacgcgtctttaaggagaaggtggacacacgtaccccgaaggcaaagcgggggacggcccaaatcatggaggtcacagctaagtggctctggggcttcctgtcccgcaacaagaagccacgtatatgcaccagggaggagtttacacgaaaagtccgcagtaatgcggctatcggcgccgtgtttgttgatgaaaaccagtggaactccgccaaggaggctgtcgaggacgaacggttctgggatctcgtgcaccgtgagcgtgagctccacaaacaaggaaagtgcgcaacttgtgtgtacaacatgatgggtaagagggagaagaagctgggggaatttggaaaggccaagggtagcagagccatctggtacatgtggttaggcgcccgctttctcgaattcgaagcactgggctttatgaacgaggaccactggttctctcgggaaaactccctgtccggcgtcgaaggagagggtctgcacaagctgggctacatcctgcgcgatatatcaaagatccccgggggtaacatgtatgccgacgacaccgccggttgggacacgcggatcaccgaggacgacctccagaacgaggcgagaatcaccgacataatggagccggagcacgccctactcgcaaagtccatctttaagctcacgtaccaaaataaggtggtccgcgtacaaaggccagccaagaacggcacagttatggacgttattagcagacgggaccaacgcggctcaggccaggtgggcacgtacggcctgaacactttcacgaacatggaggcccagctgatccggcagatggaatcggaaggcatcttctccccgagtgagctagaaactccgaacctggccgagagagttctggattggcttgaaaagtatggcgtagagcggctgaagcgtatggccatatcgggcgacgactgcgtggtgaagcctatagacgaccgcttcgcgacggctctgaccgcgctcaacgacatgggcaaagttagaaaggacattccccaatgggaaccgtccaaagggtggaacgactggcagcaagtccccttctgctctcaccacttccaccagttaataatgaaggacggcagagagatagtggtcccatgccgtaaccaggatgagctggtgggtcgggcgcgcgtgagccagggggcggggtggtctctcagagagaccgcttgccttggaaagtcctatgcccagatgtggcagctgatgtactttcaccgccgggacttacgcctggcagctaatgcgatttgttccgccgtgccggtcgactggatccctacctcgcggaccacgtggagcatccacgcccaccaccaatggatgaccaccgaggatatgttatcagtgtggaaccgcgtgtggatcgaggagaacccgtggatggaggacaagacccacataagctcatggggcgatgtcccgtatctcgggaagagagaggaccagtggtgcggctctctgatcggtctcaccgccagggccacttgggcgactaacatccaggtggccatcaaccaggtgcgccggctcatcgggaatgagaactacctggattatatgacctccatgaagcggttcaagaacgagagtgaccccgagggagcactttggtga

SEQ ID NO: 24585 - RNA, 9879 nt, synthetic construct
  misc_feature 1..9879: note = derived and/or modified CDS sequence (opt11) from DENV-1__EU482515__SS-prME
  source 1..9879: mol_type = other RNA
agcgtgaccaccctgctgatgctgatgcctaccgccctggccttccacctcaccacacggggcggggagccccatatgatcgtgtcgaagcaggaacggggtaagagcctgctgtttaagaccagcgccggggttaacatgtgcaccctcatagcgatggacctgggcgagttgtgtgaggacacaatgacctacaaatgccccagaatcaccgagaccgaacccgacgacgtggactgctggtgtaacgccacagacacctgggtcacctatgggacttgcagccagaccggcgagcaccggcgcgacaagcggtctgtcgccctcgcgccccacgtgggcctggggctggagacccgcacggagacgtggatgagctcagagggcgcctggaaacagatccagcgcgtcgaaacctgggccctccgccatcccgggttcaccgtgatcgccctgttcctggcacacgcgatcggcaccagcatcacacagaaggggattatcttcatcctcctgatgctggtgaccccctctatggctatgcggtgcgttggcatcggcagccgcgacttcgtggagggtctctccggcgcaacgtgggtggacgtcgtgctggagcacgggagctgcgtgaccactatggcaaaggacaagcccaccctggatattgagctcctgaagaccgaagtaacgaaccccgccgtgctgcgaaagctatgtatagaggcgaagatctccaacacgaccacggattcgagatgccccacccagggcgaggccacgcttgtggaggagcaggacgccaacttcgtctgccgccgcaccttcgtcgacagaggttgggggaatggctgcgggctgttcggcaaagggtccctcatcacgtgcgccaagtttaagtgcgtgaccaagctggaggggaaaattgtccagtacgagaacttgaagtacagtgtgatcgtgacggtacataccggcgatcagcaccaggtggggaacgagagtaccgaacacggcacgaccgccactatcacgccacaggcgcccaccacagagatccagttgactgactacggggcgttaaccctggactgcagcccccgaactgggcttgactttaacgagatggtcctgctgaccatgaaggagaagtcctggctcgtgcacaagcaatggttcctggacctgcccttgccctggacgagtggtgccagcacctcccaggagacctggaaccgtcaggacctgctggtgaccttcaagactgcccacgcgaagaagcaggaggtcgtggtcctcggcagccaggagggggcgatgcatacagccctgaccggggccaccgagatccagactagcggcaccaccacaatctttgccgggcacctgaaatgccgcttaaagatggacaagctgacgctaaagggcatgagctacgtcatgtgcacagggtccttcaagttagagaaggagctggcggagacccagcatggaaccgtactggtgcagatcaagtacgagggcacggacgcgccctgcaagatcccctttagcacccaggacgagaagggggtcacccagaacggccggctgatcaccgccaatccgatcgtgactgacaaggagaagcccgtgaatatcgaggccgagccgcccttcggggagtcatacatcgtcatcggcgccggcgagaaggcgctcaagcttagctggttcaaaaaggggtccagcatcgggaagatgtttgaggctaccgcccgaggggctcgtcgcatggcaatcctgggcgacaccgcctgggacttcgggtccatcggtggcgtcttcaccagtgtgggtaagctcgtccaccagatattcggcacggcctatggggtcctgttttccggcgtgagctggacgatgaaaatcggaatcggggtcctgctcacttggctgggactgaattcccgcagcacgtccctctcaatgacctgtatagccgtggggctggtgaccctgtacctcggcgtcatggtgcaggccgactccgggtgtgtgatcaactggaagggccgggagctgaagtgcgggagcggcatcttcgtcaccaacgaagtgcacacctggacggagcaatacaagtttcaggcggacagtccgaagcgcctgtccgccgccatcggcaaggcctgggaggagggggtgtgcggcatcaggagcgcaacccgactcgagaacatcatgtggaaacaaatctccaatgagctgaaccacatcctgttggagaacgatatgaagttcactgtcgtcgttggggacgtcgcgggcatcctggcgcaaggcaagaagatgatccggccccagccaatggagtacaagtacagctggaaaagctggggcaaggcgaaaatcattggcgcagacgtgcagaacaccaccttcatcatcgacggacccaacacgccggaatgtcccgacgaccagcgagcttggaacatttgggaggtggaggactacggcttcgggatcttcaccaccaacatctggctgaagctgcgggacagctacacgcaggtctgcgaccacaggctgatgtccgctgcgatcaaggacagcaaggccgtgcatgccgatatgggctactggatcgagtccgagaaaaatgagacgtggaagctagcccgggcgagcttcattgaggtgaagacctgcatctggcccaagtcccatacgctctggtctaacggagtcctggaatcagaaatgatcatccccaagatctacgggggccccatgagccagcacaactaccgcccggggtacttcacccagaccgcgggcccgtggcacttgggcaagctagaattggacttcgacctgtgcgagggcacgacagtggtggttgatgaacactgcggcaaccggggaccgtcactccgcaccacgaccgtaaccggcaagatcatccatgagtggtgctgccggagctgcacgctgccgcccctgcgcttccgcggggaggacggctgctggtacgggatggagatccggccagtgaaggagaaggaggaaaacttagttaagagcatggtgagcgccggcagcggcgaagtggactccttctctctgggactgctctgcatctccatcatgatcgaggaggtcatgcggagccgctggtccaagaaaatgctgatgaccggcaccctcgctgttttcttcctcctgatcatggggcagctgacctggaacgacctcatccggctgtgcatcatggtgggcgccaacgcaagcgaccgcatgggtatggggacaacttacctggcactcatggcgacgttcaagatgcggccgatgtttgccgtaggcctgctgttccggcgccttacctcccgggaggtgttactgctgaccatcgggctgagcctggtggcatctgtcgagctccccaacagcctagaggagttgggcgacgggctcgcgatgggcatcatgatcctgaagttactcacagatttccagtcccaccagctgtgggctaccctgctcagcctgacgttcatcaagactacgttcagcctgcactacgcctggaagaccatggccatggtgctcagcatcgtctccctgttccccctgtgcctcagcaccacctcccagaagacgacgtggctgcctgtgctgttgggcagcttgggatgcaagccgctgacaatgttcttgatcgcggaaaacaagatatggggccgccggtcttggcctctaaatgaggggatcatggccgtcggaatcgtcagcatccttctcagctccctgctgaaaaacgacgtgcccctcgccgggcccctgatcgccggcggcatgctgatcgcctgctacgtaatcagcggaagtagcgcggacctgtccctagagaaagccgccgaggtcagctgggaggaggaggccgagcactccggcgcctcacacaacatcctggtggaggtgcaggacgacgggacgatgaagatcaaggacgaggaacgcgacgacaccctcaccatcctgctgaaggcgacccttcttgccgtatccggggtgtacccgttgagcatccccgccaccctcttcgtgtggtacttctggcagaagaagaagcaacggtccggggttctgtgggacacccctagcccgcccgaagtggagcgcgccgtgctggacgatggcatctatcggataatgcagcgggggctgctcggacggtcccaggtaggcgtgggagttttccaggagaacgtcttccacacgatgtggcatgtgacccgaggcgcggtgctcatgtaccaggggaagcggttagagccgagctgggcgtccgtcaaaaaggacctcatcagctacggcggcgggtggcgcctacaagggagttggaataccggggaggaagtccaggtgatagccgtagagcccggcaagaaccctaagaacgtgcagaccgcccccgggacgtttaagactccagagggcgaggtgggcgccatcgcccttgacttcaagccagggaccagcggctcgcccatcgtaaatcgggaggggaagatcgtgggcttatacggcaacggggtcgtcaccacgtccgggacctacgtgagcgcgatcgcacaggccaaggcctcccaggaagggcctctgcccgaaatcgaggacgaggtgttccgcaagcggaacctgaccatcatggacctccaccctggcagcggcaaaacccgcagatacctgccggcgatcgtccgcgaggccatcaagcgtaagctgcgcacgctcattctggccccaacccgcgtggtggcctccgaaatggctgaggcgctgaagggcatgcccatacggtatcagaccaccgccgtcaagagcgagcacacgggcaaggaaatcgtggacttaatgtgccacgccacgttcacgatgcgcctgctttccccggtgcgggtcccgaactacaacatgatcatcatggacgaagcccacttcacagaccccagctccatcgcagcgcgcggatacatcagcacgcgggtggggatgggtgaggccgccgccatcttcatgacagccacgccacctggctccgtggaagcgttcccgcagagcaatgcggtcattcaagacgaggagcgagatatcccagaacgctcctggaacagcggttacgaatggatcaccgacttccccggcaagacggtgtggttcgtgccctcgattaaaagcggcaacgacatcgccaactgcctcagaaagaacgggaagcgggttatacagctctccaggaagaccttcgacaccgagtaccagaagaccaaaaacaatgactgggactacgtggtgacaaccgatatcagcgagatgggcgctaacttccgggcggaccgcgtcattgacccccggcgctgcctgaagcctgtgatcctcaaggacggacccgagcgggtgatcctggccggccccatgccggttaccgtggccagcgccgcccagcgccgggggcgaatcggacggaatcacaacaaagaaggcgaccagtacatatatatggggcagcccctgaacaacgacgaggaccacgcgcactggaccgaggccaagatgctcctcgacaacatcaacacgcccgagggcatcatccccgccctgttcgaaccggagcgcgagaagtccgccgccatcgacggggagtaccgcctccggggcgaggcgcgcaagaccttcgttgagctgatgagacgcggggacctgccggtgtggctttcctacaaggtggcctctgagggcttccagtattccgaccggcgatggtgcttcgatggcgagcgaaacaaccaggtcctggaggagaacatggacgtggagatctggaccaaggagggggaacgcaagaagctgcgcccacgctggctcgacgcacggacgtactcagaccccctggccctgcgtgagttcaaggagtttgccgcgggccggcggagcgtgtccggggaccttatcctggagatcggcaagctcccgcagcacctcacgcagcgggcccagaacgccctggacaacctggtcatgcttcacaactctgagcagggcgggcgggcctaccggcacgcgatggaagagctgccggacaccatcgagaccctgatgctcctggccttaatcgccgtgctcaccgggggggtaaccctattcttcctgagtggccgcgggctcggtaagacgagcatcggactgctgtgcgtcatggcctctagcgtgctactgtggatggcttccgtggagccccactggatcgcggccagcatcatattggagttcttccttatggtcctgctaatccccgagccggaccggcagcgcacaccccaggacaatcagctcgcctacgtggtaatcgggctgttattcatgatcttaactgtcgccgctaacgaaatgggcctgctggagaccacgaagaaggacctcggaattggccatgtagcggtggaaaaccaccaccacgccgccatgcttgatgtcgacctgcaccccgcttccgcgtggaccctctacgcggttgcaaccaccatcatcacgccgatgatgcggcacaccatcgagaacaccaccgccaacatcagccttaccgccatcgccaatcaggcagctatcctgatggggcttgacaaaggttggcccatttccaagatggacatcggcgtgcccctgctggccttagggtgctactcacaggtcaacccgcttactctgaccgccgcggtgctcatgttggtagcccactatgccatcattggcccggggctacaggccaaggccacccgcgaagcgcagaaacgcacggccgcaggaatcatgaagaaccccaccgtcgacgggatcgtggcaatagacctcgacccggtggtctacgacgccaagttcgagaagcaactgggccagatcatgctgctcatactatgcacctcccagatcctcctcatgcggaccacgtgggcgctgtgcgagtcaatcaccctggccaccggtcccctcaccactctgtgggaggggtcccccggtaagttctggaacaccaccatcgcggtgagcatggccaacatttttcgtgggtcctacctagccggcgcggggctggccttctcgctgatgaaatccctcggcggcgggcggcgcgggactggggcccagggagagacgcttggcgagaagtggaagcgccagctgaaccagctttccaagtccgagttcaacacatacaagcgctccgggattatggaggtggaccggagcgaagccaaggaaggcctcaaacgcggggagacgacgaaacatgcggtctcccggggcacggccaaactccgctggttcgtcgagcggaaccttgtgaagcccgaggggaaggtcatcgacctcggctgcggcagggggggctggagctactactgtgcggggctcaagaaggtgaccgaggtgaagggctacactaaaggcggccccgggcacgaggagcccattccaatggccacctacgggtggaacctggtcaagctgcactcaggaaaggacgtattttttatcccacccgaaaagtgcgacacgttgttgtgcgatatcggggagtcctcgcccaacccgaccatcgaggagggccggaccctgcgggtgctcaagatggttgagccctggctgcgggggaaccaattctgcatcaagatcttaaacccctacatgccgagcgtggttgaaacgctcgagcagatgcagcggaagcacggcggcatgctggtacggaaccctttatcccgcaacagcacccatgagatgtactgggtgtcctgcgggacgggcaacatcgtaagcgcagtgaacatgacctcccggatgctcctgaaccgcttcacgatggcgcaccgcaagcccacttacgaacgcgacgtggacctcggggccggcacgcgccacgtggccgtcgaaccagaggtggctaatcttgacataatcggccagcggatcgagaacatcaagcatgagcacaagagcacatggcactatgatgaggataacccctacaaaacctgggcctaccacgggtcctacgaggtgaaaccgagcggcagtgccagcagcatggtcaacggggtggtcaaactcctgactaagccctgggatgttatccccatggtgacacagatagccatgacagacaccaccccctttggccagcagcgcgtcttcaaagagaaggtggacacgcggacccccaaggctaagcgcgggaccgcacagatcatggaggtaaccgccaagtggctctggggcttcctttcccggaacaagaagccccgcatctgcacgcgggaggagttcacacgcaaggtccggagcaacgcggccattggcgccgtgttcgtggatgagaaccagtggaattcagccaaggaagcggtcgaggacgagcggttctgggacctggtgcaccgggagcgggagctccacaagcaggggaaatgcgcgacctgcgtgtacaacatgatgggcaagcgggagaaaaagttaggagagttcggcaaggccaaggggagccgcgccatttggtacatgtggctgggcgcccggttcttagagttcgaagcgttaggctttatgaatgaggatcactggttctccagggagaacagcctgagcggggtcgagggcgaggggctccacaagctgggctacatcctgcgggacatcagcaagatccccgggggcaacatgtatgcagatgataccgccggctgggacacacgcatcaccgaagatgacctccagaatgaggcccggatcaccgacatcatggagcctgagcatgccctgctggctaagtccatattcaagctcacctaccagaacaaagtggtgcgcgtccagcgccccgcgaagaacgggacggtgatggacgtgatcagccggcgcgaccaacggggcagtgggcaagtcggcacatacggccttaacaccttcaccaacatggaagcacagctgatccgtcaaatggagagcgaagggatattctcccccagcgagctagagacgcccaacctggcgaagcgggtgttagactggctcgaaaagtatggcgtggagaggctgaagcggatggcgatctccggggacgactgcgtcgtgaaaccgatcgacgaccggttcgcgaccgcccttacggctctcaacgacatgggtaaggtgcgaaaggacatcccccagtgggaacccagcaaggggtggaacgactggcaacaggtccccttctgctcccaccacttccaccagctaatcatgaaggacggccgcgagatcgtggtgccgtgccggaaccaggacgagctggtcggtagggcccgcgtgagccagggtgccggctggtccctccgcgagaccgcgtgcctggggaagtcctacgcacagatgtggcagctgatgtactttcaccggcgcgatctaaggctggccgccaacgccatctgcagcgccgtgcccgtcgactggatccccacgtcccgcaccacttggtcgatccacgcacaccatcaatggatgaccacggaggacatgctctccgtctggaaccgggtctggatcgaagaaaatccgtggatggaggacaagacccatatctcgtcctggggcgatgtcccgtatttagggaagcgcgaggaccaatggtgcggcagtctgatcggcctgaccgcccgcgcgacctgggcgacaaacatccaggtggccatcaaccaggtgcggcgcctcatcgggaacgaaaactacttggactatatgacgtccatgaaacgtttcaagaacgagagcgaccccgaaggagcgctgtggtga

SEQ ID NO: 24586 - RNA, 9879 nt, synthetic construct
  misc_feature 1..9879: note = derived and/or modified CDS sequence (opt11) from DENV-1__EU482516__SS-prME
  source 1..9879: mol_type = other RNA
agcgttaccatgctgctcatgttgatgcccaccgccctcgccttccacctcaccacccgtggcggggagccccacatgatcgtgagcaagcaggagcgtggtaagtccctgctgtttaagaccagcgcgggagtgaacatgtgcaccctcatcgccatggacctcggcgagctgtgcgaagacaccatgacctataagtgtccccggatcaccgagactgagccagacgacgtggattgctggtgtaatgcgacggacacatgggttacttacgggacctgcagccagacgggcgagcacaggagggacaaacggagcgtggccttggccccccacgtgggactgggactggagacccgaaccgagacgtggatgagctcagagggcgcctggaagcagatccagcgggtggaaacgtgggcactccgtcaccccgggtttaccgtaatcgccctgttcctggcccatgcaatcgggaccagcatcactcagaagggtatcatcttcatcctgctcatgttagtgacccccagtatggccatgcgctgcgtcggcatcggtagccgtgacttcgtggagggcctctcgggcgcaacgtgggtggacgtcgtgctggagcacggtagctgtgtcaccactatggccaaggacaagcccaccttggacatcgaactcctaaaaaccgaggtcacaaacccggccgtgttgcgaaagctctgcatagaggccaagatttcgaataccacgaccgactctcgctgcccaactcagggcgaggccaccctggtggaggagcaggatgccaacttcgtgtgtagacgtacgttcgtggatcggggctggggcaacggatgtggactgtttggcaaggggtccctaatcacatgtgccaagttcaagtgcgtaaccaagctagaaggcaagatcgtccagtatgaaaacctgaagtactcagtgatcgtcaccgtccacacgggagaccagcaccaggtgggcaacgagtccactgagcacgggaccaccgccaccattacgccccaggctcccactaccgagatccagcttacggattatggcgccttaacgctggactgcagccctcgcacaggcctcgatttcaacgagatggtactgctgaccatgaaggaaaagagctggctcgtgcacaaacagtggttccttgacctgcccctcccttggacctccggggccagcacttcccaggagacgtggaacaggcaggatctgctggtgacattcaaaaccgcccacgccaagaaacaagaggtcgtggtccttggtagccaggaaggggcgatgcatacggcactgaccggggctacggagatacagacatccggcacgacaaccatcttcgcagggcacctaaagtgcagactcaaaatggacaagctcacgctgaaaggcatgagctacgtcatgtgcacagggtccttcaagctcgagaaggaagtggccgagactcaacatggcacggtgctggtccagattaagtatgagggcaccgacgcgccctgcaagatccccttcagcactcaggacgagaagggggtgacgcagaatggccggctgattacggccaacccgatcgtgacggacaaggagaagccggttaacatcgaagccgaaccgccgttcggggagtcgtacatcgtcataggtgccggcgagaaggccctgaagctaagctggttcaagaaaggttcctccattggcaagatgtttgaggccaccgcccggggggcccgacggatggccatacttggggacactgcgtgggatttcgggtctatcgggggcgtgtttacaagcgtcgggaagctggtacaccagatctttggcacggcctacggggtcctcttttccggcgtctcatggacgatgaagatcggcatcggagtgctgctcacctggctaggcctgaactctcgcagcacctccctttctatgacctgtatcgccgtggggctcgtaacgctgtacctaggggtgatggtgcaggcggactccggatgcgtaatcaactggaaaggccgtgagctcaagtgcgggagtggcatattcgtgactaatgaagtgcacacatggacggagcagtacaagttccaggcggattcaccgaagagactgtctgcggccatcggcaaagcctgggaagagggggtctgcggtatccggagcgctacccgcctcgagaacatcatgtggaagcaaatctccaatgaacttaatcatatcctgctggagaacgacatgaagttcacggtcgttgtcggtgatgttgccggcatcctagcacaggggaagaagatgatccggccccagcctatggagtacaagtacagctggaagtcgtgggggaaggccaaaatcattggcgctgacgtacagaacaccacctttataatcgacgggcccaacaccccggagtgcccggacgatcaacgcgcctggaacatctgggaggtggaagactatggcttcggaatcttcacgaccaacatctggctcaagctgcgggacagctacacccaggtgtgtgatcaccgcctaatgtccgctgccattaaggacagcaaagccgtgcacgcggacatgggctactggatcgagtccgagaagaacgagacgtggaagcttgccagagcatcattcatagaggtcaagacctgtatttggcctaagtcccacacgctctggtcgaacggcgtgctcgagtccgaaatgatcatacccaagatttacgggggcccgattagccaacataactataggccagggtactttacccagaccgccggcccctggcacctcgggaagctggagctcgatttcgacctgtgcgaaggcacgacagtggtcgtagacgagcactgcgggaaccgtgggccgtccctacgcaccaccacggtcaccggcaagatcatccatgaatggtgctgccggagttgcaccctgccgcccctcagattccgcggtgaggacggctgctggtacgggatggagatccgacccgtcaaagagaaggaggagaacttggtaaagtccatggtgagcgcgggcagcggcgaggtcgactccttcagcttagggctgctgtgcatctcaatcatgattgaagaagtgatgcggagccgctggtcccggaagatgctcatgaccggcaccctggctgtgttctttctgctcattatgggccagctgacatggaatgatttgatccgcctctgcattatggtcggcgcgaacgcaagcgaccgcatggggatgggcacaacctatctggctctgatggccacgttcaagatgagaccgatgttcgcggtggggctcctgttccgcagactgacctctcgcgaggtactcctactgaccatcgggctcagcctggtcgcctccgtggaactgcccaatagcctagaggagctgggcgacgggctagcgatgggaattatgatcctcaagctcctgaccgatttccagtctcaccaactatgggccacgttactgagccttaccttcatcaagaccacactgagtctgcactacgcctggaaaacaatggccatggtcctcagcatcgtgtccctgttcccactgtgcttatcaaccacctctcagaagaccacgtggctgcccgtgttactaggctcactgggttgcaagcccctaaccatgttcctgatcgcggagaacaagatctgggggcggcgctcctggcccctgaacgaggggatcatggccgtaggcatcgtgtccatcctgctgagctcactgctaaagaatgacgtacccctagcagggccgctgattgcaggcggcatgctgatcgcctgttacgtcatcagcggttccagcgcggacctttccttagagaaagccgccgaggtgagctgggaagaggaggccgagcattcgggcgccagccataatatcctggtggaggtccaggacgacgggaccatgaagatcaaggacgaggagcgggatgataccctgaccattctcctgaaggcgacgctcctggcagtatccggcgtctatcctctgtcgatccccgcgactctttttgtctggtacttctggcagaagaagaagcagcgctccggtgtcctgtgggacaccccctcaccccccgaggtgggtcgggctgtcctggacgacggcatataccgcataatgcagcgtgggctactcggacgcagccaggtgggggtaggcgtattccaggagaacgtgttccataccatgtggcacgttacgaggggagccgtcctgatgtaccagggcaagcgactggagccttcctgggcgtccgttaagaaggacctcatcagctacggcggtggatggcggctgcaagggagttggaacaccggggaggaggtgcaggtcattgccgtcgagcccgggaagaaccccaaaaacgtgcaaacggcccccggcaccttcaagacgcccgagggtgaggttggggcgatcgcattggactttaagcccgggaccagcggctcccccatcgttaacagagagggcaagatcgttgggctgtacgggaacggcgttgtcacgaccagcggcacgtacgtctcggcgatcgcccaagccaaggcctcccaagaaggcccgctgccggagattgaggacgaggtcttccggaagcgcaacctgaccatcatggatctgcatcccgggagtggtaagacgcggcgctatctgccggcgatcgtacgggaggcaattaagcgcaagctgcgtactctaattttggcacctacccgggtggtagcttcagagatggcggaggccctgaagggcatgccgatacgctaccagaccacagctgttaagtccgaacacaccggtaaggagatcgtggatctgatgtgtcacgcaacgttcaccatgagacttctgtcccccgtccgcgtaccgaactacaatatgatcatcatggacgaggcccatttcactgacccgagctccatcgctgcgagaggttacataagcactcgggtggggatgggcgaggccgccgccatcttcatgactgccaccccgcccgggtccgtcgaggcattcccgcagagcaacgccgttattcaagatgaagagcgggacatccccgagcgctcctggaacagcggctacgagtggatcaccgactttcccggtaagaccgtgtggttcgtccccagcatcaagtcaggaaacgacatcgccaactgcctccggaaaaacgggaaacgcgtgatccagttgtcccggaagacgttcgacaccgagtaccagaagaccaagaataacgattgggactacgtggtcaccacagatatcagcgagatgggggcaaacttccgggccgaccgggtaatagacccgcgtcgatgcctgaagcccgttatactcaaagacggcccggagcgagtcatcctggccgggccgatgccggtgaccgtcgcgtccgcagcccagcggcgcggccggatcggccgaaatcacaacaaagagggggaccagtatatctatatgggtcagcccctaaacaacgacgaggaccacgctcactggaccgaagctaagatgctgttggacaacatcaacacccccgagggcatcatcccggcgctattcgaaccggagcgagaaaagagtgccgcgatcgatggcgaatacagactgaggggcgaagcgagaaagacttttgtggagcttatgagacgaggcgacctgcccgtatggctctcctacaaggtagcgagcgaaggtttccagtacagcgaccgccggtggtgcttcgacggggaacgcaacaaccaggtattagaagagaatatggacgtagagatctggaccaaggagggcgagcgtaagaaattacgccccaggtggttagatgctcggacctactccgaccccttggccctacgggagttcaaagagttcgctgcggggaggcggagtgtctccggcgatttaatccttgagatcggtaagctgccacagcacctcactcagcgagcccagaacgcactggacaacttggtgatgctccacaatagcgagcagggcggacgggcctataggcacgcgatggaggaactgcccgatacgatcgagaccctgatgctgctggccttaatcgccgtgctcacagggggagtgaccttgtttttcctgtccgggcgaggccttggtaagacctcgatcgggcttctttgcgtgatggcgagttcagtactcctgtggatggctagtgtcgagccgcactggatagcagccagcatcattctcgagttttttctaatggtcttactgattcccgaaccggaccgccaaaggacgccgcaggacaaccagctcgcctacgtggttattggactgcttttcatgatcctcaccgtggcggccaacgagatgggcctgctagaaaccaccaagaaggatctcggcatcgggcacgtggcggtcgagaatcaccaccacgccgccatgctagatgtggacctgcacccagcctccgcttggacgttatacgcggtagccaccacgattatcaccccgatgatgagacatacaatcgagaatactaccgctaacatctcgctgaccgctatcgcgaaccaggcggctatcctgatgggcttggataagggatggccgatctcgaagatggatatcggggtccccctgctggcgctcggctgctacagccaagtgaaccccctgacgctgaccgcggcggtgctcatgctggtcgctcactacgccattatcgggccgggtttacaggctaaggcgacccgcgaggcccagaaacggaccgccgccgggatcatgaaaaatcccacagtggatggtattgttgccattgacctggatcccgtcgtatacgacgccaagttcgagaagcaactgggccagatcatgctgctaatcctgtgcacctcccagatcctgctgatgcgcaccacctgggcgctctgcgagagcataacgcttgccaccgggccattaactaccctgtgggagggctcgccgggcaagttctggaacacgacaatcgccgtgtcgatggccaacatctttcggggctcctacctggccggtgcggggctcgccttcagcctaatgaagtctttaggcggaggcagacgtggcacaggtgctcaaggcgagaccctcggtgagaagtggaaaaggcaactgaaccaactctccaagagcgagtttaacacgtacaagcggtccggcatcatggaagtcgaccgctcggaggccaaggaggggctaaagcggggcgagaccaccaagcacgctgtgtcccgcggaaccgccaagctgcgatggttcgtggagcggaacctggtgaagcctgagggcaaggtaatcgacctgggctgtgggcgcggcgggtggagctactactgtgccggcctcaaaaaggtaacggaagtcaaggggtacaccaagggcgggcctgggcatgaggaacccatcccgatggccacgtacggctggaacctggtgaaactgcattcagggaaggacgtgtttttcatcccgcccgagaagtgcgatacgctcctgtgcgacatcggggagagctccccaaacccgacgatcgaggaggggaggaccctgcgcgtcctcaagatggtggagccctggctgaggggaaaccagttctgcataaagatcctgaacccctacatgcccagcgtagtcgaaacccttgaacaaatgcagcggaaacacggcgggatgctggtgcgcaaccccctttcgcggaattctacacacgagatgtactgggtgtcctgtggaaccgggaacatagtcagcgccgtgaacatgacatcgcgcatgctgctgaacagatttaccatggcgcaccggaagcccacgtacgagcgcgacgtagaccttggcgcaggaacccgccacgtcgcggtcgagcccgaagtggcgaaccttgacatcataggacagcgcatcgaaaatatcaagcacgagcacaagagcacctggcactacgacgaggacaacccttacaaaacttgggcttaccatggttcatatgaggttaagccgagcgggtctgcgagcagcatggtgaacggagtcgttaagttactgaccaagccctgggatgtgatcccaatggtcactcagatcgctatgacggacaccacacctttcggtcagcagcgggtgttcaaggagaaagtggatacccgcacaccgaaggctaaacgggggaccgcccagatcatggaggtcaccgccaagtggttatggggcttcctgtctcgcaataagaagccacggatctgcacacgcgaggaattcacgcggaaggttcgcagcaacgcggcgatcggcgccgtgttcgtcgacgagaatcagtggaatagcgccaaagaagcggtcgaggacgagcggttttgggatttggtgcatcgcgagagagaactccacaagcaaggcaagtgcgcgacctgcgtctacaatatgatggggaagcgcgaaaagaagttaggtgagttcgggaaggcaaaaggcagccgggcgatctggtacatgtggctcggggcccgctttttagaatttgaggcgctggggttcatgaacgaggaccactggttctcccgggagaacagtctgtccggcgtggagggagagggactccacaagcttgggtatatcctgcgcgatatcagcaacatccccggcggcaacatgtacgccgatgacaccgccggttgggacacacgtatcacggaggacgacctccaaaacgaggccagaataaccgacatcatggagccggaacacgctctcctggcgaaaagcattttcaagctaacctatcagaacaaggtggtccgcgtgcagcggcccgcaaaaaacggcaccgtgatggacgtgatcagccgccgggaccagcgaggttccggtcaggttggtacgtacggactgaacaccttcaccaacatggaagcccaattgattcggcagatggaaagcgaaggcatcttctcccccagcgagctggagacccccaacctggccgaaagggtgctggattggctcgagaagtatggggtcgagcggctgaagcgcatggcgatctcgggcgacgattgcgtcgtgaagccgatagacgaccggttcgcgacagccctgacagccctcaacgacatggggaaggtccgcaaggacatcccgcagtgggaaccctcaaaaggctggaacgattggcagcaggtccctttctgttcccaccatttccaccagctgatcatgaaggacggccgggaaatagtggtcccctgccgcaaccaggacgaactggtggggcgggcacgcgtttctcagggagccgggtggagcctccgggaaacggcgtgcctgggtaaatcctacgcccagatgtggcagctgatgtactttcaccgtcgggacctcaggctggccgctaacgccatctgctcagccgtccccgtggattggatacccacctcccggacgacctggagcatacacgcccatcaccagtggatgaccaccgaggacatgctgtcggtgtggaatagagtatggatcgaggaaaacccctggatggaggacaagacgcacatcagctcctggggcgacgtaccgtatttaggcaaacgcgaggaccagtggtgcggcagcctgataggtctgaccgctcgggctacgtgggccaccaatattcaggtggcgatcaaccaggtccgccggctaattggaaacgagaattacctagactatatgacctccatgaagcgcttcaaaaacgagagcgaccctgaaggggccctttggtga

SEQ ID NO: 24587 - RNA, 9879 nt, synthetic construct
  misc_feature 1..9879: note = derived and/or modified CDS sequence (opt11) from DENV-1__EU482517__SS-prME
  source 1..9879: mol_type = other RNA
tcggtgaccatgctgctgatgctgatgcccaccgccttggcctttcacttaaccacacggggcggggagccccacatgatcgtgagcaagcaggagcggggcaagtctctgctgttcaagactagcgccggggtgaacatgtgtacactcatagccatggacctgggcgaactgtgcgaggacaccatgacctacaagtgcccccggataacggagacagagcctgacgacgtggactgctggtgtaacgccacggatacttgggtgacctacggtacctgcagccagacgggcgagcatagacgggacaagcggtctgtggcgctcgcgccccacgtaggcttagggctggagacccggaccgagacgtggatgagttccgagggcgcatggaagcagatccagcgtgtcgagacctgggcgctgcggcaccccgggtttaccgtgatcgccctgttcctcgcgcacgcgatcggcaccagcattactcagaaggggatcatcttcatattacttatgctcgtgacaccctcaatggccatgcggtgcgtcggcatcggcagccgcgacttcgtggaggggcttagtggcgccacctgggtggacgtcgtgctggagcacgggagctgcgtgaccaccatggccaaggataagccaacgctggacatagagctcctcaagaccgaggtcactaatccggcagtgctgcgaaagctctgcatcgaggcgaagatctccaacaccactacagacagccgctgccccacccagggagaggcaaccctggtggaggaacaggacgcgaacttcgtctgccggcgcacgttcgttgatcgtgggtggggtaacggctgcgggctgttcggcaagggatccctcatcacttgcgccaagttcaaatgcgtgaccaagctggagggcaagattgtccagtacgaaaacctgaaatactcggtgatagtgacggtacatacgggcgaccagcaccaggtggggaacgagagcaccgagcacgggaccaccgccaccatcacgccacaggcgcccacgaccgagatccagttaacagactacggagcgctcacacttgactgctcaccgcgcaccggcttggacttcaatgagatggtcctgctgaccatgaaagagaaatcttggttagtgcacaagcaatggtttctggacctgccgctcccttggaccagcggcgccagtacgtcccaggagacctggaaccgccaggacctgttagtgaccttcaacaccgcacatgccaaaaagcaggaagtcgtggtgttgggcagccaggaaggcgccatgcacacagccttaactggggccaccgagatacagacatccggcacgaccacgattttcgccggacacctgaagtgccgcctcaagatggacaagctgaccctgaagggcatgagctacgtcatgtgcacgggatccttcaaactcgagaaagagctggccgagacacagcacggcaccgtgcttgtgcagataaagtacgagggaaccgacgcaccttgcaagattcccttcagcacgcaagacgagaagggggtaacgcaaaacggccggctgatcaccgcgaacccgatcgtgacggataaggagaagcctgtgaacatcgaggctgagccgcccttcggagagagctacatcgtgatcggtgcgggcgagaaggccctcaagttaagctggttcaagaaggggtcctctatcggcaagatgtttgaggccaccgcccgcggtgcccgccgcatggccatattgggcgacaccgcgtgggacttcggtagcatcggcggcgtgttcactagcgtggggaagttggtccaccagatcttcggtacagcttacggagtactgttctcaggcgtgtcatggacgatgaagatcggcatcggcgtcctgttaacctggctgggactgaactcccgcagcacctccctcagcatgacctgcatcgcagtggggctggtgacgctgtacctcggtgtcatggtgcaggccgactccgggtgtgtgataaactggaaaggccgggagcttaagtgcgggagcggcatcttcgttactaatgaggtgcacacctggaccgagcagtacaagttccaggccgacagcccgaagcgactgtccgcggccattggcaaggcctgggaggagggcgtgtgcggcatccggagtgccacccgcctcgagaacatcatgtggaaacagatctccaacgagctgaatcacatcctgttagagaatgacatgaagtttacggtcgtggtgggagatgtagccggcatcttagcgcaagggaagaagatgatccggccccagcccatggagcacaagtatagctggaagagctggggaaaggccaagatcataggcgctgacgtgcagaacaccacattcatcatcgacgggcccaacacccccgagtgccccgacgaccagcgcgcttggaacatctgggaggtggaggactacggcttcgggattttcacgaccaacatatggctgaagttgcgggacagttacacacaggtctgcgatcaccgcctaatgtccgcggccattaaggactctaaggccgtgcacgccgacatgggctactggatcgagtccgagaaaaacgagacctggaagctggcccgtgcttctttcatagaggtgaaaacgtgcatctggcccaagtcccacactctttggagcaacggcgttctggagtcagaaatgatcatccccaaaatctacgggggcccgatcagtcagcacaactaccgccccggttacttcacccagacggccggcccctggcacctggggaagcttgagctagacttcgatctgtgtgagggcacaacggtggtggtcgacgagcattgcggcaaccgtgggccgagcctccggaccaccacagtgaccggcaagatcatccacgagtggtgctgtcgcagctgcacgctgcctcccctgcgtttccgcggggaggacggctgctggtacggaatggaaatacgccctgtgaaggagaaggaggaaaatctcgtcaagtccatggtatctgccggctcaggggaggtggactcgttcagtctgggactgctctgtatctccatcatgatcgaggaagtcatgcgtagccggtggagccggaagatgctgatgaccggcacgcttgccgttttcttcctcctcataatggggcagctgacctggaacgatctgatccgcctgtgcatcatggtgggcgcaaatgcgagcgaccgcatggggatgggcaccacatacctggcactcatggccacgttcaagatgcggccgatgttcgcagtcggcctgctgttccgccggttaacctcccgcgaagtgctgctattgaccatcgggctgagcctggtggcctccgtcgagctacccaatagccttgaggagcttggcgacggactcgcgatgggcatcatgattctgaagttgttgaccgactttcagtcccaccagctgtgggccacgctgctcagcctgacattcataaagaccaccttctccctgcactacgcctggaagacgatggccatggtgttaagcatcgtctccctgttccccctgtgcctcagcaccacctcacagaaaaccacgtggctgcccgtattgctgggctctctggggtgcaagccgctgaccatgttcctcattgcggaaaacaaaatctggggccggcgctcatggcccctgaatgaggggatcatggccgtgggaatcgtatcaatactgctcagtagtctgctgaagaacgacgtgcccctcgccgggcccctgatcgccggcgggatgctgatagcttgctacgtgatctcggggtccagcgcagacctaagtctggagaaggccgccgaggtcagctgggaggaggaggccgaacactctggcgccagtcacaacatcctggtggaggtacaggacgacgggaccatgaaaatcaaggacgaggaaagagacgacaccctcactatcctgctgaaggcgacgctcctggccgtctcgggcgtatatccactgagcatccccgctaccctcttcgtgtggtacttctggcagaagaaaaagcagcgctccggggtcctgtgggacacacccagccctccagaggtggagcgcgcagtgctggatgacggaatatacagaataatgcaaagaggcctgctcgggcgctcccaagtgggcgtgggggtgtttcaggagaacgtctttcacacgatgtggcacgtgactcggggcgccgtactgatgtaccaggggaagcgcctggagcctagctgggcgtccgttaagaaggacctcatcagctacggcggcgggtggcggctgcagggctcctggaacaccggggaggaggtacaagtgatcgccgtcgagcccggcaagaaccccaagaacgtgcagaccgcccccggtaccttcaaaacgcccgagggagaggtgggggctatcgcgttagacttcaagccggggaccagcggctcccccatcgtcaatcgcgagggtaagatcgtgggcctttacggcaacggggtggtgaccaccagcggcacgtacgtgtcagcgatcgcccaggcaaaggcctcccaggagggccccctgcccgagatcgaggacgaggtgtttagaaagcgaaacctgacgatcatggacctccaccccggcagcgggaaaacacggcgctatctgccggcgatcgtccgggaggcgatcaaacggaagctgcgcaccctgatcctggccccgacgcgagtagtagcatccgaaatggcagaggcgctgaaggggatgcccatccgctaccaaaccactgccgtcaagagcgagcacaccggcaaggagatcgtggacctcatgtgccacgccactttcaccatgcggctgctgagccccgtccgggtccctaactacaacatgatcatcatggacgaggcccactttaccgaccccagctccattgccgcacgcggatacataagcacccgcgtgggcatgggggaagcagccgccatcttcatgacagccacgccacccggctccgcggaggccttcccgcagagcaacgccgtgatccaggacgaggagcgcgatatcccagagcgctcctggaacagcgggtacgaatggatcacagactttccgggcaagaccgtctggttcgtgccctccatcaagagcggcaacgacatcgccaactgcctccggaagaacgggaagcgcgtgatccaattatcccggaaaacgttcgacaccgaataccagaagactaagaacaacgactgggactacgtagttaccacggatatcagcgagatgggtgcgaacttccgggccgaccgggtcatcgacccgcgccggtgtctgaagcccgtaattttgaaagacgggcccgagcgggtgatcctggccggacccatgccggtgaccgttgcctccgccgcccagcgccgggggcggatcggccgcaaccacaacaaggaaggagaccaatacatctacatggggcagcccctgaataacgatgaggaccacgcccactggaccgaggcaaagatgctgctggacaacatcaatacccccgagggcatcatccccgccctgttcgaaccggagcgcgaaaagtccgccgcgattgacggtgagtaccgcctccgcggcgaggccaggaaaacgttcgtggagctgatgcgccgcggggacctgcccgtctggctctcctacaaggtggccagcgaaggcttccagtacagcgaccgccggtggtgctttgatggcgagcgcaataatcaggtgctggaggagaatatggacgtagagatctggaccaaagagggagaaaggaaaaagctgcgcccccggtggctcgacgcccgcacatacagtgatccgctggccctgcgcgagttcaaggagttcgcggccggcaggcggagtgtgtccggggacctcatcctggagatcggcaagctgccgcagcacctcacccagagggcgcagaatgccctggacaacctagtgatgctccacaactcagagcagggcgggagagcgtaccgtcatgccatggaggagctgcctgatacgatcgagacgctcatgttgctggccctgatagccgtcctcaccggcggggtgaccctgtttttcctgtcgggccggggccttggcaagacgagcatcggccttctatgcgtaatggcctccagcgtcctcctatggatggcctccgtcgagccgcattggatcgccgccagcatcatcctggagttcttcctgatggtgctgctaattcctgagccggaccgccagcggacgccgcaggataatcaactcgcctacgtggtgatcgggctgctattcatgatactcaccgtggccgcgaatgaaatgggactcctggagaccaccaagaaggatctcgggataggccacgtggccgtcgaaaaccaccaccacgcagctatgctagacgtggacctgcaccccgcatccgcgtggacgctctacgccgtggccaccaccatcatcaccccgatgatgcgacacacgatcgagaacaccaccgctaacatcagcctgacggccattgcgaaccaggccgccatcttgatggggctagacaagggctggcccatctcgaagatggacataggcgtacccctgctggccctcgggtgctacagccaagtgaaccctctgacgctcacggcggccgtcctcatgttagtggcccactacgcgatcatcggcccggggctgcaagccaaagcgacccgggaggcccagaagcggaccgcagctggcattatgaaaaaccccacggtggacggtattgtagctattgacctcgaccccgtggtttacgatgcgaagttcgagaagcagctgggccaaatcatgttactcatattgtgcacctcccagatcttgctcatgcgcaccacatgggccctgtgcgagagcatcacgctggctacgggcccactcaccaccctgtgggaggggtccccgggcaagttctggaacacaaccatcgccgtaagcatggccaatatctttcgggggtcctacttagcgggcgccggactagccttcagcctgatgaagagcctcggaggcgggcgcagaggcaccggggcccagggcgaaaccctcggcgagaagtggaaacgccagttgaaccagctgtccaagtcggaattcaacacgtataagcggagtgggatcatggaagtggacagatccgaagcgaaggagggcctcaagcgcggtgagaccaccaagcacgcggtgtcccgcggcaccgccaagttacggtggttcgtcgaacggaacttagtgaagcccgaagggaaggtcatcgacctgggctgcggtcgcgggggctggagctactattgcgccgggctaaagaaggtcacggaagtgaagggctatacgaagggtggccccggtcatgaagagcccatcccaatggccacctacgggtggaacctggttaaactgcactccggcaaagacgtcttcttcattccgccagagaagtgcgataccctcctgtgcgacatcggagaaagctcacccaacccgacgattgaggagggccgcactctgcgggtgctcaagatggtggagccatggctcagggggaaccagttctgcattaagatactgaacccatacatgcccagcgtggtggagaccctcgaacagatgcaacggaaacatggcggcatgctggtacgcaacccgctgtccaggaattcgacccacgagatgtactgggtctcctgcgggaccggcaacatcgtgagcgcggtgaacatgacttcccgcatgctcctaaatcgatttaccatggctcaccggaagccaacatacgagcgcgacgtcgacttgggggccggtaccagacacgtggccgtagagccagaggtagccaacctcgacataatcggccaacggattgagaacatcaagcacgagcacaagagcacatggcactacgacgaagacaacccctataagacctgggcgtaccatgggtcctacgaagtaaagccgtcagggagtgcctcctccatggtgaacggggtcgtgaagctgcttaccaagccttgggacgttatccccatggtgactcagatcgcgatgacggacaccactcccttcggccagcagagggtgttcaaggagaaggtcgacacacgcacgcccaaggcaaagcgggggaccgcccagatcatggaggtaaccgcgaagtggctctggggcttcctcagccgcaataagaagccccggatttgcacccgcgaagaatttacacgcaaggtgagaagcaacgccgccatcggcgctgtttttgtggacgagaatcaatggaatagtgcgaaggaggcggtggaggatgagcggttctgggatttagtgcacagagagcgggagctccataagcaggggaaatgcgcgacctgcgtgtacaacatgatgggcaagagagagaagaagctgggggagtttggcaaagcgaaggggagtcgggccatatggtacatgtggctgggcgcgagattcctcgagttcgaagccctggggttcatgaacgaggaccactggttctcccgggagaacagcctgtccggagtcgagggtgaagggctccacaagctgggctacatcctgcgcgacatcagtaagatccccgggggtaatatgtatgccgatgataccgccggctgggacacccggatcaccgaggacgatctccagaacgaggcccggatcacggacataatggagccggaacacgcgctcctggccaagtcgatcttcaagctaacatatcagaacaaggtggttcgtgtgcagcggccagccaagaacggcaccgtaatggacgtaatctcgcgccgggaccagcgcggctccggacaggtgggaacctacggcctgaataccttcactaacatggaggcgcagctgatacggcagatggatagcgagggcatctttagcccgagcgagctcgaaaccccgaatctggccgagcgggtcctggactggctagagaagtacggagtcgaacggcttaagcgcatggccatctccggtgacgactgcgtagtcaaaccgatcgacgaccgctttgccacggccctcaccgccttgaacgacatgggcaaggtgcgcaaagacatcccccagtgggaacccagcaaagggtggaacgattggcagcaggtccccttctgctcccaccatttccaccagctgatcatgaaggatggccgggagatcgtcgtgccttgccgcaaccaggacgagctggtgggccgagcccgggtcagccagggagcgggctggagcctccgggagacggcctgccttggcaagtcctatgcccagatgtggcagctaatgtacttccatcgccgggacctacgcctggccgcgaatgcaatatgcagtgccgtgcccgttgactggatacccacctcccggactacctggagtatccacgcccaccaccagtggatgaccaccgaggacatgttatctgtttggaatcgcgtgtggatcgaggagaacccctggatggaggacaagacgcatatcagctcctggggcgacgtgccgtacctcgggaagcgcgaggaccagtggtgcggcagcctgataggcctgaccgcccgggccacctgggccaccaacatccaggtcgccatcaatcaggtccgtcgactcatagggaacgagaactacctggattacatgacctctatgaagcgattcaagaacgagagcgacccagagggggccctgtggtga

SEQ ID NO: 24588 - RNA, 9879 nt, synthetic construct
  misc_feature 1..9879: note = derived and/or modified CDS sequence (opt11) from DENV-1__EU482519__SS-prME
  source 1..9879: mol_type = other RNA
tcggtcaccatgctgctcatgctaatgcccaccgccctggccttccaccttaccaccaggggtggggagccccacatgatcgtaaccaagcaggagagaggcaaaagcctgctgttcaagaccagcgcgggggtgaacatgtgcaccctcatcgccatggacttaggggagctgtgcgaagacactatgacctacaagtgcccacggataaccgaggctgagcccgacgatgtggactgctggtgcaatgccaccgacacctgggtgacctacggtacctgcagccagacgggggagcaccggcgcgacaaacggtccgttgcgctcgcaccacacgtgggtctcgggctggagacccgcacggagacctggatgtcctcggagggcgcctggaaacaaatccagcgggtcgagacgtgggctttgcgccacccggggttcaccgtgatggccctcttcctggcccatgctatcggcacgagcatcacccagaaggggattatcttcatactcctgatgttagtgacgcccagcatggccatgcggtgcgtcggcatcggctcccgcgacttcgtggaagggctgagcggcgcaacctgggtggacgtcgtcctggagcacggttcctgcgtgactactatggccaaggacaaacccacgctcgacatcgagctcctgaagacagaggttaccaacccagcggtgctgcggaagctctgtattgaggccaagatcagcaacaccacgaccgactccagatgccccacgcagggcgaggccaccctgatggaggagcaggacgccaattttgtgtgccggcgcacgtttgtagaccggggctgggggaacggctgcgggttgttcggcaaggggagccttatcacgtgtgccaagtttaagtgcgtgaccaaattggagggcaaggtggtccagtacgaaaatctgaaatactccgtgatcgttaccgtacacacaggcgatcagcaccaggtggggaacgagagcaccgagcacggcaccacggcgaccataactccgcaggcccccacttccgagatccagctcacggattacggggccttaaccctggactgtagcccccgcacgggcctcgacttcaacgagatggtattactgaccatgaaggagaagtcatggctcgtgcacaaacaatggttcctggatctgccgctcccttggaccagcggggccagcacctcccaggaaacgtggaaccggcaggatctactggtcaccttcaagacggcccacgcgaaaaagcaggaggtcgtggtgctcggctctcaggaaggcgccatgcacaccgccctgacgggagccaccgagatccaaacctccggcaccaccaccatcttcgcagggcatttgaagtgccgcctaaagatggataaactcaccctgaaaggcatgagctacgtcatgtgcactggttccttcaagctggagaaggaggtggcggagacgcagcatggcaccgtgttagtccagatcaaatacgagggaacggacgccccctgcaagatcccgttcagcacccaagacgagaaaggtgtgatacagaacggccggctaatcacggccaacccgatcgttaccgacaaggagaaacccgtcaacatcgaggctgaaccgccttttggtgagtcctacatagtcatcggcgtcggtgagaaggccctgaagttaagctggttcaagaaaggctccagcatcggaaagatgttcgaagccaccgcgcgaggagcccgtcgcatggccatcctgggcgataccgcctgggacttcgggtccattggcggcgtattcacgtccgtgggtaaactggtgcaccagatctttggtacagcttacggggtcctcttctccggcgtgagctggaccatgaagatcggaatcggggtgctgctcacatggctcggtctgaattcccgcagcacttccctgtccatgacgtgcatcgccgtcgggctcgtgaccctgtatttaggagtgatggtccaggcagactccgggtgcgtaataaattggaagggccgagagctcaagtgtgggtcaggcattttcgttaccaatgaggtccacacgtggaccgagcagtataagttccaagctgactcaccgaagcgcctgtccgcggccattggcaaggcctgggaggaaggggtatgtggtatccggtccgcaacacgcctggagaacatcatgtggaagcaaatttcgaacgagctcaatcacatactgcttgagaacgatatgaagttcaccgtggtagtcggagacgtggtaggcatactcgcgcaagggaagaaaatgatacggccccaacccatggagcacaaatatagctggaaaagttggggcaaggcgaagatcattggcgccgacgtgcagaacaccacgttcatcatagatgggcccaacacgccagagtgccccgacgatcagcgcgcctggaacatatgggaggtcgaagactacggtttcggcatcttcaccaccaacatctggctaaagttgcgggacagctacactcaggcctgcgatcacagactcatgagtgctgcaataaaggacagcaaagccgtccacgctgacatgggctactggatcgagtccgagaagaacgagacctggaagctggcacgcgctagcttcatcgaggtgaagacatgcatatggccgaagtcccacaccttgtggagcaacggcgttctcgagagcgagatggtgatccccaagatctacggaggcccgataagccaacataactaccgccccgggtatttcacccagaccgccggcccgtggcacctgggaaagctggagctcgacttcgacctgtgcgagggaaccaccgtagtcgtcgacgagcactgcggaaaccggggaccgtccctgcgcacgacaaccgtcaccggcaagattatccacgagtggtgctgccggagttgtactctgccacccctacgcttcaagggtgaggacggctgctggtacggtatggagatacgacccgtgaaggagaaagaagagaacctggtcaaatccatggtaagcgctggctcgggcgaggtggactccttcagcctcggacttctgtgcatctccatcatgatagaagaagtcatgcgcagcaggtggagtcgaaagatgctcatgaccggcaccctggcggtgttcctactactgatcatggggcaactgacatggaacgacttgacgcgactatgcatcatggtgggcgccaacgcgagcgaccgcatggggatgggcactacctacttggccctcatggccaccttcaagatgagaccaatgttcgccgtaggactgcttttcagaagactaacatccagagaagtcttattgctcaccatcgggctgagcctcgtagcctccgtggaactccctaacagcttagaagagttgggtgacgggttagcgatgggcatcatgatcttaaaactgctcaccgacttccagtcacaccagctgtgggcaaccctgctctcactgacgttcatcaaaaccacgctgtccttacactatgcctggaagaccatggcaatggtactgagtatcgtctcactatttcccctttgcttaagcacgacctcccagaaaaccacttggctgcccgtgctcctgggctccctgggttgtaagccgttaacgatgttcctgatcgcggagaacaagatatggggccgcaagtcgtggcccttaaacgagggtatcatggctgtgggagtcgtgtctatccttctgagttccctgctcaaaaacgacgtgcccttggccgggcctctaatcgcaggaggcatgctcatcgcctgctacgtcatcagcgggagtagcgcggatctgtctctagagaaggcagccgaagtaagctgggaggaggaggccgagcactccggagccagccacaatatcctcgttgaggtccaggacgacgggaccatgaagatcaaggacgaggagcgggacgatacattgaccatcctgctgaaggcaaccttgctggccgtatccggtgtatacccgttaagcatcccagcaacgctgttcgtttggtatttctggcagaagaagaagcagcgctccggggtgctgtgggatacccccagcccgcccgaagttgagagagccgtgctggacgacggtatctaccgcatcatgcaacgtggcctcctggggcgctcccaggtaggcgtgggggtcttccaggagaacgtattccacaccatgtggcatgtgacccggggcgccgtcctgatgtaccaggggaagcgccttgaacccagctgggcgagtgtgaagaaggacctgatcagttacggcggcggatggcggctgcagggcagttggaacacgggggaagaggtgcaggtaatagccgttgaacctggaaagaacccaaaaaacgtacaaaccgcccccgggacgttcaaaaccccggagggagaggtaggcgcaatcgccctcgacttcaagcccgggacgagcggctcccccatagtgaaccgcgaggggaagatcgtgggcctatatggcaacggtgttgttaccacttccggcacgtatgtcagcgcgatagcgcaggctaaggcctctcaggagggcccgctgcccgagatagaggacgaggtcttccggaagcgcaatctcacgatcatggacctacaccccggaagcgggaaaacccggagatatctgcctgcgatagttagagaagcgatcaagcgcaaactcagaaccctgatactggcccccacccgcgtggtcgcctcggagatggccgaggcgcttaagggcatgcccatacgctaccaaacgacagccgtcaaaagcgagcacacgggcaaagaaatcgtcgacctgatgtgccatgcaacattcaccatgcgtttgctctccccggtgcgcgttccaaactataacatgatcatcatggacgaggcccacttcaccgaccccagctccatcgccgcgcggggttatatcagcacccgtgtcggcatgggggaggccgccgctattttcatgaccgctacgccgccgggttccgtcgaggcgttcccgcagagcaacgcagtgatccaggacgaggagcgggacatccccgagcgctcctggaactcgggatacgaatggatcactgacttccctggcaaaaccgtgtggttcgttccctccatcaagagtggcaacgacatcgccaactgcttgcggaagaacgggaagcgcgtgatccagctgtcccggaagaccttcgacaccgagtaccagaagactaagaacaatgactgggactacgtggtcaccacagacatctcggagatgggcgccaatttccgcgcagaccgggttattgacccgagaagatgcctcaagcccgtaatcctgaaagatggtcctgaacgcgtgatcctggccgggcccatgccggtgactgtcgcctccgctgcccagcgccgcgggcggatcggacgcaaccataacaaggaaggcgatcagtacatctacatggggcagcccctaaacaacgacgaggaccacgcgcactggaccgaggccaagatgttgctggataacatcaacacgcccgagggcatcatccccgccctattcgagcccgagcgtgagaaatccgccgccatcgacggcgagtaccgactgcgcggtgaagcgcgcaagaccttcgtggagctgatgcgacgcggagacctcccagtctggctctcctataaggtcgcaagcgaggggttccagtactccgaccgccggtggtgcttcgacggcgagcgcaacaaccaagtgctcgaggagaacatggacgtggaaatatggacgaaggagggggagcggaagaagctccgcccgcggtggttggatgcccgaacatatagcgaccccctggccctgcgcgagtttaaagaatttgcagcgggccgccggagcgtcagtggggacctgatcctggagatcggcaagctgcctcagcacctcacacagcgcgcccagaacgccttagataatctcgtgatgctgcacaacagcgagcagggcggccgcgcgtacaggcacgcgatggaggaattacccgacaccatagaaacgctaatgctgctggcgctcatcgccgtcctgaccggcggagtcaccctgttcttcctcagcggccgggggctgggtaaaacctcgatcgggttattatgtgtcatggcctcaagcgtactcctgtggatggcgtccgtcgagccccactggattgctgcttccatcatactggagttctttttgatggtgctactcatccccgaaccggaccgccagcggacgccacaagataaccagctggcgtatgttgtcataggactcttgttcatgatcctgactgtggccgccaatgagatgggcctcctcgagaccaccaaaaaggacctgggcattggccacgtggctgttgagaatcaccaccacgcaaccatgctggacgtggatctccacccggcctccgcatggacgctgtatgccgtggcgactaccatcatcacgccaatgatgcgccatacaatcgagaacactaccgccaacattagcctgaccgccattgcgaaccaggccgcgatcctgatgggtctggacaagggttggcccatatccaagatggacataggcgtccccctgctcgccctggggtgctacagccaagtcaaccccctgacgctcaccgccgccgtgctgatgctggtcgcgcattacgccatcatcggcccggggctacaggccaaggcgacccgcgaggcccagaagcggaccgcggccggcatcatgaaaaaccccactgtagacgggatcgtggccatcgacctggatcccgttgtctacgacgccaagttcgaaaaacaactgggccaaatcatgctcctcattctgtgcacgtcccaaatactcttgatgcgcactacctgggccctgtgcgagagtatcacgctcgcgaccggccccctgaccaccctgtgggagggatcgccaggaaagttctggaacacgacgatcgccgtgtctatggccaacatcttccgggggagctaccttgccggggccggcctggcgttctccctgatgaagtccttgggcggagggcgccggggcaccggtgcccaaggcgagacccttggagagaagtggaagcgccagctgaaccagctctcaaaatccgaatttaacatctataagcggtccggtattatggaagtagaccgctccgaggccaaggagggcctgaagcgcggtgagacgacccgccacgccgtatcccggggcaccgcgaaattgaggtggttcgtcgagcggaacctggtcaaacccgaagggaaagtgattgatcttgggtgcggccgcggcggctggagctactattgcgctggtctgaagaaggttaccgaggtcaagggctacacgaaaggtgggcccggccacgaggagccgatccctatggctacctacgggtggaatctagtaaagctccactctggaaaggacgtgttcttcacgccgcccgagaagtgcgacacgctactgtgcgatattggcgagagcagccccaacccgactattgaggagggccggaccctacgcgtcctgaagatggtggagccctggctgcgggggaatcagttctgcatcaaaatcctaaacccctacatgcccagcgtcgtcgaaaccctggagcagatgcagcgaaagcacggtggcatgctggtgcgaaaccccctatccaggaatagcacccacgagatgtattgggtgtcgtgtggcacgggcaacatcgtctcggccgtgaacatgacatccaggatgctgctaaatcgcttcacgatggcccaccgcaagcccacctatgagcgggacgtggacctaggggcgggcacccgccacgtcgctgtcgaacccgaggttgccaacctggacatcatcggacaaagaatagagaacataaaacacgagcacaaaagcacctggcactacgacgaggacaacccctacaagacctgggcctaccatggttcctacgaggtcaagccgagcggaagcgccagcagcatggtgaacggggtggtcaagctgctcactaagccgtgggacgtgatacccatggttacccaaatcgcgatgactgacacgacccctttcggccaacaacgcgtattcaaagagaaggtggacactcgaacgccgaaggccaagagagggacggcccaaatcatggaggtcaccgcgcggtggctctggggcttcctttccagaaataaaaagccccggatatgcaccagggaggagtttacgaggaaggtgcgctcgaacgctgctattggcgctgtgttcgtcgacgagaaccagtggaactccgccaaagaggcggtggaggacgaacggttctgggacctagtgcagaaggaaagagagctacacaaacaggggaagtgcgcgacgtgcgtctacaacatgatgggcaagagggaaaagaagctgggagagttcggcaaagctaaggggagccgcgcgatctggtacatgtggctcggcgcccggttcctggagttcgaggccctgggcttcatgaacgaggatcattggttcagccgcgagaacagcttgtccggggtagagggtgaggggctgcacaagctgggctacatcctccgggacatctcaaaaatccccgggggaaacatgtacgcggacgataccgccggctgggacacccgcatcaccgaggacgacctgcagaacgaggccaaaattaccgatatcatggagccggagcacgcccttctcgccacctccattttcaaactgacctaccagaacaaggtcgtgcgggtgcagcgcccggccaagaacgggacggtgatggacgtcatcagccgccgggaccagcgcggcagtggacaggtgggcacctacggattgaacacattcaccaatatggaggctcaactaatccggcagatggagagtgagggcatattcctcccgtccgagctggagacgccgaacctcgccgagcgcgtgctggattggctggagaagcacggcgtcgagcgactcaagcggatggccatcagcggagacgactgcgttgtcaagccgatcgacgaccggttcgccacagcgctgaccgccctcaatgacatgggcaaggtccgtaaggacatacctcagtgggagccctcgaaggggtggaacgactggcagcaggtcccgttctgcagccatcattttcaccagctcataatgaaggacggccgggagatcgttgtcccgtgccgcaaccaggacgagctggtgggcagggctcgcgtgagccaaggggcggggtggagcttacgggagacagcctgcctgggcaagagctacgcgcagatgtggcagctgatgtatttccacagaagagacctgcgactcgcagcgaacgccatctgctccgcagtcccagtggactgggtgcccacgagccggacgacctggtccatccacgcccaccaccaatggatgacaactgaggacatgctgtcagtctggaaccgagtgtggatcgaggaaaacccctggatggaggataagacccacgtgtctagctggggcgacgttccgtatctggggaagcgggaggaccagtggtgcgggtccctcatcggactgacagcgcgagctacctgggcaagcaatatccaggttgcaatcaatcaagtgagacggctgatcgggaacgagaactacttggactacatgacctccatgaagcgatttaagaacgagggcgaccccgagggggccctgtggtag

SEQ ID NO: 24589 - RNA, 9879 nt, synthetic construct
  misc_feature 1..9879: note = derived and/or modified CDS sequence (opt11) from DENV-1__EU482520__SS-prME
  source 1..9879: mol_type = other RNA
agcgtaacaatgctactcatgctgatgcccaccgccctggccttccacttgaccacccggggcggggagccccacatgattgtgagcaagcaggagcggggcaaaagcctgctgttcaagaccagcgccggggtcaacatgtgcacattaatcgccatggacctaggcgagctttgcgaagatacaatgacctacaagtgcccccgcatcaccgagaccgaaccagacgatgtggactgctggtgcaacgcgacggacacatgggtgacctacgggacctgtagccagacgggcgaacaccggagagataagcggtccgtggccctcgcgccccacgtgggtctggggctggaaactagaaccgagacctggatgagctccgagggcgcgtggaaacagatccagcgggtagagacgtgggccctccgccaccccgggttcaccgtgatagccctgttcctcgcccatgcaattggcactagcatcacccagaaggggatcatcttcatcctacttatgcttgttacgccctctatggccatgcggtgcgtcggcatcggaagccgcgacttcgtggaggggctctcaggcgctacttgggtggacgtcgtgctggagcatgggagctgcgtgaccaccatggccaaggacaaacccacgctggacatcgaactgctgaagaccgaggtcaccaaccccgccgtgctgcggaagctctgcatcgaagcgaagatatctaacaccacgactgacagcaggtgcccgacacagggcgaggccaccctggtggaggagcaggatgcaaatttcgtctgccgccggacgttcgtggaccggggttggggcaacggatgcgggctgttcggcaaaggttccctcatcacgtgcgccaagttcaaatgcgtgaccaagctggagggcaagatcgtacagtacgagaacctgaagtacagcgtgatcgtgaccgtccacacgggggaccagcaccaggtcggcaacgagtctaccgagcacgggacgaccgccaccatcacgcctcaggcgcccacgaccgagatccagctcaccgattacggggccctgacgctggactgctccccccgcaccggcctcgatttcaacgagatggtcctcctgaccatgcgggagaaaagttggctcgttcataaacagtggttcctagatctgccacttccctggaccagcggcgccagcacgtcccaggagacctggaaccgccaggatctgctggtgaccttcaaaaccgcccatgccaagaagcaggaggtcgtggtgctcggcagtcaggaaggcgcgatgcacacggccctgaccggagcgaccgagatccagacatccggcacgaccaccatcttcgccgggcatctgaaatgccgcttgaagatggacaagctcaccctgaaaggcatgagctacgtcatgtgcacggggtccttcaagttggagaaagaagtagcggagacccagcacggaaccgtgctggtccagatcaagtacgagggcaccgacgcgccgtgcaaaatacccttcagcactcaagacgagaaaggggtgacccagaatggcagactaatcaccgccaacccgatcgtgaccgacaaggaaaagcccgtcaacatcgaggccgagccgcccttcggggagtcctacatcgtgataggagccggcgagaaggcgctgaagctgagctggttcaagaaagggtccagcataggcaagatgttcgaggccacggcccggggggcccgccgcatggccatcctgggcgacaccgcgtgggacttcgggagcatcggcggcgtcttcacatcggtcgggaagctggtccaccagatcttcggcaccgcctacggggtgctgttttccggggttagctggacgatgaagatcgggatcggcgtgctgctgacgtggctcggcctgaatagccggtcaacctccctcagcatgacctgcatcgccgtgggcctcgtcacgctgtacctcggcgtgatggtacaagccgacagcgggtgcgtcattaactggaagggacgcgagctcaagtgcgggagcggcatcttcgtgaccaacgaggtgcacacttggaccgagcagtacaaattccaggctgactcgcctaagcggctgagtgcggcaataggcaaggcctgggaggagggggtctgtggcatccgcagtgccacccgtctggagaacatcatgtggaagcagatttccaatgaactcaaccacatcctgctggaaaacgacatgaagttcaccgtagtggtcggggacgtggccggaatcctcgcgcaggggaagaagatgatccgcccccagcccatggagtacaagtacagctggaagtcttggggcaaggcgaagatcattggcgccgacgtgcagaacacgacgtttatcatcgacggccccaacaccccggagtgccccgacgaccaacgggcttggaacatttgggaggtcgaggactacggcttcggaatcttcacgaccaacatctggctgaagctgcgcgacagctacacccaggtgtgtgatcatagactcatgtccgcggccatcaaagactctaaggccgttcacgctgacatgggctactggatcgaatccgaaaagaacgagacctggaaactggcccgggcgagcttcatcgaagtcaagacgtgcatttggcctaagtcgcacaccctgtggagcaacggcgtgctcgagtccgagatgatcatccccaagatctatggaggcccgataagccaacacaactaccggccaggttatttcacccagactgccggcccctggcacttagggaagctggagttagacttcgacctgtgcgagggcacgaccgtggtcgtagacggccactgtggtaaccgcggcccttccctgcgtaccaccacggtgactgggaagatcatccacgagtggtgctgccgcagctgcaccctgccgccgcttcggttccgcggcgaggatgggtgctggtacggcatggagatccggcctgtcaaagagaaggaggagaacctagtgaagtccatggtgagcgccgggagcggggaggttgatagtttcagcctcggcctactgtgcatctctatcatgatcgaggaagtgatgcgcagccggtggtccaggaagatgctcatgaccgggatcctggccgtatttttcttacttatcatgggccagctgacgtggaacgacctaattcgcctctgtatcatggtcggggccaacgcgagtgaccgcatgggcatggggaccacgtatctagccctgatggctacctttaagatgcgcccaatgttcgccgttgggctcctattccggcgactgacgtcccgggaggtgctactgctgaccatcggcctctctctggtcgcctccgtcgaactgccgaacagcttggaggagctcggggacggcctggcgatgggcatcatgatcctcaagctgctgacagactttcagtcgcaccagctctgggccaccctgttgtcactcacgtttatcaagacaacgttttcgctgcactacgcctggaaaacaatggccatggttctgagcatcgtgtccctcttcccgctgtgtcttagcacgacctcacagaagaccacctggttgcccgtgctgttgggtagcttaggctgcaagccgctgacgatgttcctgatcgctgaaaacaagatttgggggcgccggtcctggcccctcaacgagggcatcatggccgtcggaatcgtgagcatcctgctgagctccctcctgaaaaacgacgtacccctcgccggccccctcatcgcgggcgggatgctgatcgcctgttacgtcattagcggatccagcgcggacctgtccctcgaaaaggcggccgaggtgagctgggaagaggaggccgaacactccggggccagccacaacatcctggtggaggtgcaggatgacggcaccatgaagatcaaggacgaggagcgggacgacaccctgaccatcctcctgaaggcgaccctgctagccgtgtccggggtgtacccgctgagcatccccgccacgcttttcgtttggtacttctggcagaagaagaagcagagatccggcgtgttgtgggacaccccaagcccgcccgaggtgggccgcgctgttctggacgacgggatttacaggattatgcagcgcggcctgctggggcggtcccaggtgggtgtcggggtatttcaggagaatgtcttccacaccatgtggcacgtgacccgcggcgccgtcctcatgtaccagggcaagcggctggagcccagctgggcgtccgtgaagaaagacctgatctcctacgggggtgggtggcgcctccaaggctcctggaacaccggcgaggaggtgcaggtcatcgccgtcgagcccggcaagaaccccaagaatgtgcagaccgcacccggcacattcaagacccccgaaggggaggtcggcgccatcgccctggactttaagcccgggacgtcaggctcccccatcgtgaaccgggagggcaagatcgtggggctgtacggcaacggggtcgtaaccaccagcggcacctacgtgagcgcgatcgcccaagccaaggcctctcaggaggggccgctccccgagatcgaggacgaagtctttcgcaagcggaatttgacaataatggaccttcatcccggcagtgggaaaacccggagatacctcccggcgatcgttcgcgaggccatcaagcgcaagctgcggaccctgatcctcgcacccacccgcgtggtggcctcggagatggccgaggcgctgaaagggatgcctattcggtaccagacgaccgccgtcaagagcgaacacaccgggaaggagattgtggatctgatgtgccatgccaccttcacgatgcgcctcctgtcccccgtccgggtgccaaactacaacatgatcatcatggacgaggcccacttcactgatcccagctccatcgccgcgcgcggctacatcagcacccgggtgggcatgggggaggccgccgccatcttcatgaccgctacgccgcccggttccgtcgaggcatttccgcagtcgaacgccgtgatccaggacgaagagcgggacatccccgaacggtcatggaacagtggctacgagtggatcaccgactttcccggtaagaccgtgtggttcgtcccttccattaagtctggcaacgacatcgctaactgtctgcgcaagaacgggaagcgtgtgatccagctctcccgcaaaacctttgatacggagtaccagaagacgaagaacaacgactgggactacgtggtcaccaccgacattagcgagatgggagccaacttccgggcggaccgcgtgatcgatccacggcgctgcctgaagcccgtgatcctgaaggacgggcccgagagggtcatcctcgcggggcccatgccggtgacggttgctagcgccgcccagcgtcggggccgcatcgggcgtaatcacaacaaggagggcgaccagtacatctacatggggcaacccctgaataacgacgaggaccacgcgcactggaccgaggccaagatgctgctcgacaatattaacacacccgagggcatcatacccgctctcttcgaaccggagagggagaagtccgccgccatcgacggggagtaccgtctgcggggcgaggcgagaaaaaccttcgtcgaattaatgcggcgcggtgacctgcccgtgtggctgtcgtacaaagtcgcaagcgaggggtttcaatacagtgaccggcgctggtgcttcgacggcgaacggaacaaccaggtgctcgaggagaacatggacgtggaaatctggacgaaggagggggagcgaaagaagcttcgtccccgctggctggacgcccggacctacagtgaccccttagccctgcgcgaattcaaggagttcgccgcgggccgccgcagcgtatccggcgacctgatactcgagatcgggaagctgccgcagcatctaacccagcgagcccagaacgcactcgacaatttagtgatgctgcataacagcgagcaaggcgggcgcgcctaccggcacgcgatggaggagctcccagataccattgagacgttgatgctactcgccttgatagccgtgctaaccggcggggtcactctcttcttcctgtccggccgcggcctggggaagacctcgatcggcctgctgtgcgtaatggccagcagcgtgctattgtggatggcctccgtcgaaccccactggatcgctgcaagcatcatcctggagttcttcctgatggtgctcttaatccccgagccggatcggcagcgtacgcctcaagacaaccagctcgcatatgtggtgatcgggctcctgttcatgatactgacggtggcggccaatgagatgggcctcctggagaccaccaagaaagacctgggcatcggtcacgtggcggtcgagaaccaccatcacgccgccatgctcgacgtggacctgcaccccgcgagtgcttggaccctgtacgcggtggccactaccataatcactccgatgatgcgccacaccatagagaacacgaccgcgaacatcagcctcaccgccatcgccaaccaagccgccatcctgatgggcctcgataaggggtggcccatctccaaaatggacattggcgtacccctactggccttagggtgctacagccaagtgaaccccctcaccctgacggccgctgtgttaatgctcgtcgcccactacgccatcatcggcccggggctgcaggccaaggccacaagagaggcgcagaagcgcaccgccgccggcatcatgaagaaccccactgtggatggcatcgtggccatcgacctggacccagtcgtgtatgacgccaagttcgagaagcagctcgggcagatcatgctgctgatcctctgcacgtcccagatcctcctgatgagaaccacctgggccctctgcgagagcataactctcgcgacgggccctctgaccaccctctgggagggttccccgggcaagttctggaataccacgatcgccgtgagcatggccaacattttccgcggcagttacctggccggggcgggcctggcgttcagtctcatgaagtccctcgggggcgggcgacgcggcactggcgcccagggggaaaccctgggcgagaagtggaagcgacagctaaaccagctgtcgaagagcgagttcaacacctataagcgctccgggatcatggaggtcgatcggagcgaggccaaggagggcctgaagcgcggggaaacgaccaagcacgcggtgtccagaggcactgcaaagctccgctggtttgtggaacgaaacctggtaaagcccgaaggcaaggtcattgacctggggtgcggccgcgggggctggagctactactgcgccgggctgaagaaggtgaccgaggtcaagggctacacgaagggcgggcccggccatgaggagcccatcccgatggccacctatgggtggaatttagtgaagcttcattccggcaaggacgttttcttcatcccgcccgagaagtgcgacaccctgttgtgcgacatcggggaatcttcgcccaacccgacgatcgaggagggccggacactgcgcgtccttaagatggtcgagccctggctccggggtaaccagttttgtatcaagatcctgaatccctatatgcctagcgtagtggagactctggagcagatgcagagaaaacacgggggcatgctcgtgcggaaccctctttccaggaactctacacatgagatgtactgggtttcctgcgggaccggcaacatcgtcagcgccgtgaacatgacctcccgcatgctgctcaaccggttcactatggcgcaccgcaagcccacttacgagcgggacgtggatctgggagctggtactcgacacgtcgccgtagagcccgaggtagccaacctagacatcataggccagagaattgaaaacatcaagcatgagcacaagagcacttggcattacgacgaggacaatccctacaaaacgtgggcctaccacgggtcctatgaggtcaagccgagtggctcggctagcagcatggtgaacggggtcgtgaagttactgaccaagccctgggacgtgatccccatggtcacccagattgccatgaccgacacgacccccttcggccagcagcgcgttttcaaggagaaggtggacacccggacccctaaggccaagcgcggcacggcccagatcatggaggtcaccgccaaatggctgtgggggttcctctcccggaacaagaagccccgcatctgcacccgagaggagttcactcgcaaggtgcggagcaatgcggccatcggggcggtattcgtcgatgagaaccaatggaactccgccaaggaggcggtggaggacgagcgcttctgggacttagtacaccgggagcgcgagctacacaaacaggggaagtgtgccacgtgcgtctacaacatgatgggcaagcgggagaagaagctcggggagttcggcaaggccaagggcagccgagccatttggtacatgtggctgggagcccgattcctggagttcgaggcgctcggtttcatgaacgaggaccactggttctcccgcgaaaacagcctgtccggggtggaaggcgaggggctgcacaagctcgggtacattctgcgagacataagcaatatccccggcgggaacatgtacgccgacgacaccgccggttgggacacccgcatcaccgaggacgatcttcagaacgaggcccgtatcacggacatcatggagccggagcacgccctcctggcgaagagtatctttaagctgacttaccagaacaaggttgtaagggtgcaaagacccgccaaaaatggtaccgtgatggacgtcataagccgacgcgaccagcggggctccggccaggtagggacctacggtctcaacacgttcaccaacatggaggcccagctgatacgccagatggagtcagaggggatcttctccccaagcgagctggagaccccgaacctcgccgagcgggttctggactggctggagaagtacggtgtggaaagactcaagcggatggccatatccggtgacgactgcgtggtgaagccgatagacgaccgtttcgcgacggccctgacggccctgaacgacatgggcaaggttcggaaggacatcccgcagtgggagccttcgaagggctggaacgattggcagcaggtgcccttctgcagccaccacttccaccagctcatcatgaaggacgggcgcgagatcgtggtcccatgccggaatcaggacgagctggtgggccgcgcccgtgtgagccagggggcgggctggtcactgcgtgagaccgcgtgcctggggaagtcctatgctcaaatgtggcagcttatgtacttccacaggcgcgacctccggctcgccgccaacgcaatctgcagcgccgtccccgtggactggatccccacctcacggaccacatggagcatccacgcccaccaccagtggatgaccaccgaggacatgctgtcggtgtggaatcgcgtctggatcgaggagaatccctggatggaggacaagacccacatcagctcctggggcgacgtgccgtacctgggcaagcgggaggaccagtggtgcggaagcctcatcggcctgacggcccgcgccacctgggcgaccaatattcaagtggcaatcaaccaggtccggcgcctgattggtaacgagaactacctcgactacatgacctccatgaagcggttcaagaacgagagcgaccccgagggcgccctgtggtga

SEQ ID NO: 24590 - RNA, 9879 nt, synthetic construct
  misc_feature 1..9879: note = derived and/or modified CDS sequence (opt11) from DENV-1__EU482521__SS-prME
  source 1..9879: mol_type = other RNA
agcgtgaccatgctgctcatgctgatgcccaccgccctggccttccatctcaccacccggggcggggagccgcatatgatcgtaagcaagcaggagcgggggaaaagcctgctgttcaagaccagcgccggggtgaacatgtgcaccctcatcgccatggacctgggtgaactatgcgaggacactatgacctacaagtgtcccaggattacagaagccgagcccgacgacgtggactgctggtgtaacgcgaccgacacctgggtcacatacggaacctgcagccaaactggcgaacaccggcgggacaagcgttccgttgccctcgcgccccatgtgggcctggggctggagacgcgcaccgagacttggatgagctccgagggcgcctggaagcagatccagcgggtggagacctgggccctccgccatccggggttcacggtgatcgcactgtttctggcgcacgccatcggaaccagcatcacccagaaggggatcatcttcatcctcctgatgctggtgacgcccagtatggcaatgcggtgtgtcggtatcggcagccgcgacttcgtggaggggctgtccggtgccacgtgggtggacgtcgtgctggagcacgggagctgtgtcaccactatggccaaggacaagcccactctggacattgagctcctaaaaacggaggtcaccaacccggcaatcctgcggaagttgtgcatcgaggccaagatctcaaacaccaccacggacagccgctgccccacccagggagaggctaccctggtggaggagcaggacgccaacttcgtgtgccggcgcaccttcgtcgaccgaggctgggggaacggctgtggtctcttcggaaaggggtccctcattacgtgcgccaagttcaagtgcgtgactaagctggagggaaagatcgtgcagtacgagaacctgaaatacagcgtcatcgtgactgtccatacgggagaccagcaccaggttgggaacgaatccacggagcacggcaccaccgccaccattacgccgcaagcccccacgaccgaaatccagctaaccgactatggggccctgactctggactgtagccccagaacgggcctcgactttaacgagatggtactgctgacgatgaaagaaaaatcctggttagtccataaacagtggttcctggaccttccgctcccctggaccagcggcgcgagcacgagccaggagacgtggaaccgacaagatctgctggttaccttcaagaccgcccacgcgaagaagcaggaagttgtggtgctgggcagccaggagggggcgatgcacactgcactcacgggggccaccgagattcaaacgtccggcaccacgacaatattcgccgggcatctaaagtgccgcctcaagatggacaagctgaccttgaagggaatgagctatgtgatgtgtaccggatccttcaaactcgaaaaggaggttgcggagacgcagcatgggaccgtactggtgcagatcaaatacgagggcaccgacgccccgtgcaagatcccgttctcaacacaagacgagaagggggtgacgcagaacggccggctgataacagccaatccaatcgtgaccgacaaggagaagcccgtgaacatcgaggccgagccgccctttggggagagctacatcgtaatcggcgcgggggagaaggccctgaagctcagctggttcaagaaggggagcagcatcggccgcatgttcgaggccaccgcccgcggggcccgccgcatggcgatactgggggacacggcctgggatttcgggtccatcggcggcgtcttcacctcagtgggtaagctggtccaccagatcttcggcacggcgtatggggtcctgttctccggcgtgagctggaccatgaagatcgggatcggcgtccttctgacttggctcggcctgaactcccggagcaccagtttcagcatgacatgcatcgctgtaggcctcgtgaccttgtacctgggcgtcatggtgcaggccgactccggctgcgtgattaattggaagggacgcgagctgaagtgcgggagcggcatatttgttactaacgaggtgcacacgtggaccgagcagtacaagttccaagctgacagcccgaagcggttgtccgccgccatcggcaaggcatgggaggagggggtgtgcggtatcagatcagcaaccagactggagaatatcatgtggaagcagatctccaacgagctgaaccatatactcctagaaaatgacatgaagtttactgtcgtggtgggcgacgtagcgggcatcctggcccaagggaagaagatgatccgccctcagcccatggagtacaagtacagctggcggtcctggggcaaggcgaagatcatcggggccgacgtgcagaacacaacgttcatcatcgatgggcctaacactccggagtgccccgacgaccagcgcgcgtggaacatctgggaggtggaggactacggattcgggatctttacaaccaacatctggctaaaactgcgggactcgtacacccaggtctgtgaccaccgcctgatgtccgccgccatcaaggactccaaggcagtgcacgccgacatgggctactggatcgagagcgaaaagaacgagacttggaagctcgcgcgggccagcttcattgaagtgaaaacctgcatctggcccaagtcccacaccctgtggagcaatggtgtcctggagagcgagatgattatccccaagatatacgggggcccgatcagtcagcacaactaccgccccggttactttacccaaaccgccggcccctggcacttggggaagctggagctggactttgacctctgtgagggcaccacggtggtcgtagacgagcactgcggtaatcgcgggccatccctgcgcaccaccactgtgacgggcaagatcatccacgagtggtgctgtcggtcatgcaccctgccgcccctccgcttcagaggggaggacggctgctggtatgggatggagatccgccccgtaaaggaaaaggaggaaaacctggttaaaagtatggttagcgcaggcagcggcgaggtggactccttttccctagggctcctgtgcatctccatcatgatcgaggaggtgatgcggagccgctggtcccggaagatgctgatgacaggcaccctcgcagtctttcttctgctcatcatggggcagctgacatggaacgacctgattcggctatgcatcatggtgggtgcgaacgccagcgaccgcatgggtatgggcactacatacctggccctgatggccaccttcaagatgcggccgatgttcgcagtcgggctcctgttccggcggctgacgtcccgcgaggtgctcctacttactatcggcctcagcctcgtggcctcggtcgaacttccaaattcgcttgaggagttgggggacgggctcgctatgggtatcatgatcctcaagctgctgaccgacttccagtcccaccagctctgggccaccttgttgagcctcaccttcatcaagaccaccttcagtctgcattatgcctggaagaccatggccatggtgctcagcatcgtctccctcttccccctgtgtctgagcactacctcccagaagacgacatggttgccagtcctgctggggagcctcggctgtaagcccctcaccatgttccttatcgcagagaataagatctggggccggcgctcctggcctctcaacgaggggatcatggccgtgggcatcgtcagcatcctcctgagctccctcctgaagaacgacgtaccgctggccgggccgctgatcgctggcggcatgctgatcgcgtgctatgtgatcagcgggtcgagcgccgatctgtccctcgaaaaagccgccgaggtctcctgggaggaggaggccgagcactccggcgcgtcacacaacatcctggtggaggttcaggacgacggtacaatgaaaatcaaggacgaggagcgtgacgacaccctgactatcctattgaaagccaccctgctggcagtctcaggcgtataccccctgagtattcccgccacgctatttgtctggtacatctggcagaagaaaaagcagcgctccggggtcctctgggataccccaagcccgcccgaggtggagagggcggtgttggatgatgggatttatcgcatcatgcagcggggcttactggggcgatcccaagtcggcgtgggggtcttccaggagaacgtctttcatacgatgtggcacgtgacccggggagcggttctaatgtaccaggggaagcgcctggagcccagctgggccagtgttaagaaggacctaatcagctacggcggcgggtggcggctccagggttcctggaacacaggggaggaggtccaggtgatcgctgtcgagccgggcaagaaccccaagaacgtgcagaccgcccccgggactttcaagacgcccgaaggcgaagtgggggccattgcgctggacttcaagcccgggacgagtggcagtcccatcgtcaaccgcgagggaaagatcgtgggtctgtacggtaacggggtggtgaccaccagcggaacctatgtgtctgccatagcgcaggccaaagcgtctcaggaaggaccgctccccgaaattgaggacgaggtgtttcggaagcgcaacctgacgatcatggacctgcatcccggcagcgggaagacccggcgctacctcccggcgatcgttcgtgaagccataaagcggaagctgcgcaccttaatcttagcccccacccgggtcgtcgcctccgagatggcggaggcccttaagggaatgcccatcagataccagacgactgccgtcaagtcagagcacaccgggaaggaaatcgtggaccttatgtgccacgccaccttcacgatgcggctcctgtcccccgtacgcgttccgaactacaacatgattatcatggacgaggcccacttcaccgatccgagctccatcgcggcccgggggtatatcagcaccagagtgggcatgggagaggcagccgccatcttcatgaccgcgacgccgccgggatccgtggaagccttcccgcagagcaacgccgtcatccaggatgaggagcgggacatccccgagcgctcttggaatagcgggtacgagtggataaccgacttccccggtaagacggtgtggttcgtgccttccatcaagagcggcaacgacatcgccaactgtctgcggaagaacgggaagagggtcatccagctctcccggaagaccttcgacacggagtaccaaaagacaaagaacaacgactgggactacgtggtgacaactgacattagcgagatgggcgcgaacttccgcgccgaccgggtcatcgacccgcgccggtgcttaaagcccgtgatcctgaaggacggccccgagcgcgtgatcctcgcaggcccgatgccggtcacggtggcctccgccgcgcaacgccgcgggcgcatcggtaggaaccacaacaaggagggcgatcaatacatctacatgggtcagcccctgaacaacgatgaagaccacgctcactggaccgaggccaaaatgctgctcgacaacatcaatacacccgagggcatcatcccggccctgttcgagccggaacgcgaaaagtccgctgctatcgacggggagtaccggctgcgcggcgaggcccggaagacctttgtcgagttaatgcgtagaggggacctgcccgtctggctgtcctataaagtggcctcagagggcttccagtattctgaccggcggtggtgtttcgacggcgagcgcaataaccaggtgctggaggaaaacatggacgtggagatctggacgaaggaaggcgagcgtaaaaagctcagaccccggtggctggacgcgcgcacctacagcgaccctctcgccttgcgggagttcaaggagttcgcggccggacgccgttcagtgtccggtgatctgatcttggagatagggaaactgccgcaacatctgacgcagcgcgcccagaatgccctcgacaacctggtcatgctgcataacagcgagcaaggcggtcgggcgtaccgccatgccatggaagaacttcctgacacaattgagactctgatgctgctcgccctgatcgccgtgctcaccggtggggtgacactcttcttcctctccggtcgggggctaggcaaaacaagcatcggcctcctgtgcgtcatggcgtccagtgtgctcctctggatggcgtccgtcgaaccccactggatcgccgccagcatcatccttgagtttttcctgatggtcctcctgatccccgagccagaccgccagcgcacgccccaggacaaccagctggcgtacgtggttatcgggctcctgttcatgattctcacggtggccgcgaacgagatgggcctcctcgaaaccaccaagaaggacctggggataggccacgtggctgttgggaaccaccaccacgccgcgatgctcgacgtcgacttacacccggcctcagcctggaccctgtatgccgtagccacgacgattatcaccccgatgatgcggcataccatcgagaacacgacggccaatattagcttaaccgccatcgcgaaccaagccgccatacttatgggtctggacaagggctggccaatctcaaaaatggacatcggtgtgcccctccttgcgctgggatgctacagccaggtcaaccccctcaccctcaccgcggccgtgctgatgctggtggctcactacgccatcatcgggccaggcttgcaagccaaagccacgcgcgaggcccaaaagcggaccgccgccgggatcatgaagaaccccacagtcgacggtatcgtggccatcgacttggacccggtggtatacgacgcgaagttcgagaagcagctaggccaaataatgctgctcatactctgcacaagtcagatcttgctgatgcgcaccacctgggccctatgcgagagcatcaccctggccactgggcctctcaccaccctctgggaaggcagcccggggaagttctggaacaccactatcgccgtcagcatggctaacatcttccggggctcttatctggctggtgcgggactggccttctccctcatgaagtctctgggcggtggccgccgggggactggcgcgcagggagagaccttgggggagaagtggaagcgccagctcaaccagctgtccaaatcagagtttaacacctacaaacggtccggtatcatggaagtggatagaagcgaggcaaaagaagggctgaagcggggcgaaattacgaagcacgctgtgtcccgcgggacggccaaacttcggtggttcgtggagcgaaacctggtgaagcccgagggcaaggtcatcgacctgggctgcgggcggggcgggtggagctactattgcgccggcttgaagaaagttacagaagtgaaagggtacactaagggcggccctgggcacgaggagcccataccgatggccacctacggctggaacctcgtcaagctgcactccggaaaggacgtattcttcgtgccgcctgagaagtgcgacacactattatgcgacatcggtgagagctcccccaaccctaccatcgaggaggggcgcaccctacgtgtcctgaaaatggtggagccctggctccggggtaaccagttttgcatcaagatcttaaacccgtacatgcccagcgtggtcgagacgctcgagcagatgcagcggaagcatggcgggatgctcgtccgcaacccgctttcccgcaacagcacccatgagatgtactgggtgtcctgcgggacggggaacatcgtcagcgccgtgaatatgacctcacggatgttgttaaaccgcttcaccatggcccaccgtaagccaacgtacgagcgtgacgtggaccttggcgccggaacccggcacgttgccgtagagccggaggtagccaaccttgacatcatcggccaaagaatcgagaacatcaagcacgagcataagagtacctggcactacgacgaggacaacccctacaagacctgggcgtaccacgggtcctacgaggttaagccgagcggctccgcaagctcaatggtgaatggcgtcgttaagctcctgacgaaaccctgggatgtaatccccatggtcacccagatcgccatgaccgacacaacccccttcggtcagcagcgggtgttcaaggagaaggtggatactcgcaccccgaaggccaagcggggcaccgcccaaatcatggaagtcacggcgaagtggctgtggggtttcctcagtcgcaataagaagccccgcatctgcacccgcgaagagttcacgcggaaggtgcgctcgaacgccgccatcggggccgtgttcgtcgacgagaaccagtggaactccgcgaaagaagccgtggaggacgagcgtttctgggacttggtccaccgcgagcgggagttacacaagcagggtaagtgcgcaacctgcgtctacaacatgatggggaagcgagagaagaagctaggcgagttcggtaaggccaagggctctcgggcgatctggtacatgtggctgggcgcgcgcttcctggagttcgaggccctcggcttcatgaacgaggatcactggttcagcagggagaacagtctgtccggcgtggagggagagggcctgcacaagctcgggtacatcctgcgcgacatcagcaagatccccggcggcaacatgtacgctgatgacacggccgggtgggacacccgcatcaccgaggacgacctgcaaaacgaggcccggataacggacattatggaaccggagcacgctctcctggccaaatcaatctttaagctgacttaccagaataaagtggtccgcgtgcaacggcccgccaaaaacggaaccgtgatggacgtcatcagcagacgggaccaacgcgggtccggccaagtgggcacatacggcctgaataccttcacgaatatggaggcccagctaatacggcagatggagagtgagggcatcttctcgccctcagaactggagactccaaacctcgctgagagagtgttagactggctggaaaagtacggggtcgagcggctcaagcgcatggcgatctccggcgacgactgcgttgtgaagccgatcgacgaccggttcgccaccgcccttactgcactgaacgacatggggaaggtccgcaaggacataccacagtgggagccctcaaaaggatggaatgattggcaacaggtccccttctgctcccaccatttccaccagttgatcatgaaggacgggcgtgagatcgtggtcccgtgccgaaatcaggatgagctggtgggccgggcccgcgtgagccagggcgcggggtggagcttacgggagaccgcctgtctcggtaagtcctacgctcaaatgtggcaactgatgtacttccaccgccgtgacctgcgcctcgctgctaacgccatctgcagcgccgtccccgtggactggatccccacctcccggactacttggagtatacacgcccatcaccagtggatgaccaccgaggacatgctgtccgtgtggaaccgggtctggatcgaagagaacccctggatggaagacaagacacatatcagctcttggggtgatgtgccgtacctgggcaagcgcgaggaccagtggtgcggcagcctcatcgggctaaccgcgagagcgacgtgggccaccaacatacaggtggccatcaaccaggtccgtcgtttgataggcaacgagaactatttggattatatgacttcgatgaagaggtttaagaacgagtcggaccccgagggtgccctatggtga

SEQ ID NO: 24591 - RNA, 9879 nt, synthetic construct
  misc_feature 1..9879: note = derived and/or modified CDS sequence (opt11) from DENV-1__EU482523__SS-prME
  source 1..9879: mol_type = other RNA
agcgtgaccatgttgctcatgctgatgcccaccgccctggccttccacctcaccacccggggcggggaaccccatatgatcgtgagcaaacaggagcgcgggaaaagcctgttattcaagacgagcgccggagtcaacatgtgcacactcatcgccatggacctgggcgagctttgcgaagacacaatgacatacaagtgcccccgcatcaccgagacggagccggacgacgtggactgctggtgcaatgccactgatacctgggtgacctacgggacctgcagccaaactggcgagcatcggcgcgacaagcggtcagtcgcactcgcgccccacgtgggcctggggttagagacacggaccgagacctggatgagctccgagggcgcatggaagcaaatacagcgggtcgagacgtgggccttacgccacccagggttcaccgtgatcgccctgttcctggcccatgctatcggcacaagcatcacccaaaaggggatcattttcatcctccttatgctggtgacgccctccatggccatgcggtgtgtcgggataggctctcgcgacttcgtggaggggctctccggcgcaacctgggttgatgtcgtgcttgaacacggaagctgtgtcactacaatggccaaggacaaacccacgctggacatcgagcttctcaaaacagaagtcactaaccccgccgttctgcggaaactctgcatagaggcaaagatcagtaacaccacgaccgacagccgatgtcctactcagggtgaggccaccttggttgaggagcaggacgccaactttgtgtgccggcgcacgttcgtggaccggggctggggcaacggttgcgggctgttcggcaaagggtccctcatcacttgcgcgaagttcaagtgcgtcacaaaacttgagggcaaaatagtccagtacgagaacctgaagtacagtgtgatcgtcactgtccatacgggcgaccaacaccaggtcgggaacgagagcaccgagcatggcacaaccgccaccataacaccccaggctcccaccacggagattcagctcaccgactacggagctctgacgctggactgtagcccccgcaccggcctcgacttcaacgagatggtcctgctgactatgaaggagaaatcttggctcgtgcacaagcagtggttcctcgacctgccgctcccatggaccagcggtgcttcaacgtcccaagagacctggaaccggcaggatctgctggtgaccttcaagaccgcacacgccaagaagcaggaggtcgtggtcctgggcagtcaagaaggcgcgatgcacacggcccttacgggtgccacggagatccagacctcaggcacgacgacaatcttcgccgggcatctgaagtgccgcctcaaaatggacaagctgactctaaaggggatgagctacgttatgtgcacgggctcgttcaaacttgagaaggaggtggccgagactcagcatggcacagttttggtccagatcaaatacgagggaacggacgcgccctgtaagatccccttcagcacgcaggacgagaagggggtgacccagaacggccggctgataacagccaacccgatagtgactgacaaggagaagcccgtcaacatcgaggccgagcccccattcggggagtcctatatcgttataggcgccggggagaaggcgctgaaattaagctggttcaagaagggctccagcatcgggaagatgttcgaggccactgcccgaggggcacggcgcatggccatcctgggcgatactgcgtgggatttcgggtccatcggcggtgtgtttacatcagttgggaagctggtgcatcaaatcttcgggactgcttacggggtactcttctctggcgtcagctggactatgaagatcggaatcggagtgctcctgacctggctcgggctgaactcccgcagtaccagtctgagcatgacctgtatcgccgtggggctcgtcacgttataccttggggtgatggtccaggctgactccgggtgcgtcatcaactggaagggccgggaactcaagtgcgggtccggcatctttgtgaccaacgaggttcacacctggaccgaacaatacaagttccaggccgacagccctaagcgcctgtcggcagccatcggcaaggcctgggaggagggggtctgcggcatccggagtgccacccgcttagagaacatcatgtggaagcagatttccaacgaactaaaccacatcctgctggaaaacgacatgaaattcacggttgtcgttggggatgtggccggcatcctcgcgcaggggaagaagatgatccgtccccaacctatggagtacaagtacagctggaaaagctgggggaaggccaaaatcataggcgccgacgtgcaaaacaccacattcatcatcgatgggcccaacaccccggaatgtcctgatgaccaacgggcctggaacatatgggaggtcgaagattacggctttgggatcttcacaaccaatatctggctgaagctgagggactcctatacgcaggtatgcgatcaccgcttaatgtcggctgccatcaaggacagcaaggcagtgcacgccgatatgggctactggatcgagtccgagaagaatgagacctggaagctggcgagagctagcttcattgaggtcaagacgtgtatatggcccaagtcccacactctgtggagcaatggcgtcctcgagtccgagatgattatcccgaaaatctacgggggtccgatcagccagcacaactaccggcccgggtacttcacccaggccgccggcccctggcacctggggaagttagagctcgatttcgacttgtgtgagggtacaacggtcgttgtagatgagcactgtgggaatcgggggccgtcccttcgcaccacgaccgtgacgggtaagatcatccacgagtggtgttgccggagctgcaccttaccgcccctccgcttccgcggggaagatggttgctggtatggaatggagatcaggccggtgaaagagaaggaggagaacttggtgaagtcaatggtaagtgccggtagcggcgaggtggactccttcagtttaggtctgttatgcatttccattatgatcgaggaggtgatgcgttcacgatggtcgcgtcgaatgctcatgacgggcaccctagccgtgttcttcctgctcataatggggcagcttacgtggaacgacttgattaggttatgcataatggtaggcgcgaacgccagcgaccggatggggatgggcaccacgtatcttgccctgatggccaccttcaagatgcgcccaatgttcgctgtaggactcctgttcagacggctgacgagtagggaggtcctactgttaaccatcgggttaagcctagttgcgtccgtggagctgccaaacagcctggaagaactcggcgacgggctcgcgatgggaatcatgatcctcaaactgctaaccgacttccaatcacatcagctttgggccaccctgctgtcacttacgttcatcaaaaccacgttctccttacactacgcctggaagactatggcgatggtcctaagcatagtgagcctctttcccctgtgcctgagcacgacaagtcagaaaacgacttggctccccgttctgctgggctctctgggttgcaagccgctgaccatgttcctgattgcagagaacaagatatgggggcgccggtcctggcccctaaacgaggggataatggcagtaggcatcgtgtccatccttttaagctccctcctgaagaacgatgtgccgctggccggacccctcatcgccggtggcatgcttatcgcgtgctacgtcatcagtggctcctctgccgatttgtctctcgagaaggcggctgaagtgtcctgggaggaagaagctgagcactcgggcgcaagtcacaacattttggttgaggtgcaggacgacgggaccatgaagatcaaggatgaagaacgggacgacaccctgaccatcctcctgaaggccacgctgctcgccgtgtcaggagtgtacccgctcagtatcccagccacgttgttcgtatggtacttttggcagaagaagaagcagcggtcgggggtactctgggacaccccctcaccgcccgaggttgagcgcgccgtgttagatgacgggatctaccggataatgcagaggggcctgctggggcgttctcaggtaggcgtgggggtcttccaggagaatgtattccacacgatgtggcatgtaacacgcggagcggttcttatgtaccaagggaagcggttagaaccaagctgggccagcgtgaagaaggacctgatcagctacggtggcggctggcgtttgcagggtagttggaatacgggagaggaagtacaggtcatcgccgtggaacccgggaagaaccccaagaacgtgcagaccgcccccgggaccttcaagacaccggagggtgaggtcggcgccatcgcactggactttaaaccggggacgagcggctcgcccatcgtcaaccgggagggtaaaattgtcggactgtacggtaatggggtcgtgactacgtcaggcacatacgtgagcgccattgcccaagccaaagcgagccaggaggggcctttaccagagattgaagacgaggtcttcagaaagcgtaacctgacgatcatggacctgcacccaggatccgggaagacccgccggtacctccccgctatcgtgcgcgaggccatcaaacgcaagctgcggacactgatcctcgcgcccactcgggtggtcgccagcgagatggccgaggccctgaagggtatgccgatccggtaccaaactaccgccgtcaagagcgagcacaccggcaaggaaatcgtcgacctgatgtgccatgctaccttcacaatgcgcctcctatcccccgtccgggtgccgaactacaacatgatcatcatggacgaagcacacttcaccgaccctagctcaatcgccgctcgtggctacatctcgacccgggtaggtatgggggaggccgccgcgatattcatgacggcgacgccgcccggcagcgtggaagccttcccgcagagcaacgccgtgatccaggacgaggagcgggacattccagaacgatcatggaatagcgggtatgaatggatcacagacttccccggcaagaccgtgtggtttgttcccagcatcaaaagcggcaatgatatcgccaattgcctgcgcaagaacgggaaacgtgtgatccagctctccaggaagacctttgatacggagtatcaaaagaccaagaacaacgactgggactacgtagtcaccaccgacatcagcgagatgggggcgaacttccgagcggatcgagttatagacccgagacgctgcctgaagcccgtgatcttgaaggacgggcctgagcgggtcatcctcgccggccccatgccggttactgtcgctagtgccgcgcaacgccgggggcggatcggccgcaatcacaacaaggagggcgaccagtacatttacatggggcagcccctgaataacgacgaggatcacgcccattggaccgaggccaagatgctcctcgacaatatcaataccccggagggcatcatccccgcgctgttcgagccggaacgggagaaaagtgcagcgatagatggtgaatatcgcctgcgaggcgaggcccgcaagaccttcgtggagctcatgcggcgcggggacctgcccgtgtggctgtcgtacaaggtagcctcagagggattccagtactccgaccggcgttggtgctttgacggcgagcgcaacaaccaagtcctcgaggagaatatggacgtggaaatatggacgaaggagggggagagaaagaagctccggcccagatggctggacgcccggacctacagtgaccctcttgccctgcgtgagttcaaggagttcgcggcaggacggcggagcgtctccggggacctcatccttgagatcggcaagctgccgcagcatctgacccagagggcccagaatgccctagacaatctcgtgatgctgcacaattccgagcagggcggtcgtgcgtaccgacacgccatggaggaattacccgacaccatcgagacgttaatgttactcgccctgatagccgtgctcaccggcggcgtcacactcttcttcctatccggccgcgggttaggtaagactagcatagggctactgtgcgtgatggcctcgagcgtgttgctctggatggcttccgtcgagccccactggatagcggccagcatcattttagagttcttcctgatggtgctcttaatccccgagccagaccgtcagcggacgccccaggataatcagctggcctacgtggtcatcggtctcctcttcatgatcctgaccgtggccgcgaatgagatgggcctcttggaaacgaccaagaaggaccttgggataggtcacgtggccgtagaaaatcatcaccacgccgctatgctcgacgttgatctgcaccccgcctcagcttggacgctatacgccgtggccacgaccataatcactccgatgatgcgacacaccattgaaaatacgactgctaacataagcctcaccgccatcgctaatcaggccgcgatcctgatgggtctcgacaagggatggcccatcagcaaaatggacatcggcgtacccctcctggccttagggtgttatagccaggtgaatcccctcacattgaccgcggccgttctgatgctcgtcgcccattacgcaattataggcccgggacttcaggccaaggcgacccgggaggctcagaaacgtaccgcggccggcatcatgaagaacccaaccgtggacgggatagtggctattgatctggaccctgtcgtttacgacgcgaaattcgagaaacaactaggccagatcatgctgttaatcctctgcacgtcgcagattctgctgatgcgtacgacgtgggccttatgcgaaagcatcaccttagccacgggtcccctcactacactctgggaggggagccccggcaagttctggaacacgacgatcgccgtgtctatggccaacatctttcgcggctcctacctggcgggtgccgggcttgccttctctctcatgaaatccctcggaggagggcgccgagggaccggagcgcagggcgaaaccctgggcgagaagtggaagcggcaactcaaccaactttccaagagcgagtttaacacttacaagaggtccggaattatggaggttgaccggagtgaggccaaagaggggcttaagcgcggggagaccacaaagcacgcagtttcacggggcaccgccaagttacgctggttcgtggagcgtaatctggtcaaaccggaggggaaggtgatagacctgggctgcggccgcggcggctggagctactactgcgccggactcaagaaggttaccgaggtcaagggatacacgaaaggcggccccggccatgaggagcctatcccgatggccacgtatgggtggaacttagtcaaactgcatagtggcaaggatgtgttcttcattccacccgagaagtgcgatacactgctctgcgatatcggcgagagcagcccaaaccccacaattgaggaggggagaacactgcgtgtcctcaagatggtggagccctggcttagggggaaccagttctgtatcaagatcctgaatccctacatgcccagcgtcgtcgaaacccttgaacagatgcagagaaagcacggcggcatgctcgtccggaacccattgtcccgtaacagcacccacgagatgtactgggtgtcatgcggcaccgggaacatcgtcagcgctgttaatatgacctcacgcatgctgctgaaccgtttcacgatggcccatcgcaagcccacctacgagcgggacgttgatctaggggccgggaccaggcacgtcgcagtggagccggaggttgccaacctggacatcattgggcagagaatagagaacatcaaacacgagcataagagcacctggcactacgacgaggacaacccctacaagacgtgggcgtatcacgggtcctatgaagtaaagccgagcggctctgccagcagcatggtgaacggggtagtgaagctactgacaaagccctgggacgtgattcctatggtcacacagatcgcaatgaccgacacgacacccttcggccagcagcgtgttttcaaggagaaggtagatacccgtaccccgaaggccaagcgcgggacagcacaaatcatggaggtaaccgcgaaatggctttggggcttcctgtcccggaataaaaagccccgcatctgcacccgggaagagttcacgcgcaaagtgcgtagcaacgccgcgatcggcgccgtgttcgttgacgaaaatcagtggaactctgcgaaggaagcagtggaggacgaacgcttctgggacctggtccaccgggagcgagaactgcacaagcaagggaagtgcgcaacgtgcgtctacaacatgatgggcaaacgggagaagaaactcggggagttcggtaaggccaaggggagccgagccatctggtacatgtggctgggagcacggtttctagagttcgaggccctcggcttcatgaacgaggaccactggtttagccgggagaacagcctatccggggtagagggcgaggggctgcacaagctcggctacattttgcgagacatcagcaagattcccggcggtaacatgtatgcagacgacaccgccgggtgggacacccgtattaccgaggacgaccttcagaatgaggccaggatcacggacattatggagcctgaacacgcgctattggccaagagcatcttcaagctcacataccagaacaaggtcgtcagagtccaaagacctgccaaaaacgggaccgtaatggacgtaattagtagaagagaccagcggggatcgggccaggttggaacctacggcctcaacacgttcacgaacatggaagcccaactcattcgccagatggagtcagaagggatattttccccctccgagctagagacccccaaccttgctgaacgggtgctggattggctggagaagtacggcgtcgagcgtcttaaaagaatggcgatctccggagacgactgcgttgtgaaacctatcgacgaccgattcgctaccgccctgacggccctaaatgacatgggcaaggtccggaaagacataccccagtgggagccatcaaaagggtggaacgactggcagcaagtccccttctgcagccaccactttcatcagctgatcatgaaggacggccgcgagatagtggtcccatgccggaatcaggacgagcttgtgggccgtgccagggtgagccagggggccggatggtccctgcgcgagaccgcctgcctcgggaagtcttatgcccagatgtggcagctgatgtacttccaccgtcgcgacttacggttagccgccaacgccatatgctcagcagtccccgttgactggatcccgacctcccgcaccacgtggtctatccacgcccaccaccagtggatgacgaccgaagatatgctttccgtctggaacagggtctggatcgaggaaaacccatggatggaggacaaaactcacatcagctcctggggcgacgtgccgtatctggggaaacgggaagaccaatggtgcggttctctcatcggcttgaccgctcgtgcaacctgggccaccaacatccaggttgccatcaaccaggtccggcgcctgattgggaacgagaactacctcgactatatgacgtccatgaagcggttcaagaacgagagcgaccctgagggcgcgctgtggtga

SEQ ID NO: 24592 - RNA, 9879 nt, synthetic construct
  misc_feature 1..9879: note = derived and/or modified CDS sequence (opt11) from DENV-1__EU482525__SS-prME
  source 1..9879: mol_type = other RNA
tcggtaaccatgctgctcatgctgatgcccacggccctggccttccacctcacgaccaggggtggggagccccacatgattgtgagtaaacaggaacggggcaagagcctgctgttcaagacaagcgccggggttaacatgtgcaccctaatcgctatggaccttggagagctgtgcgaggacaccatgacatacaagtgtccccgcatcaccgaggccgagcccgacgatgtggactgctggtgcaacgctaccgatacgtgggtaacctatgggacttgcagtcaaaccggggagcaccggcgcgacaagaggtccgtggccctcgcgccccatgtgggcctgggtctggagacgcggaccgagacctggatgtcttccgagggggcctggaagcagatccagcgggtcgagacctgggccctccgccaccccgggttcacggtgatcgccctgttcctggcacacgccattggcaccagcataactcagaaggggatcattttcatcctcctgatgctagtgaccccctccatggcgatgcggtgtgtcggcatcgggagccgtgacttcgtggaggggctctccggcgccacatgggtggacgtagttctagagcacggctcatgcgtcaccaccatggccaaggacaagcccaccctggacatcgaattgctgaagaccgaagtcactaatccagcagtgttgcgtaagctctgcatcgaagccaaaatttccaataccaccacggactcacgctgtccgactcagggtgaggccaccctcgtggaagaacaggacgctaactttgtctgccggcgcaccttcgtagaccggggctgggggaacggctgcgggctgttcggcaaggggtccctcataacctgcgccaagttcaagtgtgtgaccaagctggaaggaaagatcgtgcaatacgagaacctgaaatacagcgttatcgtgaccgtccataccggcgaccagcatcaggtggggaacgagtccacggagcatggtaccaccgctacaataacgccgcaggcccccacgaccgagatccagctcactgactacggtgcgctgaccctggactgttcgccccgcacgggcctcgatttcaacgagatggtcctgcttaccatgaaggagaaatcctggctcgtgcacaagcagtggttcctggacctcccgctgccctggaccagcggagcctccacctcccaggagacctggaaccggcaggacctgctggtcacattcaagaccgcccacgcgaagaagcaggaggtcgtggtgttagggtctcaggaaggcgccatgcataccgcgctgaccggagcaacggagatacagacgtccggaaccacgaccatcttcgccgggcatttgaagtgccgcctgaagatggacaagctgaccctgaagggcatgagctacgtcatgtgcaccgggtcctttaagctcgagaaggaggtggcggagacgcagcacggcacggtgcttgtccagatcaagtatgaaggcaccgatgccccctgcaagatcccgttctcaacccaggacgagaagggagtgacgcagaacggccggttgatcaccgccaacccgatagtgaccgacaaagaaaagcccgtcaacatcgaggccgagccgcccttcggggagtcatacatcgtgatcggcgcaggggaaaaggccctcaaattaagctggttcaaaaagggttccagcatcggcaagatgtttgaggccaccgcccgcggggcacgtcgtatggcgatcctgggcgacacggcatgggatttcgggtcgatcggcggcgtgttcactagcgtcggcaagctggtgcaccagatcttcggcactgcctacggagtactcttctccggcgtctcgtggactatgaagatcgggataggagtgttgcttacctggctcgggttgaactcccgcagcaccagtttctccatgacctgcatcgccgttgggctggtgaccctctaccttggcgtcatggtgcaggccgactctgggtgcgttatcaactggaagggtcgtgagttgaagtgcgggagcggcatcttcgtgacgaatgaggtgcacacctggaccgaacagtacaagttccaggcggatagcccgaagcgcctctcggccgccatcggcaaggcatgggaggagggagtctgtggcatccgtagcgccacccgcctcgagaatatcatgtggaaacagatcagcaacgagctgaaccacattctcttagagaatgacatgaagctgacggtggtggtcggggacgtggcgggcattctcgggcagggcaaaaagatgatccggccccagcccatggagtacaagtacagttggaagtcctgggggaaggccaagatcattggtgctgacgcccagaacacgaccttcatcatcgacggccccaacacaccggaatgccccgacgaccagcgggcgtggaatatctgggaggtggaggactatgggttcggaatcttcaccacgaacatttggctgaagctccgggacagctacacgcaggtctgtgatcacaggctcatgtccgccgccatcaaagacagcaaagctgttcatgctgacatgggttactggatcgagtcggagaagaacgaaacatggaagctggcacgggccagcttcatcgaagtgaagacctgcatctggcccaagtcccacactctgtggagcaacggcgtcctcgagagcgagatgatcattcccaagatatacggaggcccaatcagccagcacaactaccgccccggctatttcacccaaaccgccgggccctggcatctgggcaaattagagctcgacttcgacctgtgcgaaggcaccacggtggtggtcgacgagcattgtgggaaccggggaccgtccctgcgaaccaccactgtgaccgggaagatcatccacgagtggtgctgccgctcttgcactctccctcccctacgcttccggggcgaggacgggtgctggtatggcatggaaatacgccctgtgaaagagaaggaagagaacctggtcaaaagtatggtgagcgccggcagcggagaggtagactccttcagcctcggcctactgtgcatttccatcatgatcgaggaggtcatgcggagccgctggagtcggaagatgttaatgactggaactctggccgtgttcttcctgctcatcatgggccagcttacgtggaacgatctaatccgcttatgcatcatggtgggggccaacgccagcgaccgcatgggcatgggcacgacctacctcgccctgatggccaccttcaagatgcggccgatgttcgccgtcgggttactgttccgccgcctgacatccagggaggtgctcctgctgaccatcggcctcagcttagtggcgagtgtagagctgcccaatagcctcgaggagctcggggatggcctggcaatgggcatcatgatcctcaaattgctgaccgacttccagtcacaccaactctgggccaccctactgagcctcacgttcatcaagaccaccttcagcctgcactacgcctggaagaccatggcgatggtgctgagcatagtctccctgttcccgttatgcctgagcaccacttcacagaagaccacatggcttccagtgctgctggggtcgctgggctgcaagccgctgacgatgttcctgatagccgagaacaaaatctggggtcggaaaagctggccacttaacgagggtataatggccgtggggatcgtatcgatcctgctgtcatccctcctgaaaaacgacgtgcccctggccggccccctcatcgctggagggatgctgatcgcctgctacgtgatcagcggttcctctgcagacctatcgctcgagaaagccgcggaggttagctgggaggaggaggccgagcactccggggcgagccacaacatcctggtggaggtacaggacgatggtaccatgaaaatcaaggacgaggagcgggacgataccctgacaatactccttaaggccaccctgttagccgtgagtggggtgtacccgctgagcattcccgccactctgttcgtctggtacttttggcagaagaagaagcagcggtccggagtgctttgggacacccccagcccgccagaagtggagcgtgcagtgctggacgacggcatctaccggataatgcagcgcgggctgctgggcagatcccaggtgggggtaggcgtcttccaagagaatgtcttccacactatgtggcatgtgacccgcggggcggtgctaatgtaccagggcaaacgactggagccctcatgggctagtgtgaagaaagacctgattagctacggagggggctggcgccttcgggggtcctggaacacgggagaggaagtccaagtgattgccgtcgaacccgggaaaaacccgaagaacgtgcagacggcccccggcaccttcaaaaccccagagggcgaggtgggggcgatcgcgctcgacttcaagcccggcacgtcggggtcgccgatcgtcaaccgcgaaggcaaaatcgtgggactgtacgggaacggcgtggtcaccactagcgggacctacgtgagcgccatcgcccaggctaaggcttctcaggaaggcccactccccgagatagaggacgaggtattccggaagcgcaaccttacgatcatggacttgcacccggggagcggcaagacccggcgatacctcccggccatagtccgagaggccatcaagcgcaagctgcgcacattaatccttgcgcccacccgggttgtggctagtgagatggcggaggccttaaagggcatgccaatccgctaccagactaccgcggtcaagagcgaacatactggcaaggagatagtagacctcatgtgccacgcgaccttcacgatgcggctcctttcgccagtgcgcgtcccgaattacaacatgatcatcatggatgaggcgcacttcaccgacccatcttccatcgcggcccggggctacataagcacccgcgtgggcatgggcgaggccgcagccattttcatgaccgcgactccgcccgggagcgtggaggcctttccgcagtctaacgcagtcatccaggacgaggaacgggatatccccgagcgctcctggaactcgggatacgagtggatcaccgactttcccgggaagaccgtttggttcgttccgtccatcaagagcgggaacgacatcgccaactgcttgcggaagaacggcaagcgcgtcattcagctctcccggaagactttcgacacggagtaccagaagaccaagaataacgattgggactacgtggtcaccaccgacatcagcgagatgggggcaaacttccgggcagaccgggtcatcgatccgaggcgttgcctaaagcccgtgatccttaaggacgggccggagcgcgtgattctcgccggacccatgccggtcaccgtcgcctccgccgctcagcggcgcggccggatcggcagaaaccacaacaaggagggggaccaatacatctacatgggccagcccctcaacaatgacgaggaccacgcccactggaccgaggccaagatgttattagacaacatcaatacccccgaggggataatccccgccctgtttgagcctgagcgcgaaaagtccgcggcggtcgacggagagtaccggctgcgcggggaggcccggaagaccttcgtggagctcatgcggcgaggcgacctgcccgtatggctgtcatacaaggtcgccagcgagggtttccagtacagcgaccgccggtggtgcttcgacggggaacgcaacaatcaggtgctcgaagagaatatggacgtggagatctggacgaaggagggtgagcggaagaagctacgcccacggtggctggacgcccgcacctactccgacccgttagccctgcgggagtttaaagagttcgcggccggccgccggagcgtttccggggatctgatcctcgaaatcggtaaactgccgcagcacctgacgcaacgcgcccagaacgccctagacaatttggtcatgctgcataacagcgagcaaggcgggcgtgcttacaggcacgccatggaggagctccccgacactatcgagacgctgatgctgctcgccctgatcgccgtgttaacagggggcgtcaccctcttcttcctatctgggcggggtttgggcaagaccagcatcgggctcctgtgcgtgatggcctcctcggtgctgctctggatggcgtccgttgagccccactggatcgccgccagtatcatcctagagttcttcctcatggtgctgctgatccccgagccggacaggcagcggacaccacaggataatcagctggcctacgtggtcatcggcctcctgttcatgatactgacggtggctgcgaacgagatggggctattggagaccaccaagaaggacctgggcatcggtcacgtagccgtggagaaccatcatcacgccgccatgctcgacgtcgacctgcacccagcctctgcgtggaccctgtatgccgtggcgacgaccatcatcaccccgatgatgcgccacacaatcgagaatacgaccgccaatatctcattaaccgctatcgcgaaccaagcggccatcctgatgggcctggacaagggatggccaatcagtaaaatggacatcggggtccccctcctggccctgggctgctactcacaagtgaaccccctcaccctgaccgcggcagtactgatgcttgtcgcccactacgccatcataggtccggggttacaggccaaggcgacacgcgaggcccagaagcgaactgctgccgggattatgaagaaccccaccgtggatggcatagtggccatcgacctggaccccgtcgtgtacgatgcgaagtttgagaaacagctcggccagatcatgctgctaatcttatgtacttcccagatattattgatgaggaccacctgggccctctgtgaaagcataacgctggctactgggcccctgaccacactctgggaaggctcccccggtaagttctggaataccactatcgccgtcagcatggccaacatcttcaggggctcctatctggcgggcgccggactcgccttcagcctcatgaaatccttagggggcggtcgccggggtaccggtgcccagggcgagaccctgggagagaagtggaagaggcagctcaaccagctgtccaagtcggagttcaacacctacaagcggtccggcataatggaggtcgataggtcagaggcgaaagagggattgaagagaggggaaactaccaagcacgcggtgtccagagggaccgccaagctccggtggttcgtggagcggaacctggtcaaacccgagggaaaggtaatcgacctgggctgcgggagaggcggatggagctactattgcgcgggcctgaagaaggtgaccgaggtaaagggatacacgaagggcggaccagggcatgaggagcccatcccgatggccacctacggctggaacctcgtgaaactgcactcggggaaggacgtgttcttcattccaccggagaaatgcgataccctgctatgcgacatcggcgagagctccccaaaccctaccatcgaggagggacgcaccctgcgcgtcctgaagatggtggagccctggctccgcggcaaccagttctgcatcaagatcctgaacccctacatgcccagcgtggtcgaaaccctggagcagatgcaacggaaacacggcggaatgctcgtacgcaacccgttgtcccgaaacagcactcatgagatgtactgggtgagttgcggcaccgggaatattgtgagcgcggtgaacatgaccagccgcatgctgctcaacaggttcacgatggcccatcgaaagcccacctacgaacgcgacgtggacctcggaaccggcacccggcacgtggccgttgagcccgaggttgccaacctggacatcatcgggcagcgaatcgagaacatcaagcacgagcacaaatctacgtggcattacgacgaggataacccgtacaagacttgggcctaccatggctcttacgaggtcaagccgagcgggtccgcaagcagcatggtgaacggcgtggtgaaactcctgacaaagccctgggatgtgatcccgatggtcacccaaatcgccatgacagacaccacccccttcgggcagcagcgagtgttcaaagaaaaggtggacacacgtaccccgaaagccaagcggggaaccgcccaaatcatggaggtcaccgcccgctggctgtgggggttcctttcacgcaacaaaaagccccgcatctgcacccgggaggagttcacccgcaaggtgcggagcaacgctgcaatcggagcagtgttcgtagatgagaaccagtggaactccgctaaggaggctgtggaagacgagaggttctgggaccttgtccaccgggaacgcgagctgcataagcaggggaagtgtgcgacgtgcgtgtacaacatgatggggaagcgtgaaaagaaacttggcgagttcgggaaagcgaagggaagccgcgccatttggtatatgtggctgggcgctcggttcctggagttcgaggcgctcggcttcatgaacgaggaccactggttctcccgcgagaacagcctgtccggcgtggagggagaaggcctgcacaaattaggctacatcctgcgggacatctctaaaatacccggcggcaacatgtacgccgatgacaccgccggctgggatacccgcatcacggaggacgacctgcagaacgaggccaagatcacggatatcatggaaccggaacacgccttactcgcgaaggcaatcttcaaactgacttaccaaaacaaggtggtacgcgtgcagagacccgccaagaacggaaccgtgatggacgtgatcagtcgccgggaccaacgcgggtcaggtcaggttggcacgtatgggctcaacacatttaccaatatggaggcccagctgatccggcaaatggaatccgagggcatctttagtccttccgagttggagaccccaaacctcgccgagagagctctggactggctggagaaatacggaatcgagcggctcaagcgaatggcaatttccggcgacgactgcgtggtcaagccgatagacgaccgtttcgcaacggccctgaccgcgctgaacgacatggggaaagtacgcaaggacatcccgcaatgggaacccagtaagggctggaacgattggcagcaggtccccttctgcagccaccacttccaccagctcatcatgaaggacgggcgggagatcgtcgtaccgtgccgaaaccaggacgagctggtagggcgggcacgcgtgtcccaaggcgccggatggtcactgcgagagaccgcctgcctcggcaagagctacgcccagatgtggcagttgatgtacttccaccgcagagatctacgcctcgcggccaacgctatctgctcagccgtgcccgtagactgggtccccaccagcagaacgacctggagtatccatgcacatcaccagtggatgaccaccgaggacatgctgagtgtgtggaaccgggtgtggatcgaggagaatccctggatggaagacaagacgcatatctccagctgggaggacgtcccgtatcttggcaagcgcgaggaccaatggtgcggatccctcatcggcctgaccgcccgggccacctgggccactaacatacaagttgccattaaccaggtgcgccgcctgatcgggaatgagaactacctcgactacatgaccagcatgaagcgattcaagaacgagacggaccccgagggcgccttgtggtga

SEQ ID NO: 24593 - RNA, 9879 nt, synthetic construct
  misc_feature 1..9879: note = derived and/or modified CDS sequence (opt11) from DENV-1__EU482526__SS-prME
  source 1..9879: mol_type = other RNA
agtgtaacgatgctcctaatgctaatgccgaccgcgctggcatttcatctcacaacgcgcggcggcgaaccacatatgatagtcaccaaacaagaacgcgggaaatccctgctattcaaaacctctgcgggtgtaaacatgtgcacactaatcgctatggacctcggcgaactgtgtgaggatacaatgacgtacaaatgcccccgaataaccgaagcagaacccgacgacgtggattgctggtgtaacgcaactgacacctgggtaacctacggaacctgcagtcagacaggggagcatcgacgagacaaacgaagcgtagcactcgccccacacgtcgggcttggcttagaaacgagaacagaaacctggatgagctcggagggagcctggaaacaaatacaaagagtcgagacgtgggcgttaaggcacccaggtttcacagtaatcgcgctctttctggcccacgcaataggcacatcgatcacacaaaagggcataatcttcatcctattgatgctcgtcacaccaagtatggcaatgcgctgcgtcgggatcgggtcgcgagattttgtggaaggcctctcaggagcgacgtgggtcgacgtagtccttgaacatggtagctgcgtcacaacgatggccaaggacaaaccaacgctagacattgagctgctaaaaaccgaggtcactaacccagccgtacttcgaaagctgtgtatagaggctaaaatcagcaacacaacaaccgacagcagatgcccaacccaaggagaagctaccttgatggaagaacaagacgctaatttcgtgtgcagacggacgttcgtagacaggggatgggggaacggctgcgggctgtttggaaaaggaagcctcatcacatgcgcaaagttcaagtgcgtcacaaaacttgaaggcaaaatcgtccaatacgaaaatctaaaatactcggtaatagtgacggtgcacacgggcgaccaacaccaagtcggcaacgaaagcaccgagcacggaaccaccgcaaccataacaccccaagcaccaacatcggaaatccaactcacagactacggagcactcacactagactgtagcccccgtaccgggctagacttcaacgagatggtcttacttactatgaaagagaaaagctggctcgtccacaagcaatggttccttgatctaccactaccctggacgagcggggcatccacctcccaggagacctggaacaggcaggacctccttgtgaccttcaaaacggcccacgccaagaaacaagaggtggtcgtgctgggatcccaagagggagcaatgcatacagcgctcactggcgcaacggaaatacagacctccggcaccacaacaatatttgcagggcacctcaaatgccgactgaagatggacaagctgactctaaaagggatgtcctacgtaatgtgcacgggcagctttaaactagaaaaagaagtcgcggaaacccagcacgggacggtactggtccaaataaaatacgaagggacggacgcaccgtgcaaaattccattttcaacccaggatgagaaaggcgtaacacaaaatggacgcttgataacagccaaccccattgtaaccgacaaagaaaagccagtcaacatcgaagcagaaccaccctttggagagagctacatagtcataggagccggcgagaaggcgctaaagctatcgtggtttaagaaagggtcgagtataggcaagatgttcgaggcaaccgctcgcggcgcgagacgtatggcaatactgggagatactgcatgggactttggcagcataggaggggtcttcacaagcgtcggaaagctggtacaccaaatcttcggtacagcctacggcgtgctattctcaggcgtatcttggacgatgaagattggcataggagtactcctgacctggttagggctcaatagtagatccaccagtctgagtatgacctgtatcgccgtcggtctggtcacattgtatctgggggtcatggtgcaagccgactctggctgcgttatcaattggaaagggcgcgagctcaaatgcggatcggggattttcgtgacaaacgaagtgcacacttggacagagcagtacaaatttcaggccgacagccccaaacgactcagcgcggctatcggcaaggcctgggaggagggtgtttgcggaatccgatccgccacgaggctcgagaacataatgtggaaacaaatctcaaacgagctcaatcacatcctcctagaaaacgatatgaaattcacggtagtagtgggcgacgtggtcggaatccttgcccaaggcaagaaaatgatccgcccgcaacccatggaacacaaatactcctggaagagttggggtaaagctaagatcatcggagccgatgtccagaacacgaccttcattatcgacgggccaaacacgcccgagtgtcccgatgatcaaagagcctggaacatatgggaagtagaagactacgggttcggaatattcaccaccaatatttggctgaagctccgcgatagctacacacaggtgtgtgaccaccggctcatgtcagcggctataaaagatagcaaggccgtccacgccgatatgggctactggattgaaagtgaaaagaatgagacctggaagctagcaagggctagcttcatcgaagtcaaaacctgcatatggccgaagtcgcataccctatggagcaacggtgtgttggaaagcgaaatgataataccaaagatatatgggggcccaatttctcaacacaattaccggcccggatacttcacacaaactgccggaccgtggcatctaggcaagctcgagctcgatttcgacctatgcgaaggcaccactgtggtagtggacgagcattgcggcaaccggggcccgtccctgcgcacgacgaccgttaccgggaaaataatacacgaatggtgttgccggagctgcaccttgccccctctacgattcaaaggtgaagacggttgctggtacggaatggagatcagaccagtcaaagagaaagaagaaaacttagtaaagagcatggtcagcgctggtagcggcgaggtggattcatttagcctcgggttgctctgcatctcaataatgatagaagaagtgatgcgatcaagatggtccagaaaaatgttaatgacagggactctcgccgtttttctactgctcataatgggccaactcacatggaacgacctgatacgcctatgcataatggtcggagccaatgcaagcgatcgaatgggtatggggacgacttatttagcgctgatggcaacattcaaaatgcggcccatgttcgcggtgggcctgctatttagaagactaacttcccgggaagtcctcctgctaaccatcggcctcagtctcgtggcatcggtagagctccccaactctttagaggaactaggggacggactcgccatgggtattatgatcctcaaactactcacggatttccaatcgcaccaactatgggcaaccctactctcactaacatttataaaaacaaccctgtccctacactacgcctggaagacaatggcgatggtactcagcatagtgagcctatttccactatgtctgtccacaacaagtcagaaaaccacctggctaccagtactgctgggcagcctcggatgcaagccactgacaatgtttttaatagctgaaaacaaaatctggggccggaagtcgtggcctttgaacgagggcataatggcggtaggagtcgtctccatactgctcagctccctcctcaaaaacgacgtaccgcttgcagggccgctgatcgccggcggaatgctcatcgcatgttatgtcatatcaggcagctcggccgacctgtcactggagaaggcggctgaggtgagctgggaagaagaggcggagcattccggcgctagccacaacatcctagtggaagtccaagacgacggcacgatgaaaattaaagacgaggagcgggatgacacgctcacgatcctgctgaaggcaacacttctagcagtatccggagtctacccgctaagcataccagcaactcttttcgtctggtacttctggcaaaagaagaaacagcgatccggggtcctatgggacacaccgagtccacccgaagtcgaaagagcagttctcgacgatggtatataccgtataatgcaacgcggcttacttggcagaagccaagtgggcgtgggcgtctttcaggagaacgtttttcacacaatgtggcacgtaacgcgcggggcggtccttatgtatcagggcaaacgtctcgaaccgtcctgggccagcgtgaagaaggacttaatatcttacggagggggctggcgcttgcagggcagttggaacacgggagaagaagtgcaagtcatagctgtagagccgggtaagaacccgaaaaacgtacaaacggctcccgggaccttcaagacgccagaaggagaggttggggccatcgccttggacttcaaaccgggtacgagcggctcaccgatcgtaaacagggaaggcaagattgtgggcctctacggcaacggcgtggtaactacatcaggcacatacgtcagcgccatcgcgcaagcgaaagccagtcaagaaggccccctcccagaaatcgaagacgaggtatttcgcaaacgaaacctaaccatcatggatttgcacccgggatccgggaaaacgcggcgatatctccccgcgatcgtgcgtgaagcaataaagcggaagctcagaacgttaatactagcgccgacccgggtcgtagcaagtgaaatggccgaagcactaaagggcatgccaattagataccagacgactgccgtgaaaagcgagcacaccggaaaggagatagtggacctcatgtgccacgcaacatttacaatgcgcctccttagtccggtgcgagtcccgaattacaacatgataataatggatgaagcacacttcaccgacccgagcagcatagcagccagaggctacataagtacccgcgtcgggatgggggaagcggctgcaatattcatgaccgcaacaccacccggctcggtagaggcgttcccccaaagtaacgccgtcatccaagacgaggagcgtgacatcccagagagaagctggaacagcggctacgaatggatcactgattttccaggaaagaccgtttggttcgtaccctccatcaagtccggcaacgacatagccaactgcctcaggaagaacggcaaaagagtaatacagctcagtagaaagaccttcgacacagaatatcagaaaacgaaaaacaacgactgggattacgtggttacgaccgatatttccgaaatgggcgcgaatttcagagccgatcgggtaatagaccctcggagatgccttaaacctgtcattctcaaagacgggcccgaacgggtgatcttagcgggcccaatgccggtcacagtggcgtctgcagcacaaaggagaggccgaataggccgaaaccacaataaagaaggcgaccaatatatatatatgggccagccactcaataacgacgaggaccacgcacactggacagaggccaaaatgctgctagacaacatcaataccccagaggggatcatcccggcactcttcgaaccggaacgggaaaaatctgctgcgatcgacggtgaataccgactgagaggggaggcacgcaagacctttgtagagttaatgcgaaggggagatctaccagtatggctcagctacaaagtcgcatccgagggcttccaatatagcgaccggagatggtgttttgacggggagaggaataaccaagtcctagaggagaacatggacgtcgagatatggacaaaggagggcgaaagaaagaaacttaggccccgatggctagacgcccggacatacagcgacccccttgccctgagagaatttaaggagttcgccgcaggacgcaggagcgtctcaggtgacctgatattagagatcgggaaacttccacaacatctaacacagcgagcccagaatgcactggataaccttgtgatgctccacaattccgagcaaggagggcgagcatatagacacgcaatggaagagttaccggacactatagaaacactcatgctgttggcgctcatcgccgtactcactggaggggttaccctcttcttcctaagcggacggggactagggaagacaagcataggcctactctgcgtgatggcctctagcgtcttactctggatggcttctgtggaaccgcattggatcgctgccagcatcattctagagttctttctgatggtgcttctcatacccgaaccggacaggcagcgaactccccaagacaatcaactcgcatatgtcgttatcggactgctattcatgatcttaaccgtcgccgcaaacgaaatggggctcctagaaaccactaagaaagacctaggaatcggacacgtcgcggtagaaaaccaccaccacgccacaatgttggacgtagacctccacccagcctcagcctggaccctctacgcggtcgccacaactataataactcccatgatgcgacacacaattgagaacaccacagccaacatatcgctaaccgcaatagccaatcaagccgcaatcttgatgggactagacaagggctggcccataagcaaaatggacattggagtcccattgcttgccctaggatgctactcccaggtgaatccactcactttaactgcggccgtcctcatgttggtagcccactacgcaatcataggaccaggactccaagccaaagcaacacgggaagcgcaaaaacgaacggcagcaggcattatgaaaaacccgacagtcgacgggatcgtcgccatcgaccttgacccggtagtctacgacgcaaaattcgagaaacaactcgggcaaataatgttacttatcctctgcacatcacaaatactcttgatgcgcacgacctgggctctgtgtgagtccatcacccttgcaaccggtccccttactaccctttgggaaggttcgccgggcaaattctggaatacaacgatagctgtgagtatggcgaacatcttccgtggaagctacctcgccggcgctggcctagccttctccctaatgaagtcgttagggggcggtaggagaggcacaggcgcccaaggagagacgctgggagaaaaatggaaacgacagctgaaccaactaagcaagagcgagttcaacatttacaagcggagcggaataatggaagtggacagaagtgaggccaaggaagggttgaaacgaggtgagacgacaaggcacgctgtttcacgcggtactgcgaagctaagatggtttgtagaacgcaacctcgtcaaacccgaaggcaaagtcatcgatctaggctgcggccgaggaggctggtcgtactattgtgcgggcctaaagaaagtcactgaagtaaagggatacacgaagggaggcccaggccacgaagaacctatcccgatggctacctatggatggaacctggtgaaactccacagcggcaaggacgtattctttacaccacccgagaaatgcgatacactactttgcgacataggagagagtagtcccaacccgaccattgaagaaggccgaacactgagggtgctcaagatggtcgaaccgtggctccgaggaaaccaattctgcatcaagatcctaaacccgtacatgccgtcagttgtagagacgctggaacagatgcagcgcaagcacggagggatgctcgtcaggaaccccctatcacgtaactctacccacgaaatgtactgggtctcctgcggaacaggaaatatcgtttctgctgtcaacatgacatctagaatgctactgaatcggttcaccatggcacaccggaaacctacatacgaaagagacgtcgatctcggcgcagggaccagacacgtagcagtagagcccgaggttgccaacctcgacatcattggccagcgcatagagaacatcaaacacgagcataaatcgacttggcactacgatgaagataatccctacaaaacatgggcgtatcacggttcgtacgaggtcaagccctctggcagcgcgagcagtatggtaaacggcgtggtgaaactactaacaaagccatgggatgtaatcccgatggtcacacaaattgctatgacggacacaactccgttcggccagcaacgagtattcaaagaaaaagtggatacacgaacgccaaaagcaaagcgcgggacggcccagataatggaagtcaccgcacgctggctatggggcttcctaagccgaaataagaaaccacggatttgcacgcgtgaggagttcaccagaaaagtccgctcaaatgccgccattggcgccgtattcgtcgacgagaaccaatggaactccgcaaaagaggcagtagaggacgagcgcttttgggacctcgtccaaaaggaacgggagctacacaaacaagggaaatgtgcgacatgtgtctacaacatgatgggcaaaagggagaagaaactcggtgaatttggaaaagcaaagggcagcagagcaatatggtacatgtggctcggagcaagatttctggagttcgaggccttaggatttatgaacgaagaccactggttctcaagagaaaattccctaagcggagtcgaaggcgaaggcctacacaagctgggatacatcctaagagatatctccaaaattccaggaggcaacatgtatgctgacgacaccgctgggtgggacacgcgaatcacagaagacgacctacaaaacgaagcgaagattaccgacataatggagccggaacatgcccttctagccacgtcaatattcaaattaacttaccaaaataaggtggtccgagtgcaacgaccggctaagaacgggaccgtgatggacgtcatatcacgacgagatcaacgcggctcaggtcaagtagggacatacggtctcaacaccttcaccaacatggaagcacaattaatccgccagatggaatccgagggtatctttagcccgagcgagctcgaaataccaaaccttgcagagagggttctcgactggctggagaaatacggggtcgaacgcttaaaacgtatggccatatcgggagacgactgtgtggtcaagcccatcgacgacaggttcgcgacggcactcaccgcactcaacgacatgggcaaagtcagaaaggacgtgccccagtgggaaccttctaaagggtggaatgattggcaacaagtccccttctgtagccaccattttcaccaactaataatgaaggatgggcgagaaatagtagtaccatgccgaaaccaagacgagctagtcggcagggcaagagtaagccaaggagcaggctggtcgctacgggaaacggcttgcctgggcaaaagctacgcacaaatgtggcaattgatgtactttcaccggagagacctgagactcgccgcaaatgccatctgctccgcggttccggtagattgggtcccgacatcgagaacgacatggagtatacacgctcatcaccagtggatgacgacggaagacatgctgtccgtgtggaaccgcgtctggatagaggaaaatccatggatggaagataaaacccacgtcagtagctggggagacgttccatacctaggaaaaagggaagatcagtggtgtggaagcctcatagggctgacagcccgagcaacttgggcctctaacatacaagtagccataaatcaagtacggcgcctaatcgggaatgagaattacctggactacatgaccagtatgaagcgattcaagaacgagggggatccagagggcgctctgtggtag

SEQ ID NO: 24594 - RNA, 9879 nt, synthetic construct
  misc_feature 1..9879: note = derived and/or modified CDS sequence (opt11) from DENV-1__EU482527__SS-prME
  source 1..9879: mol_type = other RNA
agcgtgaccatgctgcttatgctgatgcccaccgcactggcatttcacctcaccacccgcggcggggagccacacatgatcgtgagcaagcaagagcgcggaaagtcgctgctgttcaaaacctccgcaggtgtcaacatgtgcaccctcatcgccatggacctgggcgagttctgtgaggacacgatgacctataagtgcccccgcattacagaagccgaaccggacgacgtagactgttggtgcaatgccacggacacgtgggtgacctacggcacgtgcagccagaccggtgagcaccggcgagacaagcgctccgtggccctggcgccccacgtgggcctcgggctggagacgcgcacggagacttggatgagctcggagggcgcctggaagcaaattcagcgggtcgagacctgggcccttcgccacccggggtttacggtgatcgctctcttcctggcacacgccatcgggacaagcatcacccagaaggggattatcttcatcctgctgatgctagtgaccccctccatggccatgaggtgcgtcggtatcggcagccgcgacttcgtggaggggctgtcaggcgcaacgtgggtggacgtcgtgctcgagcacgggtcctgtgtgaccactatggccaaggacaagccaactttggatatcgagctgcttaaaacagaggtcaccaaccccgcggtgctgcggaagctatgcatcgaagccaagatctcaaacaccaccacggacagccgctgccctacccaaggcgaagcaaccctcgtggaggagcaggacgccaactttgtctgccggcgcacctttgtggaccggggctgggggaacggatgcggcctgttcggaaagggctccctgatcacgtgcgccaagttcaagtgcgtgaccaagctcgaggggaagatcgtccagtacgagaaccttaagtatagtgttatagtgaccgtacacaccggcgatcagcaccaagtggggaacgaaagtacggagcacggcaccaccgcgaccattacgccccaagcccctagcacggaaattcagctaaccgactatggggcgttgacactggactgctctccccggacaggcctggatttcaacgagatggtcctcttaacgatgaaagagaaatcgtggctggtgcacaagcagtggttcctcgacctgccactgccctggacgagcggggcatccaccagccaggagacttggaaccggaaggacctcttagtgacgttcaaaactgcgcacgcgaaaaaacaggaggtcgtggtgctgggctcccaggagggagccatgcacaccgccctcaccggggccacggagatccagacctcgggcaccaccacgatcttcgccggacacctgaaatgtcgcctgaagatggacaagctgaccctgaaaggcatgagctacgtcatgtgcaccgggagctttaagctggagaaggaggtggcggagacacagcacggcacggtgctcgtacagatcaagtacgaaggcaccgacgccccatgcaagatccccttctccacccaagacgggaagggggtgactcagaacgggcgattgatcacggccaacccgatcgtgaccgacaaggaaaaacccgtcaatatcgaggccgagccccccttcggcgagagctacatcgtaataggcgcgggggaaaaggccctgaagctgtcatggttcaaaaagggcagctccatcgggaaaatgttcgaagccacggcccgcggcgccagacgcatggcaatcctgggggacacagcctgggacttcggaagcataggtggtgtattcacttccgttggcaagttggtgcaccaaatctttgggaccgcctacggcgtgctgttcagcggggtctcgtggacgatgaagatcggcatcggagtgttgttaacctggctgggtttaaatagccgctccacgagcctgtccatgacgtgcatcgctgtggggctggtgaccctctacctgggggtgatggtgcaggctgacagcggctgcgtcatcaattggaaggggcgagagctgaagtgcgggagcggcatcttcgtgaccaacgaggtccatacgtggaccgaacagtacaagttccaggcggattccccgaagcgcctcagtgccgctatcgggaaggcgtgggaggaaggcgtgtgcgggatccggtccgcaacccgcctggagaacattatgtggaaacagatcagcaatgagctgaaccacatcttgctggaaaacgacatgaagttcaccgtggtggtaggcgacgtggcggggatcttggcccagggcaaaaagatgatacggcctcagcccatggagtacaagtactcctggaagtcctggggcaaggccaagatcatcggggcggacgtgcagaataccacgttcatcatcgacggccccaacaccccggagtgtcccgacgaccagcgcgcgtggaacatctgggaggtcgaggactacggctttggcattttcaccaccaacatttggctcaagttacgggactcatacacccaggtgtgcgaccaccgcctgatgagcgccgcgatcaaagattccaaggccgtgcacgctgatatgggatactggatcgagtcggagaagaacgagacatggaagctcgcgcgggcctccttcatcgaggtcaagacgtgcatctggcccaagtcccacactctatggtcgaacggggtgttagagagcgagatgattattcccaagatctacggcggaccgatctcgcagcacaactacaggccgggctattttacgcagaccgccgggccgtggcatcttggcaagctcgagctggacttcgacctctgcgaaggtactacagtggtcgtggacgagcactgcgggaaccggggaccgagcctgcgcacgaccacagtgaccggaaagattattcacgaatggtgttgccggtcctgcactctgccgcccctgcgcttcaagggagaggacgggtgctggtacggcatggaaatccggcccgtaaaggagaaggaggagaacctggtgaaatcgatggtgtctgccggatcaggggaggtcgacagcttctccttgggcctcctgtgcatctcgatcatgatcgaagaggtcatgcgcagccgatggagccgcaagatgctgatgacagggaccttggccgtgtttttcctgctaataatggggcaactcacatggaacgacctgattcggctgtgcatcatggtcggtgcgaatgcatccgatcgaatgggcatgggaaccacctacctcgccctgatggcgactttcaaaatgcgcccgatgttcgcagtggggctcctgtttcggcgcctgacctcaagagaagtgctgttactcacgatcgggctgtccctcgtcgctttcgtggagctgccaaacagcctagaggagctcggggacggcttagccatgggcattatgattctgaagctcctcaccgacttccagtcccaccaattatgggccaccctcctgagtttaacctttatcaagacaaccttctccctgcactacgcctggaagaccatggcgatggttctgagcatcgtgtccttgttccctctctgcctcagcaccacgtcacagaaaaccacgtggctgcccgtgttgctgggtagcctggggtgcaagccgttaacaatgttccttatcgccgagaacaagatctgggggagaaagtcctggcccctgaacgagggcatcatggccgtaggcatcgtgtctatcctcctgagcagcctgctcaagaacgatgtgcccctggccggccccctgatagcgggcggcatgctcatcgcgtgctatgtgataagcggctccagcgcggatctatcactggagaaggcagctgaggtgagctgggaggaggaagctgaacactccggagcgagccataacatcctcgtagaagttcaagacgatggcacgatgaaaataaaagacgaggagagggacgacacgctgaccattctgctcaaggccacactgctggcggtgtccggggtgtatccactctccattcccgccaccctgttcgtctggtatttttggcaaaagaagaagcaacgctccggtgtgctatgggatactcccagcccgcccgaggtggagcgggcagtactggacgacggcatctaccgcatcatgcagcgggggctgttaggccgctcccaggtgggggttggcgtcttccaggagaacgtcttccacaccatgtggcacgtgacacgcggggctgttttgatgtaccaaggcaagcgcctagagcctagctgggcctccgtgaagaaggatctgatcagctacggcgggggttggcggctccaagggtcctggaacactggcgaagaggtgcaagttatcgccgtggagcccgggaagaaccccaagaatgtgcagacggctcccggcaccttcaagacctccgagggcgaggtgggggccatagcgctcgatttcaagccaggcacttccgggagccccatcgtgaaccgagagggaaaaatcgtgggcctttacgggaacggcgtcgtaacgaccagtgggacctatgtaagcgccatcgcccaggccaaggcctcacaggagggccccctgccggagatcgaggacgaggtctttcgtaagcgcaacctcaccatcatggacctgcacccggggtccggcaagacacggcgctacctgcccgccatcgtccgcgaggctatcaagcgcaagctccggaccctgatcctggcccccactcgcgtggtcgcgagcgaaatggcggaggccctcaagggcatgcccatccgctatcagaccactgccgtgaagagtgagcacaccgggaaggagatcgtggatcttatgtgccacgccaccttcacgatgcggctattaagccccgtgcgagtgcccaactacaacatgatcatcatggacgaggcccatttcacggacccgtccagcatcgccgcccgtggatacatatccacacgcgtggggatgggcgaggccgcagccatcttcatgacggctactcctcccgggagcgtcgaggccttcccccagtccaatgctgtgatccaggacgaggagcgggacatcccggagcgcagctggaactccggctacgaatggatcacggacttcccgggcaagaccgtgtggttcgtacccagcatcaaatccgggaacgacatcgccaattgcctgcggaaaaacggcaagcgagtcatacagctgagccggaagactttcgacaccgagtaccagaagacgaagaacaatgactgggactatgtggtaacgaccgacatctcggagatgggggcgaactttcgcgccgaccgagtgattgatccccgacggtgtttgaagccggtaatcctgaaagacggccccgaacgcgttatcctagccgggcccatgcccgtaaccgtcgcaagcgccgcccagcggcgcggccgcataggacgcaaccacaacaaggagggggaccagtatatctacatgggccaaccgctcaacaacgacgaggaccacgcgcactggacggaggccaagatgctgctggacaacataaacacccccgaggggatcattcccgccctcttcgaacccgagcgcgagaagtccgccgcgatagacggcgagtaccgcttacgcggggaggcacggaagacattcgtcgagctgatgcgccggggcgacttgccagtgtggctgagctacaaggtcgcctcagagggattccagtacagcgaccgcagatggtgctttgacggcgagagaaataaccaggtgctggaagaaaacatggatgtagagatctggacgaaggagggtgagcggaagaagctccgcccccggtggctcgacgctcgtacgtatagcgaccccctggccctccgggagtttaaggagttcgcggccgggcgccggagcgtcagcggcgacctgatcctggagatagggaaattaccccagcacctgacccagcgcgcccaaaacgccctggacaacctcgtgatgcttcacaacagcgagcagggagggcgggcgtaccgacatgccatggaggagctgcccgacacgatcgagaccctcatgctgctggccctgatcgccgtgctgacggggggcgtcaccttatttttcctgagcgggagggggctcggcaagacctccatcgggctgctctgcgtgatggccagctccgtgctgttatggatggcgagcgtcgagcctcattggatcgccgcttccatcatactcgagtttttcctgatggtactgctcatccctgagcccgaccgccaacggaccccgcaagacaaccagctggcctacgtggttatcggtctcctcttcatgattctgaccgtggccgccaacgagatggggctgctcgagacgaccaagaaggacctgggcatagggcacgtggcggtcgagaaccaccaccacgcggcaatgctggacgtagacctccacccggccagcgcgtggacgctgtacgctgtcgccaccacgatcattacccccatgatgcgccacacgatcgagaacaccacggccaacatctccctgacggccatagcgaaccaggccgccatattaatgggcctggacaaagggtggccgatcagcaaaatggatatcggggtccccctgctcgccttaggatgctattctcaggtgaatcccctgactctcaccgcggcagtactgatgctggtcgcccactacgccattatcggccccggcctccaggccaaggccacgcgggaggcccagaagcgcaccgccgccgggattatgaaaaaccccaccgtcgatggcatagtcgccatcgacctggaccctgttgtgtacgacgcgaagttcgagaagcaactgggccagatcatgctcttaatcctgtgcaccagccaaatcttgctcatgaggacaacctgggccctgtgcgagtccatcaccctcgccactgggccccttacgaccctgtgggagggctcccctgggaagttctggaacaccaccattgccgtgtccatggccaacatttttagaggcagctacttagccggcgccggacttgccttcagcctgatgaagtccctcggcgggggccgacgagggacgggagcccagggcgagaccctgggggaaaagtggaagcgccaactcaaccaattgagcaagtccgagtttaacacctacaaacggtctggcatcatggaggtcgaccgttccgaagcgaaggaagggcttaagcgtggcgaaaccacgaagcacgccgtgagccgggggacagcgaagctgcggtggttcgtggagcgcaacctcgtcaagccggagggcaaggtgatcgacttgggatgcggccgtggcgggtggtcgtactactgcgctggcctaaagaaggtgaccgaggtgaaggggtataccaagggcggtcccggacacgaggagcccattcccatggctacgtacggctggaatctcgtgaaactacactcggggaaggacgtgttcttcatcccgcccgagaagtgcgacaccctgctgtgcgacattggcgagtctagccccaaccccactatagaagaaggccgcaccttgcgcgtcctaaagatggtggagccatggctgcgaggcaaccagttctgtatcaaaatcctcaacccctatatgccctccgttgtcgagacgctggagcagatgcagcggaaacatggcgggatgctggtgcgcaatcccctcagccggaatagtacacacgagatgtactgggtcagctgtgggaccgggaacatcgtgtcagcggtgaacatgaccagccggatgctgttaaatcggtttacgatggcccaccgcaagccgacgtacgagcgcgacgtggacctcggcgctggcacgcggcacgtcgccgtggagcccgaggtggccaacctcgatatcatcggccagaggatagagaacatcaagcatgagcataagtccacgtggcactatgatgaggacaacccctacaagacctgggcgtaccacgggagctatgaagtaaaaccgtccggtagcgccagctccatggttaacggcgtcgtgaagctgctcacgaagccgtgggacgttatcccgatggtaacccagatcgcaatgaccgacaccacccccttcgggcagcagcgggtattcaaggagaaggtggatacccgcacacccaaggccaagcgcggcaccgcccagatcatggaggttacggcgaaatggctgtggggcttcctctcgcgcaacaagaagccgcggatatgcacccgcgaggagttcacccggaaagttaggagcaatgccgccatcggggcagtttttgtagatgagaaccagtggaactctgcgaaggaggccgtggaagacgagcggttctgggacctcgtgcaccgcgaaagggaactgcacaagcagggaaagtgcgccacctgcgtttacaacatgatggggaagcgcgagaagaaacttggtgagtttgggaaggctaagggttccagggccatctggtacatgtggttgggcgcgcgcttcctggagtttgaggcgctggggttcatgaacgaagaccactggttcagccgggagaactctctcagcggggtggagggagaaggcctacacaaactggggtacatcctccgcgacatttcaaaaatccccggcggcaacatgtacgccgatgacacggcagggtgggacacccggatcaccgaggacgacttacagaatgaggccaagatcaccgacatcatggaaccggagcacgcgttactcgccaagagtatcttcaagctcacgtatcagaacaaggtggtgcgtgtgcagcgacctgctaaaaacggcaccgtgatggatgtcatttccaggcgcgaccagcggggatcaggccaggtgggcacctacgggctaaacacattcacgaatatggaggcccaactgatcagacagatggagtctgaggggatcttcagcccttccgagctggagactccgaacctggccgggcgggtcttggactggctggagaagcacggggtcgagcgcttgaagcgaatggcgatctcaggggatgattgcgtggtgaagcccattgacgatcgcttcgccaccgccctgaccgcactgaatgacatgggcaaggtccggaaagacatccctcagtgggagccctccaagggctggaacgactggcagcaggtccccttctgcagccaccatttccaccaactgatcatgaaagatgggcgcgagatcgtggtcccctgtagaaaccaggacgagctggttggacgcgcccgggtgagccagggagcgggctggtccctgcgcgaaacggcctgcctgggcaagagctacgctcagatgtggcagctgatgtacttccaccggagagacttgcggttggccgcgaacgcgatctgttccgccgttcccgttgactgggtgcccaccagccggaccacctggtccatccacgcccaccaccagtggatgacgaccgaagacatgctatcagtctggaaccgggtgtggatcgaggagaacccctggatggaagacaagacccatatctcgtcgtggggtgacgtgccctatctgggcaagcgcgaggaccagtggtgcggaagcctgatcgggctcaccgcgcgggcgacctgggcgaccaacatccaggtcgcgatcaaccaggttcgacgcctgattgggaacgagaactacctggattacatgaccagcatgaagcggttcaagaatgagagtgacccggagggtgcgctatggtag

SEQ ID NO: 24595 - RNA, 9879 nt, synthetic construct
  misc_feature 1..9879: note = derived and/or modified CDS sequence (opt11) from DENV-1__EU482528__SS-prME
  source 1..9879: mol_type = other RNA
tctgtgaccatgctgctcatgctgatgcccacggccctggccttccacctcacgaccaggggcggggaaccccacatgatagtgtcaaagcaggagcggggcaagagcctgctgtttaagaccagcgcgggggtgaatatgtgcaccctcatcgccatggatctgggggagttctgcgaggacacgatgacctacaaatgtccacgcataaccgaggccgaaccagacgacgtggattgctggtgtaacgccacggacacgtgggtcacctacgggacctgcagccagacgggcgagcaccggcgggacaagcggtccgtggcgctggcgccacacgtcggcctcgggctggagacccgcaccgagacatggatgtcctcagagggcgcctggaaacagatccagcgggtcgagacctgggccctgcgccacccagggttcacagtgatcgccctcttccttgcgcacgccatcgggaccagcatcacccagaaggggatcatcttcatacttctcatgctggtgaccccctccatggccatgcggtgtgtcggcatcggtagccgcgactttgtggaggggctgtccggcgccacgtgggtggacgtcgtgctcgagcatgggtcgtgcgtgaccacaatggcaaaggacaagcccaccctggacatcgagttgctcaagacggaggtaaccaacccagcggtgctgcggaagctatgcatcgaggccaagatcagcaacaccaccacggacagccgctgcccgacccagggcgaggccaccctcgtggaggagcaggacgccaacttcgtctgtagacgcaccttcgtggatcggggctgggggaacggttgcgggctgttcggcaaagggagtttaataacgtgcgccaaattcaagtgcgtgactaagctcgagggcaagaccgtccagtacgagaacttgaagtacagcgtgatcgtgaccgtccacacgggcgatcagcaccaggtggggaacgaatctaccgagcacggcaccaccgcgacgataacgccccaggccccctcgacggagatccagctaacggactatggggccctcacactggattgcagtcccaggactggcctggacttcaacgagatggtcctcctgaccatgaaggagaagtcctggctggtgcacaagcagtggtttttggatctaccgctgccctggacctcaggtgcctccaccagccaggagacgtggaaccggaaggacctactggttacctttaagaccgcacacgcaaagaaacaggaggtcgtggtgttgggctcccaggagggcgccatgcacaccgctctcacaggggctacggagatccagaccagcggcaccacgaccatcttcgccggtcacctgaagtgcagactgaagatggacaagctcaccctgaaaggcatgtcctacgtcatgtgcacggggagcttcaagctagagaaggaggtggcggagacgcagcacggcaccgtgctcgttcagataaaatacgaaggcaccgacgccccctgcaaaatccctttctccacacaagacgagaagggggtaacgcagaacggccggctgatcaccgccaacccgatcgtaaccgacaaggagaagcccgtcaacatcgaggccgagccgcccttcggggagagctatatcgtgatcggcgctggcgagaaggcactgaagctgtcctggttcaagaaagggtcgtccatcggcaagatgttcgaagccaccgcccgcggtgcgcggcggatggcgatcctcggcgacacggcctgggacttcggcagcatcggcggcgtgttcacgtccgtcgggaagctggtgcaccagatattcggcaccgcctatggcgtgctgttcagcggcgtttcttggaccatgaagatcgggatcggcgtgctcttgacgtggctgggcctcaatagtcgctcgaccagcctgtccatgacctgcatcgccgtggggctggtcaccctctacctgggtgccatggtgcaggcggatagcggctgcgtgatcaactggaagggccgggagctgaagtgcgggagcggcattttcgtcaccaacgaggtgcacacctggaccgagcagtacaaattccaggcggacagtccgaagcgcctctctgccgccatcggcaaggcttgggaggagggtgtctgcggcattcggtccgcaacccggctggagaacatcatgtggaaacagattagcaacgagctgaaccacatcctcctggagaatgacatgaagttcaccgtagtggtgggggatgtcgccggcatcctggcccagggcaagaagatgatccgaccgcaacccatggagtacaagcattcatggaagagttggggcaaagccaagattataggcgcggacgtgcagaacaccaccttcatcatagacgggcccaacacaccggagtgccccgacgaccagcgcgcctggaacatctgggaggtggaggactacggcttcgggatcttcaccacgaacatctggctcaagctgagggactcctacacccaggtatgcgaccaccgcctgatgagcgccgctattaaggactccaaggccgtgcacgcggacatgggctactggattgagagcgagaagaacgaaacctggaagctcgcacgggcctcctttatcgaggtgaagacttgcatctggccaaagagccatacgctgtggagtaacggggtcctggagtctgagatgatcattcccaagatctatgggggaccgatctcccagcacaattaccgccccgggtacttcacccagaccgccggcccctggcacctcggaaagctggaacttgacttcgacttgtgcgagggcaccacggttgttgtcgacgagcattgtggcaatcggggccctagcctgcgcacgaccaccgtgacgggaaagatcatccacgagtggtgctgccggtcctgcaccttgccgccccttcgcttcaagggggaggacggctgctggtacgggatggagatacggcccgtgaaggagaaggaagagaacctggtaaagagcatggtgagcgccgggtccggcgaggtggacagcttctctctggggctattgtgcatcagcatcatgatcgaagaggtcatgcgctcccggtggagccgcaagatgctcatgactggcaccctcgcggtgttctttctgctgatcatggggcaactgacgtggaacgacctgatcagactctgtatcatggtgggcgcaaatgcctccgaccgcatggggatgggcaccacctacctcgccctgatggccaccttcaagatgcggccaatgttcgcggtcggcctcctgttccgtcgcctaactagccgggaggtgctgctcctgaccatcgggctgagtctcgtagccagcgtcgagctgcccaactctctggaagaactcggcgacgggctggccatggggatcatgatcctgaaattactgaccgacttccagtcacaccaactgtgggctacgctcttgtccctgacgtttatcaagaccaccttcagcttacactatgcgtggaagactatggccatggtcctgtcgattgttagcctgttccccctctgcctgtccactacaagtcagaagaccacttggctgcccgtgctcctaggctccctggggtgtaagccgctcacgatgttcctgatcgccgaaaacaagatatggggcagaaagagctggcccctgaacgagggaatcatggccgtgggcatcgtcagcatcctcctgtccagcctgttaaagaacgacgtgcccttagccgggcccttaatagctggcggcatgctcatcgcctgctacgtgatctccgggtcatccgccgacctgagcctggaaaaggctgccgaagtctcctgggaggaggaggcggagcacagcggagcatcacacaacatcctcgtggaggtgcaggacgatggtaccatgaagatcaaggacgaggaacgggatgataccctgaccattctgctaaaggccaccctgctggccgtgtcaggcgtgtaccctctctccatcccggccacactgtttgtctggtacttctggcagaagaaaaagcagcgcagcggggtactatgggacacccccagcccgcccgaggtggagcgtgcggtgctcgacgacgggatctacaggatcatgcagcggggcctgttaggtaggagccaggtgggcgtgggtgtgttccaggagaacgtctttcacaccatgtggcacgtgacccggggcgccgtgctgatgtaccaagggaaacgactcgagccctcctgggcgagcgtcaagaaggacctgattagctatggcggcggctggcggctgcagggcagctggaacactggggaagaagtccaggtgatcgccgtcgagcccggcaagaacccaaagaacgtgcagaccgcccccgggaccttcaagacctccgagggcgaagtgggcgcgatcgccctggactttaaacccgggacgagcggcagccccatcgttaacagagaggggaagatcgtgggcctgtatggaaacggggtggtcaccaccagcggcacctacgtgagcgccatcgcccaggcgaaagccagtcaagaggggcccctacccgagatcgaggacgaggtgttccgcaagcgcaacctgacgattatggatctgcaccccggcagcgggaagacccggcgctacctgcccgccatcgtccgggaggccatcaagcgcaagctccggacccttatcttagccccgacgcgcgtggttgcgtccgagatggccgaggctctgaagggcatgcccatcagataccagacgaccgccgtcaagagcgagcacaccggcaaagagattgtggacctgatgtgccacgccacctttacgatgcggctgctctctcccgtgcgcgtccccaattacaatatgattattatggatgaggcgcacttcacagacccaagctccatagccgcacgcgggtacatcagcaccagagtcggcatgggtgaagccgccgccatcttcatgacagccacaccgcccggctccgtggaggccttccctcagagcaacgccgtcatccaagatgaggagcgggacatcccggaacgctcctggaactctgggtacgagtggataactgacttccccggcaagaccgtgtggttcgtgccttccatcaagagtggcaacgacatcgcgaactgccttcggaaaaatgggaaacgagtcatccagctgagtagaaagaccttcgacacggaataccagaagaccaagaacaacgactgggactacgtagtgaccaccgacatcagcgagatgggcgccaacttccgggccgatcgagtaatcgacccccgacggtgcctcaagccggtgatcttaaaagacggtcccgaacgggtgatcctggccggccccatgcctgtcacggtggcctccgcggctcagcggcgggggcggatcggacgcaaccacaacaaggagggcgatcaatacatctacatggggcagccgctcaacaacgacgaggaccacgcgcattggaccgaagccaagatgctgctggataacatcaacactccagagggcatcattcccgcgctctttgaacccgagcgggaaaaatccgcggccatcgacggcgagtaccggctacgcggcgaagcgcgaaagaccttcgtcgagctgatgcgccgcggggatctcccggtatggttgagctataaggtggcctccgagggattccagtacagcgaccgcagatggtgcttcgacggagagcgcaacaatcaggtcctggaggagaacatggacgtggagatctggacgaaagagggggaacgaaagaaacttcgccctcggtggctggatgcccgcacctactccgatcctctcgcgctccgggagtttaaggaatttgccgcagggcgccggagcgtttccggggacctcatcctggagatcggtaagttaccgcaacacctgacccagcgcgcgcagaacgcgctggataacctcgtcatgctgcacaatagcgagcaaggagggcgcgcctaccgccacgcgatggaggagttaccggacacaatcgagacgctcatgctgttagccctgatcgccgtcctgaccggcggcgtgaccttgttcttcctatccggccgggggctgggcaagactagcatcggcttactctgcgtcatggcgtccagcgtgctgctatggatggcctcggtcgaaccccactggatcgccgccagcatcatcctcgagttcttcttaatggtcttgctcattcccgagccagaccgccagcggaccccgcaggacaaccagctggcctacgtggtgatcgggctcctcttcatgatactgacggtcgcggccaacgagatgggcctgctagagaccaccaagaaagacctggggattggccacgtggcagttgagaaccaccaccacgccgccatgctggacgtcgacctccaccccgcgtccgcctggacactgtacgccgtggccacgaccatcatcacccccatgatgcgccacaccatcgagaacacgacagccaacatctcactgaccgcgatcgcgaaccaggccgccatcctcatggggttagacaaaggctggccgatctccaaaatggacatcggcgtgcccctgctcgcgctggggtgctactcgcaagtgaaccccctgaccctcacggccgcggtgctgatgctggtagcccactacgccatcatagggcccgggctacaggcgaaagcaacccgggaggcgcagaagcgcaccgccgccggcatcatgaagaacccgacggtcgacgggattgtggcgattgatctggaccccgtggtctacgacgccaaattcgagaagcagctggggcagatcatgctcctgattctgtgcacgtcccagattctcttaatgcggaccacctgggccctgtgcgagagtattaccctcgccacgggacccctgaccactctgtgggaagggagtcccggcaagttctggaacactacgatagccgtgagcatggcgaatatctttcgggggagttacctcgccggcgccggtttggccttctccctgatgaagtcattgggtggcgggagacggggcaccggggcacaaggtgagaccctgggagagaaatggaagcgccagctgaaccagctctccaagagcgagttcaacacatacaaacggtccgggataatggaggtcgacagaagcgaggctaaggagggcctgaaacgcggggagacgaccaagcacgctgtctcgcgcggcaccgccaaactgcgatggttcgtggagcgcaacctcgttaagccggagggtaaggtcatcgacctgggctgtggccgcggcgggtggagttattactgcgccgggctgaaaaaggttaccgaggtgaaagggtacaccaagggcggccctggccacgaggagcccatcccaatggcaacctacgggtggaacctcgtaaagctccattccggcaaggacgtcttcttcattccgccggagaagtgcgataccctgctgtgcgacatcggggagtcctcccccaaccccacaatcgaggagggccgcactctccgcgtgctgaagatggtagagccctggctgcgcgggaaccagttctgtatcaagatcctcaacccctatatgcccagcgtggtggagaccctggaacaaatgcagcggaagcatggcggcatgctggtccgcaaccccctctcccggaacagcacgcacgagatgtattgggtgtcctgcgggaccggaaacatcgtgtcggccgtcaacatgacctcccgcatgctgcttaaccggttcacgatggcccaccgcaagccgacatacgagcgcgacgtggacctcggggccggcacccgtcacgtggccgtcgagcccgaggtggcgaacctggacatcatcggccagcgcatcgagaacattaagcatgagcacaagagcacctggcactacgacgaggacaacccgtataagacctgggcctaccacgggtcatacgaggtgaagccctccgggagcgcatcgagcatggtcaacggagtggtcaagctactcaccaagccatgggacgtgatcccaatggtgacccagattgcgatgacagacacgaccccgttcggccagcagcgggtctttaaggagaaggtggacacccgcacccccaaggccaagcgggggactgcgcaaatcatggaagtgaccgccaagtggctgtggggcttcttatcccgaaataagaagccgagaatctgcactcgcgaggagttcaccagaaaagtgcgcagcaacgccgccattggcgcggttttcgtggacgaaaatcagtggaactccgcgaaggaggccgtcgaggacgagcggttctgggacctcgtgcatcgcgagcgggagctgcacaagcaaggtaagtgcgccacgtgcgtttacaacatgatgggcaagcgcgagaaaaagctgggggagttcggcaaggccaaggggagccgtgcgatctggtacatgtggctcggcgcgcgcttcctggagttcgaggccctgggcttcatgaacgaggaccactggttctcacgggagaacagcctctccggggtagagggggagggtttgcacaaactgggctacatcctgcgcgacatcagcaagattccagggggtaacatgtacgccgatgacaccgccggctgggacacccggatcaccgaggacgacttacagaacgaggcgaaaatcacggatatcatggagccggagcacgccctgctcgccaagtccatattcaaattaacctaccagaacaaggtggtccgcgtacagcgtcccgccaagaacgggaccgtgatggacgtcattagccgccgcgaccagcggggctccgggcaggtcggcacctacggcctgaacacgttcaccaacatggaggctcagctcatccgccagatggagtcggaggggatcttctccccctcagagctggagacccccaacttagcgggccgggtgttagattggttagagaagcacggggtggagcgcctgaagagaatggcgatcagcggcgacgattgcgtggtgaaaccgatcgacgaccggttcgcaaccgcgctgacggccctaaacgacatgggaaaggttaggaaggacatcccgcaatgggagcccagcaagggttggaacgattggcaacaggtgcccttttgcagccatcactttcaccagctcattatgaaggacggcagggggatcgtggtgccctgccggaatcaggacgagttggtcgggcgcgcgcgcgtgtcccagggggctggctggagcctgagggagaccgcttgcctggggaagtcctacgcccagatgtggcagctcatgtacttccaccggagagatctgcggctggcggccaacgccatctgcagcgctgtgccggttgactgggtgcccacctcccgcaccacgtggagcatccacgctcaccaccagtggatgaccaccgaagatatgctctccgtatggaaccgggtctggatcgaagaaaacccctggatggaggataagacacacataagctcctggggcgacgtaccctacctgggcaagcgcgaggatcagtggtgtgggagtctgattggcctcacggcgcgggcgacatgggccaccaatattcaggtggccataaaccaggtcagacgcctgatcgggaacgagaactacctggactatatgacctcgatgaagcggttcaagaacgagagcgacccggagggcgccctctggtga

SEQ ID NO: 24596 - RNA, 9879 nt, synthetic construct
  misc_feature 1..9879: note = derived and/or modified CDS sequence (opt11) from DENV-1__EU482529__SS-prME
  source 1..9879: mol_type = other RNA
agcgtcaccatgctgctgatgctgatgccgaccgccttagctttccacctaacgacgcgcggcggggaaccacacatgatcgtgtccaagcaggagcggggtaagagcctgctattcaagactagcgccggggtaaacatgtgcaccctcatcgccatggacctgggggagctgtgcgaggatacgatgacatataaatgcccgaggatcactgagacggaacctgatgatgtggactgctggtgcaacgccactgacacgtgggtcacctacgggacctgctctcagaccggcgagcaccggcgggataaacggtccgtggccctggcgccccacgtgggcttaggactcgagacccgtaccgagacctggatgtcgtccgaaggcgcgtggaagcagatccagcgggtcgaaacctgggcactccggcacccaggtttcaccgtgatcgcactgttcctggcacacgctatcggcacctcaataacccaaaaagggattatcttcatcctcctgatgctagtgaccccctccatggccatgcggtgcgtcgggatcggcagccgggacttcgttgagggcctctctggcgccacctgggtggacgtcgtgctcgagcacgggagctgcgtgaccaccatggcaaaggacaaacccacgctggacatcgagctccttaaaacagaagtgaccaatcccgcagttttgcgtaagctctgcattgaagcgaagatatccaacacaacaaccgacagtaggtgcccgacgcagggcgaggcgacgctggtggaagaacaggacgccaacttcgtatgccggcgcaccttcgtggaccgggggtggggcaatggctgcggtctgttcggcaaaggatccctcatcacgtgcgccaaattcaagtgcgtgaccaagctggaaggaaagatcgtccagtacgagaatttgaagtacagcgttatcgtgaccgtccatacgggcgaccaacaccaggtggggaacgagtccaccgaacatggcaccactgccaccatcacgccacaggcgcccaccacagaaattcagctcaccgactacggggccctgactctggactgctcaccccgcaccggccttgacttcaatgagatggttcttctcaccatgaaggagaagtcatggttagttcataaacagtggtttctggacttacccctcccctggacctctggcgccagcacgctgcaagagacatggaaccgtcaggacctcctggtaaccttcaaaacagcccatgccaagaaacaagaggtcgtggtgctcggctcccaagagggcgcgatgcacacggccttgaccggtgccacagaaatccagaccagcggaactaccaccatcttcgctggtcacctcaagtgccggctgaagatggataagctgacgctcaagggcatgagctatgtcatgtgtacggggtcgttcaagctggaaaaggaggtagcggagacacagcacgggaccgtcctagtacagatcaaatacgagggcaccgatgcgccttgcaagattccgttctccactcaggacgagaagggagtgacccaaaacggcaggctgataaccgcgaacccaatcgttaccgataaagagaaacccgtaaacatcgaggccgagccgccattcggggagagttacataatcattggcgccggcgagaaggcactcaagctgtcctggttcaagaagggaagctccataggcaaaatgttcgaggctacggcccgcggggccagacgtatggccatcttgggcgacaccgcgtgggatttcgggagcatcggtggagtattcacctccgttgggaagctcgtccaccagatcttcggtaccgcctacggggtgctattctcgggtgtttcatggacgatgaagatcggaatcggcgtcctgctcacttggcttggcctaaattctcgctccacctcactcagcatgacatgcatcgccgtggggctggtgacgctttacctaggcgtcatggtgcaggctgattcaggttgcgtgataaattggaaaggccgagagctgaagtgcgggtccggcatcttcgtcacaaacgaggtgcatacatggactgagcagtacaaattccaggccgatagtcccaaacgcctgagcgcggccatcggaaaggcctgggaagagggggtgtgtggcatcagatccgcgacgcgcctcgaaaacatcatgtggaagcagatctccaacgagctgaatcatatcctgcttgagaatgatatgaagttcacggtcgttgtaggggacgtggccggcatcctggcgcaaggcaagaagatgattcggccccagcccatggagtacaagtactcgtggaagtcctggggcaaggccaagatcataggagctgacgtgcagaacaccacattcatcatcgatgggccaaacaccccggaatgtccggacgaccaaagggcctggaacatctgggaggtggaggactacgggttcggcatcttcacgaccaacatctggctgaaacttcgcgattcccatacccaggtctgcgaccatcgcttaatgtcggcggccatcaaagactccaaagctgtgcatgcagacatgggttattggatcgagtccgagaaaaacgaaacctggaagctggctcgggcgagctttatcgaggtgaagacatgcatttggcccaagagccataccctgtggtcgaacggcgtcctggagagcgagatgattatacccaagatctacggagggccgatcagccaacacaattaccgcccggggtacttcacccagaccgccggcccctggcatctggggaagctcgagttggacttcgatctgtgtgagggcacgacggtggtggtagacgaacattgtggtaatagagggcccagcctcagaacgacaacggtgaccggcaagatcatccacgagtggtgctgcaggagctgcactctcccgcctctgcgcttccgcggggaagacggttgctggtacgggatggagatacgccccgtgaaagagaaggaggagaacctcgtcaagagcatggtatccgcaggcagcggcgaagtagacagcttctccctggggctcctctgcatctctatcatgatcgaggaggtcatgaggtccaggtggagtcgaaagatgctgatgaccggcacgctggcagtcttctttctcctgataatgggccagctgacctggaacgatctgatccggctgtgcatcatggtaggagccaacgctagcgacagaatgggaatgggaaccacctatctagcgctgatggctacgtttaagatgcggccgatgttcgcagtgggcctactgttccgacgtttaaccagccgcgaagtgttgctgctcacaatcggtttaagcctggtggccagcgttgagctccccaattccctggaggagcttggtgacggtttagcgatgggcattatgatcctaaagctgttgactgactttcaaagccatcagctgtgggccacgctcttgagcctgaccttcatcaagacgacattctcgctacactacgcctggaagactatggctatggtcctctccatagtgagcctgtttccactgtgtctcagcactacctcgcagaaaaccacatggctgccggtcctgctaggttccctcggttgcaagcctctgaccatgtttctcatcgctgagaataagatctggggccggcggagctggcccctgaacgagggaatcatggccgtgggtatcgtctccatactattatccagcctgctgaaaaacgatgtgccccttgcaggtcccctgattgcaggcggcatgctgatcgcgtgctacgtaatctccgggagctccgcggacttaagcctagagaaggccgccgaagtcagctgggaggaggaagcagagcacagcggcgccagccacaatatcctggtggaggtgcaggatgatggaactatgaagatcaaagacgaggagcgcgacgacaccctcaccatactcctgaaggcgacgctgttagccgtcagcggagtgtatcccctgtccatccctgccaccctcttcgtgtggtacttctggcaaaagaagaagcagcgatctggtgtcctgtgggacaccccctctccgcccgaggttgagcgggccgtgctggatgacggcatctaccgtatcatgcagcgaggcctactcgggcgcagtcaagtcggggtgggggtttttcaggagaacgtcttccacaccatgtggcacgtgacgcggggcgccgtgctgatgtaccaggggaaacgcctggagccctcctgggcatcagtcaagaaggacctcatctcttatggtggcgggtggcggctgcagggctcatggaataccggagaggaggtccaggtaatcgctgtagagcccggcaagaaccccaagaacgtgcagaccgccccagggacctttaagacgccagagggcgaggtgggcgctatcgccctggactttaaacccgggacctcaggaagcccgatagtcaaccgtgaggggaagattgtaggcctctacggcaacggagtggtcacaaccagcggcacttatgtgtcggcgatcgcccaggccaaggcctcgcaggaagggccgctgcccgagattgaggacgaggtgttccggaagcgaaaccttaccatcatggacctccaccctgggtcagggaagacgagacgctacctgcccgcgatcgtccgggaggccatcaagcgtaaacttcgcaccctcatcctggcccccacgcgtgtagtcgcctcggagatggccgaagcgttaaaggggatgcccatccgttaccagaccaccgccgtcaaatcagagcacaccggcaaagaaatcgtggaccttatgtgccacgccacattcactatgcgtctgctaagccccgtacgcgttccgaactacaacatgatcatcatggacgaggcccacttcaccgacccctccagcatcgccgctcggggatacatcagcactcgcgttggtatgggagaggcggcggccatatttatgacggcgactcctcccggctccgtggaggcgttccctcagtccaacgctgtcatccaagatgaagaacgggacatccccgagcgctcctggaactccgggtacgagtggataaccgacttccccggaaagaccgtgtggttcgttcccagcatcaagtccggcaacgacatcgccaactgcctccggaagaacggaaagcgcgtcatacagctgtcgcggaagacgtttgataccgaataccagaaaaccaagaataacgactgggactacgtggtgacgacggatatttccgagatgggcgcgaacttcagggcagacagagtcatcgatccgcgccggtgcctgaagcctgtgatcctgaaggacgggcccgagcgagtaatcctagccggacccatgcctgtaactgtcgcgagcgccgcacagagacgcggtcggatcggccgcaaccacaacaaggaaggagatcaatacatttacatgggccagcccctgaacaacgacgaggaccacgcccactggaccgaggccaagatgctgctggacaatataaacacccccgagggtataatcccggcgctgttcgagccggagcgtgagaaatccgccgccatcgacggagagtaccggctccgaggcgaagctcggaagacgtttgtggaactgatgcgtcgcggggaccttccggtctggctctcgtacaaggtcgcctccgagggcttccagtactcggaccgccgatggtgtttcgacggcgaacgcaacaaccaggtcctggaggagaacatggacgtggagatctggaccaaggagggggagcgaaagaagctgcgcccccggtggcttgacgcccgcacgtacagcgacccccttgcattaagggagttcaaggagttcgctgcgggcagacggtccgtgagcggcgacttaatcctcgaaataggcaagttaccgcagcatctcacccaaagagcacagaacgctctcgacaacctggtcatgctgcacaattcggagcaaggagggcgggcctaccgccacgcgatggaagaactgcccgacactatcgagaccctaatgctcctggcactgattgccgtgctcaccgggggtgtgaccctgttcttcctgtcgggacgggggctcggcaagacttccatcggtctgctgtgcgtcatggccagctccgttctcctgtggatggcgtctgttgagccccactggattgcggcatccatcatcttagagttctttctcatggtcttgttgattcctgagccggaccgtcaacggacgccgcaagacaatcagctcgcctacgtggtgatagggttgctgttcatgatcttaaccgtcgccgcgaacgagatgggcctgctggaaactacgaagaaagacctagggatcggccacgtcgcggtggagaaccaccaccatgcagctatgctggacgtcgatctgcaccccgcctcggcctggacgctctacgcagtagccaccaccataattacaccgatgatgcgccacacgatagagaacaccaccgctaacatatccctgacagccatcgctaatcaggcggccattctaatggggctcgataagggttggccgatctccaagatggacataggcgtgcccctccttgcgctcggttgttactcccaggttaatcccctgacactgacagcggcggtgctaatgctggtggcccactacgccatcataggccctgggctgcaggcgaaggcgacccgggaagcgcagaaacgtacagctgctggcatcatgaagaaccccacggtcgacgggatcgtggccatcgacctcgaccctgtagtgtacgacgcgaagttcgagaagcaactgggccagattatgttactcattctgtgcacaagccagatcctactcatgcgcaccacctgggcgctgtgtgagtccatcacgttagcaaccggcccgctcaccacgctgtgggaggggtctccggggaagttctggaacacgaccatagctgtatccatggcaaacatcttccggggatcctacttggccggcgcgggtctagccttctccttgatgaagagtctcgggggcgggcgccggggtacaggagcccagggagaaaccctcggcgagaagtggaagcgccaactgaatcaactgagcaagtcggagttcaatacttataagcggtctggcatcatggaagtcgatcgctccgaagcaaaggaggggttaaagcgcggggagaccaccaagcacgcggtttctcgaggcacagctaagctcaggtggttcgtggaaaggaatctggtgaagccagagggtaaggtaattgacctgggttgcggccgcggaggatggtcctactactgcgcagggctcaagaaggtgaccgaggtgaagggctacaccaaagggggccccggccatgaggaacccatcccgatggccacatacgggtggaaccttgtaaagctgcacagcgggaaggacgtgttcttcatcccgccggagaagtgcgacactctcctctgcgacattggcgagtccagtcccaacccgacaatcgaggaaggcagaaccctgcgggtcttaaagatggtagagccctggttacgcggtaatcagttttgcatcaagatcctgaacccttatatgccttccgttgtggagacactcgagcaaatgcagcggaaacacggaggaatgctggtccgcaacccgctgagtcggaactccacacatgaaatgtactgggtgagctgtggtaccgggaacatagtgtcagccgtcaacatgacgagccgcatgctcctgaaccgctttaccatggcgcaccggaagcccacctatgaacgcgacgtggacctgggagccggcacccgccacgtcgccgtcgaacctgaagtggccaacctcgatatcataggacagcgcatcgaaaacatcaagcacgaacataaatccacgtggcattacgacgaggacaacccctacaagacgtgggcttaccacggtagctatgaggtgaagccgtccggcagcgcatcaagcatggtcaatggcgtggtcaagctactgaccaaaccgtgggatgtaatcccgatggtgacccagatagctatgacggacaccactccattcggccagcagcgggtctttaaggaaaaagtggacacgcgcacgccgaaggccaagcgggggactgcccagatcatggaagtaaccgcgaaatggctatggggtttcttaagccgcaacaaaaagcccagaatatgtaccagagaggagtttactcggaaggttcgctcaaacgctgccataggcgcagtattcgttgacgagaaccagtggaacagcgccaaggaggcagttgaggatgagcggttttgggacctggtacaccgcgaacgggagctccacaagcaggggaagtgcgctacgtgcgtgtataacatgatgggaaagagagagaagaagctaggtgagttcggaaaggccaaggggtcccgcgccatctggtatatgtggctcggcgcccgctttttggagttcgaggcgctcggctttatgaacgaggaccactggttcagccgcgaaaactccctgtcaggcgtcgagggcgaggggttacacaagctaggctacatcctacgagacatatccaagatccccggtggcaacatgtacgccgacgataccgccggctgggacacccggatcacggaggacgaccttcagaacgaagcccggataacggacatcatggaaccagagcacgccctgctggccaagagcatatttaagctaacctaccagaacaaggtagtgcgcgtccagcggccagccaagaatgggaccgtgatggacgtgatctcccgcagggaccagcgcggcagcggtcaggtcggcacgtacggactgaacaccttcaccaacatggaggcacaattgatccggcagatggagtccgagggaatctttagcccctccgagttggagacccccaacctggcagagagggtgctcgactggctcgagaaatacggcgttgagcggctaaagcgtatggccatcagtggagacgattgcgtggtgaagcctatcgacgacaggttcgcgaccgctttaacagccctcaacgatatgggcaaagtgcgcaaggacatcccccagtgggagcccagtaagggttggaacgactggcagcaggtccccttttgcagccaccacttccatcaacttatcatgaaggatggtagagagatagttgtgccgtgccgcaatcaagacgagttggtagggcgggcccgagtgtcccaaggggccggctggagcctccgtgagacagcgtgccttggcaagagctacgcccagatgtggcagttaatgtatttccaccgtcgggacctccgacttgccgcgaacgcgatctgctcagccgtaccggtcgactggatccccaccagccggacgacctggtccatccatgctcaccatcaatggatgaccaccgaggatatgttgtcagtgtggaaccgcgtgtggatcgaagagaacccctggatggaggacaagacacacatatcctcatggggcgatgttccgtacctcgggaagagggaggaccagtggtgtggctcgctgatcggcctgacggcccgtgccacatgggcaacaaatattcaggtggcaatcaaccaggtgcgccggctcatcggtaacgagaactacctagactacatgaccagcatgaagcgcttcaagaacgaaggagacccggagggggccttatggtga

SEQ ID NO: 24597 - RNA, 9879 nt, synthetic construct
  misc_feature 1..9879: note = derived and/or modified CDS sequence (opt11) from DENV-1__EU482531__SS-prME
  source 1..9879: mol_type = other RNA
agcgtaaccatgctgctcatgctgatgcccaccgcacttgcattccacctcaccaccagaggaggggaaccccacatgatcgtgaccaaacaagagcggggcaagagcctgctgttcaagaccagcgcgggagtgaacatgtgcacattaatcgccatggacctgggagagctgtgcgaggacaccatgacctacaagtgcccccggataaccgaggccgaaccagacgacgtggactgctggtgtaacgccaccgacacctgggtgacctacgggacctgcagtcagaccggcgaacaccggcgcgataagcgctcagtcgccctagcgccccacgtgggcctggggctggagacgcgcaccgagacgtggatgagtagcgagggcgcctggaaacagattcaacgggtcgagacgtgggccctccgacaccccgggttcacggtaatcgctctgttcctggcccacgccataggcacttccatcacccagaaggggatcatcttcatcctcctgatgctggtaacgccctctatggcgatgcggtgcgtcggcatcggcagccgtgacttcgtggagggactcagcggcgccacctgggtggacgtcgtgctggagcacgggtcctgtgtgaccacgatggccaaagacaagccgacgctggacatcgaactcctgaagaccgaggtcaccaaccccgcggtgctacggaagttgtgtatcgaggccaagatcagcaacaccacgaccgactctcgctgccccacccagggcgaggccaccttaatggaggaacaagacgcaaacttcgtgtgtcgccgcactttcgtcgaccggggctgggggaacggttgcgggctgttcggcaagggaagcctcatcacgtgcgccaagttcaagtgcgtgactaaactggagggcaagatcgtgcagtacgagaacctgaagtattccgtcatcgtcaccgtacacacgggcgaccagcatcaggttgggaacgagtccaccgaacacggtaccaccgctaccatcacgcctcaggcccccacttccgagatccagctcaccgattacggagccctgacgctggactgtagccccaggactggcctcgacttcaacgagatggtactgctgaccatgaaggagaagtcctggctcgtccacaagcaatggttcctggacttaccgctcccctggaccagcggggcctctacctcccaggagacgtggaatcggcaggacctgctggttaccttcaagaccgcgcacgcgaagaagcaggaggtggtcgtgctcggcagccaggagggtgctatgcacaccgccctgacgggggcgacagagatccagaccagcggaaccacgaccatcttcgcaggccacctaaagtgccgcctcaagatggacaagctgaccctgaagggcatgagctatgttatgtgcaccgggagcttcaagctcgaaaaggaggtcgcggagacgcagcacggcaccgtgttagttcagatcaagtacgagggcacagacgccccatgcaaaatccccttcagcacacaggacgagaagggggtcatccagaacggtcggctgatcacggccaacccgatcgtgaccgacaaggagaaacccgtcaacatagaggcggagccccctttcggggagagttacatcgtcatcggcgtgggggagaaagcgctaaaactcagctggttcaagaagggctccagtatcggtaagatgttcgaagctaccgcccgcggggcccggcgcatggcaatcctgggcgataccgcgtgggatttcgggtccattggcggagtgtttaccagcgtcggcaagctggtgcaccagatcttcggcaccgcttacggggtcctgttctccggtgtcagctggaccatgaaaattgggatcggggtgctgttgacctggctcggtttgaacagtcgctcgacgagcctgtcgatgacctgcatcgctgtcgggctcgtcaccctgtacctgggtgtgatggtgcaggctgactccgggtgtgtcatcaactggaaaggccgggagctcaagtgcgggtctggcatcttcgtgaccaacgaggttcatacgtggaccgagcaatataagttccaggccgactcgcccaagcgcctgtccgcagccattggcaaggcctgggaggagggggtatgtggcatccggagtgccacccgcctggagaacatcatgtggaagcagatctccaacgaactcaaccacatcctgctagagaacgacatgaagttcaccgtggtagtcggggacgtggtgggcatactcgcgcaggggaaaaagatgatccggccgcagcctatggaacataagtacagctggaagtcctggggcaaggcgaagatcatcggcgccgacgtacaaaacactacgttcatcatcgacgggcccaataccccggagtgtcccaacgaccagagagcatggaacatctgggaggtggaggactacggcttcgggatcttcaccaccaacatctggctgaaactgcgggacagctacactcaggcgtgcgaccaccgcctcatgtccgcggcaatcaaggactccaaggccgtgcacgccgatatgggttactggatcgagtccgaaaagaacgagacctggaaactggcccgggcgagcttcattgaggtcaagacctgtatctggccgaagtcccacaccttatggtcgaacggcgttctcgagtcggagatggtaatccccaagatctacgggggccctatcagccagcacaactaccgccccggctacttcacccaaaccgccggcccatggcatctagggaagctggagctggacttcgacttatgcgaggggaccaccgtcgtggtggacgagcactgtggtaatcgggggccgtccctgcgcacgacgaccgtcaccggcaaaatcatccacgagtggtgctgccggagctgcacgctgccgcccctccgcttcaagggggaggacggctgctggtacggtatggaaatccggcccgtgaaggaaaaggaggaaaacctggtgaagtccatggtcagcgcaggaagcggcgaagtggactccttcagcctggggctgctgtgcatttccatcatgatcgaggaggttatgcgcagtcgttggtcccgcaagatgctcatgaccggcaccctggccgtcttcctgctcctgatcatgggacagctgacatggaacgacctcatccggctgtgcataatggtcggcgccaacgcgagcgaccgcatggggatgggcacgacttacctcgccctcatggccaccttcaagatgcgaccgatgttcgccgtagggttactgttcaggcgtcttacctcgcgggaggtcttgctgttaacgatcgggctgagcctggtggcgtccgtcgagctccccaatagcctggaggagctgggcgatgggctggcgatgggcatcatgatactgaaactgctcaccgacttccagtcccaccaactgtgggccaccctcctcagcctgaccttcatcaaaacgaccctctcccttcactacgcctggaagaccatggccatggtgctgagcatcgtgtccctgttcccgctctgcttaagcacaacgtctcagaagaccacatggctgccggtcctgctgggcagcctggggtgtaagccgttaaccatgttcctgatcgcggagaacaagatctggggcaggaagtcctggccactgaacgaggggatcatggccgtgggtgtggtcagcatcctcctgagctctctgctcaagaatgacgtcccccttgctgggcccctgatcgccggcgggatgcttattgcctgctatgtgatcagcggctccagcgcggacctctccctggagaaggccgccgaggtcagctgggaagaggaggccgagcactccggcgcgtcacacaacatcctcgtggaggtgcaggacgacgggacgatgaagattaaggatgaggagcgggatgataccctgacaattctcctcaaggcgaccttgctggccgtctccggcgtgtacccgctcagcatccccgccaccctgttcgtctggtacttttggcagaagaagaagcagcggtccggggtcctttgggacacgccctcgccgcccgaggtggaacgggccgtgctggacgacggcatctaccgaatcatgcagcggggcctcctggggaggtctcaggtaggcgtaggggtttttcaggagaacgtctttcacacgatgtggcacgtgacccggggcgccgtgctaatgtaccaggggaagcgcctggagcccagctgggcttccgtcaagaaagacctgatcagctacggtggtgggtggcgactgcagggttcctggaacaccggggaggaagtccaggtgatcgccgtcgaacccggaaagaacccaaagaacgtgcagacggcacccgggaccttcaagacccctgagggcgaggtgggcgccatcgccctcgacttcaagcccgggaccagcggatcgcccatcgtcaaccgcgaggggaagatcgtgggcttgtatggcaatggcgtagtcaccaccagcggcacttacgtgagtgcgatcgcccaggccaaggcctcccaggaggggccgctgcctgagatcgaggatgaggtgtttcgcaagcgcaacttgaccatcatggacctgcacccaggcagcggaaagacgcggcgatacctgcctgcgatcgtccgggaggccatcaagcgcaagctacggaccctgatactggcaccaacccgggtggtggcgtccgagatggccgaggcgttgaagggcatgcccatccgatatcagaccacggctgtcaagtctgagcataccggtaaggagatcgtggatctgatgtgccacgctaccttcaccatgcgtctgctctcccccgtgcgcgtcccgaactacaatatgatcatcatggacgaagcccacttcacggaccccagctccatcgccgcgcgggggtatatcagcacccgcgtgggcatgggggaagccgccgccatcttcatgactgctacgccgccgggatccgtcgaagcgttcccccagagcaacgcagtcatccaggacgaggagcgggacatccccgagcgttcgtggaacagcggttacgagtggatcacggacttccccggaaagacagtgtggttcgtcccctccatcaagagtgggaatgacatcgccaactgtctccgaaagaacggaaagagggtcatccagttgtcccggaagaccttcgataccgagtaccagaaaacgaagaacaacgactgggattacgtggtgaccaccgacatttcggagatgggcgctaacttccgcgcggatcgggtcatcgacccgcgccggtgcctcaaacccgtgatcctgaaggacgggcccgagcgagttatcctggccggccccatgccagtgaccgtggcctccgccgcccagcggcgcgggaggatcggccgcaaccacaacaaggagggcgaccagtacatctacatgggacagcccctcaacaacgacgaggatcacgcgcactggactgaggccaagatgttactcgacaacatcaacactcccgaaggcatcattcccgccctcttcgagcccgagagggagaagtccgcagccatcgacggggagtaccgcctgcgcggcgaggcccggaagaccttcgtcgagctcatgcggcgcggggacctcccagtgtggctgagttacaaggtggccagcgagggcttccaatactccgaccgacggtggtgtttcgacggggagcgtaacaaccaggtcctggaggagaacatggatgtggagatttggaccaaagagggggagcggaaaaagctccgtccccggtggttggatgcccgtacctatagtgaccccctggccctccgcgagttcaaggagttcgccgcgggccgccggagcgtgtccggggacctgatcctcgagatcgggaaactcccgcagcaccttacccagcgggcccaaaacgccctggacaacctcgtcatgctccataacagcgaacagggtgggcgggcctaccgccacgcgatggaggagctgccagataccatcgagaccctcatgctgttagccctcatagccgtgctgacgggcggagtgacgctgttcttcctcagcggccgggggctgggcaagaccagcatcggcctgctatgcgtcatggcctccagcgttttactgtggatggcctccgtggagccccactggatcgcggcctctatcatcctagagtttttcctgatggtcctgttgatccctgaaccggaccgccagcggacgccccaggacaaccagctggcgtatgtggtgatcgggcttttatttatgatcctgactgtagccgctaacgagatgggcctgctcgagaccaccaagaaggacctagggatcggccacgtagcggttgagaaccaccaccacgccactatgttggatgtcgacctccatcccgcatccgcctggaccctatacgccgtggcgacaaccataatcaccccaatgatgcggcacacaatcgagaacacgaccgccaacatcagcctgaccgccatcgccaaccaagctgcgatattaatggggctggacaaaggctggcccatctccaagatggacataggagtgccccttctcgcactggggtgctacagccaggtcaaccccttgactcttacggccgcagtcttaatgctagtggcccactacgccatcatcgggccggggctgcaggccaaagccacccgggaggcccagaagcgcaccgcggccggcatcatgaagaaccccaccgtagacgggatcgtggctatcgacctggaccccgtggtctacgacgcaaaattcgagaagcaactgggtcagattatgctcctgattctgtgcacgtcacagatcctactgatgcgcaccacctgggccctgtgcgaaagcattaccctcgcgacgggccccctgaccaccctgtgggagggtagtccgggcaagttctggaacaccacgatcgccgtgagcatggccaacatcttccgggggtcctacctcgccggagccgggctggcgttcagcctcatgaagagtctcgggggcgggcgccgggggaccggtgctcagggcgagacccttggggagaagtggaagcgccagctgaaccagcttagcaagagcgagttcaacatctacaagcggtccgggatcatggaagtggaccgcagcgaggccaaggagggcctgaagaggggagagacgactcgccacgccgtctcccggggcaccgctaagctgcgctggttcgtagagcggaacctggtgaaacccgaggggaaggtaatcgacctcggctgcggccgcgggggctggagctactactgcgctgggcttaagaaagtgacggaagtgaagggctacaccaagggagggccgggccacgaggagcccatcccgatggccacgtacgggtggaacctggtgaagctccactccggcaaagacgtgttcttcacgccgcccgagaagtgcgacacgctgctgtgtgacatcggggagagttcgcccaacccaaccatcgaggagggcagaacgctcagagtgctgaagatggtcgagccctggcttcgggggaaccagttctgtatcaagatcctcaacccctacatgcccagcgtggtggagaccctggagcagatgcagcgcaagcacggtggcatgcttgtcaggaacccgctctcgcgtaacagcacccacgagatgtactgggtctcctgcgggaccggcaacatagtgtctgctgttaatatgacctctaggatgcttctgaaccgcttcacgatggcccacagaaagcctacttacgagcgggacgtggacctcggggcgggtacccgtcacgtggccgttgagcccgaggtggccaacctagacatcatcgggcagcggatcgagaacatcaagcacgagcacaagtctacttggcactacgacgaggacaacccctacaaaacttgggcctaccatgggtcctatgaggtcaagccgagcggctcagccagcagtatggtcaacggggtggttaagctgctcaccaagccctgggacgtgatccccatggtgacccagatcgcgatgaccgacactaccccattcggccaacagagggtcttcaaggagaaggtagacaccaggaccccgaaggccaagcgcgggacggcgcagatcatggaggtgaccgcccggtggctgtggggcttcctgtcccgcaacaagaaaccccgaatctgcacacgagaggagtttacgcggaaagtccggagcaacgctgcgatcggcgctgttttcgtggacgagaaccagtggaactccgccaaagaggcagtggaggacgaaaggttctgggacttggtgcagaaagagcgcgagctgcacaagcaggggaaatgcgccacgtgcgtctacaacatgatgggaaagcgcgagaagaaactgggggagttcggcaaggcgaaggggagcagggccatatggtacatgtggctcggcgcccggtttctggagttcgaggccttgggcttcatgaacgaggatcattggttctcccgtgagaacagcctttccggggtcgagggcgaggggctgcacaaactgggttacatcttgcgcgacatcagcaagatccccgggggaaacatgtacgcggatgacaccgccggctgggacaccaggatcaccgaggatgacctgcagaacgaggccaagatcacggacatcatggagccggagcacgccctgttggcgaccagcatcttcaagttaacctaccagaataaggtggtgcgagtccagcgtcctgccaaaaacggcaccgtgatggacgtcattagccgccgggaccagcgcggctccgggcaggtcggcacatacggccttaataccttcactaacatggaggcccagttaatcaggcagatggagtctgaggggatctttctgccctccgagctggagaccccgaatctcgccgagcgcgtgctggactggctggagaagcacggcgtggagcggctcaagcgcatggccataagcggggacgactgtgtggtaaagccgatcgacgacaggttcgccacggccctgaccgccctgaacgacatgggcaaggtgcgcaaggacattccccagtgggagccctccaaggggtggaatgactggcagcaggtccccttctgcagccaccacttccaccagctgatcatgaaggacggccgggagatcgtagtgccgtgcaggaaccaggatgaacttgtcggccgggcccgcgtgagccaaggggccggttggagcctgcgggagaccgcctgcctcggcaagagctacgcgcagatgtggcaactgatgtacttccatcgccgggacctgcgcctcgccgccaacgccatctgctccgcggtacccgtcgattgggtcccaaccagcaggacgacgtggtccatccacgcccaccaccagtggatgaccaccgaggacatgttaagcgtgtggaacagggtctggatcgaggaaaacccctggatggaagacaaaacgcacgtgtccagctggggcgacgtgccgtacctgggcaagcgggaggaccagtggtgcgggtccctcatcggcctaaccgccagggccacctgggccagcaatatccaggtagctatcaatcaggtgcgccggctgatcgggaacgagaactacctagactacatgacatccatgaagagattcaagaacgaaggcgacccagaaggggccctgtggtga

SEQ ID NO: 24598 - RNA, 9879 nt, synthetic construct
  misc_feature 1..9879: note = derived and/or modified CDS sequence (opt11) from DENV-1__EU482532__SS-prME
  source 1..9879: mol_type = other RNA
agcgtcaccatgctgctcatgctgatgcccaccgccctggccttccacctcaccacccgaggcggcgaaccgcacatgattgtgtccaaacaggagcgtggcaagtcgctgttgttcaagacaagcgcgggggttaacatgtgtaccctgatcgcaatggacttgggcgagttctgcgaggataccatgacctacaagtgcccccgcatcaccgaggccgagcccgatgacgtggactgctggtgcaatgctaccgatacgtgggtcacctatgggacgtgcagccagaccggcgaacaccggcgtgacaagcgatccgtggccctggcgccccatgtgggcctgggactggagacccgtaccgagacgtggatgagctccgagggcgcctggaagcagatccagcgggtcgagacctgggccctgcgccacccggggttcacggtaatcgccctcttcctggcccacgccatcgggaccagcatcacccagaaggggatcatcttcatcctgctcatgctggtgaccccctccatggccatgagatgcgtcggcatcggaagccgcgacttcgtggaggggctgtccggcgccacgtgggtagacgtggtgctagagcatggttcctgcgtgacaaccatggccaaggataagcccaccctggacatcgagctgttaaagacagaggtaaccaacccggccgtgctccggaagctgtgcatcgaggccaagatctctaacaccaccaccgacagcagatgcccgacccagggggaggccaccctcgtggaagaacaggacgccaacttcgtgtgccggcgtaccttcgtggacaggggctgggggaacggctgcggtctgttcggaaaagggtccctgatcacgtgcgccaagttcaagtgcgtgaccaagctcgagggcaagattgtacagtacgagaacctgaagtactctgtgatcgtgaccgtccacactggcgaccagcaccaggtggggaacgaatccactgagcatggcaccaccgctaccatcacgccacaggcacccagcacggaaatacagctgaccgactacggggcgctcactcttgactgctccccccggaccggcctcgacttcaatgaaatggtcctcctgacgatgaaggagaagtcctggctggtgcacaagcagtggttcctcgacttgccgctgccttggaccagcggggcatcaaccagccaggagacatggaaccggaaggacctcctggtgacgttcaagaccgcccacgcgaagaagcaggaggtcgtggtcctgggatcccaagagggtgccatgcacaccgcactcactggggccacggagatccagacctcgggtacaacaacaatcttcgccgggcacctgaagtgtagactgaagatggacaagctcaccctgaagggaatgagctacgtcatgtgcaccgggagcttcaagctggagaaggaggtggcggagacacagcacggcaccgtgctcgtccagatcaagtacgagggcacggacgctccatgcaagatccccttttccacgcaggacgagaagggggtgacgcagaacggacgtctgatcacagctaacccgatcgtgaccgacaaagaaaaaccggtcaacatcgaggccgagccgcccttcggggaaagctacatcgtgatcggcgcgggcgagaaggccctgaagctgtcctggttcaaaaaggggagctccataggaaagatgttcgaggcgaccgcccgaggggcccggcgcatggccatcctcggtgacaccgcttgggacttcgggagcatcggcggcgtgttcacgtccgtcggcaagctggtgcaccaaatctttggcacggcctacggtgtgctgttctcgggcgtctcctggaccatgaagattgggattggcgtgctcctgacctggttggggctcaacagcaggtccacatcgctgtccatgacttgcatcgcggtggggctggtcaccctctaccttggcgtgatggtgcaggccgatagcggctgcgtcatcaactggaagggccgggaactgaagtgtggaagcggaattttcgtgaccaacgaggttcacacgtggaccgagcagtacaagttccaggcggactccccgaagaggctctcggccgccatcggcaaggcatgggaggagggggtctgcggcatacggtcaaccacccgtctggagaacatcatgtggaagcagatctcgaacgagctaaaccatatcctcctagagaatgacatgaagttcaccgtggtggtcggggacgtggccggcatactggcccaggggaagaagatgatccggccccagcccatggagtacaagtactcctggaagagttggggcaaggccaagatcataggggccgacgtgcagaacacaaccttcatcatcgacgggcccaacaccccagaatgccccgacgaccagcgcgcctggaatatatgggaggttgaggattacggtttcgggatcttcacgacgaacatctggttaaagctgcgagactcccacacccaggtttgcgaccaccggctgatgagcgctgccatcaaggactccaaggccgttcatgccgacatgggttactggatcgagagcgagaagaacgaaacctggaagctcgcgcgggcgtccttcatcgaagtcaagacctgcatctggcccaagagccatacgttgtggagtaatggcgtcctggagagcgagatgatcatacccaaaatctatgggggcccgatctctcaacacaactaccgttccgggtacttcacacagaccgcgggtccatggcacctcgggaagctggagctggacttcgacttgtgcgaaggcaccactgtagttgttgacgagcactgcggcaaccgggggccctccctgcgcaccaccaccgtgacgggcaagatcatccacgaatggtgctgccgcagctgcaccctgccgcccctccgcttcaagggggaggatggctgttggtatgggatggagatccggccagtcaaggagaaggaggagaacctggtcaagagcatggtgagcgccggctcgggagaggtggactccttctcgttagggctcctgtgcatctccatcatgatcgaggaggtgatgcgaagccggtggtcgcgaaagatgctgatgaccggtactctcgccgtgttttttctgctgatcatggggcaactcacgtggaacgatctgatccggctgtgcatcatggtgggcgcaaatgcgtcagacagaatggggatgggcactacctacttagccctcatggctaccttcaagatgcgccccatgttcgccgtgggcttactgtttcggaggctgacgtcccgtgaggttctgctcctgaccattgggctttcactcgtagccagtgtggagctaccgaacagcctggaggagctcggcgacggactggcgatgggcatcatgatcctgaaactgctgaccgacttccagagccaccaactgtgggctaccctcctgagcctgacgttcatcaagaccacttttagtctccattacgcctggaagaccatggccatggtactgagcatcgtgagcctgttccccttatgtcttagcacgacctcccagaagacaacctggctgcccgtgctcctcggcagcctggggtgcaagcccctcacgatgttcctgatcgcggagaataaaatctggggccgcaaaagctggccgctgaacgagggaatcatggccgttggcatcgtgagtatcctcctgagctcccttctcaagaacgatgtgccactggcggggcccctgatcgccggggggatgctcatcgcctgctacgtcatcagcgggtcctcggcggacctgtccctggagaaggccgccgaggtaagctgggaggaggaggccgagcattccggcgccagccacaacatactcgtggaggtccaggatgacgggaccatgaaaatcaaggacgaggaacgggacgacaccctgaccatcctgctcaaggctaccctgctggccgtgagcggcgtgtatcccttaagtatcccggccaccctgttcgtgtggtacttctggcagaagaagaagcagcgctccggggtgttatgggacaccccctccccgcccgaggtggaacgggccgtcctagatgacggcatctaccgcatcatgcagcggggtctgctggggcgctcccaggtgggcgtgggtgtcttccaagaaaacgtgttccacaccatgtggcatgtgacccggggcgccgtcctgatgtaccaggggaaacgcctcgagccgagttgggcatccgtcaagaaggacctgatcagctacggcggcgggtggcggctgcagggctcctggaatacgggggaggaggtgcaggtaattgcggtggagcccggcaagaaccccaagaacgtacagaccgcccccggcaccttcaagacctcggagggcgaggttggcgccatcgccctggacttcaagccagggaccagtggctcacccatcgtcaatagggaagggaagatcgtgggactgtacggcaacggtgtcgtgactacctctggcacctacgtgtccgcgatcgcccaggccaaggccagccaggaggggcccctgcccgaaatcgaggacgaggtgttccggaagcgcaatttgacgatcatggacctgcacccgggcagtgggaaaacccggcgctacctgcccgcgatcgtgcgggaggccatcaagcgcaaactgcggaccctgatactggcccctacccgtgtggtcgcctccgagatggccgaggctctgaagggaatgccgatccgataccaaacgaccgcagtgaagtccgagcacaccggtaaagagatcgtggacctgatgtgccacgccaccttcacgatgcggctgctcagccccgtccgcgtgcccaactacaacatgatcatcatggacgaagcccacttcaccgacccctccagcatcgctgcgcgggggtatatctccacccgcgtcggtatgggggaggcggccgctatcttcatgactgccacgccacctggaagcgtcgaggcgttcccccaatccaacgccgtgatccaggacgaggagcgggacatccccgagcgttcgtggaacagtggctacgaatggatcacagatttcccgggcaagaccgtgtggttcgtccccagcataaagtccggcaacgacatcgccaactgcctgcggaaaaacgggaagcgcgtgatccagctgagccggaagacctttgacacggagtatcagaaaaccaagaacaacgactgggactatgtggtcaccaccgacatctccgagatgggcgctaatttccgcgccgaccgggtgatcgacccccgccggtgccttaagcccgttatcttaaaggacgggccggaacgcgtcatcctggcaggcccaatgcccgtgacggtagccagcgccgcccaacggagggggcggattggccgaaaccataataaggaaggagaccagtacatctatatggggcagcccctcaataacgacgaggaccacgcgcactggaccgaggccaaaatgctgctggacaacatcaacactccggagggcatcatccccgcattgttcgaacccgaacgggagaagtcggctgcaatcgacggtgaataccgactgcgcggcgaagcacggaagaccttcgtggagttgatgcgccgcggggacctccccgtgtggctgtcctacaaggtcgctagcgagggcttccagtactccgatcgccggtggtgcttcgacggcgaacgtaacaatcaggtgctggaggagaacatggacgtggaaatctggacgaaggagggggagcggaagaagctccgcccgcggtggcttgacgcacgcacttactccgatcccctggccctccgggagttcaaggagttcgccgcggggcgccggtccgtcagcggggacctgatcctggagatcggcaagctcccccagcatctgactcagcgggcccagaacgccctggacaaccttgtcatgctgcataactccgagcagggcgggcgggcataccgccacgcgatggaggagctgcccgacaccatcgagacgctcatgctgctggccctcatcgccgtgctgacgggaggggtcaccctgttcttcctcagcggccgggggctggggaagacctccatcggcctgctctgcgttatggccagctccgtgctgctgtggatggcaagtgtcgagccgcactggatcgcggcatccatcatcttggagttcttcctcatggtgctgctcatcccggagcccgacaggcagcggacgcctcaggacaaccagctggcctacgtggttattgggttactgttcatgatcctgacggtggccgccaacgagatgggcctgctcgagaccaccaagaaggacctgggaataggccatgtggcggccgagaatcaccaccacgccgccatgctggacgttgacctccacccggccagcgcctggaccctgtatgccgtggctacgactataatcacccccatgatgcgtcataccatcgagaacacgacagccaatatctccctgaccgccatcgcgaatcaggccgccatactcatggggcttgacaagggctggcccatcagcaagatggacatcggagtgccgttacttgccctgggctgctattcccaggtcaatcccctgactttaacggcggccgtgctgatgttggtggcccactacgccatcatcggtccgggactacaggccaaggcgaccagggaagcacagaagcgcacagctgccggcatcatgaagaaccccaccgtcgacgggatcgttgccattgacctggacccggtagtttacgacgcgaagttcgagaaacagctgggccagatcatgctcctgatcctgtgcacgagccagatcttgctgatgcgaaccacctgggccctgtgcgagtccatcaccctggccacagggcccctgaccaccctgtgggaggggagccccggcaagttctggaacactacgatcgctgtgagcatggccaatatcttccgggggtcctaccttgcgggcgccggcctggcctttagcctaatgaaatccctcgggggcgggcgccgtggcaccggggcccagggtgagaccttaggcgagaaatggaagcgccagctgaaccagctgagcaaatccgagttcaatacctacaagcggagtgggatcatggaggttgaccgctccgaagcgaaagagggcctgaagcgcggggagacgaccaagcacgcggtctcgcgcggcaccgccaagctgcggtggttcgtggagcgcaacctcgtgaagcccgagggtaaagtcatcgacctgggctgcggacgtggcgggtggtcctattactgtgccgggctgaagaaggtgaccgaggtgaaggggtacactaagggcgggccgggccacgaggagcccattcccatggccacgtatggatggaacctggtgaagctccacagcggcaaagacgtgttctttatccctcccgagaagtgcgacaccctgctgtgcgatatcggggagagtagccccaacccaaccatcgaggagggacgcacgctgcgggttctgaagatggttgaaccgtggctgcgcgggaaccagttctgcatcaagatcttgaacccttacatgccctccgtggtggagaccctggaacagatgcagcggaagcacggcggcatgctggtccgcaaccccctcagccggaattccacccacgagatgtactgggttagctgtgggaccggcaacattgtgtccgcggtcaacatgacctcgcgcatgctgctgaatcggttcaccatggcccaccgtaagcccacctacgaaagagacgtggacctcggggccggcacccgacatgtggccgtcgagccggaggtcgccaacctggatatcatcgggcagcgcatcgagaatatcaagcacgaacacaagtccacctggcactacgacgaggacaacccctataagacgtgggcttaccacgggagctatgaggtgaagccctcaggctccgcaagctccatggtcaacggggtggtcaagctgctcaccaagccctgggacgtgatcccaatggtgacccagatcgcgatgaccgacacgacccccttcgggcagcagcgggtcttcaaggagaaggtggacacccggacccccaaggccaaacggggcacggcccagatcatggaggttacagctaagtggctgtggggcttcctgagccgcaacaagaagccccggatctgcacaagagaggagttcacccgtaaggtccgctccaacgccgccatcggcgccgtgtttgtggatgagaaccagtggaatagcgcgaaggaggccgtcgaagacgagcggttttgggacctcgtgcaccgcgagcgggagctccacaagcaaggcaagtgcgccacatgcgtttacaacatgatgggcaagcgtgagaagaagctgggggagttcggcaaggccaaggggtcccgggcaatctggtacatgtggctcggcgcgcgcttcctggagttcgaggcactgggtttcatgaacgaggaccactggttcagccgggaaaactccctcagcggagtcgagggcgaggggttacacaagctgggctatatacttcgcgacattagcaaaatccccgggggcaacatgtacgccgacgacaccgccggctgggacacccggatcaccgaggacgacctacagaatgaggccaagatcacggatatcatggagccagagcacgcgctgttagccaagtccatcttcaagctgacctaccagaacaaggtggtacgcgttcagcggcccgccaagaacgggaccgttatggacgttatcagtcgccgcgaccagcgaggcagcgggcaggtaggcacctacggtctcaacacgttcaccaacatggaggcccagttgatccgtcagatggagtcggagggtatcttcagcccgtccgagctggagaccccaaacctggccggccgggtcctagactggcttgagaaacacggagtggagaggttaaagcggatggctatctctggcgacgactgcgtagtaaagcccatcgacgaccgctttgcaaccgcccttacggccttgaatgatatggggaaggtgcggaaagacatcccacagtgggagccgtcaaagggatggaacgattggcagcaggtccccttctgctcccaccacttccaccagctgatcatgaaagacggccgggagatcgtggtgccctgccggaaccaggatgagctcgtcgggcgcgccagggtaagccagggtgcggggtggtctttacgggagaccgcctgcctaggcaagagctacgcccagatgtggcagctcatgtacttccaccggcgtgatctacggctagccgcgaacgccatctgctccgcggttcccgtcgactgggtcccgaccagccgcacaacttggtccatccacgcccaccaccaatggatgaccaccgaagacatgctcagtgtgtggaaccgggtttggatcgaagagaacccctggatggaggacaagacccacatctccagctggggtgacgtaccctacctggggaagcgcgaagatcagtggtgtggcagcctgatcggactaacggcccgggcgacctgggcaactaacatccaggtggccatcaaccaggtccgaagactgatcggaaacgagaactacctggactacatgaccagcatgaagcggtttaagaacgagtccgacccagagggggccctctggtaa

SEQ ID NO: 24599 - RNA, 9879 nt, synthetic construct
  misc_feature 1..9879: note = derived and/or modified CDS sequence (opt11) from DENV-1__EU482533__SS-prME
  source 1..9879: mol_type = other RNA
agcgtgaccatgctgttaatgctgatgcctaccgccctggcctttcatcttacgacacggggcggagagccccacatgatcgtgagcaagcaggagcgggggaagagcctgctgttcaagaccagcgccggggtgaatatgtgtaccctcatcgccatggacctaggcgaattctgcgaggacactatgacctacaagtgccctcgcataacggaagccgaacccgacgacgtggactgctggtgcaacgccacggatacttgggtcacctacgggacctgcagccagacaggcgagcaccggcgggacaagcgatccgttgcgctggcgccccacgtcggcctagggctggagacgcgcaccgagacctggatgagctctgaaggggcctggaagcagatccaacgggtggagacctgggccctgcgccaccccgggtttacggtgatcgccctgttcctcgcgcacgcaattggcaccagcataacccagaaggggatcatcttcatcctgctcatgctggtgactccatccatggccatgcgttgcgtcggcatcggcagccgcgactttgtagaggggttgtccggcgccacctgggtggatgtcgtgctcgagcacgggtcgtgcgtgaccaccatggccaaggacaagcctactctggacatcgagctactcaagacggaggtcaccaaccccgcggtcctgcggaagctatgcatcgaggccaagatcagcaacactaccacggacagccgctgccctacccagggcgaggcgaccttagtggaggaacaggacgccaacttcgtctgccggcgcaccttcgtcgaccggggctggggtaacgggtgcggtctgttcggcaaggggtccctgatcacgtgcgcaaagttcaaatgcgtgaccaagctcgagggcaagaccgtccagtatgagaatctgaagtacagcgtgatcgtgaccgtccacacgggagaccagcaccaggtggggaacgagtccaccgagcacggcaccacagcgaccatcacgcctcaggccccgagcaccgagatccagctcaccgactacggggccctcaccctggactgcagcccccggacgggccttgactttaacgagatggtcctcctgactatgaaggagaaaagttggctggtgcacaagcagtggttcctcgacctaccgctgccctggaccagcggggcatccacgagccaggagacgtggaaccggaaggacctcctggtgaccttcaagaccgcccacgcgaagaagcaggaggtcatcgtgctgggctctcaggagggcgccatgcacaccgccctcacgggggccaccgagatccagaccagcgggaccacgaccatcttcgccgggcacctgaagtgccgcctcaagatggacaagctcaccctgaagggcatgtcctacgtaatgtgcaccggcagcttcaagctggagaaggaggtcgcggagacgcagcacggcaccgtgctcgtgcagatcaagtacgagggcaccgacgccccctgcaagattcccttctccacccaggacgagaagggtgtcacgcagaacggccggctgatcactgccaacccgattgtgaccgacaaagaaaagccagtgaacatagaggcagagcctcccttcggggagagctacattgtcataggcgcgggtgagaaggccctgaaactgtcctggttcaagaaggggagcagtatcggcaagatgttcgaggccaccgcccgcggggcccgacgcatggcgatactcggcgacacggcctgggactttgggagcatcggcggcgtgttcacatccgttgggaagctggtccaccagatcttcggcaccgcctatggggtgctattcagcggcgtgtcctggaccatgaagatcgggatcggcgtcctcctgacctggcttggcctcaacagcaggtccacgagcctgtctatgacctgcatagctgtggggctggtgacactctacctgggcgtaatggtgcaggccgacagcggatgtgttatcaactggaagggcagagagctaaagtgcgggagcggcatattcgtcacgaatgaggtgcacacctggaccgagcagtacaagttccaggcagactccccgaaacgcctctcagccgccatcggtaaggcctgggaggagggggtgtgcggcattcggtccgcaacccgcttggagaatattatgtggaagcaaatctccaacgagctcaaccacatcctcctggagaacgatatgaagttcaccgtcgtggtgggggacgttgcgggcatcctggcgcaggggaagaagatgatccgtccccagcccatggagtacaagtactcctggaagtcctggggcaaagccaagatcatcggcgctgacgtgcagaacgcgacgttcattatcgacgggcccaataccccggagtgcccggatgaccagagggcctggaacatttgggaggtggaggattacggcttcgggatcttcaccacgaacatctggcttaagctgcgggactcctacacgcaagtctgcgaccaccgcttaatgagcgcagcgatcaaggactccaaagccgtgcacgcggacatgggttactggatcgagagcgaaaagaacgaaacgtggaaactggcccgggcctcctttatcgaggtgaaaacctgcatctggcccaagagccacaccctgtggtccaatggcgtcctggagagcgagatgatcatccccaagatctacgggggcccgatatcccagcacaactaccgccccgggtacttcacccagaccgccggcccctggcacctcgggaagctggaactggacttcgatctttgcgagggcaccaccgtggtggtggacgagcactgcggcaaccgggggccgagcctgcgcacgacaacagtgaccggcaagataatccatgaatggtgctgccggtcctgcacgctgccgccccttcgcttcaagggggaggacggctgctggtacgggatggagatacggcccgtgaaggagaaggaagaaaacctggtcaagagcatggtgagcgccggatccggcgaggtggacagcttctcccttgggctcttatgcatcagcatcatgatcgaggaggtcatgcgttcccggtggagccgcaagatgctgatgaccggcactctcgcggtgttcttcttactgatcatgggccagctcacctggaacgacctgatccgactgtgcatcatggtgggcgccaatgcctcagaccgcatggggatgggtacaacctacctggccctgatggcaaccttcaagatgaggccgatgttcgcagtcggcctcttattcaggcgactgaccagccgggaggtgctgctcctgacgatcgggctctccctcgtggccagcgtcgagctgcctaattcccttgaggagcttggcgatgggcttgccatggggatcatgatcctgaagttgttgaccgatttccaatcccaccagctgtgggccaccctcctgtccctgacctttatcaagacaaccttcagcctccactacgcgtggaagaccatggccatggtcctgtccatcgtaagcctgttccccctgtgtctgtccaccacgagccagaagaccacctggctgcccgtgcttctgggctccctggggtgcaagccgttaaccatgttcctgatcgccgagaataagatctggggccgcaagagttggcccctgaacgaggggatcatggccgtgggcatagtcagcatactcctgtcctcgctgctcaagaatgacgtccccctagccgggcccctaatcgcgggcggaatgctcatcgcttgttacgtgatctccgggagctccgccgaccttagcctcgagaaggccgccgaggtctcctgggaggaggaggcggagcacagcggcgcctcccacaacattctcgtggaggtgcaggacgacgggacgatgaagatcaaggatgaagagcgggacgacaccttaaccatcctgctcaaggctaccctgctggccgtcagcggagtgtacccgctcagcatcccggctaccttattcgtgtggtacttctggcagaaaaagaagcagcgcagcggcgtcctttgggacacgccctctccgcccgaggtcgagcgggcggtgctcgacgacggcatctatcgtatcatgcagcggggcctgctgggccgcagccaggttggtgtgggggtcttccaggagaatgtattccacaccatgtggcacgtgacccggggcgccgtactgatgtaccaggggaagcgcctagagcccagctgggcatcagtcaagaaggacctgatctcctacggcggcgggtggcggctgcaaggcagctggaacaccggggaggaggtccaggtgatcgccgtggagcccggcaagaaccccaagaacgtacagacggcacccgggacgttcaagacctccgagggcgaagtgggcgcgatcgccctcgacttcaagcccgggaccagcgggtcacccatcgtcaaccgcgaggggaagatagttggcctgtacggcaacggggtggttacgacgtccggaacctacgtgagcgccatcgcccaggcgaaggcctcccaggaggggcccctgccggagatcgaggacgaggttttccgtaagcgcaacctcaccatcatggacctgcaccccggcagcgggaagacgcggcgctacctgcctgccatcgtccgggaggctatcaagcgcaaactccggaccctgatcctggccccgacccgcgtggtggcgtccgagatggccgaggccttgaagggcatgcccatccgctaccagaccacggccgtgaagagcgagcacaccggcaaggagatcgtggacctgatgtgccacgctaccttcaccatgcggctcctctcccccgtgcgagtccccaattacaacatgatcatcatggacgaggctcactttacagacccgagctccatcgccgcccggggctacatcagcacccgcgtcggcatgggggaggccgccgcgatcttcatgaccgccacgccgcccggctccgtggaggccttcccccagagcaacgccgtcatccaggacgaggagcgggacatcccggaacgctcctggaacagcgggtatgaatggatcacggactttcccggcaagaccgtgtggttcgtgccctccatcaagagcggcaacgacatcgcaaactgcctgcggaagaacgggaagcgcgtcatccagttgtcccggaagaccttcgataccgagtaccagaaaacgaagaacaacgactgggactacgtggtgacaacagacatcagcgagatgggggctaacttccgcgccgaccgggtcatcgatccccgccggtgcttaaaaccggtgatcctgaaggacggacccgagagggtgatcctggccggccccatgcccgtcaccgtagcctccgcggcccagcgacgcggccggatcggccgcaaccacaacaaggagggcgaccagtacatctacatggggcagccgctcaacaacgacgaggaccacgcccactggacggaggccaagatgctgttagacaacatcaacacccccgagggcatcatccccgcgctctttgagcccgagcgggagaagtccgcggccatcgacggggagtaccgcctgcgcggcgaggcccggaagaccttcgtcgaactgatgcgccgcggagacctcccggtgtggctgagctacaaggtggcctccgagggtttccagtacagcgaccgccggtggtgcttcgacggtgagcgcaacaaccaggtcctggaggagaacatggatgtagagatctggacgaaggagggggagcggaagaaactccgcccgcggtggctcgacgccagaacgtactccgatcccttggcattacgggagttcaaggagttcgccgccggccgcaggagcgtatccggcgacctgatcctggagatcggcaagctcccccagcatcttacccagcgcgcccagaacgcgctggacaacctcgtcatgctgcacaatagcgaacagggcggccgggcctaccgccacgccatggaagagctgccggataccatcgaaaccttaatgctgctggccctcatcgccgtactcacgggcggggtgactctcttttttttatcaggccgaggacttggcaagaccagcatcggtctgctctgcgtcatggcgtcctcagtgctgctgtggatggcctccgtggagccccactggatcgccgcctccatcatcctcgagttcttcctgatggtcctgctgatcccggagcccgacagacagcggaccccgcaggacaaccagctggcctacgtggtgatcggtctcctctttatgatcctgaccgtggcggccaatgagatgggcctgctcgagacgactaagaaggacctggggatcggccacgtggccgtggagaaccaccaccacgcggccatgctggacgtcgacctccaccccgcgtccgcctggacgctgtatgccgtagccaccactatcatcacacccatgatgcgccacaccatcgagaacacgacggccaacatcagtctcacggcgatcgccaatcaggccgccatcttaatggggctggacaagggctggccgatctccaagatggatatcggcgtgcccctgctcgcgctggggtgctacagccaggtcaacccgttgaccctcaccgcggcagtgctgatgctggtggcccactacgccatcattggtcccgggctccaggcgaaagccacgcgggaagcccagaagcgcacggccgccggcatcatgaagaacccgacggtcgatgggatcgtggcgatagatctggaccccgttgtctacgacgccaagttcgagaagcagctgggccagatcatgctcctgatcctctgcacatcgcagatcctcctgatgcgcacgacctgggccctgtgcgaaagcataaccctcgccaccggccccctgacgaccctgtgggaggggtcccccggcaagttttggaacaccaccatcgccgtgagcatggcaaacatcttccggggaagctacctcgccggcgccgggctggccttctccctgatgaagtccctcgggggcgggcgccggggcacgggggcgcagggcgagaccctgggcgagaagtggaagcgccagttaaaccagctctccaagagcgagttcaacacctacaagcgatccgggattatggaggtggaccgcagcgaggcaaaggagggcctgaagcgcggggagaccacgaagcacgccgtctcccgcggcaccgccaagcttcggtggttcgtggagcgcaacttggtgaagccggagggcaaggtaatcgacctaggctgcggccgcggtgggtggtcgtactactgcgccgggctaaagaaggtgacagaggtgaagggatacactaaaggcgggcccggccacgaggagcccatccccatggcgacgtacgggtggaacctggtcaaactccactccggcaaggacgtattcttcatccccccggagaagtgcgacacgctgctgtgcgatatcggggagagctcccccaaccccaccatagaggaggggcgcaccctccgggtgctgaagatggtcgagccatggctgagggggaaccagttctgcatcaagatcctcaacccgtacatgcccagcgtggtggaaactttggagcagatgcagcggaagcacggcggcatgttagtccgcaaccccctctccagaaacagcacccatgagatgtactgggtttcctgcgggaccgggaacattgtctcggccgtcaacatgacctctcgcatgctgctgaaccgcttcaccatggcccaccgaaagcccacatatgaacgcgacgtggacctcggggccggaacgcggcacgttgccgtcgagcccgaggtcgcgaacctggacatcatcggccaacgcatcgagaacattaagcacgaacacaagagtacgtggcactacgacgaggacaacccctacaagacctgggcgtaccacgggtcctacgaggtaaagcctagcggcagcgcctccagcatggtcaacggtgtggtcaagctgctcacgaagccgtgggacgttatcccaatggtgacacagatcgccatgaccgacaccacgcccttcggccagcagcgggtcttcaaggagaaggtggacactcgcacacccaaggccaagcgggggaccgcgcagatcatggaggtgacggctaagtggctatgggggtttctgtcccgcaacaagaagccgcggatttgcactcgcgaggagttcacccggaaggtccgcagcaacgccgccatcggcgcggtgttcgtagacgagaaccagtggaacagtgccaaggaggcagtcgaggacgagcggttttgggacctcgtgcaccgcgagcgggagctgcacaagcagggaaagtgcgcgacctgcgtgtacaacatgatgggcaagcgcgagaagaagctgggggagttcggcaaggccaaaggatcgcgggcgatctggtacatgtggctcggcgcccgctttctcgagtttgaagcactgggcttcatgaacgaggaccactggttcagccgggagaacagcctctccggggtcgagggcgaggggctgcataagctcggctacatcctgcgcgatatcagcaaaatccccgggggcaacatgtacgccgatgacacggccggctgggacacccggatcaccgaggatgacttacagaacgaggcgaagatcacggacatcatggagcccgagcacgccctgctggccaagtccatcttcaagctgacgtaccagaacaaggtggtgcgagtccagcggccagccaagaacgggaccgtgatggacgtgatcagccgccgcgaccagcgtggctccggccaggtcggcacgtacggcctgaacaccttcacgaacatggaggcccagctcatccgccaaatggagagtgaagggatcttctcccccagcgagctggaaacccccaacctggcgggccgtgtgctcgactggctagagaagcacggggtggagcgccttaagcggatggccatttccggcgacgactgcgtcgtgaagcccatcgacgaccgcttcgccaccgccctcaccgccctaaacgacatggggaaggtgcggaaggatatcccgcaatgggagcccagcaagggctggaacgactggcagcaggtccccttctgcagccaccacttccaccagctgatcatgaaggacggccgcgagatcgtggttccctgcagaaaccaggatgagcttgtcggccgcgcgcgggtgtcccagggggccgggtggagcctccgggagacggcctgcctgggtaagtcctacgcccagatgtggcagctcatgtactttcaccggcgcgacctgcggctggcggccaacgccatctgcagcgccgtgccggtcgactgggtgcccacctcccgcaccacctggagcatccacgcccaccaccagtggatgacaactgaggacatgctatccgtgtggaaccgggtctggattgaggagaacccttggatggaggacaaaacccacatcagctcctggggcgacgtgccctacctgggcaagagagaggatcagtggtgcggcagcctcatcgggctcaccgcgcgggccacgtgggcgactaacatccaggtggccatcaaccaggtacgccgcctcatcgggaacgagaactatctagactacatgacatccatgaagcggttcaagaacgagagcgacccggagggggccctctggtga

SEQ ID NO: 24600 - RNA, 9879 nt, synthetic construct
  misc_feature 1..9879: note = derived and/or modified CDS sequence (opt11) from DENV-1__EU482534__SS-prME
  source 1..9879: mol_type = other RNA
agtgtcacgatgctactgatgctgatgcccacggcgctcgcattccacctgacaacccgaggaggagaaccgcatatgatcgtgtccaagcaagaaagagggaaaagcctattattcaaaacaagtgccggtgtgaacatgtgcaccctcatcgccatggacctcggagagttctgcgaagatactatgacttacaagtgcccccgaatcacagaagcggaacctgacgatgtggattgttggtgcaacgcgaccgacacctgggtaacctacggtacctgttcacaaactggagagcatcgccgcgacaagagatccgtggccctggctccccacgttggactgggcctggagactcggacggaaacatggatgagttccgaaggggcatggaaacaaattcaacgcgtagaaacgtgggcgctcaggcaccccggcttcacggtcatcgcacttttcctcgcccacgcgatagggacctcgataacgcaaaaaggaatcatctttattctattgatgcttgttactccaagtatggccatgcgctgtgtcgggatagggtcaagggattttgtggaaggattgagcggtgccacgtgggtggacgtggtgctagagcacggttcctgtgtgaccactatggccaaggacaaaccaacactagacattgaactcctaaaaacggaggtcactaacccggccgtactaaggaaactgtgcatcgaagcaaaaatctccaataccacaacagatagcagatgtccgacccaaggcgaggcaacactggttgaagaacaagacgcaaactttgtgtgtagacggacctttgtcgaccgcggctggggcaacggatgtgggctattcggcaaaggaagcctaatcacatgtgccaagttcaagtgcgtaacgaaactagaaggtaaaattgtgcaatatgaaaatttgaagtacagcgtaatcgttactgtgcataccggcgaccaacatcaagtggggaacgaaagcacagaacatggcaccacggcgacaataacaccacaggccccgagtacagagatacaactaaccgactatggcgctctaacgctagactgcagtccgcgcacgggcctcgactttaacgaaatggtactactaactatgaaagagaaatcgtggctggtacacaaacaatggttcttagatctccccctgccatggacctcgggggctagcacctcgcaagaaacctggaaccgccaagacctcctggtaacatttaaaacagcgcacgccaagaaacaagaggtagtagtactgggaagccaagaaggagcgatgcacacagccctgaccggcgcgacggaaattcaaacttcaggcacaaccactatcttcgcgggacacctgaaatgccgcttaaaaatggacaaacttacactaaaaggcatgagctatgtaatgtgtacgggctcgtttaaacttgaaaaagaggtagcggaaacacaacatggtacagtcctggttcagatcaagtacgagggcacggatgcgccgtgcaagatcccgttctcgacccaagacgaaaaaggcgtcacgcaaaacgggcgcttgatcacagcaaaccccattgtcactgacaaggagaagccagtaaatatcgaagcggaacccccgttcggcgagtcgtacattgtgattggagcaggcgaaaaggctctaaaactatcatggttcaagaaagggagcagcataggtaagatgttcgaggcgacagcgcgaggcgcgagacgaatggcaatactcggtgacacggcgtgggacttcggatcgatcgggggcgtattcacctcggtgggaaaactcgtccatcaaatattcgggacagcatacggggtactcttcagcggagtctcctggaccatgaaaataggcataggtgtactcctaacttggctgggactgaactcccgaagtacatccctctccatgacatgcattgcagtgggacttgtaacgttgtatctaggagtcatggtccaggcagactcaggatgcgtcatcaattggaaaggccgagaactaaaatgcgggtcagggatcttcgtcacgaatgaggtccacacatggacagaacaatacaagttccaagcagactcccccaaacggctttcggcagcaatcggtaaagcctgggaggaaggcgtatgcgggattcgatccgccacgcgcctagagaacataatgtggaaacaaatcagcaacgaactcaaccatatcctcctggaaaacgacatgaagttgaccgtggtcgtgggcgacgtcgctggaatccttgcccaaggtaagaaaatgatcaggccgcaaccaatggaatacaaatactcttggaaatcctggggaaaagcaaagataataggcgccgatgtacagaacaccacgttcatcatagacggtcccaacactccagagtgccctgacgaccaaagagcatggaacatttgggaggtggaagactatggctttgggatcttcacaacaaacatctggttgaagttacgcgactcatacacccaggtgtgtgatcaccgtctgatgtcagcagcaatcaaggacagcaaagccgtacacgcagacatggggtactggatcgaaagcgagaaaaatgaaacctggaaactcgcaagggcctcatttatagaagtgaaaacctgcatatggccaaagtctcataccctatggtccaacggagtcctcgaaagcgaaatgataatcccgaagatatacgggggaccaatatcccaacacaactaccgccccgggtacttcacacagactgcaggaccctggcacctcggaaaactcgaattagactttgatctatgtgaaggcactactgtagtagtcgacgaacactgcgggaacaggggccccagcctccgcaccaccaccgtcaccgggaagataatccacgaatggtgctgccgcagctgcacactacctcccctccgattcaagggcgaggatgggtgctggtacggaatggaaataagaccggtcaaagaaaaagaagagaatctagttaagagcatggtatcggcggggagtggtgaggttgattccttctccctcggactattatgcattagcatcatgatagaagaagtgatgcgctcaagatggtcgaggaaaatgctcatgacaggtacattggctgtattctttctactgataatgggccagttgacgtggaacgacctaatccgtctatgcatcatggtcggggccaatgcaagtgatcgcatgggaatgggtactacgtatctggccttgatggccacattcaagatgcggccaatgtttgcagtagggttactattccgccgattaactagcagagaagtccttttactaacaatcggcttaagtttggtagctagcgtcgaactaccgaacagcctcgaggaactcggcgacgggcttgcaatggggatcatgatacttaaactattgacagacttccaaagccaccagctatgggctacactgctaagccttacattcgttcgaaccaccttcagccttcactacgcatggaaaaccatggctatggtcttaagcatcgtttcattatttcccttgtgcctaagcacaacatcgcaaaagacaacctggttaccagtcttactcggcagccttgggtgcaagccacttacaatgttcctgatcgcagagaataagatatggggccgaaaatcctggcccctcaatgagggtataatggcagtcggtatagtatcgatcctactgagcagtttgctcaagaacgatgtacctctagcgggtccactcatagccggtggcatgttaattgcgtgttacgtaatcagcggctcatcggccgacttatctctagaaaaggccgccgtcgtgtcttgggaagaagaagcagaacactcaggagcgagccacaacatcctggtggaggtccaggatgatgggaccatgaagatcaaagacgaggaaagagacgatactctaaccatcctcctcaaggccacgctcctagcggtatcgggtgtgtacccattaagcattcctgccactctcttcgtatggtacttctggcagaaaaagaaacagcgaagcggcgtgctctgggacacccctagcccaccagaagtagagagggcagtgctagacgacggtatttatcggatcatgcaacggggcctattggggcgaagtcaagtcggcgtgggagtctttcaagagaacgtattccacacaatgtggcacgtcacgcggggcgcggtcttgatgtaccagggtaagcgcctcgaaccctcatgggcgagtgtcaagaaagacctcatctcgtatggtggaggatggagactccaaggttcgtggaatacaggcgaagaggttcaggtcatagccgttgaaccaggcaaaaatccaaagaacgtccaaacagcgccggggacgtttaaaacaagcgaaggcgaagtcggagccatagctcttgacttcaaaccaggcacctcaggaagccccatagtaaaccgcgagggaaagatcgtagggctctacggcaatggagtcgtaacgaccagcggcacatatgtaagtgccatcgcgcaagctaaagcaagccaagaaggcccgctacccgaaatagaagatgaagtatttagaaagcgaaatctgacaatcatggacctacacccagggtcgggtaaaacacgacggtacctcccggcaatcgtaagagaagctatcaaacgcaagttaaggactctaatactcgctccaaccagggtggtggcctccgagatggccgaagccctgaaaggtatgccgataagataccaaaccaccgccgttaaaagcgagcacaccggaaaagagatagtcgacttaatgtgccacgcaacttttacaatgcgactactcagtccagtcagggtccccaactataacatgatcataatggacgaagcccacttcacagaccccagcagcatagccgctcggggatacatctcgacacgcgtcggcatgggagaggccgcagcgatatttatgacagccaccccgcccggatcggtagaggctttcccacaatccaacgcagtcatacaggatgaagaaagggacatcccggagcggtcatggaactcaggttacgaatggattactgattttcctggcaagaccgtctggttcgtcccttccataaaatcaggaaatgacatagccaactgcctgcgcaagaacgggaagagagtgatccaattgtcgcgcaagacattcgacacagaatatcagaaaactaagaataatgactgggactacgtcgtgacaacagatatctccgagatgggggctaactttagggccgaccgcgtaattgacccaaggagatgcctaaaaccagtaatactaaaagacggaccggaaagggtaatactggcagggccaatgcccgtcacggtagcctccgccgcgcaaaggcgcggaagaatcggccgcaaccacaacaaagagggtgaccaatacatatatatgggccagccactcaacaacgatgaagaccacgcccactggaccgaggccaaaatgcttctagacaacataaatacgccagaagggatcatacccgcactctttgaaccagaacgagagaagtctgcagcgatagacggggagtaccgattacggggagaggcacggaaaacattcgtagaactaatgcgacgcggcgacctacccgtctggctatcctacaaggtagccagcgagggattccagtactcggaccgccgctggtgttttgacggtgagcgcaacaaccaggtgctcgaggaaaatatggacgtcgaaatctggaccaaagagggagaaaggaagaaactccgtccgcgatggctcgatgctcggacatacagcgacccattggcgcttagagagttcaaagagttcgcagccggaaggagatcagtctcgggcgatctcatactcgaaatcgggaaacttccgcagcacctaacccaaagagcccaaaatgcactcgataacttagtgatgctgcacaactcagagcagggcgggcgagcatatcgccacgcaatggaagaactacccgacaccatagaaacacttatgctacttgccttaatcgccgtcctgacaggcggagtgacgttattctttctgagtgggcgggggctggggaaaacatccatcggcttactatgcgttatggcttcgagtgtcctgctgtggatggcctcggtcgaaccgcattggattgcggcatcaatcatcttagagttcttcctaatggtcctcctcattcccgagcccgaccgccaacggacaccgcaagataaccagctcgcatacgttgtaatcggtctactattcatgatcttaacagtagctgccaacgaaatgggcctgctagaaaccactaaaaaggacttaggcatcggccacgtcgcggtagaaaatcatcaccacgccgcgatgctggacgtcgacttgcaccccgcctcagcttggaccctgtacgcggttgccaccacaataataacaccgatgatgcggcatactatagaaaacaccacagcgaatatatctctcacggcgatagcaaaccaagctgcaatcctaatgggcctagacaaggggtggcccatctcgaaaatggacataggcgtaccgctgctggcactaggatgctattcccaagtgaatcctctgaccctaaccgccgccgtcctcatgctggtcgctcactacgcaattatagggccaggcctacaagcaaaagcaacccgagaggcccagaagagaacagccgccgggatcatgaaaaacccaaccgtcgatggaatagtcgccatagatctcgaccctgttgtttacgacgccaagtttgagaaacaactaggacaaatcatgctgctaatactgtgtacctcgcaaatactgctcatgagaaccacctgggccctgtgcgaatccataacattagccacaggccctctgaccacactctgggagggaagtcccggaaagttttggaacacgaccatcgccgtctctatggccaacatattccgaggaagctacctggctggcgcgggcctggcttttagcttaatgaaaagccttggaggagggagacgagggacaggagcccaaggagaaaccctaggggagaagtggaagcggcaactgaaccaattaagcaaaagcgaatttaacacctacaaaagatccggcatcatggaggtagataggtcagaagccaaagaggggctgaagagaggcgaaacaacaaaacatgcggtatcgcgtggaaccgcgaaactgagatggttcgtggaacgcaatctggtcaaacccgaaggtaaagtcattgatctaggctgcggacgaggcggctggagctactactgcgctggacttaagaaggtgacggaggttaagggctatacaaagggagggcccggacacgaagaaccgataccgatggccacgtacgggtggaaccttgtaaagctacactccggaaaagatgtcttcttcataccacccgaaaagtgcgatacactcctttgtgatataggagagtcatcccctaacccaaccatagaggaggggcgcacactcagagtcctcaagatggtcgaaccatggctccgaggaaaccaattttgcataaagatactgaatccgtatatgccgtcagtagtagaaacgctagagcagatgcaacgaaaacacggaggcatgctagtccgaaaccctctcagcagaaacagcacccatgagatgtactgggtctcctgcggtaccggaaacatagtaagcgcggtgaacatgacgagtaggatgctccttaaccggtttacaatggcacacaggaagccaacatacgaacgcgacgttgacctcggtgcgggaacgaggcacgtcgccgtggagccggaggtcgctaacttggatatcattggacaacgtatagagaatataaaacacgaacacaagagcacatggcattacgacgaagataacccctacaagacatgggcatatcacggcagttacgaggtaaaaccctccggttccgcctcaagtatggtaaatggggtagttaagctgctcaccaaaccgtgggacgtcatacccatggtgacgcaaatagccatgacggataccacgccattcggacaacagcgcgtcttcaaggagaaggtagacactcgtaccccaaaagcaaaaaggggcaccgcacaaataatggaagtcaccgcgaagtggttgtgggggttcctcagtcgaaacaaaaagccgcgtatatgcacgcgagaagagttcacgaggaaggtgcgatcgaatgcagcgataggagcagtctttgtagacgaaaatcaatggaactccgcgaaggaagcggtggaagacgaacgcttttgggatttagtccatagggaaagagagcttcacaaacaagggaagtgcgcaacatgcgtttataacatgatggggaagagagagaagaaactcggcgagttcggcaaagcgaaaggaagccgtgcgatttggtacatgtggcttggagcgcgttttctcgagttcgaagccctcgggttcatgaacgaagaccactggttctcgcgtgagaacagcttatcaggcgtagagggcgagggacttcacaagctcgggtacattctacgcgacatcagcaaaatccccggcggaaacatgtacgccgacgacacagcggggtgggacactaggataacggaagacgacctccagaacgaggccaagataacagacatcatggaacccgaacacgccctgctggcaaaatcgatcttcaagctaacctaccaaaacaaagtcgtccgagtgcagcgacccgctaagaatggaacggtaatggatgtgatcagccgacgcgaccaaaggggctcggggcaagtaggaacatacggcttaaacacgttcacaaacatggaggcgcagctcatacgacaaatggaaagcgagggcatattcagccctagcgaattagaaacgccaaatcttgcaggccgtgtgctcgactggctggagaaacacggagttgagagactcaaacgaatggcaatcagcggggacgactgtgttgtaaagccaatagacgataggttcgcaaccgccctaacagcacttaacgatatggggaaagtacggaaagacataccgcagtgggaaccctccaaagggtggaacgactggcaacaggtgcccttctgtagccatcactttcaccaactaatcatgaaagacgggcgcgaaatagtcgtgccctgccgaaaccaggacgaactcgtcggacgagcacgcgtgagtcaaggagcaggatggagcttaagagagactgcctgtctcgggaaaagctacgcgcagatgtggcaactaatgtacttccaccgacgcgacctgagactcgcagcgaacgccatatgtagcgcggtccccgttgactgggtccctaccagccgaaccacctggagcatccacgcccaccatcagtggatgactacagaagacatgttaagcgtgtggaaccgtgtctggattgaggaaaacccatggatggaagataagacacacatttcaagctggggcgatgtgccatacctaggaaagcgcgaagaccaatggtgcggatctcttatcggactgaccgcccgggccacgtgggctacgaacatacaagtcgccatcaatcaggtaagaaggctgctcgggaatgaaaactacctcgattacatgacgtcgatgaagagattcaagaacgagtcggacccagaaggggctctgtggtag

SEQ ID NO: 24601 - RNA, 9879 nt, synthetic construct
  misc_feature 1..9879: note = derived and/or modified CDS sequence (opt11) from DENV-1__EU482535__SS-prME
  source 1..9879: mol_type = other RNA
agcgtaaccatgctgttgatgctgatgcctacggctctggccttccacctcaccaccaggggcggggaaccccacatgatcgtgaccaagcaggagcgcggcaagagcctgctgttcaagaccagcgcgggtgtgaacatgtgcaccctcatagcgatggacctgggcgaactgtgcgaggacaccatgacctacaagtgcccccgcatcaccgaggctgagcccgacgacgtcgattgttggtgcaacgccacggacacctgggtgacctacgggacctgctctcagacgggcgagcaccgccgcgataagcggtccgtggccctcgcgccccacgtgggcctggggctggagaccaggaccgagacgtggatgagttcagagggcgcctggaagcagatacaacgggtcgagacgtgggccctccgccaccccggtttcaccgtgatcgccctgttcctggcgcacgccatcggcacttccataacccagaaggggatcatctttatcctcctgatgctggtgacgcccagcatggccatgcggtgcgtcggcatcggctcgcgcgacttcgtggagggacttagtggcgccacctgggtggacgttgtgctggagcacgggagctgtgtcaccaccatggcaaaggacaagcccacgctggacatcgagctcttgaagaccgaggtcaccaacccagccgtgctgcggaagctctgtatcgaggccaagatctcgaacacgacgacagactcgcgctgcccgacccagggggaggctaccctgatggaagaacaggatgccaactttgtttgccggcgcacgttcgtcgaccggggctgggggaacgggtgcgggttgttcggcaaggggagcttaatcacgtgcgctaagttcaagtgcgtgaccaaattggagggcaagatcgtgcagtacgagaacctgaagtactctgtcatcgtgacagtacacactggcgaccagcatcaggtagggaacgagtccaccgagcacggcaccaccgccacaatcacaccccaggcccccacctccgagatccagctcaccgactacggcgcgctgaccctggattgtagcccccgcacgggcctcgatttcaacgagatggtgctgctgaccatgaaggagaagtcctggctcgtccataaacagtggttcctggacctaccgctcccctggaccagcggggcaagcaccagccaggagacatggaaccggcaggacctgctagtgacctttaagaccgctcacgcgaagaagcaggaggttgtcgtgctaggaagccaggagggcgctatgcacaccgccctgacgggtgccacagagatccaaacctcgggcaccacgactatcttcgccgggcacttaaagtgtcgcctcaagatggacaagctgacactgaagggcatgagctacgtgatgtgcactggatctttcaaactcgagaaggaggtcgccgaaacgcagcacggcacggtgctggtgcagatcaagtacgagggcaccgacgccccatgcaagatcccattctcgacccaggacgagaagggggttacacaaaacggccggctaattaccgccaacccgatcgtgaccgataaagagaagcccgtgaacatagaggccgaaccgcccttcggggaaagctacatcgtcatcggggcgggcgagaaggccctcaagctaagctggtttaagaagggatccagcattggcaagatgttcgaggccaccgcccgcggggccaggcgtatggctatcttaggcgataccgcctgggacttcgggtccatcggcggcgtgtttaccagcatagggaagctggtgcaccagatcttcggaaccgcctacggggttctcttctcgggagtgagctggaccatgaagatcgggatcggcgtgctgcttacatggctcggcctgaacagccggagcacctccctgtctatgacctgcatagcggtggggttagtgactctatacctgggcgtgatggtacaggccgactccgggtgcgtgatcaattggaagggccgggagttgaaatgcggaagcggcatattcgtgacgaacgaggtccacacctggactgagcagtacaaattccaggcggacagccctaagcgcctgtctgccgccataggtaaggcttgggaggagggtgtatgcggcatccgttcagccacccgcttggagaacattatgtggaaacaaatctccaatgagctcaaccacatcctgctagagaacgatatgaagttcacggtggtcgtgggggacgtggtcggaatcctcgcgcaggggaagaagatgatacggccccagcccatggagcacaagtacagctggaagagctggggcaaggccaagatcatcggcgccgacgttcagaacacgacatttatcatcgacggacccaacaccccggagtgccccgacgaccagcgggcctggaacatctgggaggtggaagactacgggttcgggattttcaccactaacatctggcttaaaatgcgggacagctatacccaagtgtgcgaccaccgcctgatgtccgcggccattaaggactctaaggcagtgcacgcggacatgggttactggatcgagtccgaaaagaacgagacctggaagctagcccgggcgagcttcatagaggtgaagacctgcatttggcccaagtcccatacgctgtggagcaatggcgtcctggagtcagagatgataatccccaaaatttacggtggaccgatcagccagcacaactaccgccccgggtacttcactcagaccgccggaccctggcacctcgggaagctggagctggactttgatctctgcgaaggcaccacggtcgtggtggatgagcactgcgggaaccgggggccgtccttaagaaccaccacagtgacgggcaaaatcatccacgagtggtgctgccgctcctgcaccctgcccccccttcgatttaagggggaggacgggtgttggtatgggatggagatcagacccgtgaaggagaaggaggagaacctggtcaagtccatggtgtccgccgggtcgggggaggtggattcgttcagcttagggctcctgtgtatctccatcatgatcgaggaggtcatgaggagccggtggagccgcaaaatgctgatgaccggcaccctcgccgtgttcctgttgctgatcatgggtcagctaacgtggaacgatctgatacggctctgcatcatggtgggcgccaacgcgtcagaccgcatggggatgggaaccacctatctggccctgatggccaccttcaagatgcgcccgatgtttgcggtgggcctcttgttccgtcgcctgacgtcccgggaggtgctcttgctgaccatcgggctctcattagtggcctccgtcgagctgcccaacagcctcgaggagctgggcgatgggcttgcaatgggcatcatgatcctgaagttgctgaccgatttccagtcccatcagttgtgggccacgctgctgagcctcacatttatcaagaccactctgagcctgcactacgcatggaagaccatggccatggtgttaagcatcgtctcgctgatcccgttgtgtctcagcacgacctcccagaagaccacctggttacccgtactgctgggtagcctggggtgcaaaccattgacgatgtttctcatcgcggagaacaagatctggggtcgcaagtcctggcccctgaacgaggggatcatggcagtgggggttgtgagcatcctgctctcatccctgctgaagaacgacgtgcccctcgcagggcccctgatcgccggcgggatgctgatcgcctgctacgtcatcagtgggtccagcgcggacctgtccctggaaaaggccgcagaagtgagctgggaagaagaggccgagcactccggcgcgagccataacatcttggttgaggtgcaggacgacgggaccatgaagatcaaagacgaggagcgggacgacaccctcaccatcctgctaaaggcaaccctcctggccgtatccggcgtgtacccgctgagcatccccgccacccttttcgtctggtatttctggcagaagaagaagcagcgcagcggggtgctgtgggacacgcccagcccgcccgaggtggagcgggccgtcctggacgacggcatctaccgcatcatgcaaagaggcctactcgggcgctcccaagtgggcgtgggggtcttccaggaaaacgtgttccacaccatgtggcatgtgacgcgaggcgccgttctgatgtaccaggggaagcgcctggaacccagctgggcgtccgtgaagaaggacttaatcagctacgggggcgggtggcggctgcaaggcagctggaacacgggggaggaggtgcaggtcattgccgtggagcccaggaagaacccaaagaatgtgcagaccgcaccaggtaccttcaagacacccgaaggagaagtaggcgccatcgccctggacttcaagcccggaacgtccgggtcccccatcgttaaccgggagggcaagatcgtggggctctacggcaacggggtagtcaccaccagcggcacctacgtgagcgccatcgcccaggccaaggcctcccaagagggccccctgcccgagattgaggacgaggtctttcgaaagaggaacctcacgattatggaccttcacccggggagcggtaagacccgccgctacctgccggcaatcgtgagagaggctatcaagcggaagctgcgcaccttaatcctggccccaacccgcgtggtcgcctccgagatggccgaggcgctaaaggggatgcccattcggtaccaaacgaccgccgtcaagagcgagcataccggcaaggagatcgtcgacctcatgtgccacgcaacgtttacaatgcgtctgctaagtcccgttcgggtgccgaactacaacatgatcatcatggacgaggcccatttcacggatcccagctccattgcggcgcgcggctacatctctacccgggtcgggatgggtgaggccgccgcgatattcatgacggccacgcctccagggtccgtcgaggcgttcccgcagagcaacgccgtgatccaggacgaagagcgcgacattcccgagcgctcctggaacagcggttacgaatggatcaccgacttccctgggaagacggtgtggttcgtcccctcaataaagagcgggaacgacatagccaactgcctccgcaagaacggcaagcgagttatccagctgtccagaaagaccttcgacacggagtaccagaaaaccaaaaataatgactgggactacgtggtcaccacagacatcagcgagatgggggccaacttccgtgcggatcgcgttatagatccgcgtcgctgtctgaagccggtgatcctcaaggacggccccgagcgggtgatcctggcagggcccatgccggtgacggtcgcctccgccgcccaacggcgtggccgcatcggccggaaccataataaggagggagaccagtacatctacatgggacagccgctgaataatgacgaggatcacgcccactggaccgaggccaagatgttactggacaacatcaatacccctgagggcatcatcccagccctgttcgagccggagcgagagaagtcagccgccatcgacggtgagtatcgcctccgcggggaggcccgcaagaccttcgtagagctgatgaggcgaggcgacctgcccgtgtggctctcctacaaagtcgccagcgagggcttccagtacagcgaccggaggtggtgtttcgatggcgagagaaacaaccaggtgcttgaggagaacatcgacgtcgaaatctggacaaaagagggcgagcgcaagaagttgcggccccgctggctggacgcccggacctactccgaccccctggccctgcgcgaattcaaggagttcgccgcggggcggaggagcgtttccggcgacctcatcctagagatcgggaaacttccgcagcatctcacacagcgggcccagaacgctctggacaacctggtgatgctccataacagcgagcagggaggccgcgcctaccggcacgcgatggaagagttacccgacacgatcgaaacgctaatgctccttgccctgatcgccgtgctaaccgggggcgtcactctgtttttcctgtccgggaggggcctcgggaaaaccagcatcgggctgctgtgcgtgatggcctcctcagtgctcctgtggatggcctctgtcgagccccactggatagcggcctccatcatcctagagttcttcttgatggttctgctcattcccgagccggaccggcagcgaacgccccaggataaccaactcgcttacgtcgtcataggcctgctgtttatgatcctcacagtcgccgccaacgagatggggttgctggagacgacgaagaaggacctcggcatcgggcacgcggccgtggaaaatcaccatcatgccaccatgctggacgtcgacctgcatcccgctagcgcctggacgctctacgcggtggcaaccaccattatcacgccgatgatgcggcacactatcgagaacaccactgccaacatcagcttgaccgccatagccaaccaagccgccatactgatgggccttgacaaaggctggccgatctccaagatggacatcggcgtgccgctgctggctctcggctgctactcccaggtcaatcccctgacgctgaccgccgcggtgctcatgctggtggcccactacgctataatcgggccgggcctgcaggccaaggcaacgcgcgaggcgcagaaacgcacagccgccggcataatgaagaaccccacggtcgatggcatcgtcgcgatcgacttagaccccgtggtctacgacgccaaattcgagaagcagctcgggcagatcatgttactcatattgtgcaccagccagattctgctcatgcggaccacttgggcgctatgcgagagcatcacgttagccaccggtcccctgacaaccctgtgggagggttcccccgggaagttctggaacaccaccatagccgtgagcatggccaacatcttccgtggctcctatcttgccggggcgggattagcgtttagcctaatgaagtcactgggtgggggccggcgcggaactggcgcccagggcgagaccctcggtgagaagtggaagcggcagcttaaccagcttagcaagagcgaattcaacatatacaaacgctccggaatcatggaagtagaccgaagcgaggctaaggaggggctcaagcggggcgagacgactcggcatgcggtgtcccgcggcaccgccaagctgcggtggttcgtggaacgaaacctggtgaagcccgagggcaaggtgatcgacctggggtgcggccggggcgggtggagctattactgcgccggtctcaagaaggtcaccgaggtgaagggctacacgaagggcgggcctggccacgaggagcccatcccgatggccacctacggttggaatctggttaagttacactccggaaaggacgttttcttcactccgcctgagaagtgtgatactctcctatgcgatatcggcgagtcgagccccaacccgacgatagaggaggggcgcaccctgcgggtgctcaagatggtcgagccgtggctccgcggcaaccagttctgcatcaagatcttgaacccctacatgcccagcgtggtggagactctcgagcagatgcaacggaaacacggcggcatgctcgtccgcaacccgctgtcccgtaatagcacacatgagatgtactgggtgagttgcggtaccgggaacatagtaagcgccgtcaatatgactagccgcatgctcctcaaccgcttcaccatggcgcatcggaagccaacctatgagaaggacgtggacctgggcgccgggactcgccacgtggccgtcgagcccgaggtggccaatctcgatatcatcggacaacggatcgagaacatcaagcacgaacacaagagcacgtggcactacgacgaagacaacccctacaaaacctgggcgtaccacgggtcttacgaagtgaaaccgtcaggttcggctagctctatggtcaacggcgtagtcaagctgctgaccaagccatgggatgtaatccccatggttacccaaatcgccatgacggacaccaccccctttgggcaacagagggtgttcaaagagaaagtggacacacggacgccgaaagccaagcgcggcacggtgcagattatggaggtcaccgcccggtggctctgggggttcctgtcccgcaacaagaagccccggatctgtacccgcgaggaattcacgcggaaggtgcgcagcaacgcggcgataggggcagtgtttgtcgatgagaaccaatggaattccgccaaggaggccgtggaggacgagcggttctgggacctggtgaagaaggagcgcgagctccacaagcagggcaaatgcgcaacctgcgtctacaacatgatggggaagagagagaagaaactcggcgaattcgggaaggccaaggggtcccgggccatatggtacatgtggctgggggccagattcctcgagttcgaagccctgggattcatgaacgaggatcactggttctcccgcgagaacagcctgtccggcgtggagggggagggcctccataagctggggtacattctgcgggacatcagcaagatccccggcggtaacatgtacgcggacgacaccgccggctgggatacgcgcattacggaagacgacctacagaatgaggccaagatcactgacatcatggagccggaacatgccctgctggcaacatccatcttcaaactaacctaccagaacaaggtggtccgggtgcagcgccccgcgaagaacggcacggttatggatgtcatcagcaggagggaccaacgcgggagcggccaggtgggcacctacggactaaataccttcaccaacatggaggcccaactgatccggcagatggagagcgagggcattttcctcccctccgagctggagacgcccaacctggccgagcgagtgctcgactggctggagaaatatggcgttgagcgactgaagcgcatggccattagcggcgacgactgcgtggtcaagccgatcgacgaccggttcgccaccgcgctcacggccttgaacgatatgggtaaagtccgcaaggacatcccccagtgggagccttccaaggggtggaacgattggcaacaggtccccttctgctctcaccatttccatcagctgatcatgaaggatgggcgggagatcgtggtcccatgccgcaaccaggacgagctcgttggccgggcccgcgtgtcccagggcgcagggtggtctctgcgggagaccgcctgtctgggcaaaagctacgcgcaaatgtggcagctcatgtactttcacagacgcgaccttcgcctggcggcaaacgccatatgctccgcggtcccagtgaactgggtgcctactagtcggaccacatggtccatccacgcccaccatcagtggatgactacggaagatatgctcagcgtctggaacagagtgtggatcgaggagaatccctggatggaagataagacccatgtgtccagctggggcgatgtcccgtacctgggcaagcgggaggaccagtggtgtgggtccctgatcggcctcacagcgcgggcgacctgggcgagcaacatccaggtcgcgatcaaccaagtgcgccggctgatcggcaacgagaactacctggactatatgacctcaatgaagcgcttcaagaacgaaggggaccctgagggcgccctctggtga

SEQ ID NO: 24602 - RNA, 9879 nt, synthetic construct
  misc_feature 1..9879: note = derived and/or modified CDS sequence (opt11) from DENV-1__EU482536__SS-prME
  source 1..9879: mol_type = other RNA
agcgtgacaatgctgctcatgttgatgcccaccgccttagccttccaccttaccacccgcggcggtgaaccccacatgatcgtgtcaaaacaagaacggggcaagtcgctgctgttcaagacttctgccggtgtgaacatgtgcaccctaatcgccatggaccttggcgagttctgcgaagacacaatgacgtacaagtgcccgcggatcaccgaagccgaacctgacgacgtggactgctggtgcaatgcgaccgacacgtgggtcacctacggtacctgcagccagaccggcgagcaccggcgggacaagagatccgtggctttggccccgcacgtgggtctcgggctggaaacgcggaccgagacctggatgagctccgagggagcctggaaacaaatccaacgcgtggagacctgggccctgcgccaccccgggttcacggtgatcgccctcttcctggcgcacgctataggcacctcaatcacccagaagggaatcatctttatcctactcatgctggtgaccccttccatggccatgagatgcgtcggcatcggcagccgcgatttcgtcgaggggctgtccggcgctacttgggttgacgtcgtgttggagcacgggagctgcgtgaccaccatggcaaaggacaagccgaccctggacatcgagctcctcaagacggaggtcaccaaccctgcggtcctgcggaagctgtgcatcgaagccaaaattagcaacaccactaccgacagccgctgtccgacacagggcgaggccacactcgtggaggagcaggacgccaacttcgtctgcagacgcaccttcgtggatcgaggctggggaaacgggtgcggcctgtttgggaaagggtccctgatcacgtgcgccaaattcaagtgcgtgacgaagctcgagggcaagatcgtccagtacgaaaatctgaagtacagcgttatcgtaacggtccacaccggcgaccagcatcaggtggggaacgagtcgacggagcacggtaccaccgcgaccatcacgccgcaggcccccagcacggagattcagctgaccgactacggggccctcactctggactgctcgcctcggaccggcctagactttaacgagatggttctcctgacaatgaaggagaagtcctggctggtacataagcagtggttcttggacctgccgctgccatggactagcggcgccagtaccagccaggagacttggaaccggcaggacctcctcgtgacgttcaagaccgcccacgccaagaagcaggaggtcgtggtgctgggttcccaggagggcgccatgcacaccgccctcacgggggctacggagatccagacctccggaaccaccacgatctttgctgggcacctgaagtgccgcctgaagatggacaagttaactctgaagggcatgtcctatgtcatgtgcaccgggagctttaagctggagaaggaggtagctgagacccagcacggcactgtgttggtccagattaagtacgagggtaccgacgccccgtgcaaaatccctttctccacccaggacgaaaagggggtgacccagaacggccggctgatcacagccaatccgatagtgacggataaagaaaagcccgtcaacatcgaggcagagcctccgttcggggagtcgtatatcgtgatcggcgcgggcgagaaggccctgaagctgagttggttcaagaaggggagctccatcggcaagatgttcgaggccaccgcccgcggcgcgagacgcatggcgatactcggcgacaccgcttgggacttcggtagcatcggaggggtcttcacgtcggtgggcaagctggtgcaccaaatcttcggcacagcctacggggtactgttcagcggcgtaagttggaccatgaagattgggatcggagtgctcttgacctggctgggcctgaatagccgctccacgagtttgtccatgacctgcatcgcggtggggctagtcactctctacttgggcgtgatggtgcaggctgacagcgggtgtgtcatcaactggaaaggccgggagctcaagtgtgggtcgggaatcttcgtaaccaacgaggtgcacacgtggaccgagcagtacaagttccaggcggactccccgaagcgactcagcgccgctatcggcaaggcttgggaggagggggtctgcggtatacgttccgctacccgcctggaaaacatcatgtggaagcagataagtaacgaactgaaccacatccttctggagaacgatatgaaactgaccgtggtggtcggggacgtggccggcatcctcgcccaggggaagaaaatgataaggccccaaccaatggagtacaaatactcctggaagagttggggcaaggccaagatcatcggggccgacgtgcaaaatactacattcatcatcgacgggcccaacaccccggagtgccccgacgaccagcgcgcgtggaacatctgggaggtcgaggactacgggttcgggatcttcacgaccaacatctggctcaagctgcgtgattcctacacccaggtctgcgaccacaggctcatgagcgccgctattaaggatagcaaggccgtgcacgccgacatgggatactggatcgagtcagagaagaacgagacctggaagctggcgagagccagcttcatcgaggtcaagacctgcatctggcccaagtctcataccctgtggtccaacggcgtgctcgagagcgagatgatcatacccaagatctacgggggcccgataagccaacataactaccgccccgggtacttcacacagactgccgggccctggcacctggggaagctggagttggactttgacctgtgcgaaggtacgacggtagtcgtggacgagcactgcggcaaccgggggcctagcttgcgcactaccaccgtgaccggcaagataatccacgagtggtgctgccggtcctgtacgctgccgcccctgcgtttcaagggggaggacggatgctggtatggaatggagattaggcccgtcaaggagaaggaagagaacctggtcaagtccatggtcagcgccggctccggcgaggtcgacagcttctccctcgggctgctgtgcatcagcatcatgatcgaggaagtgatgcgctccaggtggtcccgcaagatgctcatgactggcaccctggccgtgttcttcctgctaatcatgggccagctgacctggaacgacctgattcggctctgcatcatggtcggcgcgaacgcctccgaccgcatggggatgggcactacatacctggccctaatggccaccttcaagatgcgcccgatgttcgcggtgggcctcctgttccggcgcctgacaagccgggaggtgctcctgctgacaatcgggttaagcctagtagcgagcgtggagctgccgaactccctggaggaactgggcgacgggctagccatgggcatcatgatactcaaacttctgaccgactttcagtcacaccagttatgggccaccctgctgtcgttaaccttcatccggacgaccttcagtctgcactacgcctggaagaccatggcgatggtcctgtccatcgtgagcctcttccccctctgcctgtccaccacgtcgcagaagaccacgtggctgcccgtgctgctgggctccctcgggtgcaagccgctgaccatgttcctgatagcggagaataagatctggggccgcaagagctggcccttgaatgaggggatcatggccgtcgggatcgtgtcaatcctcctctccagcctcctgaagaacgacgtacccctggccgggcccctcattgcagggggcatgctgatcgcatgctacgtaatttccgggagctccgccgacctaagcctcgagaaggccgcggaagtgtcctgggaggaggaggccgaacactctggcgcttcccacaacatactggtcgaggtccaggacgacgggactatgaagataaaggacgaggaacgcgacgacatgctcaccatcctgctcaaagccaccctactcgccgtgagcggcgtgtacccactgtccatcccagccacccttttcgtgtggtacttctggcagaagaagaagcagcgtagtggggtgctgtgggacacccccagcccgcccgaggtggagcgcgccgtcctggatgacggcatctaccggattatgcagaggggcctgctggggcgttcccaggtgggtgtgggggtattccaagagaatgtgttccacacgatgtggcatgtgacgcgtggcgcggtcctgatgtaccaagggaagagattggaaccctcgtgggcaagcgtgaagaaggacctgatttcgtacggcggcggttggagactgcagggctcgtggaacaccggggaagaggtgcaggtcatcgccgtagagccgggcaaaaaccccaagaatgtccagaccgcccccggtacgttcaagacctctgagggtgaggtcggcgccatcgcgctggacttcaagcccggcacctctggcagccccatcgttaaccgtgaggggaagatcgtgggactgtacggaaacggggtcgtgaccacgtccggcacctacgtgagcgccattgcccaggccaaagcgtcccaggaggggcccctcccggagatcgaggacgaagtcttccgcaagcggaacctgacgatcatggatctgcacccagggtcagggaagacgcgccggtacttaccggccattgtgcgagaagccataaaacggcggctgcgcacgctgatacttgccccgacgcgggtggtagccagtgagatggcggaagccctgaaaggtatgcccatccgctaccaaaccaccgccgtcaagtctgagcacacgggtaaagagatcgtggaccttatgtgccacgccaccttcaccatgcgtctcctgtcccctgtccgcgttcccaactacaacatgataatcatggacgaggcccacttcaccgacccgtcctcaatcgccgcacgggggtacataagcacgcgtgtgggcatgggtgaggcagccgcgattttcatgacagcgacgccgcccgggtccgtggaggccttcccacagagcaacgccgtgatccaggatgaggagcgggacatcccggagcggtcctggaacagcgggtacgagtggattacagacttcccgggcaagacggtgtggttcgtcccatccatcaagtctggcaatgacatcgccaactgcttgcggaagaacggcaaaagagtcattcaactctccaggaaaaccttcgacaccgagtaccagaagacgaagaacaacgactgggactacgtggtcaccaccgatatcagcgagatgggcgccaatttccgggcggaccgtgtgatcgatccgcgccggtgcctgaaaccggtgatcctgaaggacggacccgaacgcgtcatcctcgccggccccatgcctgtgaccgtcgcgtccgccgcgcaacggcgcgggaggatcggccgcaaccacaacaaggagggcgaccagtacatctacatggggcaacctcttaacaacgacgaggaccacgcccactggaccgaggccaagatgttactcgataacatcaacacacccgaggggattatccccgcactgttcgaaccagagcgcgagaagtccgcagctattgacggggagtaccggttgcgcggcgaagcccggaagaccttcgtggagctcatgcgccgtggggatctgccggtctggttgagctacaaggtcgcatccgagggcttccagtatagcgacagaaggtggtgtttcgacggcgaacgtaacaaccaggtgctcgaggagaacatggacgtagagatatggaccaaggagggggagcggaagaagctgcgcccccggtggctggacgcacgtacatattccgaccccctcgccctgcgggagttcaaggagttcgcggccggccgccggagcgtctccggcgacctgatcttagagatcggcaagctgccccagcatctcacgcaaagggcccagaatgcactcgataacctggtgatgctgcacaattccgagcagggcggcagagcgtaccgccatgccatggaggagctcccggacacaatcgagacactgatgttgctcgcgttgatcgccgttcttaccggcggggtaacgctgttcttcctgtccggccgggggctgggcaagacatctatcggccttctgtgcgtgatggcctcctctgtcctgctgtggatggcgtccgtggagccccactggatcgccgccagcatcattctggagttcttcctgatggtgctcctaatccccgagcccgaccgccagcggaccccgcaagacaaccaactggcttacgtcgtgatcgggctcctgttcatgatcctgaccgtagccgcgaacgagatgggcttactggagaccactaagaaggacctgggtatcggccacgttgccgtcgagaaccaccaccacgccgccatgctcgacgtggacctgcacccggcctcggcgtggaccctgtacgccgtggccaccaccatcatcacgcccatgatgcgccacaccatcgagaacaccactgctaacatctcccttacggccatcgcgaaccaggccgccatcctgatggggttggacaaggggtggccgatatccaagatggacattggcgtccccctactggcattggggtgctacagccaggtgaaccccctcaccctgaccgccgccgtcctgatgctcgtggcccactacgccattatcggccccggcttacaagccaaggcgacccgcgaggcccaaaagaggacggccgccggcatcatgaagaacccgacggtcgacggaatcgttgctatcgacctggaccccgtagtgtacgacgcgaagtttgagaaacaactgggccagatcatgttattgatcctatgcacctcccaaatcctgctgatgaggaccacctgggccctctgcgagtcgattaccctggccaccggccctctgaccaccctgtgggaggggtcccccggcaagttctggaacaccaccattgccgtgtccatggcaaacatatttcgtgggagctacttggcgggcgcagggctggcattttcactcatgaagtccctcgggggcgggcgtcggggtaccggggcacagggcgagacgctgggtgagaagtggaagcgccagctcaaccagctttccaagtcagagttcaatacttataaaagaagcggcattatggaggtcgacaggagcgaggcaaaagaaggcttgaagcgcggggagaccaccaagcacgccgtgtccagaggcaccgccaagctccgttggttcgtggagcgtaacctagtaaagccggaagggaaagtaatagacctgggctgcggcagaggcgggtggagctattactgcgccgggctgaagaaggtaaccgaggtcaagggttacaccaagggcgggcccggccacgaggaaccgatccccatggcaacctatgggtggaacctcgtaaaactgcactccggcaaggacgtgttctttatacccccggagaagtgcgacacgctgctctgcgacattggggagagctccccgaaccccacaattgaggagggccggaccctgcgggtgctgaaaatggtagaaccgtggctccgcgggaatcagttctgcatcaagatacttaacccctatatgccctcggtcgtagaaaccttagagcagatgcaacgaaagcacgggggcatgcttgtgcgcaacccactgtccaggaacagcacgcatgagatgtactgggtgtcctgcgggaccggtaacatcgtcagcgcggtgaatatgacttcccgcatgctgctaaacagatttaccatggcccaccggaagcctacctacgagcgcgacgtggacctgggcgccggcactagacacgtcgccgtggagcccgaggtggccaacctggacatcatcggacaacgcatcgaaaacattaagcacgagcacaaaagcacctggcattacgacgaggataacccctacaagacctgggcgtaccacgggtcctacgaggtcaagccaagcggcagtgcgtcctctatggtaaacggggtcgtgaagctcctgaccaaaccatgggacgtcatccccatggtaacgcagatagccatgaccgacactactcccttcggccagcaacgggtgtttaaggaaaaggtggacacacgcactcccaaggccaagcgggggaccgcccagatcatggaggtgaccgcgaagtggctctggggcttcctctcccgcaacaagaagccgcggatctgtacgcgagaggagttcacccggaaagtgcgcagtaacgccgccatcggcgccgtgttcgtggatgagaaccaatggaacagcgcgaaggaggccgtggaggacgagcggttttgggatctggtgcaccgcgagcgggagctgcacaagcaggggaagtgcgcgacctgcgtgtacaacatgatgggcaagcgcgagaaaaagctcggggagttcggcaaggcgaaggggagccgcgccatatggtacatgtggctgggtgccaggttcctggagttcgaggccctcggttttatgaatgaggaccactggttctcccgggagaatagcttgtccggggtcgagggcgaagggttacacaagctcggttacatcttacgcgatatctcaaagatcccagggggcaacatgtacgccgacgacaccgccggatgggacaccaggatcaccgaagacgacctgcagaacgaggccaaaatcacggatatcatggagcccgagcacgcgctcttggccaaaagcatcttcaagctgacataccaaaataaggtagtccgggtacagaggccggccaagaatggaacagtgatggatgtcatcagccgtcgggatcagaggggatccggccaggttggcacctacggcctcaacacctttaccaacatggaggcccagctgatccgacagatggagagcgaaggtatattctccccttccgagctcgagacgcccaacctggcaggccgggtgctcgactggctcgaaaaacatggggttgaacgcctcaagcggatggcgatcagtggcgacgattgcgttgtgaaacccattgacgaccgcttcgccacggcactgaccgccctgaatgacatgggtaaggtacggaaggacatcccgcagtgggagccctcaaaggggtggaacgactggcagcaggtccccttctgcagccatcactttcaccagctcatcatgaaggacggccgcgagatcgtggtcccctgcaggaaccaggacgaactggtagggagggctcgagtgtcacagggcgcggggtggagcctgcgcgaaaccgcctgcttaggaaagtcatacgcccagatgtggcagctgatgtacttccaccgccgagacctgcggctcgcagctaacgccatctgtagcgcagtcccggtggactgggtgcccacgtcccgcaccacctggtcgatccacgctcatcaccagtggatgaccacagaagacatgctgtcggtctggaaccgggtgtggatcgaggagaacccctggatggaggacaagacccacgtcagctcatggggcgacgtcccctacctgggcaagcgcgaggatcagtggtgcggctctttgatcgggctgaccgctcgcgcgacgtgggccacaaacatccaggtagcaatcaaccaggtgcggagactactcggcaacgagaactacctggactacatgacatccatgaaacgctttaagaacgagagcgacccggagggggcgctgtggtga

SEQ ID NO: 24603 - RNA, 9879 nt, synthetic construct
  misc_feature 1..9879: note = derived and/or modified CDS sequence (opt11) from DENV-1__EU482537__SS-prME
  source 1..9879: mol_type = other RNA
tcggtgaccatgctgctcatgttaatgcccaccgccttggccttccacttgaccaccagagggggagagccgcacatgatcgtgaccaagcaggagcggggcaagagcttgctgtttaagaccagcgctggggttaacatgtgcaccctcatcgccatggacctgggcgagctgtgtgaggacaccatgacctacaagtgcccgcggatcaccgaggccgagccggacgatgtggactgctggtgcaacgccacagacacctgggtgacctacgggacctgctcgcagaccggcgagcaccggcgggacaagcgcagcgtggcactcgctccccacgttggcctgggactggagacccgcaccgagacctggatgtccagcgaaggagcctggaagcagattcagcgggtggagacgtgggccctccgccaccccgggttcaccgtgatcgcccttttcctggcgcacgccattggcacctccatcacccaaaaggggattattttcatcctccttatgctggtaacgcccagcatggccatgcggtgcgtcgggatcggctcccgcgactttgttgaggggctctcgggcgccacctgggtggacgtcgtgctggagcacgggtcctgcgtgacaaccatggccaaggacaagcccacactggatatagagctcctgaagaccgaggtcacgaaccccgcggtgttgcggaagctctgcatcgaggcgaagatcagcaacaccacgaccgatagccgctgccccacccagggcgaagccaccctgatggaggagcaagacgccaacttcgtgtgccggagaacgttcgtcgatcggggctggggaaacggctgcgggctgtttggcaaggggagcctcataacgtgtgccaagttcaagtgtgtgacgaagctggagggcaagatagtgcaatacgagaacctgaagtactccgtcatagtgaccgtgcacacaggcgaccagcaccaggtcgggaacgagagcactgagcacggcaccaccgcgaccataacgcctcaggcccccacctccgagatccagctcaccgactacggggccctgacgctcgactgctctccccgcacgggactcgacttcaacgaaatggtcttactgaccatgaaggaaaagtcctggctggttcacaagcagtggttcttagaccttccgctcccctggaccagcggggccagcaccagccaggagacatggaatcggcaggaccttctggtgaccttcaagacagcccacgcgaagaagcaggaggtggtcgtactcggcagccaagagggcgccatgcataccgccttaacgggggccaccgagatccagacctccggcaccacgactatattcgccggtcacctgaagtgccgcctcaagatggacaagctgaccctcaagggcatgagctacgtgatgtgcaccgggtcctttaagctcgagaaagaggtcgccgagacgcagcacggcacagtgctggtgcagatcaagtacgagggcacagacgccccctgcaagatccccttcagcacccaggacgagaagggggtcatccagaatggtagactgatcacggccaatccgatcgtcaccgacaaggagaagcccgtgaacatcgaagccgagccgcccttcggggagtcatacatcgtcataggcgttggcgagaaggcgctcaaacttagctggttcaagaaagggtccagcatcggcaagatgttcgaggccaccgcgcgtggagcccgacgcatggccatccttggcgacaccgcgtgggacttcgggtccatcggcggcgtatttacgagtgtcgggaagctggtgcaccagatcttcggcaccgcctatggggtcctgttctccggcgtcagctggacgatgaaaatagggattggcgttctgctgacctggctcggtctaaattctcgctcaacgagtttatccatgacctgcatcgccgtgggtctcgtcaccctgtacctgggcgtgatggtgcaggcagactccgggtgtgtcatcaactggaagggtcgggagctcaaatgcgggagcggcatcttcgtgaccaatgaggttcatacgtggaccgagcagtacaagttccaggcagacagcccgaagcgcctgtcggcggccatcggcaaggcctgggaggaaggggtatgcggcatccggagcgccacacgcctggaaaacatcatgtggaagcagatctccaacgagctcaaccacatcctgcttgagaacgacatgaagtttaccgtcgtcgtcggggatgtagttggcatactcgcccagggtaaaaagatgattcggccccagcccatggagcacaagtacagctggaagtcctggggcaaggccaagatcatcggcgccgacgtacaaaacaccacgttcatcatcgacgggccgaatacccctgagtgtcccgatgaccagcgtgcgtggaacatctgggaagtggaggattacggcttcggtatattcaccaccaacatctggctgaagctccgggatagttatacgcaggcctgcgaccaccgcctcatgtccgccgccataaaggacagcaaggccgtccacgcagacatgggttactggatcgagtccgagaagaacgagacctggaagctggcacgggcgtcgttcattgaagtcaaaacctgcatctggcccaagtcccacaccctgtggtcgaacggcgtgctcgagagcgaaatggttatccccaagatctacggagggcccatctctcagcacaactaccgccctggttacttcacgcaaaccgccggcccctggcacctggggaagctcgagctggacttcgatctgtgtgagggcaccaccgtcgtcgtggacgagcactgtggcaacagagggccgtccctgcgcacgaccaccgtcaccggcaagatcattcacgagtggtgctgccggtcttgcacgctgccacccttgcgctttaagggggaggacggctgctggtacgggatggagatacggccagtgaaggagaaagaggagaacctggtgaagtccatggttagcgcaggcagcggcgaggtggactccttcagcctcgggctgctgtgcatctctatcatgatcgaagaagtgatgcgcagtaggtggtcccgcaagatgctcatgaccggcaccctagccgtcttcctcttactgatcatggggcaactgacctggaacgacctcatccggctgtgcatcatggtgggcgccaatgccagcgaccgcatggggatgggcacgacctatcttgccctcatggcaacattcaagatgcgcccgatgttcgccgtggggctgctgttcagacgcctcacatcccgggaggtcctgctgctcacgatcggtcttagcctggtggcctccgtcgagctcccgaatagcctcgaggagctgggcgacgggctcgccatgggaatcatgatcctgaagctgctcactgacttccagtcccatcagctgtgggccaccctgctcagcctgaccttcattaaaaccaccctttccttacactacgcctggaagacaatggctatggtgctgagcatcgtgtccctgtttccactctgcctgtcgaccacttcccagaagacgacctggttacccgtcctcctgggcagcctggggtgcaagccgttgaccatgttcctcatcgcggaaaacaagatctggggcagaaagtcctggcccctgaacgaagggatcatggcggtgggcgtcgtgagcatcctcctgagctctctgctcaagaacgacgtgcccctggccggtccactgatcgcgggcggcatgctcatcgcttgctacgtgataagcgggtcctcagccgacctgtccctggagaaggccgccgaggtcagctgggaggaggaggcagagcactccggggcctctcacaatatcctcgtagaggtgcaggacgacggaacgatgaagatcaaggacgaggagcgggacgacaccctgaccatcttgctcaaggcgacgctgctggcggtgtcaggcgtatatccactctctatccctgccaccctgttcgtatggtacttctggcagaagaagaagcagcgctccggtgtcctgtgggacacgcccagcccgcccgaggtggaacgagccgtgctagacgacggcatctacagaatcatgcaacgaggcctcctgggacgctcccaggtcggcgtaggggtgtttcaggagaatgtgtttcataccatgtggcacgtgacccgtggcgccgtgctgatgtaccaggggaagcgcctcgagccaagctgggcgtccgtcaagaaggacctaatatcctatggcggcgggtggagattgcagggctcctggaacacgggggaggaggtacaggtgatagccgtcgaaccaggcaagaaccccaagaacgtgcagaccgcccctgggaccttcaagacacccgaaggtgaagtgggtgcgatcgccctcgacttcaagcctgggacctctggctcccccatcgtaaaccgtgagggcaagatcgtagggctgtacggcaatggggtggtcacgaccagcggcacctacgtaagcgcgatcgcccaggccaaggcatcccaggagggacccctgcccgagatcgaagacgaggtgtttcggaagcgcaacctcaccatcatggacctacaccccggcagcgggaagacccggcgttacctgccggccatcgtccgggaggccatcaagcgcaagttgcggacactgatcctagcccccacccgcgtggtggcctccgagatggccgaggcgctcaagggcatgcccatccggtatcagacaacggccgtcaagtcggagcacaccggcaaggagatagtggacctgatgtgtcacgcaacctttaccatgcgtctgctctcccccgttcgcgtcccgaactacaacatgatcatcatggacgaggcccacttcactgacccttcctcgatcgcggcgcgagggtatatctctacccgcgtcgggatgggtgaggccgccgccattttcatgaccgcaacgccgcctggctccgtggaggcgttcccgcagagcaacgccgtcatccaggacgaggagagggacatcccggaacggtcctggaatagcgggtacgagtggatcacagacttccccggtaaaaccgtgtggttcgtaccctccattaagagcggcaacgatatcgcaaactgcctgcggaagaatgggaagcgcgtcatccagctgtccagaaagaccttcgacaccgagtaccagaagacgaagaataacgattgggactacgtggtgaccacggacatcagcgagatgggcgccaacttccgcgcggaccgagtcatcgacccgcgccgatgcctcaagccggtaatcctgaaggacgggcccgagagagtcatcctggccggccccatgccggtgaccgtggcttccgccgcccagcggcgcggtcggatcggccgcaaccacaacaaggagggcgatcaatacatctacatggggcagccgctcaacaacgacgaggaccatgcgcactggacggaggctaagatgctgttggacaacatcaacacgcccgagggcatcatccccgccctgttcgagccggagcgggagaagtccgccgccatcgatggggagtacaggctgcgcggcgaggcgcggaagacgttcgtcgagttaatgcgccgcggggacctacccgtgtggctgtcctacaaagtggccagcgaggggttccagtattcagaccgtcggtggtgcttcgacggcgagcgcaacaaccaagtgctggaggagaacatggacgtagaaatctggaccaaggagggggagcggaagaagctccgaccccggtggctggacgcccgcacctactccgaccccctggccctccgggagttcaaggagttcgccgcgggccgccggagcgtctccggggacctgatcctggagatcggcaaactcccgcagcacctgacccagcgcgcccagaacgccctggacaacctcgtaatgctgcacaattcagagcagggcgggcgggcctaccgccacgcgatggaggagctgcctgacaccatcgagaccctcatgctgttggccctcatcgccgttctgacgggcggtgtgaccctgtttttcctcagcggccgggggttaggcaagaccagcattggcctactctgcgtcatggcctcaagcgtcttactctggatggcatccgtggagcctcactggatcgcggcctcaatcatactcgagttctttctgatggttctgctcatccccgagccggaccgccagcgcacgccccaggacaaccaactggcctacgtggtgatagggctcctcttcatgattttgaccgtcgccgccaacgagatgggcctgctcgagaccaccaagaaggacttggggatagggcacgtggcggtggagaaccaccaccacgctaccatgctggacgttgacctgcaccccgcctcagcctggaccctgtacgccgtcgcgacgactatcatcaccccgatgatgcgccacacaatagagaacacgactgccaacatcagcctgaccgctatcgctaaccaagcagctatcctcatggggctggacaaaggctggcccatctccaagatggacatcggcgtacccctcctcgccctggggtgctattcacaggtaaaccccctcaccctcacggccgccgtgctgatgctggtggctcactacgccatcattggcccggggctccaagccaaagccacccgggaggcccagaagcgcaccgcggccgggatcatgaagaacccgaccgtcgacgggattgtggccatcgacctggaccccgtggtgtacgacgccaagttcgagaagcaactgggccagatcatgctcctgatcctgtgcacgtcccaaatcctcctgatgcgcaccacttgggctctgtgtgagagcatcaccctcgctacgggcccgctgaccaccctgtgggaggggtccccgggcaagttctggaatactacgatcgccgtgagcatggctaacatcttcagagggtcttacttagccggcgccggcttagcgtttagcctgatgaaatccctcggtggcggaaggcggggcacaggagcccagggcgaaaccctgggcgagaagtggaagcgccagctaaaccagttgtccaagagcgagttcaacatttataagcggtccgggattatggaggtggaccgctcggaggccaaggagggcctgaagcgtggggaaaccacgcgccacgccgtctcccgtggcacagcgaagctgcgctggttcgtggagcggaacctcgtgaagcccgaggggaaggttatcgacctcggctgcggccgcgggggctggtcttactactgtgccgggctgaagaaggtgaccgaggtgaagggctataccaaaggcgggcccggccacgaggagcccatcccaatggccacgtacggctggaacctggttaaactccattccggcaaggacgttttcttcacccctcccgagaagtgcgacaccctgttatgcgacatcggggagtcttcacccaacccgaccatcgaggagggccggacgttacgcgtgctaaagatggtcgagccctggctaagagggaaccagttctgcatcaagatcctcaacccatacatgcccagcgtggtagagaccctggagcagatgcagcgcaagcacggcggaatgctggtacggaacccgctcagccgcaatagcactcacgagatgtactgggtgagctgcgggaccggtaacatcgtatcggcagtcaatatgacctcccggatgctgctgaaccgcttcacgatggcccacagaaagcccacatacgagcgggacgtggatttaggggcgggcacccgccacgttgccgtcgagcccgaggtggccaacctggacatcatcggccagcggatcgagaacatcaagcacgagcataagagcacatggcactacgacgaggacaacccctataagacctgggcctaccatggatcgtacgaagtaaaaccgtcgggctccgccagcagcatggtgaacggggtggtcaagctcctcaccaaaccctgggacgtgatccccatggtgacccagatcgcgatgaccgacacgacccccttcggccagcagcgcgtcttcaaggagaaggtcgacactcggaccccgaaggccaagcgcgggacggcccaaatcatggaggtgaccgcccggtggctatggggcttcctgtcccgcaataagaagcctcggatctgtacccgcgaagagttcactagaaaggtccgcagcaacgctgcgatcggcgccgtgtttgtggacgaaaatcagtggaactccgccaaggaggccgtcgaggacgagaggttttgggacctcgtgcagaaggagcgcgagctgcacaagcaggggaagtgcgcaacgtgtgtgtacaacatgatgggcaagcgggaaaagaagctgggggagttcggcaaggccaaggggagccgcgccatctggtacatgtggctcggcgcccgattcctggagttcgaggcgctgggattcatgaacgaggaccactggttctcgcgcgagaactcgctctccggggtagagggcgaggggcttcacaagctgggttacatcctccgggacatctccaagatccccggaggtaatatgtacgcggacgacaccgcgggctgggatactcgaatcaccgaggacgacctgcagaacgaagccaagatcacggacatcatggagcctgagcacgccctgctcgccacctccatcttcaagttgacataccagaacaaggttgtgcgggtccaacgccccgcgaagaatgggaccgtgatggacgtaatctcgcgacgggaccagcgcggctccggacaagtcggcacgtacggcctgaataccttcaccaatatggaggcccaactcatccggcagatggagtctgaggggatctttctcccctccgagctggagaccccgaacctcgccgagcgcgtattagactggctggagaaacacggcgtggagcgtttaaagcgcatggccatcagcggggacgactgtgtcgtgaagcccatcgacgaccggttcgccacagcgctgaccgcactgaacgacatgggcaaggtgcggaaggacattccacagtgggagccctccaaggggtggaacgactggcagcaggtccccttctgcagccaccacttccaccaattgatcatgaaggacggccgggagatcgtggtgccgtgccgcaaccaggacgagctggtcggacgcgccagggtgtcccagggggctggatggtcactgcgggagactgcctgcctcggcaaatcctacgcgcagatgtggcagctgatgtacttccaccggcgggacctccgcctcgccgctaacgctatctgctccgcagtgcccgtggattgggtgcccacgagccgaacgacctggtccatccatgcccaccaccagtggatgaccaccgaggacatgctgagcgtatggaaccgggtctggatcgaggagaacccctggatggaggacaagacgcacgtgtccagctggggcgacgtgccgtacctggggaagcgggaagaccagtggtgcggttccctcatcggcctgaccgcccgcgccacctgggccagcaatatccaggtcgcgatcaaccaagtgcgccggctgatcgggaacgaaaactatttagactacatgacgtctatgaaacgcttcaagaacgagggtgaccctgaaggggccctgtggtga

SEQ ID NO: 24604 - RNA, 9879 nt, synthetic construct
  misc_feature 1..9879: note = derived and/or modified CDS sequence (opt11) from DENV-1__EU482538__SS-prME
  source 1..9879: mol_type = other RNA
agcgtgacgatgctgctgatgctcatgcctacggccctggccttccacctcaccacccgcggtggggaaccccatatgattgtgagcaaacaggaacgaggtaagagtttactgttcaagacaagtgcaggggtgaacatgtgcactctcatcgcgatggacttaggcgagttctgcgaagacacgatgacctataagtgcccccgcatcaccgaagctgagcccgacgacgtggactgttggtgcaacgctaccgacacctgggtgacttatgggacgtgcagccagaccggtgagcaccgccgcgataaacgatccgtggccctggcgccccacgtgggcctcggcttagaaacgcggaccgagacctggatgagctcggaaggcgcctggaagcaaatacagcgggtggaaacgtgggcgctgcgccatcccggatttacagtcatcgccctctttctggcccacgccatcggcaccagcatcacgcaaaaggggatcatcttcatcctacttatgctcgtgaccccctccatggccatgcggtgcgtagggataggcagccgcgacttcgttgaggggctctccggcgccacctgggtggatgtcgtgctcgagcacgggagttgcgtcaccaccatggctaaggacaagcccacgctcgatatagaactgctcaagacggaggtcaccaatcccgcggtgctgcggaagctgtgcatcgaagccaagatttccaatactaccaccgacagccgctgcccgacccagggggaggccaccctcgtcgaggagcaggatgccaacttcgtctgccggcgtaccttcgttgacaggggctgggggaacggatgtgggctgttcggaaaaggtagtctgataacgtgcgccaagttcaagtgcgtgacaaagttagagggcaagattgttcaatatgagaacctgaagtatagcgtgatcgtcaccgttcacactggcgaccagcaccaggtgggaaacgaatcaacagagcacggtacaaccgcgaccatcacaccgcaggcccccagtacggaaattcagttgactgattacggcgccctcactctcgactgttcgccccggaccggcctggactttaacgagatggtcctgctgacgatgaaggaaaagtcctggttagtgcacaaacagtggttcctcgacttgccgctgccctggaccagcggggcgtctacctctcaggagacctggaaccggcaggacctactggtaacttttaagaccgcgcatgccaagaagcaggaggtcgtagtacttggctcccaggaaggcgccatgcacaccgccctcaccggcgccacggagatccaaaccagcggaacaaccacgattttcgccgggcacctgaaatgccgcctgaagatggacaagctcaccctgaagggtatgagctatgtcatgtgcaccgggtcgttcaagttggagaaagaagtggcggagacacagcacggcacagtattggtccagataaagtacgagggcaccgacgcgccctgcaagatccccttttccacgcaggacgagaaaggtgtgacccagaacggtcggcttatcactgcgaatccgatcgtgaccgaccgcgaaaaacccgtaaatatcgaggccgagccgcccttcggcgagagttacattgtgatcggcgctggcgagaaggccctgaagctgagctggtttaagaagggcagctcgatcggcaagatgtttgaggccaccgccagaggggcacgccgaatggcgatcttaggcgataccgcctgggacttcggctcgatcggaggggtgttcacgtccgttgggaaactggtgcaccagatcttcggaacggcatacggagtgctgttcagcggcgtatcctggaccatgaagatcgggatcggcgtgctcctaacctggctgggccttaacagccggtccactagcttatcaatgacgtgcatcgccgtagggctagtcaccctgtacctgggagtgatggtgcaggcagacagcggctgtgttataaattggaaagggcgcgagttgaagtgcggatcaggcatctttgtgaccaacgaagtgcacacttggacagaacagtacaaattccaggcagactctcccaaacgactcagcgcggccatcgggaaggcatgggaagaaggtgtgtgtggcataaggagcgctacccggctggaaaacatcatgtggaagcagataagcaacgagctaaaccatatcctcctggagaatgatatgaaactgaccgtggtagtcggtgacgtagcgggaatcttggcccaagggaaaaagatgatccgcccccaacccatggaatacaagtactcctggaagtcttggggcaaagccaagatcataggggccgacgtgcagaacaccacgttcattatcgacgggcccaacactctggagtgtccagacgatcagcgggcgtggaatatttgggaggtagaggactacgggttcggaatattcaccaccaacatctggctaaagctcagggactcttacacgcaagtgtgcgatcaccggctgatgagcgccgctatcaaggactccaaggctgtacacgccgatatgggctactggatagagagtgagaagaacgagacctggaagctggcgcgcgcgagctttatcgaagtcaagacatgcatctggcctaagtctcacaccctgtggtcgaacggcgtgctggagagtgagatgatcatacccaagatatacgggggacccatatcccaacataactaccggccaggatacttcacgcagaccgccgggccctggcacctgggaaagctggagctcgactttgacctttgcgagggaactaccgtggtcgtggacgagcactgcggcaatcgcgggccctctctccgcaccaccaccgtgacgggaaagatcatccacgagtggtgttgccgctcgtgcacgctgccgcccctgcggttcaaaggggaggacggttgctggtacgggatggaaatccgccccgtcaaggagaaggaggagaacctagtaaaatcgatggtgagcgcgggctcgggcgaggtggacagcttctcactgggtctgctctgcatcagcattatgatagaggaggtcatgagatctcggtggagccggaagatgctgatgaccggcacccttgccgtatttttcctcctgatcatggggcaacttacctggaacgatctcatccgtctgtgcatcatggtaggcgcaaacgcctccgataggatggggatgggaacgacatacctggccctgatggcgaccttcaagatgcggcctatgtttgccgtcggcctgctgttccgccgtctcacgagcagagaggtgttactgctcacaatcgggctgtccctggtcgccagcgtcgagctccccaactccttagaggagctgggtgatgggttagccatgggcataatgatactcaagctgcttaccgacttccaaagccaccagctttgggctaccctgttatccctaactttcatccggacgaccttcagccttcactatgcctggaagactatggcgatggtcctctccatcgtgagtctgttcccactgtgcctgtccaccacgtcgcagaaaaccacctggctgcccgtgttgctcggatcactggggtgcaagcccctgacaatgttccttatcgccgagaataagatctggggccgcaagagctggccgttgaacgaagggatcatggccgtcggcatcgtgtcgatcctgctctcctcgctcctgaagaacgacgtgcccctcgcagggcccctgatcgcaggcgggatgcttatagcttgctatgtaatcagcgggtcatccgccgaccttagcttagaaaaggcggctgaggtgtcctgggaggaggaagccgaacacagcggagcgtcccacaacatcctggtggaggtccaggacgacgggaccatgaaaatcaaggacgaggagcgtgacgataccctcaccatcctgctgaaggccaccctcctggccgtgagcggcgtgtacccgctgtcgataccggcgactctcttcgtctggtacttttggcagaagaagaagcagcgctcgggggtcctctgggacacgcccagtccacccgaggtggagcgggccgtcctggacgacggcatataccgcatcatgcagcgcggtctgctcgggcggagccaagtgggcgtcggtgtcttccaagagaacgtgttccacaccatgtggcacgtgacccgaggagcggtgctgatgtaccaggggaagcgcttagagccgagctgggccagcgtcaagaaggacctcatctcctacgggggcgggtggcggttacaggggagctggaataccggggaagaggtgcaggtcatcgccgtggagcccggcaaaaacccgaagaacgtgcagacagcccccgggacctttaaaacctcagagggcgaggttggcgccatagcgctggacttcaagccagggaccagcgggagcccaatcgtgaaccgtgaagggaagatcgtgggcctctacggaaacggggtggtcacgacctccggcacctatgtaagcgccattgcccaaaccaaagctagccaggaggggcccctgcctgagatcgaagatgaggttttccgtaaacggaatctgacaatcatggacttgcatccgggcagcgggaagacacggcggtatttaccagccatagtccgggaggccatcaagcgtaggctgcggaccttgattctagcaccgacccgcgtggtcgcctccgagatggcagaagctctgaagggtatgccgatccggtatcagacgactgctgtcaagagcgaacacacgggcaaggagatcgtagacctcatgtgccacgccaccttcaccatgcgtctgctctcccccgtccgggtgcccaactacaatatgatcattatggacgaggcccacttcaccgaccccagctccatcgctgcgcgcggttacatcagcacccgggtgggcatgggtgaggccgcggccatcttcatgaccgctacgccgcccgggagtgtagaggcattcccccagtcaaatgccgtgatccaggacgaggagcgcgacatcccagagcggtcctggaacagcggatacgagtggatcaccgactttccggggaaaaccgtctggttcgtcccctcgatcaagagcggcaatgacatcgcaaactgtttgcgcaagaacggcaagagggtgatccagctctcccgcaaaacatttgacacggagtaccaaaagaccaagaacaacgactgggattacgtcgtcaccacggacatctctgagatgggcgccaacttccgggcggaccgagtaatcgacccccggcgctgtctcaagcccgtaatcctcaaggatgggccggagcgggttatcctggccggccccatgcctgttacggtcgccagcgccgcgcaacggagagggcgaatcggccgcaaccacaacaaggagggtgaccagtacatttacatggggcaacctctgaacaacgacgaggaccacgcgcactggaccgaagccaagatgctgctggacaacatcaacacccccgagggcatcattcccgccttgtttgagcccgagcgcgagaagtccgcagcaatagacggggagtaccgcctcagaggcgaggcgcgcaagaccttcgtggagttaatgcggcgcggcgacctgccagtctggctaagctacaaggtcgcctccgagggattccagtacagtgaccggcgctggtgttttgatggcgaacggaacaaccaggtactggaggagaacatggatgtggagatctggacgaaagagggtgagcgcaagaaactgcggccgcgctggctcgatgcccgaacgtactcagaccccctagccctgcgcgagttcaaagagttcgccgctggtcggcgcagtgtctccggggacctcatcttggagatcggcaagttgcctcagcacctcacccaacgggcccagaacgccctagacaacttggtgatgctacacaacagcgaacagggcggaagggcgtaccggcacgcgatggaagaactgcccgataccattgaaacgctgatgctcctggccctgatcgccgtcctcacaggcggcgtgacactgttctttctgtccggccgcgggctcggaaagacgagtatcgggctgctgtgcgtgatggcctcaagcgtcctcttatggatggcttccgtcgagccccactggatcgcggccagcataatccttgagtttttcttaatggttctcctgatccccgaacccgaccggcagcgcactccccaggacaaccagctcgcctacgttgtcatagggctgctgttcatgatacttacggtcgccgccaatgagatgggcctgctggagaccaccaagaaagatctcggaatcggccacgtggccgtcgagaatcaccatcatgccgccatgctggacgtggatttacatcctgcctccgcgtggacactttacgcggtagccactaccatcatcacccccatgatgcgtcacacaatagaaaacacgaccgccaacatcagcctgaccgccatcgccaaccaggcagccatccttatgggcctggacaagggctggcccatcagtaagatggacatcggcgtccccctgctggccctgggctgctacagccaggtgaacccgctgacactgacggccgcggtgttgatgctagtagcgcactacgccataatagggcccggcctgcaggctaaggctacgcgggaagcgcaaaaacgaaccgccgccgggatcatgaagaaccccaccgtggatgggatcgtggctatcgacctcgaccctgtcgtgtatgacgcgaagttcgaaaagcagttaggacagatcatgctactcatattatgtacctcccaaatcctactaatgcggaccacctgggcgctgtgcgagagcataacgctggctacgggtcccctcacgaccctgtgggagggctcgccggggaagttctggaataccacgatcgcagtttcgatggcgaacatcttccgtgggagctaccttgccggtgcgggactagccttttccctcatgaagtccctagggggcggtcggcgcggaaccggagcgcagggcgagaccctcggcgagaaatggaagcggcagctgaaccagctgtccaagagcgagttcaacacctacaaacgctcagggataatggaggtcgatcggtccgaagcaaaggagggccttaagcgcggggagacaaccaagcacgcagtgtcccggggcaccgcgaaactgcgctggttcgtcgatcggaacctggtcaagcccgagggtaaggtgatcgacctgggctgcggccgcgggggttggagctactattgcgccgggttaaagaaggtgaccgaggtgaaaggctacactaagggcgggccgggccatgaggagccgattcctatggccacctatgggtggaatctggtgaagctgcactccggcaaggatgtgttctttatcccgccagagaagtgtgacaccttgttatgcgacatcggggagagctcccctaaccctactatagaagagggccggacactgcgcgttctcaagatggtggaaccctggctgcgcgggaaccagttctgcataaagatcctgaacccttatatgccctctgtggtcgagactttggagcagatgcagcgcaagcatggcggaatgcttgtgcggaaccccctgtcccggaactctacgcacgagatgtactgggtatcttgtgggactggtaacatcgtcagcgccgttaacatgacatcgaggatgctcctcaaccggttcacaatggctcaccgcaagcccacctacgaacgggacgtagacctgggtgcggggacccgacacgtcgccgtcgagcccgaggtggccaacctggacatcataggccagcgtattgagaacataaaacacgagcacaagtctacctggcactacgacgaggacaatccctacaaaacctgggcgtaccatgggtcctatgaggtaaagccctctggcagcgcgtcctctatggtgaacggcgtcgtgaagctgctgaccaagccctgggacgtgatcccgatggtcacccaaattgcaatgactgatacgaccccctttggccagcaacgcgtatttaaggagaaggtggacacccgtacccccaaggccaaacgcgggacggcccaaatcatggaggtcaccgccaagtggctttggggcttcctttcacggaacaaaaagccccgcatctgcacccgagaggagtttacacgcaaagtgcgtagcaacgccgccatcggcgccgtgttcgtcgacgaaaaccagtggaactccgccaaggaagccgtggaggacgagcgcttctgggacctggtgcaccgggagcgcgagctccacaagcaggggaaatgcgccacatgcgtctacaacatgatgggtaagcgggaaaagaagttaggggagttcggcaaagcgaaggggagccgggccatctggtacatgtggctgggcgcccggttcctcgagttcgaggcgctcgggtttatgaacgaggaccactggttctcccgtgagaacagcctgtccggggtcgagggcgagggcttgcacaagctgggctatattctgcgggatatcagcaaaatccctggagggaacatgtacgccgacgacaccgccggttgggacacccgcatcaccgaggatgacctccagaacgaggctaagataaccgatatcatggagcctgaacacgcgctgctggcgaagtccatcttcaagctcacctatcagaacaaggtggtacgcgtccagcggccagccaagaacgggaccgtcatggacgtcattagccgccgcgaccagcgcggttccggccaggtgggcacctacggcctgaacacgttcaccaacatggaggcccaactgatcagacagatggagagcgaggggatcttctccccatccgagcttgagacacccaacctggccggccgcgtactggattggctagagaagcatggggttgaacggctgaagcgcatggcgatctccggtgacgactgcgttgtgaagcccatcgacgaccgtttcgctaccgccctgacggcactcaacgacatggggaaggtccgcaaagatatcccccaatgggagccgagcaagggctggaacgactggcagcaggtacctttttgctcacaccacttccatcagctgatcatgaaagatggcagagagatcgtggtcccttgccgcaatcaagacgagctggtggggcgggcccgtgtttcccaaggggccgggtggtctctccgggagacggcttgcctgggcaagtcctacgcacaaatgtggcaattaatgtattttcaccgccgggacctccgcctcgccgcaaacgcgatctgcagcgccgttccagtggactgggttccgacgtcccgaaccacgtggtctatccacgctcaccaccagtggatgaccaccgaggatatgttgtccgtctggaaccgtgtatggatagaggagaacccctggatggaggacaagacccacgtgtcctcctgggaggacgtcccctacctggggaagcgggaggaccagtggtgcggttccctgattggcctgacggcccgggccacgtgggcaaccaacatccaggtggccataaaccaagtgcgccgcttactgggaaacgaaaactacttagactatatgacttccatgaagcgcttcaagaacgaaagcgaccctgagggcgcactctggtaa

SEQ ID NO: 24605 - RNA, 9879 nt, synthetic construct
  misc_feature 1..9879: note = derived and/or modified CDS sequence (opt11) from DENV-1__EU482539__SS-prME
  source 1..9879: mol_type = other RNA
tcggtgaccatgctgctcatgttaatgccaaccgcccttgcatttcacctcaccacccggggcggggagcctcacatgatcgtatctaagcaggagcggggcaagagcttgctgttcaagacgagcgccggggtgaacatgtgtaccttaatcgccatggacttgggcgagctgtgcgaggacacaatgacctacaagtgcccacggatcaccgagaccgagcctgacgacgtcgactgctggtgcaatgccacggacacctgggtaacctacgggacctgcagccagacgggcgagcaccggcgcgacaagcggtccgtggccctcgcgccccacgtgggcttagggctggagacccgaaccgagacctggatgagctccgagggagcgtggaagcagatccagcgggtggaaacgtgggccttgcgccaccccggatttaccgtgatcgccctgttcctggcacacgcgatcgggaccagcatcacccagaaggggatcatcttcatcctcctgatgctggtgacgccctcaatggccatgcgatgcgtcggcatcgggtcccgcgatttcgtggaggggctctccggcgctacttgggtggacgtcgtgctggagcacggaagctgcgtgaccactatggccaaggataagcccacgctagacatcgagctcctgaagacggaggtcaccaaccccgcagtcctgcggaagctctgcatcgaagcgaagatctccaacaccacgaccgacagccgctgcccgacacagggcgaggctactctggtggaggagcaggacgccaacttcgtatgccggcgcacgttcgtggaccggggctgggggaacggctgcgggctgttcggcaaggggtccctcatcacgtgcgccaaattcaagtgcgtgaccaagctggagggcaagatagtccagtacgagaacctaaaatatagcgttatcgtgaccgtccacacgggcgaccagcaccaggtggggaacgagagtaccgagcacggcaccaccgccaccatcactccccaggcgcccaccaccgagatccagctcacggactacggggcccttaccctggactgcagcccccgcaccggcctagacttcaacgaaatggtcctgctgacaatgaaagagaagtcctggctggtgcacaaacaatggttcctggacctgcccctcccctggaccagcggggccagcacgtcccaagaaacctggaaccggcaggacctactggtgaccttcaagaccgcgcacgccaagaagcaagaggtcgtggtgttaggcagccaggagggagcgatgcacacagccctgaccggtgccactgaaatccagacttctggcacgactaccatcttcgccgggcacctgaagtgtcgcctcaagatggacaagctgaccctgaagggcatgagctatgtcatgtgcacggggtccttcaagctggagaaggaggtggccgagacccagcacggcacagtgctggtccagattaagtacgagggtaccgacgcgccatgcaagatccccttcagcacccaagatgaaaagggggtgacccagaatgggcggctgatcaccgccaatccgatagtgaccgacaaggagaagccggtcaacatcgaggccgagccgcctttcggggaatcctacatcgtgatcggcgcaggcgagaaggcgctgaaactcagctggtttaagaaagggtccagcatcggcaaaatgtttgaggccacggcccgcggggcccggcgcatggccatcctgggcgacacagcctgggacttcggatccatcggcggcgtgttcaccagcgtagggaaactggtacaccagatcttcggcaccgcgtacggggtcttgttctccggcgtcagctggacgatgaagatcgggatcggcgtactgctgacctggcttggcctgaactccaggtctacctccttgtcaatgacctgcatcgccgttgggttagtcacgctgtacctgggcgtgatggtgcaggccgattccgggtgcgtcatcaactggaagggtcgggagctcaagtgcggaagcggcatcttcgtgaccaacgaggtacacacctggaccgaacagtacaagtttcaggccgacagcccgaagcgcttatccgcggccatcggtaaggcctgggaggagggcgtctgcggtatccggagtgccacccgcctggagaacatcatgtggaagcagatctccaacgagctcaatcatatcctattagagaatgacatgaagtttacggtggtggtcggggacgttgccggcattctcgcgcaggggaagaagatgatccggccccagcccatggagtacaaatacagctggaagtcctggggcaaggcaaaaatcatcggcgccgatgtgcagaacaccactttcatcatcgatgggcccaacaccccggagtgccccgacgaccagcgcgcctggaacatctgggaggtcgaagactacggcttcgggatcttcacaaccaacatctggctgaagctccgggacagctacacccaggtgtgcgaccacagactcatgtccgctgctattaaggacagcaaggccgtgcacgcagacatgggctactggatcgagtccgagaaaaacgagacctggaagctggcccgggcgagcttcatcgaggtcaaaacgtgcatctggcccaagtcccataccctgtggagcaacggcgtgttagagtccgagatgatcatccctaagatctatgggggccctatcagccagcacaactaccgccccgggtacttcacccagaccgccggcccctggcatctgggaaaactggagttggacttcgacctgtgcgagggcacgaccgtggtggtggatgaacactgtggcaaccgtggtccgtccctgaggaccaccacggtgaccggcaagatcatccacgagtggtgctgccgctcctgcaccctgcctcccctccgcttccgcggagaggacggctgctggtatgggatggaaatacgccccgtcaaggagaaggaagagaacctggttaagtccatggtgtctgccggcagcggcgaggtcgactccttcagcttagggctgctgtgcatctccatcatgatcgaggaggtcatgcggagccgctggtcccggaagatgctcatgaccggcacgctggccgtgttcttcctgctcatcatgggacagctgacttggaacgatctgatcaggctctgcatcatggtcggcgccaacgcgtctgaccgcatggggatgggcaccacctacctggccctgatggcaacgttcaagatgcggccgatgttcgcggttgggctcctgttccgacggctcacctcccgtgaggtactcctgctgaccatcggcctcagcctggtcgcctccgtggaactgcccaactcactcgaagaactaggcgacgggttagcgatgggaattatgatcttaaagctgctgacggacttccagtcgcaccaactctgggccacgctgctgagcctcaccttcattaagaccaccttctccctgcactatgcctggaagactatggccatggttctgagcatcgtgtccttgttccccctgtgtctgagcaccacttcccagaaaaccacgtggctccccgtgctgctgggcagcctcgggtgcaagccgctaaccatgttcttgatcgcggagaacaaaatatggggccggcgctcgtggcccctcaacgagggtatcatggccgtcggcatcgtgagcatactgctgagctccctcctgaagaatgacgtgcccctcgccgggcccttaatagccggaggtatgctgatcgcctgctacgttatcagcgggtcgagcgcggacctgtccctcgagaaggccgccgaggtgagctgggaggaggaggcagagcactccggcgcctcccacaatatcctggtggaggtccaggacgacgggaccatgaagatcaaggacgaggagcgggacgacaccctaacaatcctcctgaaggcgacgttgctcgccgtgtccggagtgtacccgctgagtatacccgccaccctattcgtctggtacttctggcagaagaagaagcagcgctccggggtgctctgggacacccctagcccgcccgaggtggggcgggccgtactcgacgacggcatataccggataatgcagcggggactgctgggccggtcccaggtgggggtgggcgtcttccaggagaacgtatttcacaccatgtggcacgtgacgcgcggggccgtactcatgtaccagggcaagcgactggagccttcctgggcgtccgtgaagaaggacctgataagctacggcgggggctggcggctccaggggtcctggaacaccggcgaggaggtgcaggtcattgcggtagagcccgggaagaaccctaagaacgtgcagactgcgccaggcaccttcaagacgccggagggcgaggtcggggccatcgccctagacttcaaacccggcacaagtgggagtcccatagtgaatcgcgaggggaagatcgtaggcctatacggtaacggcgtggtgacgacctctgggacatacgtgagcgcgatcgcccaggccaaggcctcccaagagggcccactccccgagatcgaggacgaagtcttccggaagcgcaacctgaccatcatggacctgcaccccgggagcggcaagacacggcgctacctcccggcgatcgtgcgggaggccatcaagcgcaagttgcgaaccctgatcctcgcccccacgcgggtggtcgcctccgagatggccgaggcgctgaagggcatgccaatccgctaccagaccaccgccgtcaagagtgagcacaccgggaaggaaatcgttgacctgatgtgtcacgctacgttcaccatgcggctcctatcccccgtccgcgtgccgaactacaacatgatcatcatggacgaggcacatttcaccgaccccagctcaatcgccgcacggggctacatcagcacccgcgtcgggatgggcgaggctgccgccatcttcatgacggccacgccgcccggttccgttgaggccttcccgcagagcaacgccgtaatccaggacgaggaacgggacatccccgagcgctcctggaacagcggctacgaatggatcaccgacttcccgggcaagaccgtgtggtttgtcccctccatcaagagcggcaacgacatcgccaactgcctgcggaagaatggcaagcgcgtaatccagctctcccggaagacgtttgacactgagtatcagaagaccaagaacaacgactgggactatgttgtcaccacggacatcagcgaaatgggggccaacttccgcgcggaccgggtgatcgacccacgccgatgtctgaaacccgtgatcctgaaggacggccccgagcgcgtcatcctcgccgggcccatgccggtcaccgtcgcctccgccgcccagcggcgcggccggatcggccgcaatcacaacaaggagggggaccagtacatctacatgggccagcccttgaacaacgacgaggaccacgcgcactggaccgaggccaagatgctgctcgacaacatcaataccccagagggtatcatcccagccctgttcgagccggaacgcgagaaatccgccgcgatcgacggtgagtacagactgcgcggagaggcgcggaagacgtttgtggagctcatgcgccggggcgacctgcccgtgtggctgtcctacaaagtcgccagcgaaggcttccagtactctgaccgccggtggtgcttcgacggggagcgcaataaccaggtcttggaggagaacatggacgtggagatttggaccaaggagggagagaggaaaaagctgagaccacggtggctggacgcccgcacctactccgaccccctcgcattacgggagtttaaggagttcgccgcggggcggcggagcgtctccggcgacctgatcctcgagatcggcaagctgccgcagcacctaacgcagagggcccagaacgcccttgacaaccttgtgatgctgcacaacagcgaacagggcgggcgggcctatcgccacgcgatggaggaactccccgacactatcgagaccctgatgttactggccctgatagccgtgctgaccggtggcgtcaccctcttcttcctgtccgggcggggattaggcaagacaagcatcgggctcctttgcgtgatggcgtcgagcgtgctgctctggatggcttctgtcgaaccccactggatcgcggccagcattattctggagttcttcctgatggtgctcctgatccccgagccggaccgacagcggactccccaagacaaccagctcgcctacgtggtcatcggcctcctgttcatgatcctgaccgtcgccgccaatgagatgggattgctggaaaccaccaaaaaggacctgggcatcgggcacgtggcggtcgagaaccaccaccacgccgccatgctcgacgtggacctgcaccccgcctccgcctggacgctgtacgcggtagccaccacgataatcaccccgatgatgcgccacacgatcgagaacacaacagctaacatcagcctcacggccatcgccaaccaggcggccatcctgatgggcctggacaagggctggcccatctccaagatggatatcggggtccccctcctggcccttggctgctacagccaggtgaaccctctcacgctgaccgccgcggtcctgatgctcgtcgcccactacgccatcatcgggccggggttgcaggccaaggccacccgcgaggcgcagaagcggaccgccgctgggatcatgaagaacccaacagtggacggcatcgtagccatcgacctggaccccgtcgtgtacgacgccaagttcgagaagcagctcggccaaatcatgttgctgatcctttgcaccctgcagatcctgctcatgcgcaccacctgggcgctgtgcgagtccataacgctggccaccggtcccctcaccacactgtgggagggcagccccggcaagttctggaacacaacaattgcggtttccatggccaacatcttccgcgggagctatctggccggtgcagggctcgccttctccctgatgaagtccctgggcggtggccgccgggggacgggcgcccagggcgagaccctcggggagaagtggaagcgccagctgaaccagctatccaagtccgagttcaacacgtacaagcggagcggcatcatggaagtcgaccgctccgaggcgaaggagggtctcaagcggggcgaaaccaccaagcacgcggtgagccgcgggaccgccaagctgcggtggttcgtggagcgcaacttggtcaaacccgagggcaaggtgatcgacctgggatgcgggcggggcgggtggtcctactactgcgccgggcttaagaaggtgacggaggttaaggggtacaccaagggcggccccgggcacgaggagcctatcccgatggcaacctacggctggaacctggtgaaactgcattcggggaaggatgttttcttcatcccgcccgagaaatgtgacaccctcctctgcgatattggcgagtccagcccgaatccgacgatcgaggaggggcgcactttaagggtcctcaagatggtggagccctggctgcggggcaaccagttttgcataaagatcctgaacccctacatgccctccgtggtcgagaccctcgagcagatgcagcggaagcacggcgggatgctggtgcgcaacccactgagccggaactccacccacgagatgtactgggtgagctgcggcaccgggaacatcgtctcagccgtgaacatgacgagccgcatgctcctgaaccgcttcacgatggcgcaccggaagcccacctacgagcgcgacgtggacctgggagccggcacccggcacgtcgccgtggagccagaggtggccaacctagacattatcgggcagcgcatcgagaatatcaagcacgagcacaagtccacgtggcactacgacgaggacaacccctacaagacctgggcctaccatggcagctacgaggttaagccgtcaggtagcgcgtcctcaatggtgaacggcgtcgtgaagctgctgaccaagccctgggacgtaatccccatggtcacccaaatcgccatgacggacaccacccccttcgggcagcagcgggtgttcaaggagaaagtggataccaggacgccgaaagcgaagcggggaaccgcgcagatcatggaggtcacggccaagtggctctggggtttcctgagccgcaacaagaagccgcggatctgcacccgcgaagagttcacccggaaggtgcgctccaacgcggccatcggggccgtattcgtcgacgaaaaccagtggaacagcgccaaggaggcggtggaggatgagcggttctgggacctagtgcatcgcgagcgggagctccacaaacagggcaaatgcgcgacctgcgtctacaacatgatgggaaagcgcgagaagaagctgggggagttcggcaaggccaaaggctcccgggccatctggtacatgtggctgggcgcccgcttcctcgagttcgaggcgctggggttcatgaacgaggaccactggttcagccgggagaactctctgagcggcgtggagggggagggcctccacaagttagggtacatcctccgcgacatctccaacattcccggcggcaacatgtacgccgacgacaccgccggttgggacacccggatcacggaggacgacctccagaacgaggcccgcatcaccgacatcatggagccggaacacgcactgctggctaaaagcatcttcaaactcacctaccaaaacaaggtggtgcgcgtgcagcggcccgccaagaacggcaccgttatggatgtcatcagcaggcgggaccagcgcgggagcggccaggtgggcacgtacggcctaaacaccttcaccaatatggaggctcagctgattcggcagatggaatcggagggcatttttagcccctccgagctcgagacccccaacctggccgagcgggtgctggattggctcgagaagtacggggtcgagcggctgaagcgcatggccatctctggcgacgactgcgtggtgaagccgatcgacgaccggttcgcgacggccctgaccgccctaaacgacatggggaaggtccgcaaggacatccctcaatgggagccctcgaagggctggaacgactggcagcaggtccccttctgcagccaccactttcaccagctgatcatgaaggacggccgggagatcgtggtcccgtgccgcaaccaggatgagctggtggggcgggcccgcgtgtcccagggggccgggtggagcctccgggagaccgcgtgtctgggtaagagctacgcacagatgtggcagctaatgtacttccaccgccgggacctccgcctggccgccaacgcgatctgctccgcagtccccgtggactggatccccaccagccggaccacctggtccatccacgcccatcatcagtggatgaccaccgaggacatgctgagcgtgtggaaccgcgtctggatcgaggagaacccctggatggaggacaagacgcacatatccagctggggcgacgtgccgtacctcggaaaacgagaggatcagtggtgcggctccctgatcgggctgaccgcccgggccacctgggcgaccaatatccaggtcgccatcaaccaggtcaggcggctcattggcaatgagaactacctggactacatgaccagcatgaagcgttttaagaacgagtccgaccccgagggggccctatggtga

SEQ ID NO: 24606 - RNA, 9879 nt, synthetic construct
  misc_feature 1..9879: note = derived and/or modified CDS sequence (opt11) from DENV-1__KP188539__SS-prME
  source 1..9879: mol_type = other RNA
agcgtcaccatgctgctcatgcttctgcccaccgccctcgccttccacctgaccacgcggggcggagagccccacatgatcgtgtcgaagcaggaacggggcaagagcctactgttcaagaccagcgtcggtgtaaacatgtgcaccttaatcgcgatggacctgggtgagctctgcgaggacacgatgacctacaagtgcccccggattaccgaggccgagcccgacgacgtggactgttggtgcaatgcaaccgacacctgggtgacatacgggacctgcagccagaccggcgagcaccggcgcgacaagcggtctgtagccctggcaccgcacgtaggcctggggctcgagacccgtactgagacctggatgagcagcgagggcgcctggaagcaaatccagaaggtggagacctgggccttgcggcacccggggttcacggtgatcgccctgttcctcgcacacgcgatcgggaccagcatcacccagaaggggatcatctttattctgctgatgctcgtcaccccctccatggccatgcgctgcgtgggcattggcaatcgggacttcgtggagggactgagcggtgccacttgggtcgacgtggtgctggagcacggttcctgcgtcaccaccatggccaaaaacaagcccaccctcgatatcgagctactgaaaactgaggtgaccaatccggccgtgctccgcaagctgtgcatcgaggcaaagattagcaacacaacaacggattcccggtgcccgacacagggcgaggccacccttgtcgaagagcaggacgcaaacttcgtgtgccgacggaccttcgtggaccgcgggtgggggaatggctgcggcctcttcggcaagggttctctgctgacgtgcgccaagttcaagtgcgtcacgaagctcgagggaaagatcgtgcagtacgagaacctgaagtactccgtgatcgtcaccgtgcacaccggtgaccagcaccaggtcgggaatgagacgaccgagcatggcaccatcgccatcatcaccccgcaggcgcccaccagcgagatccaactgacggactacggggccctcacactagactgcagcccccggaccggcctggacttcaacgaaatggtgttgctgaccatgaaggagaagtcctggctagtgcacaagcagtggttcctcgacctgccgctgccctggacgtccggggcaagcaccagtcaggagacctggaaccgccaggacctcctggtcaccttcaagacggcccatgccaagaagcaggaagtagtggtactgggctcccaggaaggcgcgatgcataccgccctcaccggggccaccgagatccagacaagtggcactaccaccatcttcgccgggcacctgaaatgccggctgaaaatggataagctcacgctgaagggcatgtcctacgtgatgtgcaccgggtcgttcaagctggagaaggaggtggccgagacccagcacggcaccgtcctggtccaggtaaagtacgaaggcacggacgcgccctgcaagatcccctttttaacccaagacgagaagggtgtcacccagaatggtcgcctgatcaccgccaacccgatcgtgacggacaaggagaagcccgtgaacatcgaaaccgaaccgccgttcggggagtcctatatcgtcgtaggcgctggcgagaaggcactgaagctcagctggttcaaaaagggatccagcatcggcaagatgtttgaagcgaccgcccgcggggcccgccggatggccatccttggcgacaccgcctgggacttcgggagcatcggcggcctgttcacgagcgtggggaagctcatccaccaggttttcggaaccgcgtacggggtgctgttctccggcgtgagctggaccatgaagattgggatcggcatcctccttacctggctggggctgaactccaggagcacgtccctcagcatgacgtgcatcgccgtcggcatggtcaccctgtacctcggcgtaatggttcaggccgactccgggtgcgtgatcaattggaagggccgcgagttaaagtgcgggagcggcatcttcgtgacgaacgaggtacacacgtggaccgagcagtacaagttccaagccgactccccgaaacggctcagcgccgcgatcggcaaggcctgggaagagggggtgtgcggcatcaggagtgctacccggctggagaacatcatgtggaagcagatctcaaacgagctcaactatatcctgctggagaacgacatgaagttcaccgtggtcgtgggggacgtgaacggcatactcgcccaggggaagaagatgatccgcccccagcccatggagcacaagtacagctggaagtcctggggcaaagcgaagatcattggcgcggacatccagaacaccactttcatcatcgacgggcccgacacccccgaatgtcctgacgaccagcgggcgtggaacatctgggaggtggaggactatggcttcgggatcttcacaaccaacatctggctgaaactgcgcgacagtcacacgcagatgtgcgaccaccggttgatgtccgccgccatcaaggacagcaaggcggtgcacgccgatatgggatactggatagaatccgagaagaacgagacctggaagttggcacgcgccagcttcatcgaggtgaagacctgcatctggcccaaatcccacaccctgtggagcaacggagtcctcgagtccgagatggttatccccaagatctatgggggcccaatctcgcagcacaactaccggcccggttacttcacgcagaccgccggcccctggcatctggggaagctggagctcgatttcgacctgtgcgagggcacaaccgtggttgtggacgagcactgcggctaccgcgggccgagtctgcgaacgactacggtgaccggaaagatcatccacgaatggtgctgccgcagctgcacgctgccgcccctgcggtttcgcggggaggacggatgctggtacgggatggagatccggcccgtcaaggagaaggaagaaaacctggtgcgatccatggtgagcgcgggctccggcgagatggacagctttagcctcgggattctctgcgtctccatcctgatcgaggaggtgatgcggagccgctggtcccggaaaatgctcatgaccggcaccctcgccgtgttccttttactaatcatggggcagctaacctggaacgacctcattcgactgtgtatcatggtcggcgccaacgccagcgaccgtatggggatgggcacaacctacttagccctcatggcgacctttaagatgcggccaatgttcgccgtgggcctgctgttccggaggctcacctcccgcgaggtgctgctgctcacagtcgggctgagcttggtggcctccgtcgagctccccaacagccttgaggagctgggcgacgggctcgccatgggcatcatgatgctgaagctgctcaccgacttccagccgcatcagctgtggaccacgctgctctcactgacgttcattcggacttccctgtccctcgactacgcatggaagaccatggccatggcactgagcattgtgtccctgttccctctctgcctaagcaccacgtcccagaaaactacctggctgcctgtgctactgggcagctttgggtgcaagcccctgacaatgtttctcatcacggagaacaagatttggggccgcaagtcctggcccatcaacgaggggatcatggccgtcggcatcgtgtcgatcctgctgagtagcctattgaaggacgatgtgcccctggccgggccgctcatcgcaggaggcatgctgatcgcctgctacgtaatcagcgggtccagcgctgacctttcactcgagaaggccgccgaggtgagctgggaggaagaggcggaacactccggcaccagccacaatatcctggtggaggtccaggacgacgggacaatgaagatcaaggacgaggagcgggacgataccctgaccatcctgctgaaggccacgctgctcgcggtttccggcgtgtaccccatgagcatccccgccaccctgttcgtctggtacttctggcagaagaagaagcagcgctctggggtgctgtgggatacccccagcccgcccgaggtggagcgggccgtcctggacgacggcatctaccgtatcctacagcgggggctgctggggcgctcccaggtgggcgtgggggttttccaggacggagtgttccacacaatgtggcacgtgacccgcggggcggtcttgatgtaccagggcaagcggctggagcccagctgggccagtgtcaaaaaggacctgataagctacggtgggggctggcggttccagggatcctggaacaccggcgaggaggtgcaggtcatcgccgtggagcccgggaagaacccaaaaaacgtgcagaccacccctgggacgttcaaaacccccgagggcgaggttggggccatcgccctcgacttcaagcccggcaccagcgggtccccgatcgtgaaccgcgaaggtaaaatcgtgggcctgtacgggaacggcgtggtgaccacgagcgggacctacgtgtccgcgatcgcccaggccaaggctactcaggaggggcccctgcccgagatcgaggacgaggtcttcaagaagcggaacctcacaatcatggacctgcacccggggagcggcaagacgcgccggtacctgcccgccatcgtgcgcgaggcgatcaaacggaagctccgcacactgatcctggccccaacccgtgtggtcgcgtcggagatggccgaggcgctcaagggcatgccgatccggtaccagaccacggccgtgaagtcggagcacaccgggcgtgagatcgtggacctcatgtgccacgcgacgttcaccatgcggctgctctctccggtccgcgttcccaactacaacatgataatcatggacgaggcccacttcacggaccccgcctccatcgctgcccggggctacatcagcacccgcgtcgggatgggggaggccgccgccattttcatgaccgcgacgccacccgggtccgtggaagcattcccccagagcaacgcagtgatccaggatgaggagcgggatatccccgagcgctcctggaacagcggatacgactggatcacggacttcccgggcaagaccgtgtggttcgtaccctcaatcaagtctgggaacgacatcgcaaactgcctgcggaagaatgggaagcgcgtcatccagctgtcccggaagacgttcgacaccgagtaccagaagaccaagaacaacgactgggactacgtggtcaccaccgacataagcgagatgggggccaacttccgcgccgaccgagtgatcgatccgcgccggtgcctcaagcccgtgatcctgaaggagggccccgagcgcgtgatcctggcggggccaatgcccgtgaccgtcgcttccgccgcacagcggaggggccggatcggccgcaaccaaaacaaagagggggatcagtacatatacatgggccagccactcaacaacgacgaggaccatgcgcactggacggaggccaagatgctacttgacaacatcaacacccccgagggtatcatcccggccctcttcgagcccgagcgcgagaaatccgccgcgatcgacggcgagtaccgtcttcgcggggaagcccgcaagacctttgtggagctgatgcgtcggggcgacctccccgtgtggctatcctacaaggtcgccagcgagggctttcagtactccgaccgacggtggtgtttcgacggggagcgcaacaaccaggtgctggaggagaatatggacgtggagatctggaccaaggagggcgagagaaagaagctccgcccccggtggctggacgcccgcacgtacagcgacccgctggctctcagagagtttaaggagtttgcggccggacgccggtccgtctctagcgacttgatcctggagatcggcaaacttccccagcacctgacgctgcgcgcccagaacgctctcgacaacctggtgatgctgcacaattccgagcagggcgggaaagcctatcggcacgcgatggaggagctccccgacaccatcgaaaccctgatgctgctcgctctgatcgcagtgctgaccggcggggtcacccttttcttcctgagcggcaaggggctgggcaagacctccatcggcctcttatgcgtgatggccagctccgctctgctgtggatggccagcgtagagccccactggatcgccgcatccatcatactggagttcttcctgatggtcctcctgataccggagcccgaccgccagagaacgccgcaggacaaccagctggcctacgtggtgatagggctcctgttcatgatcttgactgttgccgccaacgagatgggcctcctggagacgacaaagaaggatctgggcatcggacacgtggccgtggagaaccaccaccacgcaaccatgctcgacgtcgacctgcgcccggctagcgcgtggaccctctacgccgtggccacgaccgtaatcacccccatgatgcgtcacaccatcgagaacacgaccgccaacatctccctcaccgccatcgcgaatcaggccgctatcctgatgggccttgacaaggggtggcccatcagtaagatggacatcggcgtccccctcctggccctgggatgctattcccaggtgaaccccttaaccctgacggccgcggtgctgatgcttgtcgcccattacgccatcatcggccccgggctgcaggcgaaggcgacccgcgaggcccagaaacgcaccgcggccggcatcatgaagaaccccacggtggacgggatcgtgaccatcgacctggacccggttgtgtacgacgccaagttcgagaagcagctcggccagatcatgctgctgatcctctgtaccagccagatcttgctgatgagaaccacgtgggcgctatgtgagtccatcacgctggccaccggacctctcacaacactctgggaggggagtccaggcaagttctggaatacgaccatcgccgtgtccatggccaacatcttccgcggctcctatctggccggcgcgggcctggccttctccctcatgaagtccctcggcggcgggcggcgcgggaccggggcccagggcgagaccctgggagagaagtggaaacggcagctcaaccagctcagtaagagcgagttcaacacgtacaagaagtccggtatcatggaagtcgaccgcagtgaggccaaggagggcctgaagcgcggggagaccaccaagcacgccgtgagccgtgggaccgcgaaactgcggtggttcgtggaacgcaacctcgtcaagcccgaggggaaggtaatcgacctgggctgcggccgcggtggttggtcctactactgcgcggggctgaagaaagtcacggaggtcaaagggtacaccaagggcgggcccggccacgaggagccgatccccatggccacatacggatggaacctcgtgaagttgcacagcggcaaggacgtgttcttcactccgcccgagaagtgcgacaccctgttgtgtgacatcggggagtccagcccgaatcccacgatcgaggaaggccgcaccctgcgggttctaaagatggtggagccctggctccgcggcaaccagttctgcatcaagatcctgaatccctatatgccgtcagtggtcgagacactggagcagatgcagaggaagcacggcggcatgctcgtgcgaaaccccctgagccggaactccacccacgagatgtactgggtgagctgcgggacgggcaacatcgtctccgccgtgaacatgaccagccgaatgctgctcaacagattcacaatggcgcaccgcaagcccacgtacgagcgagacgtggacctgggggccgggactcggcacgtcgcggtggaacccgaggtcgcaaacctggacataatcggccagcgcatcgagaacatcaaaaacgagcataagtccacctggcactacgatgaggacaacccgtacaaaacatgggcctaccacgggagctacgaggtcaagccctccggcagcgcgtccagcatggtgaatggagtcgtacggctcctgaccaagccctgggacgtgatccccatggtcacgcagatcgccatgaccgacacgaccccgttcggccaacagcgggtattcaaggagaaagtggacacgcggaccccccgggccaagcgtgggaccgcccagataatggaggtcaccgccaagtggctatggggcttcctctcgcgcacgaagaaaccccggatctgtacccgggaggagttcacacgtaaagttcgcagcaacgcggccatcggcgccgtgttcgtcgacgagaaccagtggaactccgccaaggaggccgttgaggacgagcggttctgggacctggtgcaccgcgagcgggagctgcataaacaggggaagtgcgcgacatgcgtatacaacatgatgggcaagagagagaagaagctcggggagttcggcaaggccaaggggtcccgggccatctggtacatgtggctgggcgcccgcttcctagagtttgaggccttgggcttcatgaacgaggaccattggttctcacgggagaactctctatcaggggtagagggagaggggctgcacaaactaggttacatcctgcgcgacatttccaagatccccggcgggaatatgtatgccgacgacacggcgggatgggacacgcggatcacggaggacgacctgcagaacgaggccaagatcaccgacatcatggagcccgagcacgccctcctggcgacgagcatcttcaagctgacttaccagaacaaggtggtccgcgtacagcgccccgccaaatccgggaccgtcatggacgtcatcagccggcgcgaccagcggggctcaggccaggttggcacctacggcttgaacacgttcaccaacatggaggtgcagctgatacgccagatggagagcgaggggattttctcccccagtgagctggagaccccgaaccttgccaagaaggtcctggactggctggagaagcatggcgccgaacggctcaagagaatggccatctccggtgacgactgcgtggtgaagcccatcgacgaccggtttgctaccgctctgacggccctgaacgacatgggaaaggtccgcaaggacataccccagtgggaacccagcaagggatggaacgactggcagcaggttccgttctgctcccaccacttccaccagttaatcatgaaggacggccgggagatcgtggtcccctgccgcaaccaggacgagctggtgggcagagctcgggtgtcacagggggccggctggagcctgcgggagactgcgtgcctcggcaagagctacgcccagatgtggcagctgatgtacttccaccgccgggatctgcgcttggcagccaacgccatctgcagcgcggtcccagttgactgggtccccacgtcccggaccacctggtcaattcacgcccaccaccagtggatgacgaccgaggacatgctgtccgtgtggaaccgcgtgtggatcgaggaaaatccgtggatggaagacaagacccacgtgagctcctgggaggaggtgccatacttaggcaagcgggaggaccagtggtgcgggagcttgatcggcctgaccgcccgcgccacgtgggcgaccaacatccaggtcgccatcaatcaggtgcgccggttaataggcaacgagaactacctcgactacatgacgtccatgaagcgcttcaagaacgagagcgaccccgagggagccctgtggtaa

SEQ ID NO: 24607 - RNA, 9879 nt, synthetic construct
  misc_feature 1..9879: note = derived and/or modified CDS sequence (opt11) from DENV-1__KP188540__SS-prME
  source 1..9879: mol_type = other RNA
tctgtgactatgcttctcatgctgctgccaaccgcgctcgctttccatctgaccacccgcggtggggagccccacatgatcgtatcgaagcaagagcggggcaagagcctcctatttaagaccagcgcgggcgttaatatgtgcacgctaatcgcaatggacctgggcgagctctgcgaagacacgatgacatacaagtgcccccgcattactgaagcagagcccgacgatgtagactgctggtgtaacgctaccgatacctgggtcacttacgggacatgcagccaaacaggcgagcaccgtcgtgagaagagatccgtagccttagcgccccatgtgggcctggggctggagacccgcactgaaacttggatgagctcggagggcgcctggaaacagatccagcgggtcgagacatgggccctcaggcaccctgggttcactgtgatcgccttcttcctggcgcacgccataggcaccagcataacccaaaaagggatcattttcatactgcttatgctggtgaccccctccatggccatgcggtgtgtcggcatcgggaaccgcgacttcgtggagggtctctccggtgccacgtgggtggacgtagtgttagagcacgggtcctgcgtgactaccatggctaagaacaaacccaccctggacatcgagcttctgaaaacggaggtcaccaaccccgcagtgctcaggaagctctgcatcgaagccaaaataagtaacaccaccacggactccaggtgccccacccagggcgaggccacccttgtggaggagcaggacgccaactttgtatgccggcgcaccttcgtagaccgagggtgggggaacggctgcgggctttttgggaaggggagcctcctgacttgcgccaagttcaagtgtgtgaccaagctcgagggcaaaatcgtccagtacgagaacctcaagtattccgtgatcgttaccgtacatacgggtgatcaacaccaagttgggaatgaaaccaccgagcacgggaccatcgcgaccatcacgccccaggcgcccacgagcgagatccagttgaccgactacggggccctgaccctagactgctcaccccggaccggactcgacttcaacgaaatggtcctcttgacgatgaaggaaaagagctggctcgtgcacaagcagtggttcctggacctgccgctgccctggacgagcggggccagcactagccaggagacatggaaccggcaagacctgctcgtgacgttcaagaccgcgcacgcgaagaagcaagaggtggtcgttctgggctcacaggagggcgccatgcacaccgcccttacaggagccaccgagatccagaccagcggcactaccaccatctttgcaggccacctcaagtgccggctaaagatggacaaattgaccctcaagggcatgtcatacgtcatgtgcaccgggtccttcaaactggagaaagaggtggctgagacccagcacggcacggtattagtccaggtcaagtacgaggggactgatgcgccctgcaaaatccccttctcaacccaggatgagaagggggtgacgcagaacggccggctgatcactgcaaacccgattgtcaccgacaaggagaagcccgtgaacatcgagacagagccgccgtttggagagtcatatatcgtagtcggagcgggggagaaggcgctcaagctcagctggttcaaacgcggaagctctatcggcaaaatgttcgaggccaccgctagaggggcgcgccgcatggccattctgggggacacggcgtgggacttcggcagcattggcggggtgttcacctccgtggggaaacttgtccaccaggtattcgggactgcctacggcgtgttattctcgggtgtctcctggaccatgaagatcggtatcggcatcctgctcacttggctgggcctgaacagccggtccaccagcctctccatgacctgcatcgccgtggggatggtgacactctacttaggcgtgatggtgcaggccgacagcgggtgcgtgatcaactggaagggcagagaattgaagtgcgggtccggtatattcgtcacgaacgaagtgcacacctggaccgagcagtacaagttccaggccgacagcccgaagcggctgagtgcggccattggcaaggcttgggaggaaggggtgtgcggtatccgctctgcgacccggctcgagaacattatgtggaaacagatcagcaacgaacttaaccacatactgctggaaaacgacatgaagttcacagtcgtcgtgggcgacgcgaacggtatactcgcacaagggaagaagatgatccgcccccagccaatggagcacaagtacagctggaagtcgtggggcaaagcaaaaatcatcggcgccgatatccagaacacaaccttcatcatcgacggtcccgacactccagagtgtcccgacggccagcgggcgtggaacatctgggaggtcgaggactatgggttcggcgttttcactacgaacatctggctgaaacttcgtgattcctatacccagatgtgcgaccaccggctcatgtcagctgccatcaaagactccaaggcagtgcacgccgacatgggatactggattgagagcgagaagaatgaaacctggaaactggcgagagcgtccttcatagaagtcaaaacctgcacatggccaaaaagccacaccctatggagcaacggggtactcgagagcgagatgattatccccaagatcttcggcgggccgatctctcaacataactatagacctggctacttcactcagaccgccgggccgtggcatctgggcaagttagagctcgatttcgacttatgcgagggcacgaccgtcgtcgttgacgagcactgcgggaaccgcggcccaagcctgcggaccaccacggtgaccgggaagatcatccacgagtggtgctgccgctcctgtaccctgccaccgcttcggttccgcggagaggacgggtgctggtacgggatggagattcggcccgtcaaagagaaggaggagaacctggttcgcagcatggtttccgccggcagtggcgaggtcgactccttctccttgggcatgctgtgtgttagcatcatgatcgaagaggtgatgagatcccgctggagccgcaagatgctgatgaccgggacgctcgccgtattcctcctgctcatcatgggacagctgacatggaacgatttgatccggctttgcatcatggttggcgccaatgcgagcgaccgcatgggaatgggcaccacatatctagccctgatggccactttcaagatgcggccgatgttcgccgtggggctcctgttccgccggctcactagccgagaggttctcctgctgaccataggcctctcactggtcgccagcgttgagctgcccaattcgctcgaggagcttggggacggcctcgcgatgggcatcatgatgctcaagctgctgaccgagttccagccgcaccaactctggaccaccctgctaagcctgacatttgtgaagaccaccctgtccctggactacgcatggaaaactactgccatggtgctcagcatagtatccctgttcccactgtgcctgagcaccacgtcgcagaagaccacctggctgcctgtgctgctcggatcgttcggctgtaaacccctgaccatgtttctcattactgagaataaaatttgggggcggaagtcctggccactaaacgagggaatcatggcgatcgggatcgttagcatcctgctgtccagcctacttaaaaacgacgtccccctggccggcccattaatcgccggagggatgctaatcgcctgttacgtgatcagcggctcctccgctgacttatccctagagaaggccgcggaggtgagctgggagcaggaagctgaacactccggtgcaagccacaacatcctggtcgaggtgcaggatgatgggacgatgaagatcaaggacgaggaacgcgatgacacactcaccatcttgctgaaggccaccctgctcgccgtgtcgggtgtctaccccatgtcaatcccggcgacactgttcgtgtggtacttctggcaaaagaagaagcagcgatccggcgtgctatgggatacgccgagcccgccagaggtagagcgcgcagtactcgacgacggcatttacaggatcctgcagagggggttattgggccggagccaggtgggggtcggagtcttccaggacggggtgtttcacaccatgtggcacgtgacacgcggcgccgtcttaatgtaccagggcaagcggttggagcctagctgggcatcggtcaagaaggatctgattagctacggagggggttggaggtttcagggctcgtggaacacgggagaggaggttcaggtgatcgccgtggagcccggcaagaaccctaaaaatgtccagaccactccggggacctttaagacgcctgagggggaggtgggtgcgatcgccctcgattttaagcccgggaccagcggcagtccgattgtgaatcgggagggcaagatcgtagggctgtacggtaacggcgtggtaaccacctcgggcacgtatgtatccgccatcgcacaggccaaagcgagccaggaggggcccttacccgagatagagaacgaggtgttcaagaagcgcaacctcaccatcatggatctgcacccgggcagcggcaagacccggcgctacctgcccgccatcgtgcgggaggccatcaaaaggaagctccgtaccctgatcctggcccccacgagggtcgtggcgtccgagatggccgaggccttgaagggaatgcccatccgctatcagaccactgcggtcaagagcgaacacaccggccgggagatcgtcgacctgatgtgtcatgccacgttcaccatgcgcctgctcagcccggtgagagtacctaactataatatgatcatcatggacgaggcgcacttcaccgatcccgcaagcatcgcagcccgtggttacatatccacccgcgtcggaatgggggaggcggcggccatcttcatgacggccaccccgcccggctctgtggaggcattcccccagtccaacgccgtgatccaggatgaagaacgggacatccccgagcggagctggaactcaggctacgactggatcaccgatttccccggcaagaccgtctggttcgtaccctcgatcaagagcggcaacgacatagcgaactgcctccgtaagaacgggaagcgagtaatccagcttagccgcaagacatttgacacagagtaccagaagaccaagaataacgattgggactacgtcgtcaccacggatatctcggagatgggcgctaactttcgggccgaccgggtgatcgacccccggcgctgtctaaagcctgtcatactgaaggacgggccagagcgggtgatcttagccgggccgatgccggtcaccgttgctagcgccgcacagcgccggggccgcatcgggcgcaatcagaacaaggagggcgaccaatacgtatatatggggcagccgctcaataacgatgaggaccatgcgcactggacagaggccaagatgctgctggacaatatcaacacgccggagggaatcattccggccctgttcgagcccgagcgggagaagtccgccgccatcgatggggaataccgcttgcggggcgaggctcgcaagacgttcgttgagctgatgcggcgcggcgacctccccgtatggctgagctacaaagtggcctctgaagggttccagtactccgaccggagatggtgctttgacggtgagcgaaacaaccaggtgctggaggagaacatggacgtggagatctggaccaaagagggggaacgcaagaagctacggcctcgctggctggacgcgcggacctactctgacccgttggccttacgggagttcaaggagttcgccgcgggtcggcgctccgtgtcgggggacctcatcctggagatcgggaaacttccacaacatctgaccctgcgcgcccaaaacgcgctagacaaccttgtaatgctgcacaactccgagcagggcgggaaagcgtacaggcacgcaatggaagaactccccgacacaatcgagacgctgatgctgcttgccttgatagcggttttgaccggcggggcaaccttattctttctgagcggcaagggcctggggaagacctcgataggcctcctgtgtgttacagcctcatcagccctgctctggatggcgtcagttgagccacactggatcgctgcctcaatcattctggagttcttcctgatggtgttgttgatcccggagcccgaccggcagcggactccccaggacaaccagctggcctacgtggtcataggactcctgttcatgatcctgacggtggccgccaacgagatgggcttgctggagacaacgaaaaaggacctgggtatcggttacgtggcggccgaaaaccaccagcacgctaccatgctcgatgtcgatctgcacccggccagcgcctggaccctgtatgcggtggcaaccacggtgatcacccccatgatgcggcacaccatcgagaacaccacggccaacatctccctcacagcgatcgccaaccaggctgccatcctgatgggactggacaagggatggcccataagcaagatggacatcggcgtccctctcctggccttagggtgctattcccaggtcaatcccctgacattgactgccgcagtcctgatgctagtcgcccactacgccatcatcggacccgggcttcaggccaaggcgacgcgcgaggcccagaagcgcaccgccgccggcatcatgaagaaccccaccgtggatggtattgtggcgattgacctggaccccgtagtgtacgatgccaagttcgagaagcagctcggacagataatgttgctgatcctctgtaccagccagatcctgctgatgcggacgacttgggctctctgcgagtccataacccttgccaccggccctctaacgactctctgggaggggtccccgggaaagttttggaataccactatcgcagtttccatggccaacatctttcgcggttcgtatctggccggtgcgggactggccttttccctaatgaaatcactcgggggtgggcgtcgcgggacgggcgctcagggcgagaccctaggcgagaagtggaaacggcaactcaatcaactgtccaagagcgagtttaacacctacaagagatctgggattatggaggtcgacaggtccgaggccaaggaaggcttgaagcgcggggaaacgacaaagcacgcagtgagcagaggaaccgccaaactccgctggttcgtggagcggaacctggtcaagcccgagggcaaggttatcgacctggggtgtggccgcgggggctggtcctactactgtgccgggctgaagaaggtcacagaggtcaagggctacactaagggcgggcccggccacgaggagccgatcccaatggcaacatacggttggaacctggttaagctgcacagcggcaaggacgtcttctttatgcctcccgaaaaatgcgacacactgctctgcgacatcggggagagctcaccaaatcccacgatcgaggaaggccggacccttcgagtcctgaagatggtggagccatggctgcggggcaatcaattctgcatcaagatcctgaacccatacatgccgagtgtggtcgagacactggagcagatgcagagaaagcacgggggcatgctcgtccggaatcctctcagtagaaattctacgcacgagatgtactgggtcagctgcggtaccggcaacattgttagtgccgttaacatgacctcacggatgctgctgaaccgcttcaccatggcgcaccgtaagcccacgtatgagcgtgacgttgatttaggcgccgggacccgccacgtcgcagtggagcctgaggtggcgaacctggatattatcggccagcggatcgagaacataaagaatgaacacaagtccacttggcactatgacgaagacaacccgtataagacctgggcataccacgggagctacgaggtcaagccatcgggcagcgcgtccagcatggtgaacggggtcgttcgcctcctgacgaaaccctgggacgtaatccccatggtcacccaaattgctatgactgacactacaccgttcgggcagcagcgggtgttcaaggagaaggtggacacccgcacaccacgcgcgaagcgcgggaccactcagatcatggaggttaccgccaaatggctgtgggggttcctcagccgcaacaagaagccccgcatttgcacccgggaggagttcaccaggaaagtccggagcaacgctgctatcggagccgtctttgtcgatgagaaccagtggaacagcgccaaggaggccgtggaggacgagcgtttctgggacctggtgcaccgggagcgcgagctgcataagcaggggaaatgcgcgacgtgcgtttacaacatgatggggaaacgggagaagaagttgggggagttcggcaaggcaaaagggtcccgcgccatttggtacatgtggctgggggctcggttcttggagttcgaggcgctcggattcatgaacgaagaccactggttcagccgcgaaaacagcctgagcggggtggagggcgagggtctgcacaagctcggctacatcctgagagacatctccaagattccgggcggcaacatgtatgctgacgataccgcaggctgggacacacgtatcacagaggacgacctgcagaacgaggccaagattacggacatcatggagcccgagcatgccctcctggccacatcaattttcaaacttacataccagaataaggtggtccgcgtccaaaggcccgccaagaacgggacggtaatggacgtcatctcccgccgggatcaacgcggcagcggacaggtggggacttacggactcaataccttcaccaatatggaagtacagcttatacggcagatggaatcggaggggatcttcctgcccagcgagctagaaacccccaatcttgccgagagagccctggactggcttgagaagcacggcgccgagcgcctgaagcgaatggccatctccggggacgactgcgtcgtgaagcctatcgacgaccggtttgcgacggctctgaccgctctcaacgatatgggcaaagtccgcaaagacataccacaatgggagccgagcaaaggctggaatgactggcagcaggtcccgttctgctcccaccacttccaccagctcatcatgaaggatgggcgggagatcgtggtgccatgtcgcaaccaggacgagctggtcggccgggcccgcgtgagtcagggagccgggtggtccctccgggaaaccgcctgtctgggcaagagctacgcacagatgtggcagcttatgtactttcaccgccgggacctccgcctggccgcaaatgccatctgctcagccgtgccggtcgattgggtgccggcatctcggactacatggagcatccatgctcaccatcagtggatgacaacagaggacatgctgagtgtgtggaaccgcgtgtggattgaggagaacccgtggatggaggacaaaacccacgtttcgagctgggaggaggtgccctatctcggcaagcgcgaagaccaatggtgtggcagcctgatcggtttaaccgcccgtgctacatgggccaccaacatacaggttgctatcaaccaggtgcgccggctcattggcaacgaaaactaccttgactacatgaccagcatgaagcgattcaaaaacgagagcgacccagagggggctctgtggtga

SEQ ID NO: 24608 - RNA, 9879 nt, synthetic construct
  misc_feature 1..9879: note = derived and/or modified CDS sequence (opt11) from DENV-1__KP188541__SS-prME
  source 1..9879: mol_type = other RNA
tcagtgactatgctgctcatgcttttgcccacggcactcgcctttcacctgaccacccgcggcggcgagccacacatgatcgtgagcaaacaggagaggggcaagagcctcctgtttaaaactagcgctggcgtaaacatgtgtaccctgatcgcgatggatctgggcgagttgtgtgaggacactatgacctacaagtgtccccgcatcaccgaggccgagcccgatgacgttgactgttggtgcaacgctaccgacacctgggtaacttacggaacctgtagtcagaccggcgagcacaggagggagaaacgctccgtggccctggcgccccatgtgggcctcgggctcgagacgcgcaccgaaacctggatgagctccgaaggcgcatggaagcaaatccagcgcgtagagacctgggccttgcgccaccccggattcacggtgatagcattttttctggcccatgccattgggacgagcatcactcaaaagggtattatcttcatcctcctaatgctggtgaccccctcaatggccatgcgctgcgtgggcatcggtaaccgcgacttcgtggagggcctgtccggggcaacgtgggtcgatgtcgtgcttgagcatgggtcctgtgtgacaacaatggccaaaaacaagccgacactggacattgagctcctgaagacggaggtaaccaaccctgcggtgctccgaaagttgtgtattgaggccaagatcagcaataccaccacggactcccgctgcccaacccagggagaggccaccctggtggaggagcaggacgccaacttcgtttgccgacggacttttgtggaccgcggctgggggaacggctgcgggctgtttggcaaggggagcctcctcacgtgtgcaaagttcaagtgcgttaccaagttggaggggaagatcgtccagtacgagaacctcaagtactccgtgatcgtaaccgtccataccggcgaccaacaccaggtggggaatgaaacgaccgagcacggcacaatagcgaccatcaccccgcaggcccccacctccgaaattcagctcaccgactacggggcgctgaccttggattgtagcccccggacgggcctggacttcaacgagatggtcctccttacgatgaaagagaaatcttggctggtgcacaagcagtggttcctggacctcccgcttccctggactagtggggccagcaccagccaggaaacatggaaccggcaagatctgctcgtgacgtttaagaccgcccacgcgaagaagcaggaggtcgttgtgctgggctcacaagaaggcgcaatgcacactgccttgaccggggccacggagatccaaactagcggcaccaccacgatcttcgccggacacctaaagtgtcgcctgaagatggataagctgaccctaaaggggatgagttacgtcatgtgcactgggagtttcaagctggaaaaggaggtggcagaaacccaacatgggacggttctggtccaggttaaatacgagggtaccgacgcgccctgcaagataccgttctccacccaagacgagaagggagtgacgcagaacggccggcttatcactgccaacccaattgtcacggacaaggagaagcctgtgaacatcgagaccgagcctcccttcggggagagctacatagtcgtcggcgccggcgagaaggcgctcaagttaagctggttcaagagggggagctccatcggcaagatgtttgaagccactgccagaggggcccgccgtatggccatcctgggtgacactgcgtgggatttcgggagcatcggcggtgttttcactagcgtgggaaagctcgtacaccaggtgtttggcacagcatatggggtgctattcagcggcgtctcatggactatgaagatcggaattggcatcctgctcacgtggctggggctgaactcccgctcgacctcactcagcatgacatgcattgccgtggggatggtgactctatacctgggagtcatggtacaggcggacagcgggtgtgtgatcaactggaagggtagagagctcaaatgcgggtccggcattttcgtcacgaacgaagtgcacacttggaccgagcagtacaaattccaggcagacagcccgaaacggctgagcgcggcgataggcaaagcctgggaggagggggtctgtgggattagatcagccactagactggagaacataatgtggaaacaaatcagcaacgagctcaaccatatcctactggaaaacgacatgaagttcaccgtggtggtcggggacgcaaacgggatcctagcgcaggggaagaagatgatccgcccccaacccatggagcacaagtactcctggaaatcatggggaaaggccaagatcatcggcgccgatatccagaacacgacattcatcatcgatggccccgatacgccggagtgtccagacgggcagcgagcctggaacatttgggaagtagaggactacggcttcggcgtgtttaccacgaacatttggctgaagctgcgcgacagctacacccagatgtgcgatcaccggctcatgtctgcggccataaaggactccaaggccgttcatgccgacatgggctactggatcgagagcgaaaaaaacgagacctggaagctggctcgcgcgtccttcatcgaagtcaaaacttgcacctggcccaagagccataccctgtggtccaacggggtactcgagagtgagatgataatccccaagatcttcggtgggcctatctcgcaacacaactaccggcccggctactttacccagaccgccgggccgtggcatctggggaagctcgagctcgacttcgacctgtgcgagggcacgaccgtggtagttgatgaacattgcgggaatcgagggccgtcactgcgcaccacaacggtgacagggaaaattatacatgagtggtgctgccgttcttgtaccctgccgcccctgcggtttaggggcgaagacgggtgctggtacggcatggagattcggcccgtaaaggagaaggaggagaacttggtgcgcagcatggtgtctgccggtagcggggaggtcgattccttcagtctcggcatcctgtgcgtgagtataatgatcgaggaggtgatgaggtctcgttggtctagaaagatgctgatgactgggacgttggccgtcttcttgctcctcattatggggcagctgacctggaatgacttaatacggctctgcataatggtgggggccaacgcttctgatagaatgggcatgggcaccacctatctggccttaatggccacgttcaaaatgcggccaatgttcgccgtgggcttgttattccgacggctaaccagccgcgaggtcctcctgctgaccatcggcctatccctggtggccagtgttgagctgcccaacagcctagaagagctgggtgacggcctggcgatgggcatcatgatgctgaagctgcttaccgagttccagccccaccagctctggaccaccctgcttagcctcaccttcgtcaagaccacattatccctggactatgcgtggaagacaaccgcaatggtgctaagtatagtctcgctgttccccttatgcctcagcaccacgagtcagaagaccacctggctaccggtgctgctcgggtctttcggctgcaagccacttaccatgttcttcatcacagagaacaagatctgggggcggaagagttggcccctgaacgaggggatcatggcaatcggaattgtgagcatcctcctgtccagcctgctaaagaacgacgtccctctggctggcccgttgatcgccggcgggatgctaatcgcctgttacgtgatcagcggctccagcgccgacttgtccctggagaaggccgctgaggtcagctgggagcaggaagccgaacattcaggtgccagccacaatatcctcgtcgaggtacaagacgacggcacaatgaagatcaaggacgaggagcgcgatgacacactgacaattctgttgaaggctaccttgctggccgtatccggggtttatccgatgtccatccccgcaactcttttcgtttggtacttttggcagaagaagaaacagcgaagtggtgtgctgtgggacaccccaagcccaccggaagtagaacgcgccgtcctggacgacggtatctaccggatacttcaacgcgggctgctgggccggtcccaggtaggggtcggtgtatttcaggacggcgtttttcataccatgtggcacgtcacccgcggggcagtgctgatgtaccagggcaagcggctcgagcccagctgggctagtgtcaagaaagacctgatcagctatggtggcggctggcgattccagggctcctggaatactggggaggaggtccaggtgatagctgttgagcccggcaagaacccgaagaatgtccagaccaccccgggaactttcaaaacacctgagggagaggtgggcgcaatcgccctggacttcaagccagggaccagcggtagtccgatcgtgaaccgagaaggcaagatcgtcgggctctacggcaatggggtggtgacgacctcgggtacttatgtctccgccatcgcccaggccaaggcgagccaggaggggcccctcccggagattgagaacgaggtgttcaagaaacgcaacctcacgatcatggacctccacccgggcagcggcaagaccaggcgctatcttccagccattgtccgggaggctatcaagcgtaagctccgcacacttatcctggcccccactcgggtggtggcatccgagatggccgaggcactgaaagggatgcccatccgctaccagactacagccgtcaaaagcgagcatacaggccgggagatcgtcgacctcatgtgccacgcaacgtttaccatgaggttactgtccccggtgcgggtgccaaactacaatatgataatcatggatgaggctcattttaccgaccccgcctcaatcgccgcccgtggttacatctccacccgggtaggtatgggggaagctgcggctatcttcatgacagccacaccgcccgggtcagttgaagcctttccccaatccaacgctgtgatacaggacgaggaacgcgacatccccgagcggagctggaattccgggtacgactggatcaccgatttccccggaaagactgtgtggttcgttccgtcaatcaaaagtggcaacgacatcgcaaattgcctccggaaaaacggcaagcgggtgatccagcttagccgcaagactttcgacacggagtaccaaaaaaccaagaacaacgactgggactacgtcgtgacgacggacatctccgaaatgggcgctaattttcgggccgaccgagtcattgacccgcggcgctgcctgaagcccgtaatacttaaggatgggcccgagcgtgtgatcctggcaggcccgatgcccgtgacggtggcgagcgccgcccagcgccgcggccgcatcgggaggaaccagaacaaggagggagaccagtacgtgtacatggggcagcccttgaataacgacgaagaccacgcccattggaccgaagctaagatgctcctggacaacatcaacacacccgagggtatcatcccggcgctcttcgagccggagcgggagaagtccgccgccatcgacggggagtaccgccttcggggcgaggctcgcaagacctttgtcgaactgatgcggcgcggcgacctaccagtgtggctcagctacaaggttgcctccgaggggttccagtacagcgatcggcgttggtgcttcgatggcgagcggaacaaccaggtcctcgaggagaatatggacgttgagatctggaccaaagagggtgagcgcaagaagctgcggcctcgctggttggacgcacggacctactccgacccgctggcactgcgcgaattcaaggagttcgccgccggccggcgcagcgtaagcggagacttgatcctggagattgggaagttgccccagcacttaactcttcgggcccaaaacgcgctcgacaacttagtcatgctgcacaactccgaacaaggcgggaaggcctaccgccacgccgtggaggagctgcccgacacaatcgaaactcttatgttactggccctcatagcggtccttaccggcggggtcactctgttcttcctcagcggcaagggcctgggcaagacctccatcggcctgctctgcgttacggccagctccgccctgctatggatggccagcgtcgaacctcactggatcgcagcgtccataatcctggagttctttctgatggtactgctcatcccggagccggaccgacagagaaccccccaagacaatcagttggcgtacgtggtgataggactccttttcatgatcctaactgtcgccgccaacgaaatgggccttctcgaaaccacgaagaaggacctgggcatcggctacgtggccgcggagaaccaccaacacgccaccatgttagacgtcgacttacacccggcgagcgcctggacactgtatgctgttgctaccacggtgattaccccgatgatgagacataccatcgagaacaccactgctaacatttccctgaccgctatcgccaaccaggcggcgattcttatgggactggataaagggtggcctattagtaaaatggacatcggcgtaccccttctcgccctcgggtgttactcccaggttaatccgctgaccctcactgccgccgttctgatgctggtggcgcactacgccatcattggacctgggctccaggccaaggccacgcgtgaggctcagaagcgcaccgcggccggtatcatgaagaatcccaccgtggatggcatcgtcgcgatcgacctagaccccgtggtctacgacgccaagttcgaaaagcagctgggtcagattatgctcctgatcctgtgtaccagccagatactcctcatgcggacgacttgggctctgtgtgagtccatcaccctcgcgaccggtccgctgacaaccctgtgggagggctcgccgggcaagttctggaacacaacaatcgccgtgtccatggccaatatctttagaggctcatatctagccggggccggcctagcgttctcgctgatgaagagcttggggggtgggcggcgtggcacgggtgcccaaggcgagacgctaggcgagaagtggaagcggcaactgaatcagctttccaaaagcgagttcaacacctacaagaggagcgggatcatggaagtggaccggtccgaggcaaaagagggcttgaagcgcggggaaaccaccaagcacgccgtctcaagggggaccgcgaagctgcgatggttcgtggagcgcaacctcgtgaagcccgagggtaaggtcatagatctggggtgcggacgagggggctggtcatattattgcgctgggctgaaaaaggtgacagaagtaaaaggttacaccaaaggcggccccggccacgaggaaccgatcccaatggcaacgtacgggtggaacctggtcaagctgcacagcggcaaagacgtgttcttcatgccgcccgagaagtgcgatacgctgctgtgcgacatcggggagtccagcccgaaccctaccatagaggagggtaggaccttgcgcgtactcaaaatggttgagccatggctgcggggaaaccaattctgtattaagatcctaaacccttatatgccgtcggtggtggagacactggagcagatgcagcgaaaacacggcggcatgcttgtgagaaatcctctcagccgcaactccacgcacgagatgtactgggtgtcttgcgggaccggcaacatcgtatctgccgtcaatatgaccagccggatgcttctaaaccgcttcacgatggcccaccgaaagccaacgtacgagcgggacgttgacctcggggcagggacccgccacgttgccgttgagccagaggtagcaaatctggatataatcggccaacggatcgaaaacatcaaaaacgagcacaagagtacctggcactacgatgaggacaacccgtacaagacgtgggcctaccatgggtcctacgaggtcaagccctccggcagcgcgtcaagcatggtgaacggcgtggttcgcctgctgacgaagccctgggacgtgatacccatggtaacccagatagcgatgactgacaccactccgtttggccagcagcgggtgttcaaagagaaagtagacacccgcactccacgggccaagcggggcacaacgcagataatggaggttaccgccaagtggctgtgggggttcctgtcacggaacaagaagccaaggatttgcacacgcgaggaattcactcgaaaagtgcgtagcaatgccgcaatcggcgcagtgtttgtcgacgaaaaccaatggaacagcgcaaaggaggccgtcgaggacgagcgcttctgggacctcgtgcacagagaaagagagctccacaagcaggggaagtgcgccacttgcgtctacaacatgatgggaaaaagagagaaaaagctgggagaattcggtaaggcgaagggcagtcgcgccatctggtatatgtggctcggggcaagatttctcgagttcgaggccctgggctttatgaacgaggatcactggttcagcagagagaattccttgtcaggagttgagggtgaggggctgcacaagctaggctatattctccgtgacatatcgaaaatacccggcggcaatatgtacgcggacgacaccgcgggctgggatactcgcataacagaggacgacctgcagaacgaggccaagatcacggacataatggagcctgagcacgccttgctcgccaccagtatcttcaaactgacgtaccagaacaaggtagtacgcgttcagcgtcccgccaaaaacggcaccgtcatggatgttatttcgcgacgggaccaacgcggctccggccaggtaggtacatatgggttgaacacctttacaaatatggaggtgcagctcatccgtcaaatggagtccgaggggatctttctgcccagcgaactcgagactcctaacctcgcggagcgagctctggattggctggagaaacatggagccgaacggctcaagcgcatggccatctctggagacgactgcgtcgtgaagcccatcgacgaccggttcgctacggcgctaacagcccttaacgacatgggcaaggtgcgcaaggatatcccccagtgggaacccagcaaaggctggaacgactggcagcaggtcccgttctgctcccaccacttccatcagctcattatgaaggacggccgggagatagtggtgccctgcagaaaccaagacgagctggtgggccgggcgcgcgtcagccagggggcaggctggtccctgcgggagaccgcgtgcctaggcaagagctatgcacaaatgtggcaacttatgtactttcaccgccgggacctgcgtctagccgctaacgccatctgttcagccgtgcccgtcgactgggtccctgcgagcaggaccacctggtctatacatgcccaccaccagtggatgaccacagaagacatgttgagcgtttggaaccgcgtgtggatcgaggagaacccgtggatggaggacaagacccacgtctcctcatgggaggaagttccctacctgggcaagcgcgaggaccagtggtgtggctcactaatcgggctgacagcgcgggcgacgtgggcgaccaacattcaggtggctatcaaccaggtccgccggctgatcggaaacgagaactacctcgactatatgacgtctatgaagcgctttaaaaatgagagcgaccccgagggcgccctgtggtga

SEQ ID NO: 24609 - RNA, 9879 nt, synthetic construct
  misc_feature 1..9879: note = derived and/or modified CDS sequence (opt11) from DENV-1__KP188543__SS-prME
  source 1..9879: mol_type = other RNA
agcgtgaccatgctgctcatgctgctacccaccgccctcgccttccacctgaccacacggggcggggagcctcatatgatagtgagcaaacaagagcggggcaaatcgctccttttcaagacctcggtgggggtgaacatgtgcacgttgatcgccatggaccttggcgagctctgcgaagatacaatgacgtataaatgcccccgaatcaccgaagtcgagcccgatgacgtggattgctggtgcaacgccaccgacacctgggtgacgtacggcacgtgcagccagactggcgaacatcggcgggacaagcggtccgtcgccctggcgccccacgtgggcctggggctcgagacaagaaccgagacctggatgagctccgagggcgcctggaagcagatccaaaaggttgagacgtgggccctgcgacatcccggatttacggtcatcgccttgtttctggcccacgccattggcaccagcatcactcaaaagggtattattttcatcctgctgatgctcgtgaccccctcgatggcgatgcgctgcgtaggcataggcaatcgggatttcgtcgaggggctgagcggcgccacgtgggtggacgtggtcctggaacacgggtcttgcgtgaccaccatggccaagaacaagcccaccctcgacattgaactgctgaagacggaagtgacgaaccccgccgtcctccgcaagttgtgcatcgaggcgaagatcagcaacaccaccacagacagccggtgtccgacccagggcgaggcgaccctggtggaggagcaggacgccaacttcgtgtgtaggcggacctttgtggaccgcgggtggggcaacggctgcggcttattcggcaagggaagcctgctgacgtgcgctaagttcaagtgcgtaaccaaactcgagggcaagatcgttcagtacgagaacctgaagtattccgtcatcgtgaccgtccacaccggggaccagcaccaagtggggaacgaaacgaccgagcacggaaccatagccaccataacaccgcaagcccccacgagtgagatccagcttacggactatggggcgctcaccctggactgcagtccccggaccggcttagacttcaacgagatggtgctcctgaccatgaaggagaagtcctggctggtccacaagcagtggttcctcgacctgccgctaccctggaccagcggggctagcacctcccaggagacttggaaccggcaggatttactggttactttcaaaactgcccacgccaagaagcaggaggtggtcgtgctgggctcccaagagggcgccatgcacaccgcgctcaccggggccacggagatccagaccagcggcaccacaacgatcttcgccggtcacctgaagtgccggctgaaaatggacaagctcaccctgaagggaatgtcctacgtgatgtgtaccgggtcattcaagctggagaaggaggtcgccgaaacccagcacggaacagtgcttgtgcaggtcaagtacgagggcaccgacgcgccgtgcaagatccctttcctcacccaggacgagaagggggtgacccagaacggcagactaatcacggctaaccccatcgtcaccgacaaagagaagcccgtcaacatcgagaccgagccccccttcggcgagtcctacatcgttgtaggagccggagagaaggccctgaagctcagctggttcaagaaagggtcctcaatcggcaagatgttcgaggccaccgcgcgcggggcccgccggatggccatcctgggcgacacggcctgggactttgggtccatcgggggcctcttcaccagcgtggggaagctcattcaccaggtgttcggcaccgcatacggggtgcttttctccggcgttagctggaccatgaaaatagggatcgggatcctgttaacgtggctgggcctgaatagtcgcagcacctcacttagcatgacctgcatcgcggtcgggatggtgaccctgtatcttggcgtcatggtccaagccgactccgggtgcgtgatcaactggaagggccgcgagttaaagtgcgggagcggcatcttcgtcacgaacgaagtgcatacatggaccgagcagtacaagtttcaagctgacagtccgaagcgtctgagcgccgctatcggcaaggcgtgggaggagggtgtgtgcggcatcagaagcgcgacccggctggagaatatcatgtggaaacaaatctccaatgagctcaactacatacttctggagaacgacatgaagttcaccgtcgtggtgggcgacgtcaacggcatactcgcccaggggaaaaagatgatccgcccccaacctatggagcacaaatatagctggaaatcctggggcaaagccaagatcatcggcgccgacatccagaacactaccttcatcatcgacgggccggacaccccggagtgccccgacgaccagcgggcgtggaacatctgggaagtggaggactacggcttcggtatcttcactacgaacatctggctgaagctccgagactcacacacccagatgtgtgaccacagattaatgtccgccgccatcaaggactccaaggccgtgcacgcggacatgggctactggatcgagtccgagaagaacgagacctggaagctggccagggccagcttcatagaagtcaagacctgcatctggcccaagtcccacaccctgtggagcaacggtgtgcttgagtccgagatggtgatccccaagatatacgggggcccgatcagccaacacaactaccgaccggggtatttcacgcagaccgccggcccgtggcacctaggaaagctggagctcgacttcgacctgtgcgaaggtaccacggtcgtagttgacgagcactgcggctatcgcgggccgtccctgcggaccaccaccgtcacgggcaagatcatccacgagtggtgctgccgcagctgtactctgccgcccttgcggttcagaggcgaggacggttgctggtacgggatggagatccggcccgttaaggagaaggaggagaatctggtgcgcagtatggtcagcgccggctccggcgagatggactccttcagcctcgggatcctgtgcgtgtctatcttaatcgaggaggtaatgcgcagccgctggtctcggaagatgctcatgaccggcacgctggcggtcttcctgctcctgatcatggggcagctcacgtggaacgacctcatccgtctgtgtatcatggtgggcgccaatgctagcgaccgcatgggaatgggcaccacttatctggccctcatggccaccttcaaaatgcggccgatgttcgccgtggggctgctgttccgcagacttacctcccgcgaggtcctgctgctgaccgtggggctgagtctcgtcgcctccgtagaactacccaacagcctggaggagctgggcgacggcctcgccatgggtatcatgatgctgaagctgctcaccgacttccaaccccaccagctatggaccacattgctgtccctgaccttcatccggacctccctgtccctcgactacgcctggaagacaatggccatggcgctgagcatcgtgtccctgttccccctctgtctgtcaacgacctcccagaagaccacctggctaccggtcttactgggctccttcgggtgcaagcctctgacgatgtttctaatcactgagaacaagatctggggccgcaaatcctggccaataaacgaggggattatggccgtgggaatcgttagcatcctgctgtccagcctccttaagaacgacgtgcccctggccgggccgctcatcgccggcggaatgctgatcgcgtgttacgtaatcagcgggtccagcgccgacctgtccctcgagaaggccgccgaggtgtcatgggaggaggaggccgagcactcgggcacgagccacaacattctggtcgaagtgcaggatgacgggaccatgaagatcaaggacgaggagcgggacgataccctgacgatcctcctgaaggcgaccctgcttgccgtgtccggggtttacccaatgagcatccccgcaaccctgttcgtgtggtacttctggcaaaagaagaagcagcgctccggggtgctgtgggacacccccagcccgcccgaagtcgagcgggcagtgctggacgacggcatctaccgcatcctacagcggggcctattgggtcgctcccaggtgggcgtgggggtgttccaggacggcgtcttccacaccatgtggcacgtcacccgcggtgctgtgctgatgtaccagggcaaacgcctggagccctcatgggcgtccgtgaaaaaggatttgatttcctacggcgggggctggcggtttcagggcagctggaacaccggggaagaggtacaggtgatcgccgtggagcccgggaagaacccgaagaacgtccaaaccacgcccggcaccttcaagacccccgagggcgaggtgggagccatcgccttggacttcaagcccggcaccagcgggtccccgatcgtgaatcgcgagggcaaaatcgtcggcttgtacggaaacggcgtggtgacgaccagcgggacctacgtcagtgccatagcgcaggccaaggcgacccaggaggggccccttcctgagatcgaggacgaggtcttcaaaaagcggaacctcacgatcatggacctgcacccagggagcggcaagacccgccggtacctgcccgcgattgtgcgcgaggccatcaaacggaagctccgcaccctcatactagcgcccacccgcgtcgtggccagcgagatggccgaggcgctcaaaggcatgcccatccggtaccagacgaccgcggtcaagtccgagcacacagggcgagaaatagtcgatctgatgtgccacgcgaccttcacgatgcggttactcagcccagtgcgcgtgcccaattacaacatgatcatcatggacgaggcgcacttcaccgaccccgcctccatcgccgccaggggctatataagcacccgcgtcgggatgggcgaggccgccgccatctttatgaccgctacgccgcctgggtccgtcgaggcgttcccccagagcaatgccgttatccaggacgaggaacgggacatccctgaacgcagctggaacagcggctacgactggatcaccgatttccccggcaagaccgtctggtttgtgccctccatcaagagcgggaacgacatcgccaattgtctgcggaaaaatggcaagagggtcatacagctgtccagaaagacctttgacactgagtaccagaaaaccaagaataacgactgggactacgtcgttaccaccgatatcagcgagatgggggccaacttccgcgccgaccgagttatcgaccctcgccggtgcctcaagcccgttatactgaaggaaggcccagaacgcgtgatccttgcgggtccaatgcccgtcacagtggcctccgctgctcagcggcgtggcagaataggccgcaaccagaacaaggaaggggaccagtacatctacatgggtcagccgctcaacaacgacgaggaccacgcacactggaccgaagccaagatgctgcttgacaacataaacacccccgaggggatcatcccggccctgttcgagccagaaagagagaaatccgccgccatcgacggcgaatacagactgcgcggggaggcgcggaagacattcgtggagctgatgcgccgaggcgacctccccgtctggctgtcctacaaggtagcctcagagggcttccagtactccgataggcgttggtgcttcgacggggagcgcaataatcaggtcctggaggagaacatggacgtcgagatctggacaaaagaaggagagcggaagaagcttcgcccccggtggctggacgcgcgcacctacagcgacccgctggccctcagggaattcaaggagttcgccgccgggcgcaggtccgtgagcggcgacctgatcctggagatcggcaagctcccgcagcacctgacgctaagagcccagaacgcactggacaatctcgtgatgctgcacaacagcgagcagggcgggaaggcctaccgacatgcgatggaggagctccccgacacgatcgagaccctgatgctgctggccctcattgccgtcctgaccggaggggtcaccctcttctttctgtccggcaaggggctaggcaagactagcatcgggctcctgtgcgtgatggcctccagcgccctattgtggatggcctccgtcgagccccactggatcgccgcatccatcatcctggagttctttctgatggtgctcctgatcccggagccggatcgccaacgtacgccccaggacaatcagctggcctacgtggtcatcggcctcctgttcatgatactgacggtggccgcgaacgagatggggctcctggaaaccaccaagaaggacctgggtatagggcacgtggccgtcgagaaccaccatcacgcaaccatgctggatgtagacctgcgcccggcctccgcctggacgttgtatgcggtggccactaccgtcataacccccatgatgcgacacacaatcgagaacaccaccgccaacatcagcctcaccgccatcgccaaccaggcggccatactgatgggcctagataagggctggcccatatccaagatggacatcggggtgcccttactggccctcggctgctacagccaggtgaacccgctcacgctgaccgcagccgtcctgatgctcgtggcccactacgccatcatagggccaggcctgcaggccaaggcaacacgcgaggcgcagaagcgaaccgccgccgggatcatgaagaacccgaccgtggacggtatcgtcaccattgaccttgatccagttgtgtacgatgccaagttcgagaagcagctcggccaaatcatgctgcttatcctctgcacctctcagatcctgcttatgcggacgacgtgggccctctgcgagagcatcaccctggccaccgggccgctaaccacgctttgggagggctcccccgggaagttctggaacaccaccatcgcggtctccatggccaacatcttcagaggctcctacctggctggtgccgggctggctttcagcctaatgaagtccctgggcgggggccggcgcgggaccggcgcacagggcgaaacgctgggagagaagtggaagcgccagctcaaccagttaagcaagtccgagtttaacacctacaagaagtccggcatcatggaggtggacaggtccgaggccaaagaggggcttaagcggggcgaaaccaccaagcacgccgtgtcccgggggaccgccaagctgcggtggtttgtcgaacgcaacctagtgaagccagagggaaaggtggtcgatctaggctgcgggcgcggcggttggagctactattgcgcgggactgaagaaggtgaccgaggtcaaggggtatacgaagggcggcccggggcacgaagagccgatccccatggcaacatacggctggaacctcgtcaagctgcactccgggaaggacgtgttcttcacgccgcccgagaagtgtgacacgctgctctgcgacatcggggagagcagcccgaacccaaccattgaggaaggtcgcaccctgcgggtgctgaagatggtcgaaccatggctccgcgggaaccagttctgcattaagatcttaaacccctacatgccgtctgtggtggagaccctggagcaaatgcaacggaaacatggaggaatgctcgtccgaaaccccctgtcccgaaactcgacgcacgagatgtactgggtgtcctgcggcaccgggaacatagtctctgccgtcaacatgacctcacgcatgctgctcaacaggttcaccatggcccaccgcaagcccacgtatgagcgcgacgtggacttaggcgcgggtacccggcacgttgccgtggaacccgaggtggccaacctggacatcatcggacagcgcatcgagaacatcaagaacgagcacaagtcgacctggcactatgacgaggacaacccatacaagacgtgggcttaccacggctcctacgaagtcaagcccagcgggtccgccagctccatggtgaacggcgtggtccgattgctgacgaagccctgggacgtcatccctatggtgactcagatcgcgatgaccgacaccacgccgttcgggcagcagcgcgtcttcaaggagaaggtggacacccggacgccccgggccaagcgggggaccgcccagatcatggaggtgacggccaagtggctgtggggcttcttgagccgcaacaagaaaccccggatttgcacacgcgaggagtttacccggaaggtccgctccaacgccgcgatcggggctgtgttcgttgacgagaaccagtggaacagcgccaaggaggccgtcgaggacgagagattctgggacctcgtgcaccgcgagcgcgagctgcataaacagggaaagtgcgcgacttgcgtgtacaacatgatgggtaagcgtgaaaagaagttgggcgagttcgggaaggcaaagggcagcagagccatctggtacatgtggctgggcgcccggtttctggaattcgaggccctaggtttcatgaacgaggaccactggttctcccgggaaaacagcctatccggggtcgaaggggagggcctgcataaactcgggtacatcctgcgcgacatcagcaagatccctggcggaaacatgtacgcggacgacacggccgggtgggatacccggatcaccgaggatgatctgcagaacgaggccaagatcaccgacataatggagcccgagcacgccctattggcgacgtccatcttcaagctgacataccaaaacaaggtggtgcgcgtgcagcgccccgccaagtctgggactgtgatggacgtgatctcccggagggaccagcgggggagcggccaggtgggcacctacggactcaacaccttcaccaacatggaggtgcagctgatccgccagatggagtccgagggcatctttagccccagtgagctggagacaccgaacctcgcgaagaaggttctggactggctggagaagcacggggccgagagactcaagcgcatggcgatcagtggcgacgactgcgtcgtgaaacccatcgacgatcgcttcgccaccgcgctgacggccctgaacgacatggggaaggttcgcaaggatatcccccagtgggagccctccaagggctggaacgactggcagcaggtccctttctgcagccaccacttccaccagctgattatgaaggacggccgggagatcgtggtgccctgccgcaaccaggacgagctggtcgggagggcgcgcgtgagccagggcgccgggtggagcctgcgggagaccgcctgcctcggcaagtcctacgcgcagatgtggcagctgatgtacttccaccgcagagacctgcgcctcgccgctaacgcaatctgcagcgcggtgccggtagactgggtccccactagccggacgacctggtccatccacgcgcatcaccagtggatgacgaccgaggacatgcttagtgtgtggaaccgcgtctggattgaggagaacccatggatggaaaacaagacccacgtgtccagctgggaggaggtgccctacctgggcaagcgggaggaccagtggtgcggctccctcatcggcctgaccgcccgcgcgacatgggccactaacatacaggtcgcgatcaaccaggtgcgacggctcattgggaacgagaactacctcgattacatgaccagcatgaaacgcttcaagaacgagagtgatcccgagggggcgctctggtga

SEQ ID NO: 24610 - RNA, 9879 nt, synthetic construct
  misc_feature 1..9879: note = derived and/or modified CDS sequence (opt11) from DENV-1__KP188544__SS-prME
  source 1..9879: mol_type = other RNA
agcgtcacaatgctgctaatgcttctgcccacggcactcgcattccacctcacgacccgaggaggagaaccgcatatgatcgtaagcaaacaagaacggggaaagtccctgctatttaaaacgagcgttggagtcaatatgtgcacgctgatcgcgatggaccttggcgagttatgcgaggacaccatgacctacaagtgtccgaggatcactgaagcagaacccgatgacgtggactgctggtgcaatgcaaccgatacatgggtgacttatggaacgtgttctcaaactggagagcatcgtcgcgacaagcggtcagtagcactcgctccgcatgtaggcctgggcctcgaaacgaggacggaaacttggatgtcatctgagggggcctggaaacaaatacaaaaggtagaaacctgggcactacgacacccgggtttcactgtcatcgcactcttccttgcgcacgccatagggacgagcataacacaaaagggtatcatattcatactcctgatgctcgtcactccgtcgatggcgatgcgctgcgttggaatcggcaaccgagatttcgtggagggactttcaggtgcgacgtgggtagacgtcgtcctggaacacgggagctgtgttaccacgatggccaaaaacaagcccacactagacatcgaactactgaaaacggaagtcacaaaccccgcagtcctgcggaaactctgcattgaagcaaagataagtaataccaccactgactcgaggtgtcccacccaaggcgaggctaccctagtggaagaacaagacgccaacttcgtttgtaggcggaccttcgtagaccgaggatggggtaacgggtgcggactcttcggtaaagggagcctcttaacgtgtgcaaaatttaaatgcgtcactaagttggaggggaagatcgtacaatacgaaaacttgaaatatagcgtgatagtgacagtccacacaggcgatcaacaccaagttgggaatgaaactaccgaacacggaacgattgcgaccataacgccccaagcgcccacgagcgaaattcagctcaccgactacggcgccctcactctagactgcagtccgcgaactgggctcgacttcaatgaaatggtgctacttacgatgaaagaaaaatcctggcttgtccacaaacagtggtttctggaccttccactcccctggactagcggagcttccacttcacaagagacctggaaccgccaagatctactggttaccttcaaaacggcccatgccaagaaacaagaggtggtcgtactagggagtcaagagggggcgatgcacaccgccctcacaggcgcaacagaaatacagacttccgggacaacaacaatattcgccggacacctgaagtgtcgcctaaaaatggacaaactgactctcaaaggaatgtcctacgtaatgtgcacaggatcattcaaactggaaaaggaggtagcggaaacgcagcacggaaccgtccttgtacaagtgaaatacgaggggaccgacgcaccatgtaaaatccctttcttgacccaggacgaaaagggcgtaacccaaaacggccgcctaattacggcaaacccgatcgtcacagacaaagagaaaccagtcaacattgagaccgagccaccgtttggagaatcatacatagtagtcggggcgggcgaaaaagccctgaagctatcgtggtttaagaaagggtccagcataggaaaaatgttcgaggcaacggcgagaggggcacggaggatggccatcctcggggacactgcatgggactttggcagtataggaggactcttcacatcagtcggcaagctcatacaccaggtcttcggtacagcctacggcgtcctttttagcggtgtgagctggacgatgaaaataggtattggaatcttgctaacgtggctagggctcaactcgcgcagtacatccctcagtatgacctgtatcgccgtaggaatggtgacactgtacttaggtgtcatggtacaagccgactccggctgcgttattaattggaaaggcagagaattgaaatgcggaagcggcattttcgtaacaaatgaggtccacacctggacagagcaatataaattccaagcggacagccccaaaagactctccgcagcgattggaaaggcctgggaagagggggtatgcgggatcagatccgcgaccagactcgagaatatcatgtggaaacagataagtaacgaactgaattatatactactggagaacgacatgaagttcacagtggtagtcggagacgtgaacgggatactcgcacagggcaagaaaatgattcgaccccaaccgatggaacataagtatagttggaaatcctggggcaaggccaagataataggcgccgacatccagaacaccacattcatcatcgatgggcccgacactcccgaatgcccagatgaccaacgagcttggaacatttgggaggtagaagactacggattcggaatcttcaccaccaacatctggctaaagctgcgagactcccacacacaaatgtgcgaccaccgcttaatgagcgccgcaatcaaagattcgaaggcggtccacgcggatatgggatactggatcgaaagcgaaaagaacgaaacctggaaactcgcacgagcctcgttcatcgaagtaaaaacctgcatatggcctaagtctcacacactgtggtcgaacggcgtcctcgaaagcgaaatggtcattccgaaaatttacggaggtcccatcagccaacacaactaccgacccggttatttcactcaaactgcggggccttggcatctgggcaaactggaactagacttcgacctatgcgaaggcacaacagtagtggtggacgaacattgtggctaccgaggcccctcactccgcactaccaccgtcacaggaaaaattatccatgaatggtgctgccgctcatgcaccctgccacccctacgcttcaggggtgaagacggctgctggtacggaatggagatccgaccagtaaaagagaaagaagaaaacctggtccggagtatggtatccgccgggtcgggggaagtcgactcattcagcctaggaatactatgcgtaagcatactaatagaagaggtcatgaggtccaggtggagccgcaagatgctcatgacaggaactctagcggtgttcctactcttgattatgggacaattgacatggaacgacctaatacgcctatgcatcatggtaggagccaacgccagcgacagaatgggaatgggaacgacatacctagccctcatggccacctttaaaatgcgacccatgttcgccgttggcctgctattccgaaggctgacatgccgcgaggtcctcctactcacagtcgggttaagtctagttgcatcagtagagcttcctaactctctggaagaactcggcgacggcttggccatgggcattatgatgttaaagctactcacagactttcagccccaccaattgtggaccacactactctcactaaccttcatccgaacgagcttatccctcgattacgcctggaaaacaatggcaatggcgctgtccatagtctccttattccccctctgtttgtccacgacaagccagaaaaccacgtggctcccagtattgctcggatcctttggatgcaaaccgctgacgatgtttcttataaccgaaaacaagatctgggggcgaaagagttggccaataaacgagggcataatggccgtcggtatcgtatcaattctactaagttcgctgctcaaaaacgacgtcccgctagccgggcccctgatcgccggtggcatgttaatagcctgttatgtgataagcggaagttcagccgatctgagtctcgaaaaagcggctgaggtcagttgggaggaagaagcggaacacagcggcacctcacacaacatcctggtcgaggtgcaggatgacgggaccatgaaaatcaaagacgaggaaagagacgacacactaaccatactcctgaaagccacgctgctcgcggtaagcggtgtataccccatgtcaatccccgcgacgcttttcgtatggtacttctggcagaaaaagaaacaacgcagcggagtactttgggacacacccagcccacccgaggtcgaacgcgcagtcctcgacgatggaatttacagaatactgcaaaggggcttgctcggacgtagtcaagtcggcgtaggcgtgttccaggacggtgtgttccacaccatgtggcacgtgacacggggagcggtcttgatgcaccaaggaaaacgcctcgaaccgagttgggcctccgtcaagaaagacctaataagttacggcggagggtggcggttccaaggctcctggaacaccggagaagaggtccaggtcatcgcggtagaaccaggcaaaaaccccaaaaatgtccagacgacgcctggaacattcaaaacaccggaaggagaagtgggagcaatagcactggactttaaaccagggaccagcgggagcccaatagtgaaccgagagggaaagatagtcggcttgtacggaaacggtgtcgtaacaacaagcgggacatacgtaagcgccatagctcaagctaaagccactcaagaaggaccactacctgagatagaagacgaggtcttcaagaaaaggaacctcacgatcatggacctacaccccggatcaggaaagacaagaagatacttgcccgccatcgtgcgcgaggccatcaagcgcaaactacgaacccttatactggcacccactcgcgtagtagcaagcgaaatggcggaggcgctaaagggaatgccgatcagataccaaaccaccgccgtaaagagcgaacacaccggccgtgagattgtggatctgatgtgtcacgcaaccttcacgatgcgcctcctgagccccgtccgggttccgaactacaacatgattatcatggacgaagcacacttcaccgatccggcctccatcgctgctaggggttatatcagcacacgagtagggatgggcgaagcggcagcaatattcatgaccgccactccgcctggatccgtggaggctttcccccaatcgaatgccgtaatacaagatgaagaaagggacatacccgaaaggtcgtggaactcaggatatgattggattacagacttcccggggaagactgtgtggtttgttcctagcatcaagtcggggaatgacatagccaactgcctacgcaaaaacgggaaaagagtaatccaattaagtaggaagacgttcgacaccgaataccagaagactaaaaataacgactgggattacgtcgtcaccaccgacatatctgaaatgggggcaaacttcagagcagatcgggtgatcgatcccagaaggtgcctgaagccggtcatattaaaggagggaccagagagagttatcctagccgggcctatgccagtgacggtagcctccgcggcgcagcgacgcggacgcatcggtcggaaccagaacaaggagggagaccagtatatctatatgggacaacctctgaacaatgatgaggaccacgcacactggacggaggcaaaaatgcttctcgataacataaacacaccggaaggaataatccccgcgctgttcgaacccgagagggaaaagtcggccgcaatcgacggggaatataggctcaggggcgaggcacgaaagacatttgtggaactcatgcggaggggagatctcccagtctggctcagttacaaagtagctagcgagggatttcaatactcagaccgaagatggtgtttcgacggagagaggaacaatcaagtcctggaagaaaacatggacgtcgagatatggacaaaggagggtgaacgtaagaagctgcgccccagatggttggacgcacgcacctactcggatccgctagctttgagagaatttaaagaatttgccgcaggaagaaggtccgtatcgggagacctgatacttgaaatcgggaagctgccacagcatcttacgctcagagcacaaaacgcccttgataacctagtcatgcttcacaacagcgaacagggaggaaaggcttatcggcatgctatggaggaattacccgacacaatagagacgctgatgctgctcgcgttaatcgcagtgcttaccggcggagttaccctatttttcctgagcgggaaaggcctcggtaagacaagtatagggctgctctgcgtcatggcatcgagcgcactgttgtggatggcatcggttgaacctcactggatagcggcgtcgatcatactagaatttttcttaatggtactactgattccagaaccggacagacaacgaactccccaggacaaccaactggcctatgtcgttatcgggctactattcatgatcctgacagtcgctgcgaacgaaatgggattactagagaccacgaagaaagacctaggaataggccacgtcgcagtagaaaaccaccaccacgccacaatgttggacgtcgacctgcgaccggcgtcagcatggactctatatgccgtcgctacaacggtcataaccccaatgatgcggcacacaatagaaaacacgacggccaacatcagcctcacagcgatcgccaaccaggccgcaatcctgatgggactagacaaaggctggccaatatctaaaatggatatcggggtcccactactagcgctcggctgctactcccaagtaaaccctctaacgctgacagccgctgtgctgatgctcgtcgcacactacgcaataataggccccggactgcaggctaaggcaaccagagaggcacagaaaaggaccgccgccggaattatgaagaacccaacggtcgacgggatagttacaattgacctcgaccccgtcgtctatgacgccaaattcgagaagcaactgggtcagattatgctcctaatcctctgcacttctcagatactactgatgcgcaccacctgggccctctgcgagagcattacactagcaactggacccctgaccacactgtgggaaggaagtccaggcaaattctggaacacaaccatcgcggtatccatggctaacatcttccggggttcgtacctagcaggcgctggattggccttctctctcatgaaaagtctgggcggaggtcgacgaggcacgggagcgcaaggcgagacgctcggcgagaagtggaaaaggcaattgaatcagcttagcaaatccgagttcaacacctataagaaaagcggaataatggaagtagacaggtctgaagcaaaagagggcctaaaacggggagaaacgacaaaacacgccgtctctcgtgggaccgccaaactcagatggttcgtagagaggaacctggtgaaacctgaggggaaggtaatagacctcggatgcggtcgaggtggctggagctattactgcgccggcctcaaaaaggtaacagaagtaaaaggatacaccaagggtggacctgggcacgaggaaccgataccgatggcaacatatggttggaacctggtcaagttacactccggaaaagatgttttctttacaccacccgaaaaatgcgacacgctcctatgcgacataggcgaaagctcccccaaccccacaatagaagaagggaggaccctacgggtgctgaaaatggtagagccatggctacgaggaaaccaattttgcatcaaaatacttaatccatacatgccttcggttgtcgaaacactggagcagatgcagcgcaagcacggcggtatgctggtgcgtaaccccctcagcaggaacagtacacatgagatgtattgggtcagctgcggcaccggtaacatcgtaagcgcagtgaacatgaccagtaggatgcttttgaaccggttcacgatggcccacaggaaaccgacttatgaaagggacgtagacctaggagccgggaccagacatgtagctgtagaaccggaggtcgccaaccttgacataataggtcagcgtatagagaacattaaaaatgaacataaatcaacatggcaccacgacgaagacaacccatacaagacctgggcataccacggttcctatgaagtcaaaccatccggcagcgccagctcaatggtcaatggagtggtacgactactaaccaaaccgtgggatgtaatcccaatggtcactcaaatagcgatgaccgacacgacaccattcggccaacaaagagtgttcaaggagaaggtagatacacgtacgcctcgggcaaagcgaggaacggcacaaataatggaagtcacggctaaatggctatgggggtttctgagccgaaacaagaaacccaggatatgtaccagagaagagttcacccgaaaagttcgctccaatgcggcgataggcgccgtattcgtcgacgaaaatcagtggaactccgccaaagaggcagtcgaggatgaaagattctgggatctcgtacatcgagaacgagaactacacaaacaaggtaaatgcgcgacctgtgtatataacatgatgggcaagcgtgagaagaagctcggagagttcggcaaagcaaagggatcccgggcgatatggtacatgtggctcggtgcacgattcttagaatttgaggcgctaggtttcatgaacgaggaccactggttctccagggagaatagcctatcaggagtagaaggagaaggtctccacaaactaggatatatcctacgcgacatttcaaaaataccgggaggtaacatgtacgcagacgacacggccgggtgggacacaagaataacggaagacgatttgcaaaacgaggctaaaatcacggacatcatggagcctgaacatgccctgttggcaacatccatcttcaaactaacttatcaaaacaaagttgtccgcgtccaacggcccgccaagtcgggtacagttatggatgtgatcagccgccgcgatcagcgaggttccggtcaagtaggcacctacgggctcaacacgttcacaaacatggaggtgcagttaataagacaaatggagtccgaaggcatctttagccccagtgaactggaaaccccaaatctagccaaaaaggtgcttgactggctagaaaaacacggtgcggagcgactgaaacgtatggcgatcagcggggacgattgcgtggtcaaaccaatcgacgatcgattcgcaacggctctgaccgcgttgaacgacatggggaaagtaagaaaagacattccacaatgggagcctagcaaaggctggaacgactggcaacaggtaccattttgctcgcaccactttcaccaactaatcatgaaagatggtcgagaaatcgtcgtaccttgtcgaaaccaggacgaactcgtcggccgtgcgagagttagccaaggggcaggctggagccttcgcgagacggcctgtctcggtaagtcctacgcgcagatgtggcaattaatgtatttccatcgccgcgatctcaggctggccgctaacgccatctgcagtgcagttcccgtagactgggtcccaacaagccggaccacgtggagtatccatgcccaccaccaatggatgactacggaagacatgctaagcgtctggaacagagtatggatagaggagaacccgtggatggaagacaaaacccatgtcagctcctgggaagaagtgccttacctcggcaaacgcgaagatcagtggtgcggcagcttaataggactgaccgcgcgagcaacgtgggccaccaatatacaggtagccataaatcaggtgcgacgactgataggaaacgaaaactacttagactacatgacgagcatgaaaaggttcaaaaacgagtcagatcccgaaggggcattgtggtaa

SEQ ID NO: 24611 - RNA, 9879 nt, synthetic construct
  misc_feature 1..9879: note = derived and/or modified CDS sequence (opt11) from DENV-1__KP188547__SS-prME
  source 1..9879: mol_type = other RNA
agcgtgaccatgctgctcatgctgctgcccaccgccttggccttccatcttaccacgcggggcggcgagccccacatgatcgtgagcaagcaggaacggggcaagtcgctcctgttcaagacctcagtgggggtgaacatgtgcaccttaattgcgatggacctgggcgagctctgtgaggacacgatgacctataagtgccctcggatcaccgaggcggagcccgacgacgtcgactgctggtgcaacgcaacggacacttgggtgacctacggaacttgcagccagaccggcgagcaccggcgggacaagcggtccgtggctctggctccccatgtgggcctggggctcgagacgcgcaccgagacctggatgtcatccgagggcgcgtggaagcagatccagaaagtagagacctgggcccttcggcaccccgggttcaccgtcatcgccctgttcctcgcccacgcgataggcaccagcatcacccagaagggtatcatcttcatactgctgatgctcgtcaccccatccatggctatgaggtgcgtcggcatcggcaaccgggacttcgtggagggactgagcggagccacgtgggtggacgtagtgctggagcacgggtcctgcgttaccacgatggccaaaaataagcccaccctcgacatcgagctgcttaagacggaggtaaccaaccccgccatcctccgcaagctgtgcatcgaggccaaaatcagcaacaccaccacggactcccgctgccccacccagggggaggccaccctagtggaggagcaggacgccaattttgtctgccgccggacgttcgtcgaccgcggctgggggaatggctgtggcctcttcggcaaggggagcctgctgacgtgcgccaagttcaagtgcgtgaccaagctagagggcaagatcgtccagtacgagaacctgaagtactccgtgatcgtgaccgtccacaccggtgaccagcaccaggtggggaacgaaactacggagcacggcaccatagccaccatcacgccccaggcgcccacgagcgagattcagctgacagactacggggctctcaccttggactgttcaccccggaccggcttagacttcaacgagatggttctcctgacgatgaaggagaagtcatggctggtgcacaagcaatggttcctcgatctccccctgccctggacctcaggagcaagcaccagccaggagacctggaatcgccaagacttgctggtgacctttaagaccgcccacgctaaaaagcaggaggtcgtggtgctgggctcccaagaaggagcgatgcatacggccctcaccggggccacggagatccagacaagcggcaccaccacgatcttcgccgggcatctgaagtgccggctgaagatggacaagttaaccctgaaaggcatgagttacgtcatgtgcaccggaagtttcaagctggagaaagaggtggccgagacccaacatgggactgtgctcgtccaggtcaagtatgagggcaccgacgcgccgtgcaagatccccttcttaacccaagacgaaaagggggtgacccagaacggaagattaattacggccaatccaatcgtcaccgacaaggaaaaacccgtgaacatcgagaccgagccgccattcggcgaatcctacatcgtggtcggcgccggcgaaaaggccctgaagctctcctggttcaagaaaggatcctctataggcaagatgtttgaggcgacggctagaggagctcgccggatggccatcctgggcgacacggcctgggacttcgggagcatcggcggcttattcaccagtgtggggaagctcattcaccaagtgttcggtacagcgtacggggtcctgttctccggcgtgagctggaccatgaagatcgggatcggcatcttattaacgtggctgggcctgaactcacgcagtaccagcctgagtatgacctgcatcgccgtggggatggtcacactgtacttaggggtcatggtgcaggccgacagtggatgcgtcataaactggaagggccgcgaactaaagtgcgggagcggcatctttgttacaaatgaggtgcacacctggaccgagcagtacaagtttcaggccgactccccgaagcggcttagcgccgcgatcggcaaggcctgggaggaaggggtctgcggtatccgcagcgccacccggctggagaacatcatgtggaagcagattagcaacgagttgaactacatcttgctggagaacgacatgaagttcacagtggtggttggggacgtgaacggcattttagcccaggggaagaagatgatcaagccccagcccatggagcacaagtacagctggaagtcatggggcaaggcgaagatcataggcgctgatattcagaacacgaccttcatcatcgacgggcctgatacaccggagtgccccgacgaccagcgcgcctggaacatttgggaagtggaggactatggtttcgggatcttcaccacgaacatctggctaaagctccgggacagccacacccagatgtgcgaccaccgactcatgtccgccgcgatcaaggacagcaaggcggtacatgccgacatgggttactggatagagtccgagaaaaatgagacctggaagctggcccgtgcctccttcatcgaggtgaagacctgcatatggcccaagtcccatacattgtggagcaacggcgtcctcgaatccgaaatggtcatacccaagatctatggcggcccgatcagccagcacaactatcgacccgggtacttcacccagaccgcgggaccctggcacctgggaaagctggagctcgacttcgacctgtgcgagggaacaacggtggtggtcgacgagcactgcggctaccgggggccgtccctacgcaccaccacagtgacgggcaagatcatacacgagtggtgctgccggagctgcacgctcccgccgttgcgcttccgtggtgaggacggctgctggtacgggatggagatccgccccgtgaaagagaaggaggagaatttagtgcggtcaatggtgagcgccggctcaggcgaggtggacagcttcagcctcggcatactgtgcgtctccatccttatcgaggaggtgatgcgcagccggtggtcccgcaagatgttaatgaccggcaccctggccgtgttcctgctcttgataatggggcagttgacgtggaacgacctcatccggctatgcatcatggttggcgctaacgccctggaccgcatggggatgggcaccacctacctcgccctgatggccacgttcaaaatgaggcctatgttcgcagtggggctactcttccggaggctgacgagcagagaggtgctgctcctgaccgttgggctctcactagtagccagcgtggagctgccctcctcactggaggagctcggcgacgggctggcaatggggatcatgatgctgaagctcctgaccgacttccagccacaccagctgtggaccacgctcctgtcactgactttcatcaggacgagcctctcactggactacgcttggaagaccatggctatggccctgtccatcgtgtccctcttcccactgtgtctgagcacgacctcccagaagacaacttggctacccgtgctcctgggttcgttcgggtgcaagcccttgacaatgtttctgatcaccgagaacaagatctggggccggaagtcctggcccatcaacgaggggatcatggccgtgggcatcgtgagcatcctgctctccagcctgctgaagaacgacgtgccccttgccggtcctttgatcgcgggcggcatgctgatcgcctgctacgtaataagcgggtccagcgctgacctctccctggagaaggccgcggaggtgagctgggaggaagaggcggagcactccggcaccagtcacaacatcctggtggaggtacaggatgacggaacgatgaagatcaaggacgaggaacgcgacgacaccctcaccatcctgctcaaggccaccttactggccgtatccggcgtgtaccccatgtcaatccccgcaacactgttcgtctggtacttctggcagaaaaagaagcagcggtccggggtactgtgggataccccctcaccgcctgaggtggagcgcgctgtgctcgacgacggcatctaccggatcctgcagcgcggcctgctcgggaggtcccaagtcggggtcggggtcttccaggacggagttttccacacaatgtggcacgtaactcgcggggcggtcctgatgtaccagggcaagagactggagcctagctgggcctccgtgaaaaaggaccttataagctacggcggcggttggcgctttcagggcagctggaacaccggcgaagaggtacaggtcatcgccgtggagcccgggaagaacccgaagaacgtgcagaccacgcccggcaccttcaagacccccgaaggcgaggtgggggccatcgccctagacttcaaacccggcactagcgggtccccgatcgtgaaccgagaggggaagatcgtaggcctgtacgggaacggcgtggtgacaaccagcgggacctacgtatccgcgatcgcccaggcgaaggccactcaggagggcacgctccccgagatcgaagacgaggtcttcaagaagcgcaacctgactatcatggacctgcaccccgggagcggcaagacccggcgctatcttccggctatcgtgagggaggcgatcaagcgcaagctgcggacccttatcttggcccccacaagggtggtcgccagcgagatggccgaagcgctgaagggcatgcccatccgctaccagactaccgcagtgaagtcggagcacaccgggcgggaaatcgtggacctgatgtgccacgcaacgtttaccatgcgcctactcagccccgtccgggtcccgaattataatatgatcattatggacgaggcccactttaccgaccccgcgagcatcgccgcccgcggctacatcagcacccgcgtggggatgggggaggccgccgccatcttcatgacggcgacaccaccagggtccgtcgaggcctttccgcaaagtaacgccgtgatccaggacgaggagagagacatccccgagcggtcttggaacagcggctacgactggatcaccgatttcccgggcaagaccgtgtggttcgtcccctccatcaagagcggcaacgacatagccaactgccttcgcaaaaacggcaagcgggtcatccagttgtcccgcaagacattcgacaccgagtaccagaagaccaagaacaacgactgggactacgtggtcacaacggacatctctgaaatgggggccaacttccgggcggaccgcgtgatagacccccgacgatgcctgaaacctgtgatcctgaaggagggccccgagcgggtcatcttggccgggcccatgccggttaccgtggcctccgccgcgcaacgccgaggcaggatcggccggaaccagaacaaggagggggatcagtacatctacatgggccagcccctgaacaacgacgaggatcacgcacactggaccgaggccaagatgctgctcgacaacatcaatacccccgaagggatcatccccgccctgttcgagccggagagagagaagtccgcggcgatcgacggcgagtatcgcctgaggggggaggcgcgcaagacgttcgtggagctcatgcgacgcggcgacctgcccgtgtggctgtcctacaaagtcgccagcgagggcttccagtacagtgacagacgctggtgcttcgacggggaacgtaacaaccaggtgctcgaagaaaacatggacgtggaaatctggaccaaggagggtgaacggaagaagctgcggccccgctggctggacgcgcggacctacagcgaccccctcgccctaagggagttcaaggagttcgcggccgggagacggtccgtcagcggcgacctgatcctagagatcggcaagctccctcagcatctcaccctccgggcccagaacgctttggacaacctggtgatgctccacaacagcgaacaaggcggcaaggcctaccgccacgcgatggaggagctgcctgacaccatcgagacgctgatgctcctggccctgatagccgtgctcaccgggggcgtcacactgtttttcctgtccgggaagggcctcggcaagacatctatcgggctgctctgcgtgatggccagcagcgcgctcctgtggatggcctccgtggagccccactggatcgccgcaagcattatcctggagttcttcctcatggtactgctgatccccgagccggaccgacagcgcacgccccaggacaaccaactcgcctacgtggtaatcgggctactgtttatgatcctcaccgtcgccgccaacgagatggggctactggagaccaccaagaaggacctcggcatcgggcacgtggccgtggagaatcatcatcacgctacgatgcttgacgtcgacttacggcccgcctccgcatggaccctctacgcggtggccaccaccgttatcacgcccatgatgcgccacacgatcgagaacaccaccgcgaatatcagcctgaccgcgatcgcgaaccaagccgccatcctgatgggtttggacaaaggatggcccatctccaagatggacatcggggtccccctgctggctctgggctgctacagccaggtgaaccccctgaccctgacggccgccgtgctcatgctggtcgcgcactacgcaatcatcggaccggggctgcaggccaaggcgaccagggaagcccagaaacgtacggcagccggtatcatgaagaaccccaccgtggacggaatcgtgaccatcgacctcgacccggtcgtttatgacgccaagttcgagaaacagctcggccagatcatgctgctcatcctgtgcacatcgcagatcctgctcatgcgcaccacctgggcgctgtgcgaaagcatcactctggccactgggccgctcacgaccttgtgggagggcagtccagggaagttctggaacacaaccatcgccgttagcatggccaacatattccggggctcctatctggccggtgcgggcctcgccttcagcctgatgaagtccttaggcgggggccgccgggggacgggcgcccagggcgagaccctcggggagaagtggaagcgacagctgaaccaactgtctaagtccgagttcaacacctacaagaaatccggcatcatggaggtggaccggagcgaggccaaggagggattaaagcgcggtgagaccactaagcacgccgtttcaagagggaccgcgaagctacgctggttcgtggaacgaaacctggttaagcccgagggcaaggtgatagacctgggctgcgggcgtggcgggtggagctactactgcgccggcttaaagaaggttacggaggtcaagggctacaccaagggaggcccagggcacgaggagcccatcccgatggcaacgtatggctggaatcttgtgaaattacactccgggaaggacgtgttcttcaccccccccgaaaagtgcgacaccctcctgtgcgacatcggcgagagctctcctaaccccaccattgaggaggggcgtaccctgcgtgtcttgaagatggtggagccctggctgagaggcaaccagttctgcatcaagatcctgaacccctacatgcccagcgtggtcgaaacgcttgagcagatgcagcgcaagcacggcgggatgctggttcggaatccgctgtcgaggaacagcacgcacgagatgtactgggtgtcctgcggcaccggtaacatcgtcagtgccgtgaacatgacatcccggatgctcctgaaccgcttcacgatggcgcaccggaagcccacctacgagcgcgacgtggacctgggcgctggcacccgccacgtcgccgtggaacccgaggtggcaaacctcgacatcatcgggcagcgaatagagaatatcaagaacgagcacaagagtacttggcactacgacgaggacaacccttacaagacgtgggcctaccatggctcctacgaggtcaagccgagcgggtccgcaagctccatggtgaacggcgtcgtgcgcctgctgaccaagccctgggatgttattcccatggttacccagatcgcgatgacagacacgacacccttcggccaacagagagtgttcaaggagaaagtggacacccgcaccccgcgggccaaaagaggcacggcccagatcatggaggtcaccgccaagtggctatggggctttctgagcagaaacaagaagccgcgcatttgcacccgcgaggagttcacccggaaggtacggtctaacgcggccatcggcgccgtgttcgtggacgagaaccagtggaacagcgccaaggaggccgtggaggatgagcggttctgggacctggtgcaccgggagcgcgagctccataagcagggtaagtgcgccacttgtgtctacaacatgatgggaaagcgggagaagaaactgggcgagttcggaaaggcaaagggcagccgcgccatctggtacatgtggctgggcgccagattcctcgaattcgaggcgctgggcttcatgaacgaggaccattggttcagtcgcgagaatagcctgtcgggcgtggagggggagggcctccacaagctggggtacatcctccgggacattagcaagattcccggcggcaacatgtacgctgatgacacagcagggtgggacacccggattaccgaggatgatctccagaacgaggccaagatcactgacataatggagccggagcacgccttgctggcgacctccatctttaagctcacttaccagaacaaggtggtccgggtgcagcgccccgccaagtcgggaacggtgatggacgttataagccgccgggatcaacgcgggagtggccaggtgggcacgtacgggcttaacaccttcaccaacatggaggtgcagctgatcagacagatggaatctgagggcatcttctccccctccgagctcgagacgcccaatctggctaagaaggttcttgattggctagagaagcacggggcagagcgcctgaagcggatggccatcagcggcgacgattgcgtggtgaagccgattgacgaccgcttcgcgacggccctgaccgcgctcaacgacatgggcaaggtgcggaaggacatcccccagtgggagccctccaaaggctggaacgactggcagcaggtccccttttgcagccaccacttccaccagcttatcatgaaggacggccgcgagattgtggtcccttgccggaaccaggacgagctggtcggccgcgccagggtgtcccaaggcgccgggtggagcctcagggagaccgcgtgcctgggcaagtcttacgcacaaatgtggcagctgatgtatttccatcggcgcgacctccggctggccgcgaacgccatctgcagcgcggtccccgtggactgggtgcccaccagccgcaccacgtggtccatccacgcccaccaccaatggatgactaccgaagacatgctaagcgtatggaacagagtgtggatcgaggagaacccctggatggaagacaagacacacgtctcgagctgggaggaagtcccgtacctcgggaagcgtgaggaccagtggtgcggctccctgatcggcctgactgcccgggccacctgggcaacgaacatccaggtggccattaaccaggtgcgccgcctgatcggaaacgagaactatctcgactacatgaccagcatgaagcggttcaagaacgagtccgaccccgagggcgccctctggtga

SEQ ID NO: 24612 - RNA, 9879 nt, synthetic construct
  misc_feature 1..9879: note = derived and/or modified CDS sequence (opt11) from DENV-1__KP723473__SS-prME
  source 1..9879: mol_type = other RNA
agcgtgaccatgctgctaatgctgcttcccacagccctcgcattccacctcaccacccggggcggggagccccacatgattgtgtcaaaacaggagcggggcaagagcctcctgtttaagaccagtgcgggtgtgaacatgtgcaccctgatcgccatggacctgggcgagctctgcgaggacaccatgacctacaagtgtccccggatcaccgaggccgagcccgacgacgtggactgctggtgcaacgccaccgacacctgggtgacctacgggacctgcagccagaccggggagcaccggagagacaagaggtccgtggccctggcgcctcacgtgggcctggggctcgagacgcgcaccgagacctggatgagctccgagggcgcctggcggcagatacagaaggtggaaacctgggccctgcgccaccccggcttcacggtaatagctctgttcctcgcgcacgccatcggcaccagcatcacccagaagggtatcatcttcattctgctgatgctcgtgaccccctccatggccatgcggtgcgtcggcattggcaaccgcgacttcgtggaggggctcagcggcgccacgtgggtggacgtcgttctcgagcacggctcctgcgtgaccaccatggccaagaacaagcccacactcgacatcgagcttctaaagacggaggtcacaaaccccgcggtgctccggaagctatgcatcgaagccaagatcagcaatactacgacagactcccgctgtccgacgcagggagaggccaccctggtggaggaacaggacgccaacttcgtctgccgacgtaccttcgtggaccggggctgggggaacggctgcggcctcttcggcaaggggagcctgctgacgtgcgcaaagttcaagtgcgtgaccaagctcgagggcaagatcgtccagtacgagaacctgaagtactccgtgatcgtgaccgtccacaccggcgaccagcaccaggtggggaacgagacgaccgaacatggcaccatcgccacaatcacgccccaggcccccacgtccgagattcagctgaccgactacggggccctcacgctggactgcagcccccggaccggcctggacttcaacgagatggtcctcctaacgatgaaggaaaagtcctggctggtccacaagcagtggttcctcgatctgccgctaccttggacctccggggccagcaccagccaagaaacctggaatcggcaggacctcctggtgacgttcaaaacggcacacgcgaagaagcaggaggtcgtggtgctgggttcccaggagggcgccatgcataccgctctcactggggccaccgagatccagaccagcggcaccaccacgatcttcgccgggcacctgaagtgccggctgaagatggacaagctcacccttaaaggcgtctcctacgtgatgtgcaccgggagcttcaagctggagaaggaggtggcagagacccaacacggcacggtactggtacaggtgaagtatgagggcaccgatgccccttgcaagattcccatcagtacccaagacgagaagggggtcacccaaaacggccggctcatcacggccaacccgatcgtgaccgacaaggagaagcccgtgaacatcgagacagaaccgcccttcggtgagagctacatcgtcatcggcgccggcgagaaggcgctcaagctgtcctggttcaagaaggggagctccatagggaagatgttcgaggccacggccaggggggcccgacgcatggccatcctcggcgatacagcgtgggacttcgggagcatcgggggcgtgttcacctccgtggggaagctggtccaccaggtgttcggcaccgcctacggggtgttgttctccggcgtctcgtggaccatgaagatagggatcgggatcctcctgacctggctgggcctcaacagccgctccacctcgttatccatgacctgcatcgccgtggggatggtgaccctgtatctcggcgtcatggtgcaggccgacagcgggtgcgtgatcaactggaaggggcgggaacttaagtgtgggtccggcatcttcgtcacgaatgaagtgcacacctggaccgagcagtacaagttccaggccgattcgccgaagcgcctgtcagccgctatcggcaaggcctgggaggagggggtgtgcggcatccgatcagcaacccgcctcgagaacatcatgtggaaacaaatcagcaacgagctgaaccacatcctgctcgaaaacgacatgaaatttacagtcgtggtgggggacgcaaacggcatcctgacgcaggggaagaagatgatccggccccagcccatggagcacaagtactcctggaagagctggggtaaggcgaagatcatcggcgccgacacccaaaacaccaccttcatcatcgacggccccgacacgccggagtgcccagacgaccagcgggcgtggaacatctgggaggtcgaggactacggcttcggggtgttcacaaccaacatctggctgaagctacgagactcttacacgcagatgtgcgaccaccgcctgatgagcgccgcgatcaaagactccaaggccgtgcacgcagacatgggctactggatagagagtgaaaagaacgaaacgtggaagctggcccgggcgtccttcatcgaagtcaaaacctgcatctggccccgcagccacaccctctggtccaatggcgtactggagagcgagatgatcatacccaagatctacgggggcccgatctcccagcacaactatcggcccgggtacttcacccagacggcgggcccgtggcacctggggaagctcgagctggacttcaacctgtgcgagggcaccaccgtggtcgtggacgagcactgcggcaaccgcgggccgagcctccgtaccacgaccgtgaccggcaagataatccacgagtggtgctgccgcagttgtaccctgccgcccctgcggtttcgcggggaagacggttgctggtacgggatggagatccggcccgtcaaggagaaggaggagaaccttgtgcgcagcatggtgtccgccgggagcggcgaggtcgacagcttctccctggggctgctttgcgtgagcattatgattgaggaggtgatgaggtcccgctggagccgcaagatgctgatgacgggcaccctggccgtattcttcctcctcatcatggggcagttgacctggaacgacctcatccgcctctgcatcatggtgggcgccaatgtttccgatcgcatggggatggggaccacgtacttggcgctcatggccaccttcaagatgcggccgatgttcgccgtcgggctgcttttccgccggctcaccagcagggaggtcctgctgctcacaatcgggctgtccctggtcgcaagcgtggagctacccaactccctggaggagctgggggacgggctcgccatgggcatcatgatgctgaagctgctcacggacttccagagccaccagctgtggaccaccctgctctccttgaccttcatcaagacgaccctgagcctcgactacgcctggaagaccatggcgatggtgttgtccatcgtcagcctgttcccactctgtctttccacaacgagccagaagaccacatggctacccgtgctcctgggatccttcgggtgtaaaccgctgaccatgttcctcatcaccgagaacaagatatggggccgcaagtcgtggcccctgaacgaggggatcatggccgtgggcatcgtatccattctgttaagcagcctgctgaagaacgacgtgcccctagctgggcccctgatcgccggcggaatgctgatcgcgtgctacgtcatctcgggaagctccgcagacttaagcctggagcgcgccgccgaggtctcctgggaggaggaggccgagcactcgggcgcgtcccataacatcctggttgaggtacaggatgatgggacgatgaagatcaaggatgaggagagggatgacaccctgacgatcttgctgaaggctaccttgctggccgtcagcggcgtgtacccgatgtcgatccctgcgaccctgttcgtgtggtacttctggcagaagaagaagcagcgcagcggtgtcctatgggacacccccagcccaccagaggtggagagggcggtgctggacgacggcatataccgcatcctgcagcggggcctgctcggtcgcagccaggtcggcgtcggcgtgttccaggacggtgtcttccacaccatgtggcacgtgacccgcggggccgtgctgatgtaccagggcaagcgcctggagccttcctgggccagcgtcaagaaggacctcatctcctatggcgggggatggcggttccaggggagctggaacacgggcgaggaggtccaagtgatcgccgttgagcccgggaagaatcccaaaaacgtgcagactacccccggcaccttcaaaacaccagagggcgaggtgggcgccatcgccctggacttcaagcccggtacctctgggagccctatcgtcaaccgcgagggcaagatcgttggcctctacggtaacggcgtggttaccacctccggaacttacgtaagcgcgatagcccaggccaaggctagccaggaaggcccgctcccagagatcgaggacgaagtgttcaagaagcggaacctgaccatcatggacctccaccccgggtccggcaagacccgccggtacctgccagccatcgtccgtgaagcgatcaagcgcaagctacggaccctgatcctcgccccaacgagagtagtggccagcgagatggcagaagcgctgaagggcatgcccatccggtaccagaccaccgccgtcaagtccgagcacactggaaaagagatcgtggacctgatgtgccacgccacgttcaccatgcgcctcctgtcccccgtgcgggtcccgaactacaatatgatcatcatggacgaggcccacttcaccgaccccgcctccatcgcggcccgcggctacatcagcacccgagtggggatgggcgaggccgcagcaatcttcatgactgcgactccgcccgggtcagtggaggcattcccgcagagcaacgccgtcatccaagacgaagagcgcgacatccccgagcggtcctggaacagcggctacgactggatcaccgacttccccggcaagaccgtgtggttcgtgccctccatcaagagcgggaacgacatcgccaactgcctgcgtaagaacggcaagcgggtaatccaactctcccgcaagactttcgacaccgagtaccagaagaccaagaataacgactgggactatgtggtgaccacggacatcagcgagatgggggccaacttccgggccgacagggtaatcgaccctcggcgctgcctgaagccggtgatcctcaaggacggccccgagcgagtcatcctcgccgggcccatgccggtgaccgccgcctccgcggcccagcgccgggggcgcatcggccgcaaccagaacaaggagggcgaccagtacatctacatgggccagcccctgaacaacgacgaggaccacgcccattggaccgaagccaagatgttgttggataacatcaacacccccgaggggatcatccccgccctgttcgagccggagcgtgagaagtccgcggccatcgacggcgagtaccgcctacgcggggaggcccgcaagaccttcgtggagctcatgcggcgcggcgacctgcccgtctggttatcctacaaggtggccagcgagggcttccagtactccgacaggcgctggtgcttcgacggagagaggaacaaccaagtgctcgaggagaacatggacgtcgaaatatggaccaaggagggcgagcgcaagaagtgcgacagccggtggctggacgcccgtacctactcagaccccctcgcgctccgggagtttaaggagttcgccgccgggcgccggtccgtgagcggcgacctgatcttagagatcggcaagctcccccagcacctgacccttcgcgcccagaacgccttagacaacctggtcatgcttcataattccgagcagggcgggaaagcgtaccggcacgccatggaggagctcccggacaccatcgaaacgctgatgctgctcgccctgatcgccgtcctgacagggggtgtgaccctcttcttcctgagcgggaagggcctgggcaagacctccatcgggctactgtgcgtgatggcgagctctgtcctgctctggatggccagcgtggagccccactggattgccgcgtccataatcctggagtttttcctgatggtgctcctgatccctgaacccgaccgccagcggaccccgcaagacaaccagttagcctacgtcgtgatcgggctcctattcatgatcctgaccgtggccgccaacgaaatggggctcctggagaccaccaagaaggacctgggtatcgggcacgtcgttgccgagaaccaccaccacgccacgatgctcgacatagacctgcaccccgctagcgcgtggacgctgtacgccgtggccaccaccatcatcacccccatgatgcgccacacaatcgagaacaccactgccaacatctccctcacggccatcgctaaccaggctgccatcctcatgggcctggacaagggctggcctatcagcaagatggacatcggcgtccctctcctggccctgggctgctactcccaagtgaatcccctcacactgacagccgcggtgctgatgctcgtcgcccactacgccatcatcgggcccggcttacaggccaaggcgacccgggaggcccagaagcgcactgccgccgggatcatgaagaacccgaccgtggacggcatcgtggccatcgacctggaccctgtcgtttacgacgcgaagttcgagaagcagctcggccagatcatgctgctcatactctgcacctctcagatcctgctgatgcgcaccacgtgggccctctgtgagtccatcaccctggccaccgggcccctgactactctctgggagggcagccccggaaagttctggaacaccaccatcgccgtgtccatggccaacatcttccggggcagttacctggcgggcgccggactggccttcagtcttatgaagtctctgggcggcggccgccgggggaccggcgcccagggagagacgctgggcgagaagtggaagcgccagctcaaccaactgagcaagtccgaattcaatacgtacaagcgtagcggcatcatggaagtcgaccgctccgaggccaaagaggggctgaagcgaggcgagaccaccaaacacgccgtgagccgtggcacggccaagctccggtggtttgtggagcgcaacctggtcaagccggagggcaaggtgatcgacctaggctgtgggcggggcgggtggtcctactactgcgccggcctgaagaaggtgaccgaagtcaaggggtacaccaagggcggccccggacacgaggagcccatccccatggccacgtacggctggaacatcgtgaagcttcacagcgggcgcgacgtgtttttcacccctccggagaagtgcgacacgctgctgtgcgacatcggcgagtcctctccaaacccgaccatcgaggaagggcggaccctccgcgtcctgaagatggtggagccgtggctgcggggcatccagttctgcatcaaaatcctcaacccctacatgccctccgtggttgagactctggagcagatgcagcgcaagcacggcgggatgttagtgcggaaccccctcagcagaaattccacgcacgagatgtactgggtgagctgcggcacgggcaacatcgtcagtgccgtgaacatgaccagccggatgctgttgaaccgcttcaccatggcccaccgcaagccgacgtacgagcgcgacgtggacctcggagccggcaccagacacgtcgccgttgagcccgagatcgccaacctggacataatcgggcaacggatcgagaacataaagaacgagcacaagtccacctggcactacgacgaggacaacccctacaagacgtgggcgtaccatgggtcatacgaggtgaagccctccgggacggccagctcaatggtcaacggcgtggtccgcttgttaaccaagccgtgggacgtgatccccatggtgacccagatcgccatgaccgacacgaccccttttgggcagcagcgggtcttcaaggagaaggtggacacccgcacgccccggccgaagcgcggcacggcccagatcatggaggtgactgccaagtggctgtggggcttcctgagcaggaacaagaagccgcgcatctgtacccgggaagagttcacccgtaaagtccggagcaacgcggccataggggccgtgttcgtggacgagaaccagtggaacagcgctaaggaggctgtagaggacgagagattctgggacctcgtgcatcgggaacgcgagctgcacaagcagggcaagtgtgcgacgtgcgtgtacaatatgatggggaagcgggaaaagaagctgggcgagttcgggaaggcgaagggatcccgcgccatctggtacatgtggctcggcgcccgcttcctggagttcgaggcgctggggttcatgaacgaggaccactggttctcccgcgagaatagcctctccggcgtcgagggcgagggcctgcacaagctggggtacatcctccgggacatttcgaagatccccggtggcaacatgtatgccgacgacaccgccgggtgggacacgaggatcaccgaggacgacttacagaacgaggccaaaatcacggacatcatggagccggaacacgcgctgctcgcgacctccatcttcaagcttacctatcagaacaaggtggtgcgcgtccagcggcccgcaaagagcggcaccgtaatggacgttatctcccgccgggaccagcgcgggtcaggccaggtgggcacttacggcctcaacaccttcaccaacatggaagtacagctcatccggcagatggagtccgagggcatcttcagcccttccgagctagagaacagcaatctggccgagcgcgtgctcgactggctggagaagcacggggttgagcggctgaagcgcatggctatctccggagacgactgcgtggtgaagcccaccgatgaccggttcgccacggccttaaccgccttgaacgacatggggaaggtccgcaaggacatcccacagtgggagccgtcaaagggatggaacgactggcaacaggtcccgttctgtagtcaccacttccatcaactgatcatgaaggatggccgggagatcgtggtcccctgtcgcaatcaggacgaactcgtggggcgggccagggtcagccagggcgccggttggagcctgagggagaccgcctgcctgggcaagtcctatgcgcagatgtggcagctcatgtacttccaccgccgggacctgcgcctcgccgcaaacgccatatgtagcgccgtcccggtgaactgggtgcctacctcccgtaccacgtggtctatccacgcgcaccaccagtggatgacaaccgaggacatgctcagcgtctggaaccgcgtttggattgaggagaacccctggatggaggacaagacccatgtgagctcctgggaggacgtcccctatctggggaagagggaagaccagtggtgcggcagcctgatcggcctcacggcccgggccacctgggccaccaacatccaggtggcgatcaaccaggtgcgccggctgatcgggaacgagaactacctggactacatgacctccatgaagcgatttaaaaacgagagcgaccctgagggcgccttatggtga

SEQ ID NO: 24613 - RNA, 9879 nt, synthetic construct
  misc_feature 1..9879: note = derived and/or modified CDS sequence (opt11) from DENV-1__KT187564__SS-prME
  source 1..9879: mol_type = other RNA
agcgtgacaatgctgcttatgctgatgccaaccgcgctggcctttcatcttaccactcggggaggagagccccacatgatggtcagcaaacaggagcgtgggaagtccctgctgttcaagacaagcgccggtgtcaacatgtgcaccttgatcgcgatggaccttggggaactgtgcgaggacactatgacctataagtgtccgcgcattaccgaggccgagcccgacgatgtagactgctggtgcaacgccactgacacgtgggtgacctacgggacctgcagccagactggagagcaccggagggacaagcggagcgtagctctcgcgccccacgtgggccttggtctcgagacgcgcactgaaacttggatgagctccgagggcgcctggaagcagatccaacgggtcgagacctgggccttgaggcaccccgggttcacggtgatcgccctattcttggcccacgccatcggcaccagtatcacccagaaggggataatcttcatcctcctgatgctagtgaccccctccatggccatgcggtgcgtcggcatcggttcacgcgacttcgtggaaggactttccggcgcaacgtgggtcgacgtcgtgctggaacacgggagctgcgtgaccaccatggctaaggacaagcccacccttgacatagagctcctcaaaacggaggtgacgaaccccgcagtgctgcggaagttgtgcatagaggccaaaatctccaataccactacggatagccgctgcccgacacagggggaagccaccctggtggaggagcaggacgccaacttcgtctgccggcggacattcgtggaccggggatgggggaacggctgtgggctgttcggcaaggggtccctcatcacgtgtgccaagttcaagtgcgtaacgaagctggaaggtaaaatcgtccagtacgagaatctgaagtacagcgtgatcgtaaccgtacacactggagatcagcatcaggtggggaatgaatcgacggagcatggcacaaccgctacgatcacccctcaggcccccaccaccgagatccaactcacggactacggggccctgacgttggattgctcgccgcgcaccggccttgatttcaacgagatggtcctgctaacgatgaaggggaaatcctggctagtacacaaacagtggttcctggacctcccccttccctggaccagcggcgcttctacctcccaggaaacgtggaatcggcaggacttgctggttacattcaagacggcccatgcgaagaagcaagaggtggtggtcctcggctcgcaggaaggggctatgcacaccgcgctgacgggcgccactgagatccaaacctcgggtaccacgaccatatttgccggtcaccttaagtgtcgcctcaagatggataagctaacgctgaaggggatgagctatgtcatgtgtacaggcagtttcaagctcgagaaggaggtcgccgagacgcagcacggcacagtactcgtccagattaagtacgaaggcaccgacgccccctgcaagatcccctttagcacccaggacgaaaagggtgtaacgcagaacgggcggctgataaccgccaacccaattgttaccgacaaggagaagcccgttaacattgaggcagagcctcccttcggggagagctacatcgttattggggcgggggagaaggcactgaaattgagctggtttaagaagggctcgtcaattggcaagatgtttgaggccaccgctcgcggcgcacgccgcatggcgatcctgggtgatacagcctgggactttggatccataggcggggttttcaccagcgtcgggaagctggtgcaccagattttcgggaccgcttatggtgtcctattttccggagtctcgtggaccatgaagataggcatcggagtgttgctgacgtggcttggattgaactctcgctcgacctccttatctatgacctgcatcgccgtgggcctcgtcacactgtacctgggggttatggtgcaggccgactccggctgcgtcatcaattggaaagggcgcgagctcaagtgcggcagcggcatctttgtgacgaacgaggtccacacttggaccgaacagtacaaattccaagcggattccccgaagcgcctaagtgccgcgatcgggaaggcatgggaggaaggcgtgtgtgggatccgctcagccactcgtctagagaacattatgtggaaacaaatctccaacgaactcaaccatattttacttgagaatgacatgaaattcaccgtggtggtcggcgacgtcgcggggatactcgcacagggaaagaagatgatccgaccacagcccatggagtacaagtacagctggaagtcctggggcaaggctaagatcatcggggccgacgtgcagaataccacctttatcatcgacgggcccaacacccctgaatgcccggacgatcagcgcgcatggaacatctgggaggtcgaagactacgggttcggtatttttaccacgaatatctggctgaagctgcgggacagctacacccaggtgtgcgatcaccggctgatgtccgccgcgatcaaggactcgaaggccgtgcacgctgatatgggctattggatcgaatccgagaagaatgagacttggaaactggcgagggctagcttcattgaagtcaaaacctgcatttggcccaagtcccacacgctctggagcaacggagtgctcgagtcagagatgatcatacccaagatatacggcgggccgataagccaacacaattacaggcccggctacttcacgcagaccgccgggccatggcacctgggcaaactcgagctcgacttcgacctgtgtgagggcaccacggtcgtcgtcgacgagcattgcggaaatcgtggcccctccctgcgcaccaccaccgtgacaggaaagataatccacgagtggtgctgccgttcctgcacactgccgcccctccggttccggggcgaagacggttgctggtacggcatggagattcggcccgtgaaggagaaagaggagaacctggtgaaatccatggtcagcgccggcagcggggaggttgactccttcagtctcggacttctgtgcatctccatcatgattgaggaggtaatgagaagccgctggagtaggaaaatgctcatgatcgggaccctggccgtattcttcctactcatcatgggccagctgacatggaacgacctgatccgactctgtataatggtcggtgcgaacgcctctgaccgaatgggcatgggcactacctacctggcccttatggcgacattcaagatgcggccgatgttcgctgtggggcttctattccgccggctgacctcccgcgaggtgctgctgctgaccataggattatcgcttgtcgcgtccgccgagttgcctaacagcctcgaggaactgggggacggcctggccatgggcatcatgattctcaagctgttgactgacttccagtcccatcagctctgggcgaccttactgagcctcaccttcattaagacaaccttctccttacactacgcgtggaaaaccatggccatggtgctttcgatcgtctcactcttccccctttgtctgtctaccacgtcccagaaaactacctggctcccagtattactgggttctctaggctgcaagcctctgactatgtttctgattgccgagaataagatctgggggcggaaatcgtggcccctcaacgagggaatcatggccgtggggatagtctctatcctgctgtcatcccttctgaaaaacgatgtgcccctggccggccccttaatcgcaggagggatgctgatagcctgctacgtgataagcgggtcaagcgccgatctgagcctagagaaggccgccgaggtcagctgggaggaggaggccgaacactccggggcctcccataacatcctggtggaggtgcaagacgacggcaccatgaagataaaggatgaggaacgggatgacaccctgacgatcctactgaaagccacactgctagccgtctccggggtgttcccgctgtcgattccagcaactctgttcgtgtggtatttttggcaaaagaagaagcagcggagtggagtcctctgggatacgcccagcccacccgaggtggagcgcgcggtgctcgacgacggcatttacaggatcatgcagcgagggctgctcggtcggtcccaggtaggggtgggcgtctttcaggagaacgtctttcacaccatgtggcacgtaacgcgcggggccgtgttaatgtaccaaggaaaacggctggagccctcctgggcgagcgtcaagaaagatctgatttcatacggcggaggctggcgcctgcaggggtcttggaacactggcgaggaagttcaggtaatcgccgtcgagcccgggaagaaccccaagaatgtgcagacggcccccggcacctttaagaccccggagggcgaggtgggagcgatcgccttagacttcaagcccggcacctcgggctcacccattgttaaccgggagggcaagatcgtgggcctttatgggaatggcgtggtcacgaccagcgggacgtacgtgagcgccatcgctcaagcgaaggccagccaggagggcccactccccgaaattgaggacgaggtgtttagaaagcggaacctgacgatcatggacttacaccccggctccgggaagactcgtcggtacctcccggccattgtgcgcgaggccatcaagcggaagttgcgcaccttgatcctcgcccctacacgagtagttgcctccgagatggccgaggccctgaagggcatgcctatcaggtaccagaccacagccgttaagtctgagcacaccgggaaggagatagtggaccttatgtgccacgccaccttcacgatgcgcctcctgtcgcccgtgcgggtcccgaactacaacatgattatcatggacgaggcgcatttcacggacccctcgagcatcgccgcacggggttacatatctacccgggtggggatgggcgaagcagccgctatcttcatgaccgccacgccgccaggctccgtggaggcattcccgcagagcaacgcggtgatccaggacgaggagcgcgacatcccagagcggtcttggaactcgggctatgagtggatcactgactttccgggcaagaccgtgtggtttgtgccatccatcaagagcggtaacgacatcgcaaactgcctcaggaagaacggaaagagagtcatccaactatcacgcaaaaccttcgacactgaataccagaaaaccaagaacaatgattgggactacgtggttacgaccgatatctccgagatgggcgccaatttccgcgccgaccgcgtcatcgacccgcggcgttgtctgaaacccgttatcctgaaggacggccccgaacgtgtgatcctagccggtccgatgccggtcaccgtggcctccgcagcccagagacgtgggaggatcggccggaaccacaacaaggaaggcgaccagtacatttacatgggccaacccctgaacaatgacgaggaccacgcgcattggacggaggccaaaatgctgctcgacaacatcaacaccccagaggggattatccccgccctattcgaaccggagagagagaagtctgcggcaatcgacggcgagtaccgccttagaggtgaagcccgtaagaccttcgttgagctgatgaggcgcggcgacctgcccgtttggctgtcctacaaggtagcgagcgagggcttccaatactcagaccggagatggtgctttgacggggaaagaaacaatcaggtcctcgaggagaacatggacgtagaaatctggaccaaggagggtgagcgcaagaagctccggccccgctggcttgacgcgcggacttactccgatccgctcgcgctcagagagtttaaggagtttgccgctggtagacgcagcgtttcaggcgaccttatcttagaaatcggcaagctgccccagcacctgacccagcgcgcccagaatgcgctcgacaaccttgtcatgttacacaactcggaacagggcgggcgcgcgtaccggcacgcaatggaagaattacctgatactatagagactctgatgctgctcgccctgatcgccgttctcactgggggcgtgactctcttctttctgtccgggcgcgggctgggcaaaaccagcatcgggctactctgcgtcatggcgagcagcgtgctgctttggatggcctccgtagagccccactggatcgccgcatcgatcattctggagtttttcctcatggtcctgctcatccccgagccggaccgacagaggacgccacaggacaaccaactggcctacgtggtgatcggcctcctgttcatgatcctcaccgttgcagcaaacgagatggggcttctggagacgaccaagaaggacctaggcattggacacgttgccgtagagaaccaccaccacgctgccatgctcgatgttgacctgcaccccgcgtcagcctggactctatacgcggtcgccacaacgatcattacacctatgatgcggcacaccatcgaaaacaccacagccaacatcagcctgaccgcgatcgccaatcaggccgccatcctgatgggcctagacaagggatggcccatctccaaaatggacattggggtgccacttctcgctctgggctgctatagccaggtgaatcccttgaccttaaccgcagccgtgcttatgctggtggcccactatgccatcatcggcccgggtttacaagcgaaggcaactcgcgaggcccagaagcgcaccgctgccgggataatgaaaaatcccaccgtcgacggaatcgtagcgatagatctggacccggtggtctatgatgccaagttcgagaaacagctcggccagatcatgctgttaatactctgtacctcccagatactgctgatgaggacgacctgggccctctgtgagtcaatcactctggccaccggccccctaaccactctttgggagggctccccgggaaaattctggaataccaccatcgctgtatctatggcgaacatcttcaggggctcctacctggccggggccgggctggccttcagcctcatgaagtcattgggcgggggacgccggggtacgggagcgcagggcgagaccctgggggagaagtggaagcggaggcttaaccagctgtccaagagtgagttcaacacttataagcggtccggcatcatggaagttgaccgtagcgaggccaaggaagggctgaaacggggcgagacgacgaagcatgcggtctcccgcgggacggccaaacttcggtggttcgtcgagcgcaacctggtcaaaccggagggtaaggtcatcgatctagggtgcggacggggagggtggtcctattactgtgccggcctgaagaaggtaaccgaggtcaaggggtacaccaaagggggtccgggtcacgaggaacccatcccaatggctacatacggatggaacctcgttaagctgcattcggggaaggacgtgttcttcatccctcccgagaaatgtgacactcttctctgcgacatcggtgagagctcacccaacccgactatcgaggaagggcggactctgagagtgctcaaaatggtcgaaccttggctccggggcaatcagttttgcattaagatactgaacccctacatgcccagtgttgtggaaacgctggagcagatgcagcggaaacacggcggtatgctcgttcgcaacccactgtctcggaactccacccacgaaatgtattgggtgtcctgtggcaccgggaacatcgtgagcgccgtcaacatgacatcgcgtatgctgcttaacagatttaccatggcccacagaaagcccacgtacgagagggacgtggacctgggtgcgggcacccggcacgtagccgtcgagccagaggtggcgaacctggacatcatcggccagcgcatagagaatattaaacacgagcacaagagcacatggcattacgacgaggacaacccgtataagacgtgggcctaccacggctcctatgaagtcaagccgagtgggtccgccagcagcatggtcaacggcgtggttaagctcctgaccaagccctgggatgttattcccatggtgacccagatcgccatgactgacaccacgccgttcggacagcaacgggtattcaaggagaaggtggacaccagaaccccgaaggcaaagcggggcaccgcgcagatcatggaggtgacggcaagatggctatggggctttctctcacggaacaagaaacccagaatctgcacccgcgaggagttcacccgtaaggtccggagcaatgccgccatcggagcggtctttattgacgagaaccagtggaactccgccaaggaagccgttgaggacgaacgcttctgggacctggtccaccgggaacgtgagttgcacaagcagggaaagtgtgcaacctgcgtttataatatgatgggtaagcgggaaaagaagttaggcgagttcgggaaggcgaaggggagccgcgcgatatggtatatgtggctaggagcgaggttcttggagtttgaggccttgggcttcatgaatgaggatcactggttttcacgcgaaaactcgctgtccggcgttgagggtgaaggcctgcacaagctagggtacatattacgagatatctccaaaatcccgggcgggaacatgtacgccgatgacacggccgggtgggatacccgcatcaccgaggacgacctgcagaacgaggctaagatcaccgacatcatggagccggagcatgccctgttagctaaagccatattcaaactgacctaccagaataaagtcgtccgcgttcagcggcccgcgaagaacgggaccgttatggatgtgatatcccgcagggaccagcgcggttcgggccaagtaggcacctacggcctcaacaccttcacaaacatggaggcgcagctgatccggcagatggagtcggagggcatctttagccccagtgagctggaaacccctaatctggccgagcgcgtcctggactggctggggaagtacggcgtagagcggttgaagcgcatggccatatcgggtgacgactgcgtggttaaacccatcgacgacaggttcgccaccgccctgaccgcactgaacgatatgggaaaggtgcgtaaggacatcccccagtgggagccctccaagggctggaacgactggcaacaagttcccttctgttcccatcacttccaccagttaatcatgaaggacgggcgggagatcgtcgtgccgtgccgtaaccaagatgaacttgtgggcagggccagggtctcccagggggcgggctggagcctgcgggaaacggcctgcctcggcaagagctacgctcagatgtggcaattgatgtactttcaccgtcgggacttgaggctggccgcgaacgccatctgctccgccgtcccagtggactgggtccccacatcgcggacaacgtggtcaatccacgcgcatcaccagtggatgactaccgaggacatgctttcggtgtggaatcgggtgtggatagaggagaacccctggatggaggacaaaacacacatctccaactgggaagacgtcccgtatctcggcaagcgtgaggaccagtggtgcggcagccttatcgggctaaccgcccgggccacgtgggctaccaacatccaggtggccatcaaccaggtgcgacggctgattggtaacgaaaactacctcgactatatgacatccatgaagcgcttcaaaaacgagtctgaccccgaaggtgcattatggtag

SEQ ID NO: 24614 - RNA, 9879 nt, synthetic construct
  misc_feature 1..9879: note = derived and/or modified CDS sequence (opt11) from DENV-1__KT187560__SS-prME
  source 1..9879: mol_type = other RNA
agcgtcaccatgctgctcatgctgttgccgaccgccctcgccttccaccttacgactcgtggaggagagccgcatatgatcgtcagcaaacaggagcggggcaagagcctccttttcaagacatctgcaggggtgaacatgtgtacactgatagccatggacttaggcgagctatgcgaagacaccatgacctataagtgcccgcgtatcacagaggctgagcctgacgacgtggactgctggtgcaacgctaccgacacgtgggtgacctacgggacctgcagccagaccggagagcaccggcgcgacaagcggtccgttgctctcgctccgcacgtgggcctgggcctcgagacgcgcacagagacctggatgagctccgagggcgcctggcggcagatccaaaaggtcgagacctgggcgttacgccacccagggttcactgtgatagcactgtttctcgcgcacgccatcggcaccagcatcacccaaaaagggatcatcttcatcctgctgatgttggtgaccccgagcatggccatgcgttgcgtcggtattgggaatagggacttcgtcgagggtttaagcggcgcgacgtgggtggacgtagtgttggagcacggttcctgcgtcacaaccatggccaagaacaagcccaccctcgacattgaactgctgaagacggaggtcaccaaccccgcggtgctccgcaagttatgtatcgaggccaaaatcagcaacacaaccacggactcccgctgtcccactcagggcgaggccaccctggtggaggaacaggacgctaattttgtctgccggcgtaccttcgtggaccggggatggggaaacggctgcggtctgttcggcaaagggagcctgttaacgtgcgccaaattcaagtgcgtgacgaaactcgagggaaaaatcgtccagtacgagaacctgaagtactccgtgatcgtgaccgtacacaccggcgaccaacaccaggtgggaaacgagacaaccgagcacggcaccatcgcgaccatcacgccccaagccccgacgagtgaaatccagctcacggactacggggccctcaccctggactgctcgccccggaccggtttagacttcaacgagatggttcttttaacgatgaaagagaagtcctggctagtgcacaagcaatggttccttgatttaccgctgccctggacttccggagcatcgacgtcgcaggagacttggaaccggcaggatctcttagtgacgttcaagaccgctcacgcgaagaagcaggaggttgtggtgctgggctcccaggagggcgcgatgcacacagcgctcacaggggcaacggagatccagaccagtggaaccaccacgatcttcgccgggcacctgaagtgccgcctgaagatggacaaactcaccctgaagggcgtctcctacgtgatgtgcaccgggagctttaagctggagaaggaggtcgcggagacacagcacggcactgtcctggtacaggtcaagtatgagggcaccgacgccccctgcaagatccccatctccacccaggacgagaaaggtgtcacccagaacggccggctcatcacggccaaccccatcgtgaccgacaaggagaagcccgttaacatcgagaccgagccgcctttcggggagtcctacatcgtaataggcgccggcgaaaaggcgctgaaattgtcctggttcaagaaggggagctccattgggaagatgttcgaggccaccgcccgcggggcccggcgaatggccatcctcggggacactgcttgggacttcggcagcattggcggtgtgttcacctccgtggggaagctggtacaccaagtgtttggcacggcttacggggtgctttttagtggagtctcctggacgatgaagatagggatcggcatactcctgacgtggctgggcctcaactcgcgctccacaagcctgtccatgacctgtattgcggtggggatggtgacactgtacctcggcgtcatggtgcaagccgacagcgggtgcgtgataaactggaagggccgggagctgaaatgcgggtcaggcatcttcgtcacgaacgaggtgcatacatggaccgagcagtacaagttccaagcagatagtccgaagcgcctgtcagctgctatcggcaaggcctgggaagagggggtgtgcggcatccgttcggccacccggctggagaacatcatgtggaagcagatcagcaacgaactgaatcacatcctgctcgagaacgacatgaagttcaccgtcgtggtgggggacgcaaacggcatcctgactcagggaaagaagatgatccgcccccaacccatggagcacaaatattcttggaagtcctggggcaaggctaagatcatcggcgccgacactcagaacacgaccttcatcatcgatgggcccgacacgccggagtgccccgacgaccagcgcgcctggaacatttgggaagtcgaggactacggcttcggcgttttcacaactaatatctggctgaaactccgggactcctatacccagatgtgtgaccaccgcctgatgagcgccgcgatcaaggactctaaggccgtgcacgcagacatgggctactggattgagagcgagaaaaacgagacgtggaagctggcccgggcctccttcatcgaggtcaagacatgcatatggccacgcagccacaccctctggtccaacggggtgttagagagcgaaatgataatccccaagatctacgggggcccgatctcccagcacaactaccggcccgggtactttacccagacggctggtccttggcatctagggaagctagagctggacttcaacctgtgcgagggcaccaccgtagtcgtagacgagcactgtggcaatcgcgggccgagcctccggaccacgaccgtgaccggcaaaattatccacgaatggtgctgcaggtcctgtaccttaccgcccctacggttccgcggggaggatggttgctggtacgggatggagattcggcccgtcaaggaaaaggaggagaacctcgtgaggagcatggtgtccgccggcagcggcgaagtcgatagcttcagtttggggctcctctgtgtctctatcatgattgaggaagtgatgcggtcccgctggagccgcaagatgttgatgacgggcaccctggctgtgtttttcttgcttataatggggcagctgacctggaacgacctcatccggctgtgcatcatggtaggcgccaacgtgtccgatcgcatgggaatgggcaccacatacctggccctcatggcaacctttaagatgcggccgatgttcgccgtcgggctgctgttccgccggctcacaagccgcgaagtgctgctgctcaccatagggttgtccttggtagcatctgtggagcttcccaactccctggaggagctgggggatggattggccatgggcatcatgatgctgaagctgctcacggacttccagagccatcagctctggaccacactgctctccttgaccttcataaaaacgaccctgagcctcgactacgcctggaagacaatggcgatggtgctgtccattgtcagcttatttcccctgtgtctgtccaccacgagccaaaagaccacctggctgcccgtgctcctgggatccctcgggtgcaagccgctcaccatgttcctgatcaccgagaacaagatctggggccgcaagagctggcccctgaatgaggggatcatggcggttggcattgtgtccatcctcctgagcagcctgctcaagaacgatgttcccctggctggacccctgatcgcgggcggcatgctcatcgcgtgttacgtgatctccgggagctccgccgacttatcactggaacgcgcagctgaggtcagttgggaggaggaagccgagcacagcggtgcgtcccacaacatcttggtggaagtacaagacgacgggacgatgaagataaaagatgaagagcgggacgacacgctgaccatcctgctcaaagccaccttactggccgtcagcggcgtgtacccgatgtccataccggccaccctcttcgtgtggtatttctggcagaaaaagaagcagagaagcggagtcttgtgggatacccccagcccgcctgaggtcgagcgcgccgtgctggacgacggcatctatagaatcttgcagcggggcctcctggggcgcagccaggtgggggtcggggtctttcaagacggtgtgttccacaccatgtggcacgtcacccgcggggcggtgctgatgtaccagggaaagcgcctcgagccttcctgggcaagcgtcaagaaggacctgatctcctatggagggggctggcgattccaggggtcgtggaacacgggggaagaggtccaggtgatcgcggtcgagcctgggaagaaccctaagaacgtacagaccacgcccggtacctttaagaccccggaaggggaggtcggggcaatagccctcgacttcaagcccggtacatccgggagcccgatcgtcaatcgcgagggaaaaattgtgggcctctacgggaacggggtggtcacaacatccgggacgtacgtgagcgccatcgcacaggccaaagctagccaggagggcccgctgcccgagatcgaggacgaggtgttcaagaagcggaacctaaccatcatggatctccatcccgggtcgggcaaaacccgccggtatcttccggccatcgttagggaagctatcaaacgcaagctgcggaccctcatcctggctcccacgagagtggtggccagtgagatggccgaggcgctgaagggcatgccgatccggtaccagacaactgccgttaagtccgagcacaccgggaaagagatcgtggacctcatgtgccatgccacgttcaccatgcgtctgctgagcccggtacgggtaccgaattacaacatgatcataatggatgaggcccacttcaccgacccggcctccattgcggccaggggctacattagcacccgggtagggatgggggaagctgccgccatcttcatgacggccacgccgcccgggtccgttgaggccttcccgcagtcgaacgctgtcatccaggacgaggagcgcgacatccccgagcggtcctggaacagcggctatgactggataactgatttccccggaaagaccgtgtggttcgtgcccagcatcaagtcggggaacgacatcgccaactgcctccgcaagaatggaaagcgcgtcatccagttgtcccgcaagactttcgataccgagtaccagaagaccaagaacaacgactgggactacgtggtgaccacagatatcagcgagatgggggccaatttccgggccgaccgcgttatcgacccgcggcgctgcctgaagccggtgatcctcaaggacggccccgagcgggtcatcttggccggccccatgccggtgacggccgccagcgccgcccagcgccggggacgcatcggccgcaaccagaacaaggagggggatcagtacatctacatgggacagcctctaaacaacgacgaggaccacgcccactggaccgaggctaaaatgctcctggacaacatcaacacccccgagggtatcatccccgccctgttcgaaccggagcgtgaaaaatccgcggccatcgacggtgagtaccgcttacgaggagaggcccgcaagacattcgtggagctcatgcggaggggggacttacccgtctggctctcctacaaagtagcgagcgagggcttccagtactccgatcggcgctggtgcttcgacggggagcgtaacaatcaggtgctggaggagaacatggatgttgagatttggaccaaggagggcgagcgcaagaagctgcggccgcgctggctcgatgcccggacctactccgaccccctagcgttacgggaattcaaggagttcgccgccgggcggcgcagcgtatccggcgacctcatcctcgagataggcaagctgccgcagcacctcaccctgcgcgcccagaacgcattagacaacctcgtgatgttacacaacagcgagcagggcgggaaggcgtaccgccacgcaatggaggaactgccggacaccattgaaactctcatgctgcttgcactcatagccgtactgaccgggggcgtgaccctgttcttcctatccggtaagggcctgggcaagaccagcatcgggctgctttgcgtgatggcgtccagcgtcctgctgtggatggcctccgtggagccacactggatcgccgccagcatcattctcgagttcttcctaatggttctgctcatccccgagccggaccggcagcgcacgccccaggacaaccagctggcttatgttgtcatcggcctactatttatgatcctgacagtggcggccaacgagatggggctgctcgagaccactaagaaggacttaggcatcgggcacgtcgtggcagagaaccaccaccacgccacgatgctggacatcgacctccaccccgcttccgcatggaccctgtacgcagtggcgacgaccattatcactccgatgatgcggcataccatcgaaaacaccacagcgaacataagcctcacggccatcgcaaaccaagccgccatccttatgggcctggacaagggctggcccatctccaagatggatattggagtgccactgctggctctgggatgctactcacaggtaaatcccctgacccttaccgcggcggtgctcatgctggtcgcgcactatgccatcattggaccggggctccaggcgaaagcaacccgagaggcccagaagagaacagcggctgggatcatgaaaaaccccaccgtggatggcatagtggctatcgacctggaccccgtcgtctacgacgcgaaattcgagaaacagctgggccagatcatgctcctaatcctttgcacttcccagatcctcctgatgcggaccacgtgggccttatgcgagagcatcaccctcgctaccgggcccttaaccacgttgtgggaaggttccccggggaagttctggaacaccactatcgcagtgagtatggcgaacatatttcgcggcagctacctcgccggcgccgggctggcctttagcctgatgaaatccctcggcggggggcggcgcgggacaggcgcccagggcgagacgctgggggagaagtggaagcggcagctgaaccaattaagcaagagcgagtttaacacatacaaacgctcgggtataatggaagttgaccggagcgaggccaaggaggggctgaagcgcggcgaaaccaccaagcacgccgtgtccagggggacggccaagctgcgctggtttgtagagcggaacctggtcaaacccgagggaaaagtgatcgacctgggctgcggcagaggcgggtggagctattactgcgctggtctaaaaaaagtcaccgaggttaagggttacacgaagggcggacctgggcatgaagagcccatccctatggctacatacggttggaacatcgtaaagctgcacagcgggcgggacgtgtttttcacgccgccagagaagtgcgacacgctgttgtgcgacatcggcgagtcaagccctaatccgaccatcgaggaaggacgcaccctgcgggtcctaaagatggtggaaccctggctgcggggcaaccagttctgtatcaagatcctgaatccctacatgcccagcgtggtcgagaccctggagcagatgcagcgcaaacacggtggaatgttagtacgcaacccgctgtcccggaacagcactcacgagatgtactgggtgtcctgcggcaccggaaacatcgtcagcgcggtgaacatgacctcacgcatgctccttaaccgcttcacaatggcccaccggaagcccacgtacgagcgcgacgtggatctgggagccggaacccggcacgtcgccgtggagcccgagattgccaacctcgatatcatcggccaacgcatagagaacatcaagaatgaacacaagagtacctggcactacgatgaagacaacccctacaaaacatgggcctaccatggctcctacgaggtgaagccgagcgggtccgcttcctccatggtcaatggcgtggtgcggctgctcacaaagccctgggacgtgatcccgatggtgacccagatagccatgaccgacaccacgccctttgggcagcagcgcgtcttcaaggagaaagtggatacgaggaccccgcgccctaagcggggcaccgcgcagattatggaggtgacggccaagtggctatggggcttcctgagccgcaataagaagccccggatctgcactcgcgaggaattcacccggaaggtccgcagcaatgcggcgattggggctgtttttgtggacgagaaccagtggaactccgccaaggaggccgtcgaagacgagaggttctgggaccttgttcaccgcgagcgggagctccacaaacaaggcaagtgcgccacctgcgtctataacatgatggggaagcgggagaaaaagctgggcgagtttgggaaggccaagggaagtcgggccatatggtacatgtggctgggagccaggtttcttgagttcgaggctctagggttcatgaacgaggaccattggttctcccgggagaacagcctttccggcgtcgagggggagggcctccacaagctggggtacatcttgcgcgatatcagtaagatacccggcgggaacatgtacgctgacgacacggccggatgggacacccgcatcacagaagacgatttgcagaacgaggccaagataaccgacatcatggaacccgagcacgccctgctggcgacgagcatcttcaagttgacttaccagaacaaggtggtgcgggtacagcgccccgccaagagcggcaccgtcatggacgtgatctctaggagggaccagcgggggagcggtcaggttggaacctacggtctgaacactttcacaaacatggaggtgcagctgatacgacaaatggagagcgagggcatcttcagcccctccgagctcgaaaatagcaacctggccgagcgggtcctggattggctcgagaagcacggagtcgagagactgaagaggatggccatctccggcgacgactgcgtagtcaaaccaaccgacgaccgcttcgccaccgccctgacggccctcaacgatatggggaaggtccgaaaggacataccccagtgggagccctcgaagggctggaacgactggcagcaggtccccttctgctcccatcacttccaccagcttatcatgaaagatgggcgcgaaatagtggtaccgtgccggaaccaggacgagctggtggggcgcgcccgggtgagccagggcgccgggtggagcctacgcgagaccgcctgcctgggcaagtcctacgcccagatgtggcagctgatgtacttccatcggcgcgacctccggttggccgccaacgccatttgctctgccgtccccgtgaactgggtgcccacctcccgcacaacctggagcattcacgcgcaccaccagtggatgacgacggaagacatgctgtcggtctggaaccgcgtgtggatcgaggagaacccctggatggaggacaagacccatgtgagcagttgggaggacgtcccatatctcggtaagcgggaggaccagtggtgcgggagcttgatcggcctcaccgctcgcgccacatgggcaacgaacatacaggtggcgatcaaccaggtgcggaggttgatcgggaacgagaactacttggactacatgactagtatgaagcggttcaagaatgagagcgaccccgagggcgccttgtggtaa

SEQ ID NO: 24615 - RNA, 9879 nt, synthetic construct
  misc_feature 1..9879: note = derived and/or modified CDS sequence (opt11) from DENV-1__KT187561__SS-prME
  source 1..9879: mol_type = other RNA
agtgtcaccatgctgcttatgctgctgccgaccgccctcgcattccacctgaccactcgcggcggggaaccccacatgattgtgtctaaacaggaacgcggcaagagcctcctatttaaaaccagtgcgggggtgaacatgtgtacgctaatagcaatggacttgggcgagctgtgcgaggacaccatgacctacaagtgtcctcgtattaccgaggccgaacctgacgacgtagactgctggtgcaacgccaccgatacttgggttacgtacgggacctgtagccaaactggggagcaccgacgcgacaagcggtcagtggcgctggcgccccacgttggcctggggctcgagacgcgtactgagacctggatgtcatccgagggagcctggcgccagattcagaaagtggaaacctgggccctgcgccatcccgggtttacggtgatcgcgttctttctggcacatgccattggaacaagcatcacacagaagggcatcatcttcatactcctcatgcttgtgaccccctccatggccatgaggtgcgtcggcatcggcaatcgtgatttcgtagaggggctgtcgggcgccacgtgggtcgacgttgtgctggagcacggttcctgcgtgacaaccatggcgaagaacaagcccacactggacatagagctgctcaagacggaggtcaccaatcccgcggttctgcggaaactctgcatcgaggcgaaaatctctaacactaccacggactcccgctgtcccacgcaaggcgaagccacgctggtggaggaacaggacgcgaacttcgtctgccggcgtactttcgtggaccgaggctgggggaatggctgtgggctgtttggcaagggttctctgctgacgtgtgcgaagttcaagtgcgtgaccaagctggaggggaagattgtccaatacgagaacctcaagtactccgtaatcgtgaccgtccacactggggaccagcaccaggtgggtaacgagacgaccgagcacggcacaatcgcgactatcacaccgcaggccccgacaagcgagatccagctaaccgactacggagccctgaccctcgactgcagcccccggaccggacttgacttcaacgaaatggtactgttaacgatgaaggagaagtcctggctggtgcacaagcagtggttccttgacctcccgctaccgtggacatccggtgccagcacctctcaagaaacctggaatcgacaggacctgctcgtaacgttcaaaaccgcccacgcgaagaagcaggaggtcgtggtgctaggctcccaggaaggtgccatgcacacggccctgacaggggccacagaaatccaaacgtcgggtactaccacgatttttgctgggcatctcaagtgccggttaaaaatggataagctgactctcaagggtgtctcctacgtgatgtgcaccgggtcattcaagctggagaaagaggtcgccgaaacccagcatggcacggtcctagtccaggtgaagtacgagggcaccgacgccccgtgcaagatccccatctccacccaggacgagaagggggtcacccagaatggcagacttatcaccgccaacccgattgtgaccgacaaagagaagcccgtgaatatagagactgaacctcccttcggggaaagctacatcgtcatcggcgctggggagaaggccctcaagttatcctggttcaagaaggggtcttccatcggcaagatgttcgaggccacggcccgcggggcccggcgaatggccatccttggcgacacagcgtgggacttcggctcaattggcggcgtgttcacgagtgtggggaagctcgtccaccaggttttcggcaccgcatacggcgtgcttttctctggtgtgtcgtggaccatgaagatcggaattggcatcctgctcacatggctggggctgaacagccggagcactagcttgtccatgacctgcatagccgtcggcatggtgaccctatacctgggcgtaatggtacaggccgacagcgggtgcgtaataaactggaaaggccgcgagttaaagtgcggatccggcatcttcgtcaccaatgaggtacacacctggaccgagcagtacaagttccaggccgattcaccgaagcgcctcagtgcggccatcggcaaggcctgggaggagggggtctgcggcatacgatcagccactcgtttggagaacatcatgtggaagcagatcagcaatgaactcaatcacatcctgctggagaacgacatgaagttcacggtggtggtgggtgacgcaaacggaatcttaacccagggaaagaagatgatacgaccacagcccatggagcacaaatactcgtggaagtcctggggaaaggcgaagatcataggcgccgacacacagaatactacctttatcatagacgggcccgacacgccggagtgtcccgacgaccagcgggcctggaacatctgggaggtggaggattacggctttggggtgttcactaccaacatatggctgaagttacgggactcctacacccaaatgtgcgaccatcggttgatgtcagccgcgatcaaagactccaaggctgtgcatgctgacatgggctactggatagagagcgagaagaacgaaacttggaagctggcccgcgcctccttcatcgaggtcaagacctgtatttggcctcgcagccacactctgtggtccaacggtgtcctcgagtccgagatgattatccccaagatctatgggggcccaatctcccagcacaactaccgccccgggtactttacccagacggccggcccctggcacttggggaagctggagctcgactttaacctctgcgagggcacgaccgttgtcgttgacgaacactgcgggaaccgtgggccgagcctgcggactaccaccgttaccggcaagatcatccacgaatggtgctgccgatcctgtaccttacccccactacggttccgtggagaggacggatgctggtacgggatggagatccggccggtaaaagaaaaggaggagaacctagtcaggagcatggtgagtgccggctcgggggaggtcgactcattctcccttgggctgctgtgcgtctccataatgatagaagaagttatgcggtcgcgctggtctcgtaagatgctaatgactggaaccttagcggtattcttcctgctcatcatgggacagctaacatggaacgacttaatccggttatgtatcatggtgggcgcgaacgtgtccgaccgcatgggaatgggcacgacgtacctggccctgatggcgaccttcaaaatgcgccccatgttcgccgtcgggctcctcttccgccggctgactagccgggaggtgctcctactgaccatcgggctctccctcgtagccagcgtggagctgccaaactcactcgaggagctgggggacgggttggcaatgggcatcatgatgttaaagttgctgacggacttccaaagccaccaactctggacgactttactgtccctgacgttcatcaaaaccactttgtcgctggactacgcctggaagactatggcgatggtgttaagtatcgtcagcctgttccccttgtgtctctccaccacgagccagaagaccacctggctccccgtgctcctgggctcctttggatgcaagcctctgaccatgttcctgatcaccgagaacaagatctgggggcgcaaatcttggccactgaacgaggggatcatggcggttggcattgtctccatcttgctgtcttctctcctgaaaaacgatgtgccactggccggtcccctcatcgcaggcggcatgctcatcgcgtgctacgtgatctcggggtcgtcggccgacctgagcctcgagcgcgccgccgaagtctcctgggaggaggaggccgagcacagcggtgcttctcacaatatactggtggaggtgcaagacgatgggacgatgaagatcaaggatgaggagcgagacgacacgctgaccattctcttgaaggccacactactcgccgtttcgggcgtgtacccgatgagtatcccggccacgctgttcgtatggtacttctggcagaagaagaagcaacgcagcggggtactgtgggatacccctagccctccagaggtggagcgggccgttctcgacgatggaatctatcgtatcttgcagcggggcctgctgggacgcagccaagtaggagtaggggttttccaagacggcgtattccacaccatgtggcacgtcacgcggggtgcggtgttaatgtaccaaggcaaacggcttgaaccctcctgggctagcgtcaagaaggacttaatcagctacggcgggggctggcggtttcaggggagctggaacaccggagaggaggtccaggtcatcgctgtcgaacccgggaaaaaccccaagaacgttcagaccacccccggcaccttcaagacgcctgagggtgaggtgggggccattgccctcgacttcaagccggggacctccggcagccccatcgtcaaccgcgaaggaaagatcgtaggtttgtacggcaacggcgttgtcactacgtcggggacgtacgttagcgcgatagcccaggccaaggctagccaagagggaccgctccccgagatcgaagacgaagtgttcaaaaagcggaacctcacaatcatggacctacaccccggatccggaaaaacccgccggtacctgccggcgattgtccgcgaggctattaagaggaagttgcggactctcatcctggcgccaacgcgcgtggttgcaagcgagatggccgaggcgctcaaggggatgcccatccggtaccaaaccaccgcggtcaagtccgaacacacggggaaggagattgtggacctaatgtgtcacgccacgtttacaatgagactgctcagccccgtgcgggtccccaactacaacatgatcatcatggacgaagcgcactttaccgaccctgctagcatcgctgccaggggctacatcagcacccgggtagggatgggcgaagccgccgcgatcttcatgacggcaacaccacccgggtccgtggaagcctttccgcagagcaacgcggtgatacaggacgaggagcgcgacatccccgaacggtcttggaactcggggtatgactggatcaccgacttcccaggcaagacggtgtggttcgtgccatcaattaagtctggtaacgacattgccaactgcttaagaaagaatggaaaacgagtgattcaactgtcccggaagaccttcgacactgaatatcagaagacgaaaaacaacgactgggactacgtagtgaccacggacatcagcgagatgggggccaactttcgggcggaccgcgtcatagatccccggcgctgcctgaaaccggtgatcctaaaggacggccctgagcgggtgatccttgcagggcccatgccggtaaccgccgcctccgcagcgcagcgccgggggcgcataggacgtaaccaaaacaaggaaggtgatcaatacatttacatgggccagcccctcaacaacgacgaggaccacgcgcactggaccgaggccaagatgctgctcgataacattaacacacccgaggggatcattcccgccctctttgaaccggaacgggaaaaatcggcggcaatcgacggagagtaccggctgcgcggggaagcccgcaagacgttcgtggagttgatgcgacgcggcgatctccccgtctggctgtcctacaaggtggccagcgagggcttccaatactccgaccgccgctggtgcttcgacggagaacggaacaaccaagtgctggaggagaacatggatgtcgagatatggactaaggagggcgagcgcaagaagctccggccccgctggctggatgcgagaacctactctgaccccctcgcactacgagagttcaaggagttcgccgctgggcgtagatctgtgagcggcgacttgatcttggagattggcaagctcccccagcacctgaccctgcgcgcccagaacgcactcgacaacctggtcatgcttcacaacagcgagcagggcggaaaggcttaccgccacgccatggaggagctacccgacacaatcgaaacgctgatgctactcgcactaatcgccgttctgaccggcggggtaaccctcttctttctgtcggggaagggccttggcaagactagcatcgggctcctgtgcgtaatggcgtcctcggtcctgctctggatggcgtccgtggagcctcactggatagcggccagcatcatcctggagttctttctgatggtgctcctgatccccgagccggaccggcagcggactccccaggataaccagctggcgtacgttgtgatcggcctccttttcctcattctcacggtggccgccaacgagatggggctgctggagacaaccaaaaaggatctcggcatagggcacgttgtggccgaaaatcaccaccacgccacaatgcttgacatcgacttgcatccggcctctgcgtggacactatatgccgtagccaccaccatcataaccccgatgatgcgacacaccatcgaaaacaccaccgccaacatctcactgactgccatagccaaccaggcagccatactcatgggcctagacaaaggctggcctatctccaaaatggatattggggtcccccttctggctttgggctgctacagccaggtcaatccactgaccctaaccgccgctgtactcatgctggtcgcccattacgcgataatcgggccgggtctgcaggccaaggcgacgcgcgaagcccagaagaggacggcggccggtattatgaagaaccccaccgtggatggtatcgtggccatcgacctcgatccagtcgtgtacgacgcgaagttcgagaagcagctcgggcaaattatgctgctcatactgtgcacctcccaaatactgctaatgcggaccacgtgggcattatgcgagagcatcaccctagctaccgggccgctcaccacgttatgggagggctccccggggaaattctggaatactaccatcgctgtgtctatggccaacatcttccgcggttcctacctggcgggcgccgggcttgccttctcgctgatgaagtcactgggcggtgggcgccgcgggaccggcgcccagggagaaacgctcggcgaaaagtggaagcggcaactaaaccagttgagcaagtcagagttcaacacctacaagcgatctggtatcatggaggtcgacagaagcgaggctaaggaggggctcaagcgaggcgagaccactaaacatgcggtatcccgcgggacggccaaactacgctggttcgtggagcggaacctggtcaaaccggagggcaaagtcatagacctgggatgtgggcgcggcggttggagctattactgcgccggactcaaaaaggtgacagaggtcaaggggtacaccaaagggggacctgggcacgaggagcctataccgatggccacctacggctggaacatcgtgaagctccattccggacgggacgtcttctttacgccgcccgagaagtgcgacactctgctctgcgacatcggtgagagctcccccaatccgaccatcgaggaggggcgaacactgcgggtgctgaaaatggtggagccttggctccgcggcaatcaattctgcatcaagatcctaaacccatacatgccctcggtagtagaaaccctggagcagatgcagcggaagcacggcgggatgctcgttaggaacccgctgtcacggaactccacacacgagatgtactgggtctcctgcgggaccgggaacatcgtaagcgcggtaaacatgacttctcgcatgctgctcaacaggtttaccatggctcaccggaagcccacctatgagcgcgacgtagacctgggcgccggcacccggcacgtcgccgtagagcccgagatcgccaacctcgacatcatcggccagcgtattgaaaacatcaagaacgagcacaagagcacctggcactacgatgaggacaacccctacaagacctgggcctatcacggctcgtatgaagtgaagccgtcaggatccgcctcctccatggtcaacggagtggtcagactgctgacgaagccgtgggacgttatccccatggtgacccaaatcgctatgaccgacaccacgcccttcgggcagcaacgagtttttaaagagaaagtggacactaggacaccccgcccaaagcggggcactgcccaaatcatggaggttacggccaagtggttatggggcttcctgtcgcgcaacaagaaaccgcgtatctgcactcgagaggagttcacacggaaggtcaggtcaaacgcggccatcggtgcggtatttgtcgacgaaaatcagtggaactccgccaaggaggccgtcgaagacgagcggttctgggatctcgtgcaccgcgaacgcgagctgcataagcagggcaaatgtgcgacctgcgtgtacaacatgatgggaaaacgcgagaagaagctcggcgagttcggaaaggccaagggctcgcgggctatctggtacatgtggctgggtgcgaggttcttagaatttgaagcgctcgggttcatgaacgaggatcattggttctcccgggagaatagcctgtccggcgtggagggggaaggcctgcacaagctcgggtacatattgcgcgacattagcaagattccgggcggcaacatgtacgctgacgacacggccgggtgggatacccgcataaccgaggacgacctgcagaacgaggcaaagataactgacatcatggaaccagaacatgccctccttgcgacttccatattcaaactgacataccagaacaaggtggtgcgtgtccagcgccccgcaaaaagcggcacggtgatggacgtcatctctcgccgtgaccagcgaggtagcggccaagttggcacatacgggctgaacactttcaccaacatggaggtccagctcatccgccagatggagagcgagggcatattctccccttccgagctggagaacagtaaccttgcggagcgggtgttagactggctggaaaagcatggggtcgagcgcctcaagcgcatggcgatatcaggtgacgactgcgtggtgaaaccaaccgacgatcgcttcgccaccgctctgaccgccctcaacgacatgggtaaggtgcgtaaggacattccccagtgggagccctccaaagggtggaatgactggcagcaagttcccttttgttcacaccacttccatcaactcatcatgaaggacggacgcgagatcgtggtaccgtgccggaaccaggatgaactcgtggggagagccagggtgagccagggagccgggtggagtctgcgcgagacagcctgcctcgggaagtcctacgcacagatgtggcagttgatgtattttcacagaagagatctgcggctggctgccaacgccatatgcagcgccgtccccgtgaattgggtgccgacgtcacgcaccacatggagcatccacgcgcaccaccagtggatgactaccgaagacatgctgagtgtatggaacagagtctggatcgaggagaacccctggatggaggacaaaacacacgtaagctcctgggaggacgtcccgtacctgggaaagcgggaggatcagtggtgtggctcgctcatcggcttgactgcccgtgccacgtgggcaaccaacatccaggtcgcgatcaatcaggttcggcgcctgatagggaacgagaattacctcgattacatgacctctatgaagcgattcaagaacgaaagcgaccccgagggcgcgctgtggtga

SEQ ID NO: 24616 - RNA, 9879 nt, synthetic construct
  misc_feature 1..9879: note = derived and/or modified CDS sequence (opt11) from DENV-1__KT187562__SS-prME
  source 1..9879: mol_type = other RNA
agcgttaccatgctgctcatgctgctgcccaccgcccttgccttccacctaacaaccaggggcggggagccccacatgatcgtgagcaagcaggagcggggaaagagcctcctgttcaaaacctccgcaggggtgaacatgtgcactctgatcgccatggatctgggcgagctctgcgaggacaccatgacctacaagtgcccgcggatcactgaagccgagcccgacgacgtggactgctggtgcaacgccaccgacacctgggtgacctacgggacctgctcacagaccggggagcaccgccgcgacaagcggtccgtggccctggcgcctcacgtgggattaggtctcgagacgcgcaccgagacctggatgagcagtgagggcgcgtggcggcagatccagaaagtggagacctgggccctgcgccaccccgggttcacagtgatcgctctcttcctcgcgcatgctatcggcacgagcatcacccagaaggggatcatcttcatcctgctgatgctcgtgaccccctccatggccatgcggtgcgtcggaatcggcaaccgcgacttcgtggaggggctgtctggcgcgacttgggtggacgtcgtgctagagcacgggtcctgcgtgaccaccatggccaagaacaagccgaccctcgacatcgagctgctgaagacagaggtcaccaaccctgcggtgctccggaaactgtgcatagaagctaagatcagcaacaccaccacggactcacgctgccccacgcagggcgaggccaccctggtggaggagcaagacgccaacttcgtctgccgacgcaccttcgtggacagaggctgggggaacgggtgcggcctcttcgggaaggggtccctgctgacgtgcgccaagttcaagtgcgtcaccaagctcgagggcaaaatcgtccagtacgagaacctgaagtactccgtgatcgtcaccgtccataccggtgaccagcaccaggtggggaacgagacgaccgaacacggcaccatcgcgaccatcacgccgcaagcccccacgagcgagatccagctgaccgactacggggccctcaccctggactgcagccctcggaccggcctggactttaacgaaatggtcctcctgacgatgaaggagaagtcctggctggtgcacaagcagtggttcctcgacctgccgctgccctggaccagtggggctagcaccagccaggaaacttggaaccggcaggacctcctggtgacgttcaagacggcccacgcgaagaaacaggaagtcgtggtgctgggctcccaggagggcgccatgcacaccgccctcaccggggccacggagatccagacgagcggtaccaccacgatcttcgccgggcacctgaagtgccgcctgaaaatggataagctcaccctgaagggcgtctcctacgtgatgtgcaccggtagcttcaagttagaaaaggaggtggcggagacacagcacggcacggtcctggtccaagtgaagtacgagggcaccgatgccccctgtaagatccccatttccacccaggatgagaagggggtcacccagaacgggcggctcattacggccaacccgatcgtgacagacaaggaaaaacccgtgaacattgaaaccgagccgcccttcggggagagctacatcgtcatcggggccggcgagaaaacccttaagctttcctggttcaagaaggggtcatcaatcggcaaaatgttcgaggcgacggcccgcggggcccggagaatggccatcctcggcgacaccgcctgggacttcggtagcatcggcggggtgttcacctcagtgggtaagctggtccaccaggtgtttggcactgcgtacggggtgttgttcagcggcgtctcctggacgatgaagatcgggatcgggatcttgctgacctggctgggcctcaactcccgctccaccagcctgtccatgacctgcatcgccgtgggtatggtgacactgtacctcggcgtcatggtgcaggccgacagcgggtgcgtgataaattggaaggggcgggagctaaagtgcgggtccggcatctttgtcaccaacgaggtgcacacctggaccgagcaatacaagttccaagccgacagccccaagcgcctgagtgccgcgatcggcaaggcctgggaggaaggggtgtgcggcatccggtccgccacccgcctcgagaatattatgtggaagcagatcagcaacgaactaaaccacatcctgctcgagaacgacatgaagttcacggtcgtagtgggggacgccaacgggatcctgacccaggggaagaagatgatcaggccccagcccatggaacacaagtactcctggaagagttggggcaaggcaaaaattatcggtgccgacacccagaacaccacgttcataatcgacgggccggataccccagagtgccccgacgaccagcgcgcctggaacatctgggaggtggaggactacggctttggggtgttcaccacaaacatctggctgaagctccgggactcctacacgcagatgtgcgaccaccgcctgatgtcggccgccatcaaggacagtaaggcggtgcacgccgatatgggctactggattgagagcgaaaaaaacgagacttggaagctggctcgagcctcctttatcgaggtcaaaacctgcatctggccacgcagccacacgctctggtccaacggcgtgctggagagcgagatgatcatccccaagatctacgggggccccatctcgcagcacaactaccggcccgggtacttcactcagaccgccgggccctggcacctggggaagctggagctggacttcaacctctgcgagggcaccaccgtggtcgtggacgagcactgcggcaatcgcgggccgagcctccggacgaccaccgtgaccggcaaaatcatccatgaatggtgttgccgctcctgtacgctgccgcccctgcggtttcgcggggaggacggctgctggtacgggatggagatccggccggtcaaggagaaggaggagaatctcgtgagaagcatggtgtccgctggaagcggcgaggttgacagcttctcactggggctgctctgcgtgagcatcatgatcgaggaggttatgcgttcccgctggtcgcgcaagatgctcatgaccggcaccctggccgtcttcttcctcctgatcatggggcagttaacctggaacgacctcatccggctatgcattatggtgggcgccaacgtgtccgaccgcatggggatgggcacgacctacttagccctcatggcgaccttcaagatgcggcctatgttcgcggtcggtttactgttccggcggctcaccagccgagaagtgctgctgttaacgatcgggctgtcactggtcgccagcgtggagctccccaactccctggaggagttaggtgacgggctcgccatgggcatcatgatgctgaagctgctcaccgacttccagagccaccagctgtggaccaccctgctctccctgacgtttatcaagacaacgctgagcctcgactacgcctggaagaccatggccatggtgctgtccatcgtcagcctgtttcccctctgtctgtccacgactagccagaagaccacctggctgcccgtgctcctgggttccttcgggtgcaaaccgcttaccatgtttctcatcacggagaacaagatatggggcagaaagagctggcccctgaatgagggaatcatggcggtgggcatcgtctcgatactgctcagcagcctgttaaagaacgacgtgcccttggccgggcccttgatcgccggcggcatgctgatcgcctgctacgtgatctccgggagcagcgcggacctcagcctggagcgcgccgccgaggtctcctgggaggaggaggccgagcacagcggcgcatcccacaacatcctggtggaagtgcaggatgacggaaccatgaagatcaaggacgaggagcgggatgacaccctgaccatcctgctgaaagcgactctcctggccgtcagcggcgtatatccgatgtccatccccgccaccctgttcgtttggtacttctggcagaaaaagaagcagcgcagcggcgtgctctgggacacccccagcccgcccgaagtagagagggccgtgctggacgacggcatctaccgcatcctgcagcggggcctgttaggtcgcagccaggtcggcgttggggtgttccaggacggcgtcttccacacgatgtggcacgtgacgcgcggggccgtgctgatgtaccagggcaaacgcctggagccctcctgggcgagcgtcaagaaagacctcatctcctacggcgggggctggcggttccagggcagctggaataccggcgaggaggtccaggtgatcgctgtggagcccgggaagaaccccaagaacgtgcagacgacccccggcacctttaaaacccccgagggcgaggtgggggccatcgcactggacttcaagcccggcacttccgggtctcccatcgtcaaccgcgagggcaagatcgtgggcctgtacgggaacggcgtggtcaccacgtccgggacctacgtgagcgccatcgctcaggccaaggccagccaggagggcccattgcccgagatcgaggacgaggtgtttaagaagcggaacctgaccatcatggacctgcaccctggcagcggcaagacccgccgatacctcccggccatcgtccgcgaggccattaagcgcaagctgcgaacgctgatcctcgcgcccacccgcgtggtggccagcgagatggccgaggccctaaagggcatgccaatccggtatcaaaccaccgcggtcaagtccgaacatactggaaaggagatcgtggacctgatgtgccacgcaaccttcaccatgcggctcctgagccccgtgcgggtcccgaactacaacatgatcatcatggatgaggcccatttcaccgacccggcctcgatcgctgcgcgcggctacatcagcacgcgggtgggaatgggagaggccgctgccatattcatgaccgctactcctcccgggtccgtggaggcgttcccgcagagcaacgccgtcatccaagacgaggaacgcgacatccctgagcggtcctggaacagcggctacgactggatcaccgacttccccggcaagacggtgtggtttgtgccctccatcaaaagcgggaacgacatcgccaactgcctgcgcaaaaacggcaagcgcgtgatccagctctctcgcaagaccttcgacaccgagtaccagaagaccaaaaacaacgactgggattatgtggtaacgaccgacatcagcgagatgggcgccaacttccgggccgaccgcgtcatcgacccgcgacgctgcctcaaacccgtaatcctgaaggacggccccgaaagagtcatcctcgcggggcctatgcctgtgaccgccgcctccgccgcgcagcgccgcggccgcatcggccgcaatcagaacaaggagggggaccagtacatctacatgggtcagcccctgaacaacgacgaggaccacgcccactggactgaggccaagatgctactggacaatatcaacacgcccgagggtatcatccctgccctattcgagccggagcgggagaagtccgccgcgatcgacggcgagtaccgcttgcgcggggaggcccgcaagacctttgtggagctaatgcgacgcggcgatctgcccgtctggctctcctataaggtcgcgagcgagggcttccaatactccgaccggcgctggtgcttcgacggcgagcgaaacaaccaggtgctcgaggagaacatggacgtcgaaatctggaccaaggagggcgaacgcaagaagctgcggccccgttggctggacgcccgcacctactccgaccccctcgcgctgcgcgagtttaaggagttcgcagccgggaggcgtagcgtgtccggcgacctgatcctcgagatcgggaagttgccgcagcacctgaccctcagagcccagaacgccctagacaacctggttatgcttcacaactcggagcagggcgggaaggcctaccgccacgcgatggaggagctacccgacacgattgagaccctgatgctcctggcccttattgccgtactcactgggggcgtgaccctgttcttcctttccgggaaaggcctcggcaagacgagcatcgggctgctttgtgtgatggcctcaagcgtcctcctgtggatggcatccgtggagccccattggatcgcagccagcatcatcctggagttcttcctgatggtgctgctgatccccgaacctgaccggcaacgcacgccccaggacaaccaactcgcttacgtcgtgatcggcctgctgttcatgattctcaccgtggccgcgaacgagatgggcctgctggagaccactaaaaaggacctgggcatcgggcacgtcgtggccgagaaccatcaccacgccaccatgctggacatcgacctgcaccccgcctccgcctggaccctctacgcggttgccaccacgatcataaccccgatgatgcggcacaccatcgagaacaccacggcaaacatcagcttaacagccatcgccaaccaggcggccatcctgatgggcctcgacaagggctggcccatctccaagatggacataggggtccccctactggccctcggctgctacagccaggtgaaccccctgaccctgaccgccgccgttctcatgctggtcgcgcactatgccatcattgggccggggctgcaggccaaggccacgcgcgaggcccaaaagcgcacagccgccggcatcatgaaaaaccccaccgtggacggcatcgtggccatcgacctcgaccccgtcgtgtacgacgctaagtttgagaagcagctgggccagatcatgctgctcattctgtgcacctcccagattctgctcatgcggacgacctgggcgctgtgcgagagcatcaccctggccaccgggcccctgacgaccctgtgggagggctccccagggaaattttggaacaccacgatcgccgtgagcatggccaacatctttcgaggctcttacctagccggcgcggggctcgccttcagcctgatgaaatccttgggtgggggcagacgcgggacgggcgcccagggagagaccctcggcgaaaagtggaagcggcagctgaaccagctgagcaagagcgagttcaacacatacaagcgcagcggcatcatggaggtcgaccggagcgaggccaaagaggggttgaagagaggcgagacgacgaaacacgccgtgtctcgggggactgcgaagctccgttggttcgttgagcggaacctggtcaagcccgagggaaaggttatagacctgggctgtgggcgcggcgggtggagctactactgcgccggcctcaagaaggtgaccgaggtcaaggggtacaccaagggcggccccgggcacgaggaacccatccctatggccacctacggctggaacatcgtgaagctgcattcagggcgggacgtgttcttcacgccgcccgagaagtgcgacaccctgctctgcgacatcggcgagagctcccccaacccgaccatcgaggaggggcgtaccctgcgtgtcctgaagatggtggagccctggctccgcggcaaccagttctgcatcaagatccttaatccctatatgcccagtgtggtcgagacgctggagcaaatgcagcggaaacacggcggtatgctcgtgcgcaaccctctgtcacggaatagcacccacgagatgtactgggtctcctgcggcaccgggaacatcgttagtgccgtgaacatgacctcccgcatgctgctcaaccgcttcactatggcgcaccggaagcccacctacgagcgcgacgtcgacttgggcgccggtacccggcacgtcgccgtagagcccgagatcgccaacctggacattatcgggcagaggatcgagaacatcaagaacgagcacaagagtacatggcactacgacgaggacaacccctataaaacgtgggcctaccacggttcctacgaggttaagcccagcgggtccgcgagctccatggtcaacggcgtcgtccgtctcctgaccaagccctgggacgtgatccccatggtgacccagatcgctatgaccgacacgacccccttcgggcagcagcgtgtcttcaaggagaaggtggacacccggacccctcgaccaaagcgtgggaccgcccagatcatggaggtgactgccaaatggctgtggggattcctaagccgcaacaagaagccccggatctgcactcgcgaggagttcacgcggaaggtccgaagcaacgccgcgattggagccgtgttcgtggacgagaatcagtggaactccgccaaggaggcggtcgaggacgagcggttttgggacctggtgcaccgcgagcgcgagctgcacaagcagggcaagtgcgcaacttgcgtgtacaacatgatggggaagcgcgagaagaaactcggcgagttcgggaaggcgaagggcagcagggccatctggtatatgtggctgggcgcccgcttcctggagttcgaggccctcgggttcatgaacgaagaccactggttttcccgggaaaacagcctgtctggagttgaaggggagggtctgcacaagttaggttacatcctgcgggacataagcaagatcccgggcggcaacatgtacgcggacgacaccgccgggtgggatacccgcatcaccgaggacgacctgcagaacgaggccaaaatcacggacattatggagccagagcacgccctcctggccaccagtattttcaagctaacctaccagaacaaggtggttcgggtccagcgccccgcaaagagcggcaccgtgatggacgtcatctcccggcgcgaccagagggggagcggtcaggtcggaacgtacggattaaacacgttcaccaacatggaggtgcagctaatccgccagatggagtcggaggggatctttagccccagcgaactggagaacagcaacctcgcggagcgggtgctggactggctggagaagcatggggtggaacgcctcaagcggatggccatctccggggacgactgcgtggtgaagccgaccgacgaccgcttcgccacggctctaacagcgctgaacgacatggggaaggtccggaaggacatcccccaatgggagccctcgaagggctggaatgactggcagcaggtccccttctgctcccatcatttccaccagctcatcatgaaggacggccgcgagatcgtggtgccgtgtcggaaccaggacgagctggttgggcgcgcccgggtgtcgcagggtgcgggttggagcttgcgcgagaccgcctgcctcggcaaatcctatgcccagatgtggcagctgatgtacttccatcggcgcgatctgcggctcgcggccaacgccatttgtagtgccgtccccgtgaactgggtgcccacatcccgcaccacgtggagcatacacgcccaccaccagtggatgaccaccgaagacatgctgtccgtctggaaccgcgtatggatagaggagaacccctggatggaggataaaacccacgtgtcgtcctgggaggacgttccgtacctggggaagcgggaagaccagtggtgcggaagcctcatcggactgacggcgcgcgcgacctgggccacaaatattcaggttgcaatcaaccaggttcgccgcttgatcgggaacgagaactacctcgactacatgacctccatgaagcgcttcaaaaacgagagcgatccagagggcgcgctgtggtga

SEQ ID NO: 24617 - RNA, 9879 nt, synthetic construct
  misc_feature 1..9879: note = derived and/or modified CDS sequence (opt11) from DENV-1__JQ045628__SS-prME
  source 1..9879: mol_type = other RNA
tcagtcaccatgctactgatgttaatgcccactgcgctagctttccacttgacgactcggggaggggaaccgcacatgatagtatccaaacaagaaagggggaagtctctcctatttaaaacatccgcaggagtgaacatgtgcacactgatagcaatggacctaggagaactttgcgaagatacgatgacgtacaaatgcccacggataacagagaccgaacccgacgacgtagattgctggtgtaacgccaccgacacatgggtgacctacggaacctgcagccaaacgggagaacaccgacgagacaagcgctccgtggctctagccccacacgtaggactcggcctcgagactagaaccgagacctggatgagtagcgaaggggcctggaaacaaatccagagagtggagacctgggccctccgccatccgggcttcacagtaatagctttcttcttggcacacgccatcggaaccagcattacccagaagggcataatctttatacttctgatgttagtcacaccaagcatggcaatgaggtgtgtcggaataggatcccgggactttgtagaggggctgtccggggccacctgggtggatgtagtcttggaacatggatcttgtgtcaccacaatggcaaaagataaaccaacactagacatcgagcttctcaaaacagaggtgaccaacccggccatactccgcaaactttgcatagaggcaaaaatcagcaacacgaccacagactcccgatgtccaacacaaggagaggcaactctagtggaagaacaagacgccaactttgtatgcagaaggacattcgttgaccgtgggtggggcaatgggtgcggtttattcggaaagggaagcctaataacgtgcgcaaaatttaagtgcgtgacaaaactggagggaaaaatcgttcagtatgagaacctcaaatatagtgtaattgttaccgtacacaccggagaccaacaccaagtaggcaacgaatcaacagagcacgggacgacggccacaatcaccccacaggcaccaaccacggaaatccaattaacggactacggggccttgacactcgactgcagtccacgcacaggactagacttcaacgagatggtgctcctgaccatgaaggaaaagtcttggttagtgcacaaacagtggtttctcgatctaccgctcccgtggactagcggtgcaagtacgtcacaagagacctggaatcggcaagacctgctcgtcaccttcaaaacagcgcacgcgaaaaagcaggaagtagtagtactgggcagtcaggaaggcgctatgcacaccgccctaacaggtgcgaccgagatccagacgagtggtaccacgactatattcgcaggccacctcaagtgtcgcttgaaaatggacaaactaacactaaaagggatgagctacgtcatgtgcacagggtccttcaaactagagaaagaggtggcagaaacacaacatggcacggtgttagtgcaaataaaatacgagggaacggacgccccctgcaaaatacctttctcaacccaagacgagaaaggcgtaacacaaaacgggcggctaatcacagctaacccgatagtcaccgacaaagagaagccggtaaacatagaagccgaacccccttttggggaatcctacatcgtaataggggccggcgaaaaagctctgaagttaagttggttcaagaagggaagcagtattggaaagatgttcgaagcaacagcacgtggcgcccggcgaatggcgatcttaggcgacacagcatgggacttcggatcgattggaggggtattcacaagtgtgggaaaactcgtccaccaaatttttggaaccgcgtatggcgtattattcagcggcgttagttggaccatgaaaatcgggatcggggtgctattgacgtggctcggtctcaacagtcgcagcacaagcctaagtatgacctgcatcgcggtgggcttagttactctctacctgggagtgatggtgcaagcggactctggatgcgtcatcaactggaagggacgagagctgaagtgtggaagtgggatattcgtgaccaatgaggtgcacacttggaccgagcagtacaaatttcaagcggacagtccaaaaaggctgagcgcagcgatagggaaagcatgggaagaaggcgtatgcggcataaggtcagcgacccggttggagaacataatgtggaagcagatctccaacgaactgaatcatatactcctagaaaacgacatgaaatttacagttgtcgttggcgacgtagccggtattctagcacaaggcaagaaaatgatccgcccacagccaatggagtacaaatattcctggaaaagttggggaaaagcaaaaatcataggggcagacgtccaaaacacaacctttataatcgatgggccaaacacaccggagtgtcccgacgaccaaagagcatggaacatctgggaggttgaggactatgggttcggaatattcacgacaaacatatggctgaaactacgagacagttacacgcaagtctgcgatcatcgcctaatgagtgcagccataaaggattcgaaggcggtccacgccgacatgggatattggatagagtcagagaaaaacgagacatggaaattggcacgcgcgtccttcatagaggtaaaaacatgtatttggccgaaaagccatacgctgtggtcaaacggagtgctcgaaagcgaaatgatcatcccaaaaatatacggtggacctatcagtcaacacaactacagaccaggctacttcacacaaaccgcaggcccgtggcacctgggtaaactagaactcgacttcgacctgtgcgaaggaactacggtagtagtcgacgaacactgcggcaataggggcccatcacttcgaacgacaacggtcaccgggaaaattatacacgaatggtgctgccgctcgtgtacactaccaccactacgattcaggggagaagatgggtgctggtatggcatggaaataagacccgtgaaagagaaggaagaaaacctagtgaaatcgatggtaagtgcggggtccggcgaggtggacagcttctcgttaggcctattatgcatttcgataatgatcgaggaagtaatgcgctcacgatggtcgcgaaaaatgcttatgacaggaaccctagccgtgttcctgctcctcatcatgggacagctcacctggaatgacctaatcaggttatgcataatggtaggcgccaatgccagcgatcggatgggtatgggaaccacgtatttggctctcatggctacgttcaaaatgagaccaatgtttgcagtggggctcctgttccgccgccttacaagtcgagaagtactcctcctaacgattgggttaagtctggtagcaagtgtagagctacccaacagcctagaagagttaggcgacggactagcaatgggaataatgatactcaaactattaacggacttccagagccaccaactttgggccactctcttatccttgacattcattaaaacaacattcagccttcactatgcttggaagacaatggctatggtcctaagtatagtatcgctctttccattatgcctaagtacgaccagccaaaagaccacgtggttgccagtgttgttaggatcactaggatgtaagcccctaaccatgttcctcatagccgagaataaaatatggggccgtcgatcatggccactaaatgaggggatcatggccgtgggaatcgtgagcattctgctcagctcgctactaaagaacgacgtaccattggcaggacctttaatagcaggagggatgctaatagcatgctacgtcatcagcggcagctcagccgacctatcactagaaaaagcagcagaagtctcttgggaagaagaggcggaacatagcggggcaagtcataacatactggtcgaggtacaagacgatgggaccatgaagataaaagacgaagaacgcgacgacacgcttacgatactactcaaggcaacgctcctagcagtctccggcgtctacccattatcaatacccgcgacgctattcgtgtggtacttctggcagaagaaaaagcaacgatcgggagtcttgtgggacaccccctcgccaccagaagtagaaagggccgtactagatgacggcatataccgcataatgcaacgcggcttgttaggccgatcacaagtcggggtgggcgtctttcaagaaaatgtgttccatacaatgtggcacgtcactcgaggggccgtcctaatgtaccaagggaagcggcttgaacccagctgggcaagtgttaagaaagatctaatttcttacggaggcgggtggcggttgcaagggtcctggaacactggggaagaggtgcaggtaattgcagtagagccgggtaaaaacccaaagaacgtccagacgacgcccggcacgttcaagacgctagagggcgaggtaggtgcgatagcgttggacttcaaacccgggaccagtgggtcccccatcgtgaatagagaaggaaaaatagtgggattgtacggcaacggcgtggtgactacatcagggacgtacgtcagcgccatagcacaggccaaagccagccaagaaggccctctcccggaaatagaagacgaggtcttcaggaagaggaacctcactataatggacctacacccaggctcaggcaagacacgccgataccttccagccattgtgcgcgaagctataaaaagaaaactgcgaacattgatcttggccccaacccgcgtcgtggctagcgagatggcggaagccctaaaaggcatgccaatcagataccaaacaaccgctgtcaaatcggaacacaccggcaaagaaattgtggacctcatgtgccacgccacatttacgatgcgcctactcagccccgtgcgcgtacctaattacaacatgataatcatggatgaagcccacttcacggatcccagcagtatcgccgcaaggggctatatctcaactagagtcggtatgggggaagccgcagcaatcttcatgacagccacaccacccggcagtgtagaagcattcccgcaatcgaacgcggtcatacaagatgaggaaagggatataccggagcgatcatggaacagtggctacgaatggattactgacttccctggcaagaccgtctggtttgtaccatccatcaaatcgggtaatgacatcgcgaactgcctacggaaaaacgggaaacgagttatacaactcagccgaaaaacattcgacacagagtaccagaaaaccaagaacaacgactgggattacgtagtcacaactgatataagcgaaatgggcgcgaattttagggccgacagagtaatagatcccaggcgatgcctcaaaccagtcatcttaaaagacggcccagaaagagtcatacttgcaggccccatgcccgtaacggtagcatcagccgcgcaacgacgcggtcgcatagggaggaaccacaacaaagaaggggaccaatacatctacatggggcaaccactaaataacgacgaggaccacgcccactggacagaagccaaaatgctcctcgacaacatcaatacgccggaaggcataattcccgcccttttcgagcccgagagagaaaaatcagccgcaatcgacggagaatataggctccgaggggaagcccgaaagacattcgtggaactaatgcgccgtggggacttgccagtgtggctatcttataaggtcgccagtgagggattccaatatagcgacagaaggtggtgcttcgacggtgagcgcaataaccaagtcctcgaggaaaatatggacgtagaaatctggactaaagagggcgaacgtaagaaacttcgtcccagatggttagacgctagaacgtatagcgaccccctcgccctccgcgagttcaaagaatttgctgcaggccgacgatcagtgtcaggcgacctcatactggagataggcaaacttccccaacacctaacacaacgggcgcaaaatgcgctggacaacctcgtcatgctccataattccgaacaaggagggagagcctacagacacgcaatggaagaactaccagacaccattgaaactctaatgctgctagcgctcatagccgtactcaccgggggcgttactctattcttcctcagcggccgggggcttgggaagactagcatcggcctactatgcgttatcgcgtcctcagttttgctatggatggccagtgtagagccccactggatcgccgcatcaatcatccttgagttcttcctcatggtccttctcattcccgaaccagaccgacaacgaacgcctcaggacaaccagctcgcgtacgtcgttatcggcctcttgtttatgatcctcacagtggctgccaacgaaatgggcttactagagaccacgaagaaggatctaggaattggacatgtggcagttggaaaccaccaccacgccgcaatgctagatgtcgatttacatccagcaagcgcatggactctttatgcagtcgccacaacaataataacacccatgatgcgacacacgatcgaaaacaccaccgcaaacataagcctcacagctatcgcgaaccaagcagcaatcctgatgggactcgacaaagggtggccgatatcgaagatggacataggagtcccgttactggccctggggtgctacagccaggttaacccattgaccctaacagcagcagtgctcatgttggtcgctcactacgccatcataggtccaggcttacaagcaaaggcgaccagggaagctcaaaagcggactgcggccggcatcatgaagaacccaacggtggatggaatagtagcgatcgacctcgacccagttgtctacgacgcaaagttcgagaagcagctcggacaaattatgctcctgatactatgcaccagccagatcttactcatgcgcacgacctgggcactttgcgaaagcattacactagcaacaggaccgctgactacattatgggaaggctcccctggcaaattctggaacacaacgatcgccgtgtcaatggcaaacatcttccgaggctcttacctagccggtgcggggttggcattctccttgatgaaaagtctgggaggagggcgccgcgggacgggcgcgcaaggtgaaaccctgggagagaaatggaaacggcagctgaaccagctcagcaaaagcgagttcaacacttacaagaggagtgggataatggaagtagacagatccgaggccaaagagggattaaagcgtggggagacgacaaaacatgccgtgtcccgcgggaccgccaaactaagatggttcgttgaaaggaacttagtgaagcctgaagggaaagtcatcgatctcggctgcgggcgcggcgggtggtcgtactattgcgcagggctcaaaaaggtcaccgaggtcaaaggctatactaagggaggtcccggacacgaagaacctatcccgatggcaacatacgggtggaatctcgtaaagctacattcaggtaaggacgtgttcttcataccgcccgaaaagtgcgacacgctgctgtgcgatataggtgaatctagccccaacccaacgatagaggaaggccgaacattacgcgtcctaaaaatggtggaaccctggcttcggggaaaccagttctgtataaagatattgaacccatacatgcccagtgtcgttgaaaccctcgagcaaatgcaacggaaacatggcggaatgctagttaggaaccccctcagtcgcaactcaacacacgaaatgtactgggtgtcctgtggcactggaaacatcgtgtcagcagtcaacatgacaagccgaatgcttcttaaccggtttacgatggcacataggaagccgacatacgaacgagacgtggacttaggtgcaggtaccaggcacgtcgcagtcgaaccagaagtcgcaaacctggacatcatcgggcagaggatagagaacattaagcatgagcacaaaagtacgtggcactacgacgaggacaacccatacaaaacatgggcctaccacgggtcatacgaagtaaaacccagcggcagcgcttcgagcatggtgaacggagtggtgaagttactaacgaaaccttgggacgtaattccaatggtgacacaaatagcgatgactgatacaacaccattcggacaacaaagggtgttcaaggaaaaggtagacacaagaacgccgaaagcaaaacgaggaacggcccaaatcatggaagttaccgcgaagtggctttggggattcctgtcccgaaacaagaagcccagaatctgcacgcgagaagaatttactcgcaaagtgcgatcaaacgccgcaataggggcagtatttgtggatgaaaatcaatggaactcggccaaagaagcagtagaggacgagcgcttctgggacctagtccaccgggaacgtgagctgcacaagcaaggtaaatgcgccacatgcgtgtacaacatgatggggaaacgggagaaaaagctgggggaatttggcaaggcaaaagggtcaagggctatatggtacatgtggctaggagcaagatttctagagttcgaggcgctcggattcatgaatgaggaccactggttctcaagagagaatagccttagcggcgtagaaggagaaggacttcacaaactaggatacatcctgcgagacattagtaaaatcccgggtggaaacatgtacgccgacgatacggctggatgggacacacgtatcacagaggacgatttacaaaacgaagcacgaataaccgacattatggaaccagagcacgcactattagccaagtccatcttcaaactcacataccaaaacaaagtggtgcgggtccagcgtcctgcaaagaacggcacggtgatggacgttatttcgcgacgcgaccagcgcggcagcgggcaagtcggtacttacggtctcaatacgttcacgaatatggaggcacagcttatacgccagatggaatcggagggcattttcagtccaagcgagctagagacgccaaaccttgccgagcgcgtgttagactggttggaaaaatacggggtggaacggctaaagagaatggctatcagcggagacgattgcgtggtcaaaccgatagacgaccggttcgccaccgcactcacagccctgaacgacatgggaaaggtccgcaaggacattccccagtgggaaccgagcaaaggatggaacgactggcaacaggtacctttctgctcgcaccacttccaccagttaataatgaaagacgggcgggagatagtcgtaccctgcaggaatcaggacgaattagtgggcagagccagggtcagccaaggagcgggctggagcctgcgggaaacggcctgcctaggcaagtcttacgcccaaatgtggcaactcatgtacttccatcgaagggatcttaggctagccgccaacgccatatgcagcgcagttccagtggactggattcccacgagcagaaccacttggagtatccacgcccaccaccaatggatgaccacggaagacatgttgtccgtgtggaaccgcgtctggatcgaagaaaacccctggatggaggacaagacacacatcagtagttggggcgatgtaccatacttaggcaaacgagaagaccaatggtgcggcagcctaatcggactgaccgcgcgcgcgacgtgggccacaaacatccaagttgcgatcaatcaggtaagacgactcatcggaaatgaaaactacctcgactacatgacaagcatgaagaggttcaaaaacgaatctgaccccgaaggagcactctggtga

SEQ ID NO: 24618 - RNA, 9879 nt, synthetic construct
  misc_feature 1..9879: note = derived and/or modified CDS sequence (opt11) from DENV-1__JQ045629__SS-prME
  source 1..9879: mol_type = other RNA
agcgtgaccatgttgctcatgctgatgcccaccgcactggctttccatctcacgaccagaggcggggaaccccatatgatggttagcaagcaggagcggggcaagtcgcttctgttcaagacctctgccggggtgaatatgtgcaccctcatcgccatggacctgggggagctgtgtgaggatacgatgacctacaagtgcccacggatcacggagaccgagcccgacgacgtggactgctggtgcaacgccacggacacatgggtcacatacgggacctgcagccagactggcgagcaccggcgggacaagagatccgtggccttagcgccccacgtgggcctgggtctggaaacacgaaccgagacctggatgagcagtgagggcgcctggaagcagatccagcgggtcgaaacgtgggccctccggcaccccgggttcaccgtgatcgccttattcctggcccacgcaatcggtacctcgattacccagaagggtattatcttcatattgctgatgctggtcacgccctccatggccatgcgatgcgtcggcatcggctctcgcgacttcgtggaagggctctcaggtgcgacctgggtagatgtcgtccttgagcacggtagctgcgtgaccacgatggccaaggacaagcccaccctggatatcgagcttctgaaaactgaggtcaccaaccctgcagtgctgcggaagctgtgcatcgaagcgaagatcagcaacaccacgaccgacagccgctgcccgacgcagggggaggccaccctggttgaggagcaggacgccaatttcgtttgccggaggacgttcgtggaccggggctggggtaacggatgcgggctgtttggcaagggttcccttatcacgtgcgctaagtttaagtgcgtgactaagctggaggggaagatcgtacagtacgaaaaccttaagtacagcgtgatcgtgaccgtacacacgggcgaccagcatcaggtggggaatgagtccaccgaacacggcactaccgccaccatcacaccccaggcgcccaccaccgaaatccagttgaccgactacggcgccctcacgctggactgctcacccagaacaggcttggacttcaacgagatggtcttactgacgatgaaagagaagtcctggctcgtgcacaagcagtggttcttagacctgccgttgccatggacgagcggtgcctcaacgagccaggagacctggaatcggcaggacctgcttgtgaccttcaagaccgctcacgccaagaaacaggaggtcgtggtgctcggcagccaggagggcgcgatgcacacggcgctgacgggggctacagaaatccagacctctggtacaacaaccatttttgccgggcacctgaagtgccggctcaagatggacaagctgacactgaagggcatgagctacgtcatgtgcacggggagcttcaaactcgagaaggagttggcggagacacagcacggtaccgtactggtgcagatcaagtatgaggggaccgacgcgccctgcaaaatccccttcagcacgcaagacgagaagggggtaacgcaaaacggccggctgatcaccgcaaacccgattgtcacggacaaagagaagccagtcaacatcgaggccgagccgcccttcggggagtcctacatcgtaatcggagcgggagaaaaagctcttaaacttagctggttcaaaaaggggtcctctattggcaagatgttcgaggcgactgcccgcggggcccggcgcatggccatactcggggacaccgcgtgggacttcgggtccatcggcggcgtcttcaccagcgttggcaagttggtgcaccagatcttcggcaccgcctatggggtgctgttctccggcgtaagctggaccatgaagatcgggatcggcgtcttgctgacctggctgggcctaaactcccgcagtacctccctctcgatgacctgcatcgcggtgggcctggtgacactgtacctcggcgtgatggttcaggctgatagtgggtgcgtgatcaattggaagggccgggaactgaaatgcggcagcgggatcttcgtcactaatgaagtccacacctggaccgagcagtataagttccaggccgactcaccgaagcggttatccgcagccatcggcaaggcctgggaggaaggcgtgtgcggcatccggagcgcaacccgcctcgagaacatcatgtggaaacaaatctccaacgagctgaaccatatcttactcgagaatgatatgaaattcactgtggtcgtgggagacgtagcgggcatactggcgcaagggaagaaaatgattcggccacagcccatggagtacaaatacagctggaaatcctggggcaaagcgaagatcattggcgcggatgttcagaacaccaccttcatcatcgacgggcccaatactccggagtgccccgacgaccagcgggcgtggaacatttgggaagtggaggactacggcttcgggatctttaccaccaacatctggctgaaactgcgggacagccacacgcaagtctgcgaccacagactcatgtccgccgccatcaaggacagcaaggccgtgcacgccgatatggggtactggatcgagtccgagaagaacgaaacctggaagctggcccgggcatcgttcatagaggtgaagacatgcatctggcccaagtcccacaccctctggtcaaacggcgtcttggagtcggagatgattatccccaagatttacgggggtcctatcagccagcacaactaccgccccgggtacttcacgcagaccgccggcccatggcacctgggcaagctcgagttagactttgacctgtgcgagggcaccacagtagtggttgacgagcattgtggcaaccgggggccgtcactccgcaccaccacggtgaccggaaagatcattcacgaatggtgctgccgaagctgtaccctgccgcctctgcgcttccgcggggaggacggctgctggtacgggatggagatccgccccgtaaaggagaaggaggagaacctagtcaagtccatggtgtctgccggctccggcgaggtggatagcttttccttggggctgctctgtatatcgatcatgatcgaggaagtcatgcggagccgatggtccagaaaaatgttgatgaccggtacgttagccgtcttctttctcttgatcatggggcagctgacctggaatgacttaattcgcctgtgtatcatggtgggcgcgaacgcgagcgacagaatgggaatgggtaccacctacctagccctcatggccacgttcaagatgcggccgatgttcgccgtcggccttctgttcagacgacttacctcccgcgaggtgcttcttctgaccatcggactcagcctggtggcctccgttgagcttccgaacagcctggaggagttgggcgacggtttggcgatgggcatcatgatcctgaagctgctcaccgacttccagtcccaccaattatgggccacgctactcagcttaacattcatcaagactaccttcagcttgcactacgcatggaagacgatggccatggtgctcagcatcgtctccctgttcccactgtgcctgtccactacctcccagaagacaacgtggctgcccgtgctgctgggctccctggggtgcaagcccctgacaatgtttctcatcgccgagaacaagatctggggacggcgctcctggcccctgaatgaagggattatggccgtgggcatcgtttcaatcctactctcgtccctgttaaagaacgatgtgccacttgcaggtcccctgatcgccggcggaatgctgatcgcctgttacgtgattagcggctccagcgctgacctctcactggagaaggctgccgaggtcagctgggaggaagaagccgaacactcgggcgcctctcacaacatccttgtggaagtgcaggacgatgggacgatgaaaattaaagacgaggaacgggacgacactctcaccatcctgctgaaggcgacgctactggccgtcagcggcgtgtacccgttaagtatccccgcgacactcttcgtgtggtacttctggcagaagaagaagcagcgctccggtgtcctgtgggatacccccagcccgcccgaggttgagagggctgttctggacgatggaatctaccgcatcatgcagcggggcctgctcgggcgcagccaagtcggggtgggggtgttccaggagaacgtcttccataccatgtggcacgtcacgcggggcgccgtgctgatgtaccaggggaagcgcctagaaccctcgtgggcttctgtcaagaaggacctcatatcctatggcggagggtggcggctccagggctcctggaacacaggggaagaggtccaggtaatcgccgtcgaaccgggcaagaatccgaagaacgtgcagaccgctcccgggactttcaagactcccgagggcgaggtaggagcaatagcgctggactttaagccaggtaccagcggctcccccatagtcaatagagaagggaagatcgtaggcctgtacggaaacggggtggtcacaacctcaggtacttatgtgtccgccatcgcccaggccaaggcctcgcaggagggtccgctgcccgagattgaggacgaagtgttcagaaagcgaaatctaacaatcatggacctccaccccggaagcgggaagacgcggcgctacctgccggcgatcgtccgggaggctataaagcgcaaattgagaaccctcatcctagccccaactcgggtagttgcttctgaaatggctgaagcgctgaagggcatgcccatcaggtaccagaccaccgccgtaaagagtgagcacaccggtaaggagatcgtggacctcatgtgccacgccactttcaccatgcggctgttgtcccccgttcgggtcccgaactacaatatgatcatcatggacgaagcccacttcaccgacccaagctccatcgccgctcggggatacatctcaaccagggtgggcatgggggaggccgccgccattttcatgacggcgacgccgcccggctccgtggaggcgttcccgcagagcaacgccgtcatccaggacgaggaacgggacattcccgaacgctcctggaactccgggtacgagtggatcaccgacttccccggcaaaacggtatggtttgtgccttcgataaaaagcggtaacgatatcgccaattgcctccgcaagaacgggaagcgcgtcatccagctgtcccggaagacgttcgataccgagtaccagaaaaccaagaacaacgactgggactacgtagtgacgacagacatatcggagatgggcgccaatttccgtgctgatagggtcatcgacccgcgccggtgtctgaagccagtgatactcaaggacggaccggagcgggtgatactggcaggcccaatgccagtcaccgtggcgtccgctgcccagcggcgcggtaggattggacggaaccacaacaaggagggggaccagtatatctacatgggccagcccttaaacaacgatgaggatcacgcgcactggaccgaggcgaaaatgttgcttgataatatcaataccccagaaggcatcatccccgcgctgttcgagccggaacgcgagaagtccgccgccatcgacggggagtaccggctccggggcgaggcgcggaagaccttcgtagagcttatgcgccgcggtgacctgcccgtgtggctcagctacaaggtggcctctgagggcttccaatacagcgatcgccgatggtgttttgatggggagcgcaataaccaggtcctggaagagaacatggacgttgagatctggacgaaagagggcgagaggaagaaactgcgcccccggtggctcgacgctagaacctactcagaccccctggccctgcgggagttcaaggagttcgcagcgggcagacgtagcgtgagtggagatctcatactggaaattggcaagctcccgcaacacctcacccagcgagcccagaatgcattagataacctagtcatgctccacaattccgagcagggcgggcgggcatatcgccacgcgatggaggagctgcccgacacaatcgagaccctgatgctcctggccctgatcgccgtcctcaccggcggggtgaccctgttctttctgtccgggcggggcctcgggaagacgagcatcggtctactatgtgtcatggcttccagcgtcctattatggatggcgtccgtagagcctcactggatagcggctagcatcatcctggagttcttcctcatggtcctgctgatccccgagccggaccgccagcggacaccccaggacaatcagctcgcctacgtagtcattggcctgcttttcatgatcctcaccgttgccgctaatgaaatgggactgctggagaccaccaagaaggacctgggaatcggccacgttgcggtggaaaaccaccaccacgcagccatgcttgacgtcgacctgcaccccgcctccgcctggaccctctacgcggtggccaccaccatcatcaccccgatgatgcgtcacacaatcgagaataccaccgcgaacatctcattgaccgctatcgccaatcaggcagctatcctaatggggctcgacaaaggctggcccatctcaaagatggacattggcgtgcccctgctggctctcgggtgctatagccaggtcaaccctctcacgttaacggctgcagtgctcatgcttgtggcgcactacgccatcatcggcccggggctgcaggccaaggccacccgcgaggcccagaaacggaccgcggccggcatcatgaagaaccccacggtcgatgggatcgtggccatagacctcgacccagtggtttacgacgccaagttcgagaagcagctgggacagataatgctgctaatcctttgtacatcccagatcctgcttatgcgcaccacctgggccctatgcgaatcgatcacgctggccaccggcccactcacaacgctgtgggaggggtcgccgggcaaattctggaatacaaccatcgccgtaagcatggcgaatatttttagggggagttacctggccggtgcggggttagccttttctctcatgaagtccctcgggggaggtcgccgggggaccggagcccaaggcgagaccctcggcgagaagtggaagcgccagctgaatcagctgtcgaaaagcgagttcaacacgtacaaaagatctgggattatggaggtggacaggtccgaggccaaagagggcctcaagcgcggggagactaccaagcacgccgtatcgagaggcaccgccaaactgcggtggttcgtggagcgcaacctggtgaaacccgaggggaaggtcatcgacctcggctgcggccgcgggggctggagctactattgcgcagggctcaagaaggtgacagaggtgaagggttacaccaagggaggccccggtcacgaggagccgatccccatggccacctacgggtggaacttagtgaaacttcactccggcaaagatgtgttcttcatcccgcccgagaagtgcgacacactcctgtgcgacattggggagtcatcccctaatccgactatcgaggaaggccgcaccctacgggttttaaaaatggtcgagccatggttgcggggcaaccaattttgcatcaaaatcttaaacccgtacatgccatcggttgtggagaccctcgaacagatgcagcgtaagcacggcggcatgctggtacgcaacccgctgtcaagaaactccacacatgagatgtactgggtctcctgtgggaccggcaacattgtatctgccgtaaacatgacgtcccgtatgctccttaaccgctttaccatggcgcaccgtaaacccacatacgagcgcgacgtggacctgggggccggaacacggcacgtggccgtagaacccgaagttgcgaacctcgacatcataggacagcgtatcgagaatataaagcacgagcacaaaagcacgtggcactacgacgaggacaacccctataagacctgggcctaccatgggtcctacgaagtaaagccgtcgggcagtgcgtcctctatggtcaacggggtggtcaagttactgaccaaaccgtgggacgtgatacccatggtgacccagatcgccatgacggacaccactccctttggccagcagcgggtcttcaaggagaaggtggacacacgcaccccgaaggctaagcgcgggaccgctcagatcatggaggtgacggccaagtggctttggggttttctgtcccggaacaagaagccccggatctgtacccgcgaagagttcacgcggaaggttagaagcaatgcggcaatcggcgccgtcttcgtggatgagaatcagtggaactccgcaaaagaggcggttgaggacgagcgattctgggatttggtgcaccgcgagcgggagctccacaaacaggggaagtgcgcgacatgcgtatacaatatgatggggaagcgcgagaaaaagttgggggagttcggcaaagccaaggggagccgggccatttggtacatgtggctgggcgcaagatttctcgagtttgaagcgctgggttttatgaacgaggaccattggttctcccgggagaactcgctgtccggggtcgagggcgagggacttcataaactgggctacatcctccgtgatatcagcaagatccccggaggcaacatgtacgccgacgacactgccggttgggacacacggatcacggaagacgacctccagaacgaagcccggatcacagacatcatggagcctgagcacgccctactggcgaagtccatcttcaagttaacctaccagaacaaggtggtgcgcgtacagagacccgcaaagaacgggaccgtgatggatgtgatttcgcgacgggaccagagaggctccgggcaggtcggcacgtacggtttaaataccttcaccaacatggaggcccagctgatccggcaaatggagtccgaggggatcttctcccccagcgaattagaaacccccaacttggcagagcgcgtgctggattggctcgaaaagtatggcgtggaacgcctgaagcgcatggccatctccggggatgactgcgtagtgaaaccgatcgacgaccgtttcgctacggccctgaccgcgctcaacgacatgggcaaggtgcgcaaggacatcccccaatgggagcccagcaaaggatggaacgactggcagcaggtcccattctgctcccatcacttccaccaacttatcatgaaagacggccgggagatcgtggtgccctgtaggaatcaagacgagctggtcggtagggctagagtgtcgcagggggctggctggtcgctccgggagacggcatgcctggggaagtcctacgcccagatgtggcagctgatgtatttccaccgacgggatctccgattggcggcgaacgcgatctgcagcgccgtgcccgtggactggataccgacatcccggaccacctggagcatccacgcccaccaccagtggatgacaaccgaggatatgctgtccgtgtggaaccgcgtgtggatcgaggagaacccttggatggaggataagacacatatcagctcctggggagacgtcccgtacttagggaagcgtgaggaccagtggtgtggcagcttgatcggcctgaccgctagagcaacttgggccaccaacatccaggtggcgatcaatcaagtccgccggctcatcgggaatgagaactacctggactacatgacctccatgaagcgcttcaaaaatgagtctgatccagaaggcgccctctggtga

SEQ ID NO: 24619 - RNA, 9879 nt, synthetic construct
  misc_feature 1..9879: note = derived and/or modified CDS sequence (opt11) from DENV-1__JQ045630__SS-prME
  source 1..9879: mol_type = other RNA
agcgtaaccatgctcctaatgctgatgcccaccgccctcgccttccatctcactacccggggcggggagccccacatgatcgtttcaaagcaggagcggggcaagagccttttgttcaagacaagtgccggggtgaacatgtgtaccttaatcgctatggacctgggcgagctgtgtgaagacaccatgacctacaagtgtcccaggatcacggagaccgagcccgacgatgttgactgctggtgcaacgccactgacacgtgggtgacctacggtacctgcagtcaaacgggcgagcaccggcgggacaagcggagcgtggcactcgcgccccatgtcggcctggggttagagacccgcacggagacctggatgagtagtgagggtgcgtggaagcaaatccaacgagtcgagacttgggccctccgccaccccgggttcaccgttatcgctttgtttctggcccacgcgatcggcaccagcatcacccagaaagggatcatcttcattctcctgatgctggtgacgccctccatggccatgcggtgcgtcggcatcggcagccgagacttcgtggaggggctctccggcgccacctgggtggatgtagtgctggagcacgggagctgcgtgactacgatggctaaggacaagccaacgttagacatcgagctcctgaagaccgaggtcaccaaccccgccattctgagaaagctatgcatagaggcgaagatctccaacacgacgaccgatagccgctgtccaacccagggtgaggccaccctggtggaggagcaggacgccaactttgtgtgccggcggacgttcgtggaccggggctggggtaacggctgcgggctattcggcaaggggtccctaataacgtgtgccaaattcaagtgcgtgaccaaactggagggcaagatcgttcagtacgagaacctgaagtacagcgtgatcgtgaccgtacacaccggcgaccaacaccaggtcgggaacgagtccactgagcacggcaccaccgccaccattacaccccaagcgcccacgactgagatccagctcaccgactacggggccctcacgctggactgcagcccccgtaccggcctcgacttcaacgagatggtgctgctgaccatgaaggagaaatcctggctggtccacaagcagtggttcctggacttgcccctcccctggactagcggagccagcacgtcccaggagacctggaaccgacaggacttactggtcaccttcaagaccgcccacgccaaaaagcaggaggtagtagtcctcggcagtcaggagggcgcgatgcacactgcactaacaggggcgaccgagatccagaccagcggcacgaccaccatctttgccggccacctcaagtgccgcctcaaaatggacaagctgaccttgaagggcatgagctacgtaatgtgcacggggtccttcaaactcgagaaggaggtcgcagagacacaacacggcaccgttctggtgcagatcaagtacgaggggaccgacgctccctgtaagattccctttagcacgcaggatgaaaagggcgtcacccagaacggccggctgatcaccgccaaccctatcgtaaccgacaaagaaaagcccgtgaatatagaggccgagccgcccttcggtgaaagctacatcgtaatcggcgccggcgagaaggctttgaagctcagctggttcaagaaggggtccagcattggcaaaatgttcgaggccacggcccgcggggcccggagaatggccatactgggcgacaccgcgtgggacttcgggagcatcggcggcgtgttcacctcggtcgggaagctggtccaccagatcttcgggacggcctacggcgtcctgttctccggcgtgagctggacgatgaagatcgggatcggtgtcctgctaacctggctcggattaaactcgcggagcacatcactgagcatgacctgcatcgcggtcggtcttgtgacgttgtacctgggcgtcatggtgcaggccgacagtgggtgcgtgatcaactggaaaggtcgtgagctcaaatgcgggagcggcattttcgtcacgaacgaggtgcacacatggaccgagcagtacaaattccaggccgacagcccgaagcgcctttccgcggccatcggcaaggcctgggaggagggggtgtgcggcatccggagcgctacccggctggagaacataatgtggaagcagattagcaatgaactcaaccacatcctgctggagaacgacatgaagttcacggtcgtggtgggggacgtcgccggcatcctcgcgcaaggcaaaaagatgatccgaccccaacccatggagtacaagtacagctggaaatcctgggggaaggccaagatcatcggcgccgacgtgcagaacaccacattcatcattgacgggccaaatacacccgagtgccctgacgaccaacgagcctggaatatatgggaggtggaagactacggattcgggattttcacgactaacatctggctgaaactgcgcgacagctacacccaggtctgtgatcatcgcctcatgtccgcggccatcaaggacagcaaagccgtgcacgctgacatgggctactggatcgaatccgaaaagaacgagacttggaaactcgcccgggccagctttatcgaagtcaagacgtgcatctggcccaagtcccacactctgtggagtaacggcgtcctggagtccgagatgatcatccccaagatatacggcgggccgataagccaacacaactaccgccccgggtacttcacccaaactgcaggcccctggcacctggggaagctggaactcgactttgacctgtgcgagggaacgaccgtggtggtggatgagcactgtgggaaccggggtccttccctgcggacaaccactgtgaccggcaagataatccatgagtggtgctgccggagctgcacgctgccgcccctacgctttagaggggaggacggctgctggtacgggatggaaatccgccctgtaaaggagaaggaggagaacctggtcaaaagcatggtaagcgcaggcagcggcgaggtggacagcttctccttggggttactgtgcatttccatcatgatcgaggaggtcatgaggagccgctggtcccggaagatgctcatgaccggcacgctggccgtgtttctgctcctgattatggggcagctgacctggaacgacctaatcaggctgtgcatcatggtgggcgccaacgcgagcgaccgaatggggatggggacgacctaccttgcattgatggccacgttcaagatgcggcctatgttcgctgttggcctgctattcagacggctcacatcccgtgaggtgctgctactcaccatcgggctgagcctggtagcctccgttgagctcccgaacagtttggaggagctgggcgacgggctcgcgatgggcatcatgatcctcaaactgctgaccgacttccagtcccaccagctgtgggccactctgctatcactaacattcatcaagaccacattctcgctacattacgcttggaagacgatggccatggtgctcagtatagtctccctgttcccgctgtgcctcagcacgacctcccaaaagacaacctggctacccgtgctgctcggcagccttggatgcaagcccctgaccatgtttctcattgcggaaaacaagatctggggcagacgctcctggcccctaaacgagggtatcatggccgtgggcatcgtgagcatcctgctcagcagtctcctgaaaaatgacgtaccgctcgccggtcccctgattgccggaggaatgctgatcgcctgctacgtgatcagcggttcgtctgcagacctgagcctggagaaagccgccgaggtcagctgggaggaggaggccgagcactccggcgcctcccacaacatcttggtagaggtgcaagatgacgggacgatgaagatcaaagacgaggagcgggatgacacgctcaccatcttgctgaaggcgacgcttctggccgtctccggcgtatatccgctaagcatccccgccaccctcttcgtgtggtacttctggcagaagaagaagcagcgcagcggtgtcctctgggacacgccaagcccgcccgaggttgagcgggccgttctggacgacggcatctacaggatcatgcagcgaggcctgctcgggcgctcccaggtcggcgtgggggtgttccaggagaacgtcttccacacgatgtggcacgtgacgcggggcgccgtgcttatgtatcaagggaagcgcttggagccctcatgggcgtccgtcaaaaaggacctcatctcctatggcggcgggtggcggctgcagggctcatggaatacaggggaagaggtccaggtgatcgctgttgagcccgggaaaaatcccaaaaatgtacagaccacccccgggacgttcaaaactcctgaaggcgaggtcggcgccatcgccctggacttcaagcccgggacctctggctcacccatcgtgaacagagaagggaagatcgtgggcctctatggtaacggggtagtcaccacgagcggcacctacgtgagcgccatcgcccaagccaaggcctcacaggaggggccgctgccagaaatcgaggacgaggttttccggaaaagaaacctgaccataatggacctccatcccggctccgggaagacacggagatacctgccggccatagtccgggaggctatcaagcgcaagctgcgcacgctgatactggcccccacgcgggtggtggcctccgagatggccgaggccctgaagggaatgcccatccgctaccagaccacggcagtcaagagcgagcacacgggcaaggagatcgtagacctcatgtgccacgccaccttcaccatgcgtctcctgagtcccgtgcgcgtcccaaactacaacatgatcataatggatgaagcccacttcaccgaccccagctccatagctgcccgggggtacatctctacgcgcgttggcatgggtgaggcggcggccatattcatgaccgccaccccacccggctcggtagaggccttcccgcagagcaacgcagtcatccaggatgaggagcgggacatccccgagcgctcctggaacagcgggtatgagtggatcaccgacttcccaggcaagacggtgtggttcgtgccctccattaagtcaggtaacgatatcgccaactgcctccggaagaacgggaagcgcgtaatccaactgtcccggaagaccttcgacaccgagtaccagaagaccaagaataatgactgggactacgtggtgacgaccgacatctcggagatgggcgccaacttccgcgcggaccgggttatcgacccccgccgctgcctgaagcccgtcatcttgaaagacgggccggagcgcgtgatcctggcgggacccatgccggtcaccgtcgcctcggccgcccaaaggcgcgggagaataggccggaaccataacaaggagggcgaccagtacatctacatggggcagcccctgaacaatgacgaggaccacgcccactggaccgaggcgaaaatgctcctggacaatatcaacacgcccgagggcatcatccccgccctgttcgagccggagagagaaaagtccgccgccatcgacggggaataccgtctccgcggtgaggcccggaagacgttcgtcgagctgatgcgcagaggggacctgcccgtgtggttgagctataaggtggcgagcgagggctttcagtactcagaccgccggtggtgcttcgacggagagcgcaacaaccaggtactggaggagaacatggacgtggagatttggaccaaggagggggaacggaagaaacttcgcccccggtggctcgacgcccgcacctactccgaccccctggctctgcgcgagttcaaggagttcgccgccggccgccgttcagtgtccggagacctcattctcgagatcggtaagctgccgcagcacctcacgcagcgtgcccagaacgccctggacaatctcgtcatgctccacaatagcgagcaaggcgggcgggcctacaggcacgccatggaggagctgcccgacaccatcgagaccctcatgctcctggctctgatagccgtgttgaccggcggggtgaccctgttcttcctctccggccgggggctcggcaaaacgagcatcggactgctatgtgtcatcgcaagcagcgtgctcttatggatggcgagtgtggagccgcactggatcgcggcgtcaatcatcctggagttctttttgatggtgctcctgatacccgagccggaccgccagcggacgccccaggacaatcagttagcctacgtcgttatcggtctgctgttcatgatcctcaccgtcgccgcgaacgagatgggtctgctggagaccacgaagaaggacctcgggataggccacgtggcagtgggtaaccatcaccacgcggcaatgctggacgttgaccttcaccccgccagtgcctggaccctctacgccgtagcgactacaatcatcaccccgatgatgcgccacacgatcgagaacacaaccgctaacatctccctgaccgccatcgccaaccaggccgcgatcctgatgggcctcgacaagggttggcccatctccaagatggacattggggtgccccttctggccctcggttgctactcccaggttaaccccctaaccctgaccgcggccgtcctcatgctggtggctcattacgccataatcgggccgggtctgcaggcaaaagccacacgcgaggcccagaagaggacggcggccgggattatgaaaaatcctaccgtcgacggcatcgtcgccattgacctcgatcccgtggtttatgacgctaaatttgagaagcagctgggccagatcatgctcctaatcctgtgcacctcccagatcctgctcatgcgcaccacatgggccctgtgcgagagcataacgctggccaccgggcccctcaccacgctgtgggaaggctccccggggaagttctggaacacaaccatagcagtgtcaatggcaaacatattccggggatcctacctggccggtgcagggttggcgttcagcctgatgaaaagcctgggcggtggccgccgggggaccggcgcccagggcgagacactaggggagaagtggaagagacagctgaaccaactgtccaagagcgagttcaacacctacaagcggtctggcatcatggaagtggaccgctcggaggccaaggagggacttaagcgcggcgaaacgaccaaacacgccgtctcccgcggtacggcaaagctgcgatggttcgtggaaagaaacctggtgaagcccgagggcaaggtcatcgacctgggctgcggtaggggcggctggtcctactactgcgccggtctcaagaaagtcacggaggtgaaggggtacaccaagggtgggcccgggcacgaggaacccatccccatggcgacctacggctggaacctggtcaaactccactccggcaaggacgtgttctttataccacccgagaagtgcgacaccttgctgtgtgacatcggagagtcctcccccaacccgactatcgaggaggggcgcactcttcgggtgctcaagatggtcgagccgtggcttcgcggaaaccagttctgcatcaaaatactgaacccgtacatgcccagtgtggtggagacactcgagcagatgcagcggaagcacggcggcatgctggtccgcaaccccctgtcaaggaactcaactcatgagatgtactgggtgtcttgcggcacagggaacatcgtgagcgccgtcaacatgaccagtcgcatgctcctgaaccgcttcacgatggcccaccggaaaccaacctatgagcgcgacgtcgacctgggcgcgggcactagacacgtggccgtcgaacccgaggtggccaacctcgacatcatcgggcagcgcatcgagaatatcaaacatgagcacaagagtacctggcattatgatgaggacaacccatataagacctgggcttaccacggctcctacgaagtgaagccgagcgggtccgctagcagcatggtcaacggcgtcgtcaaacttctcaccaagccttgggacgtgatacccatggtgacacaaatcgcgatgacagatacaacacccttcgggcagcagcgggtcttcaaggaaaaggtggacactcgcacgcccaaggccaagcggggcaccgcccagatcatggaggttacagccaagtggctctggggcttcctgtcccgcaacaagaagccccggatctgcacgcgcgaggagttcacacggaaagtccgcagcaacgcggcgatcggggccgtctttgtggacgagaaccagtggaactccgccaaggaggccgtcgaggacgagcggttctgggatctggtgcatcgcgagcgggagctccacaagcagggcaagtgcgcgacttgcgtgtacaacatgatggggaagcgcgagaagaagctgggcgagttcggtaaggccaaaggcagtcgagccatctggtacatgtggcttggcgctcgctttctcgagttcgaggccctggggttcatgaacgaggatcactggttttcccgtgagaacagccttagcggcgtcgagggggagggcctccacaagctgggttacattttgcgcgacatcagcaagatccccggcggcaacatgtatgcagacgataccgccggatgggacacgcggataaccgaggacgaccttcagaacgaagcccgaatcaccgatataatggagccggagcacgccctactggccaaatccatcttcaaacttacatatcagaacaaggtggtccgcgtccagcggccagcgaagaatggaacggtgatggacgtgatcagccgccgggaccagagagggtctggacaggtcggaacctacgggcttaatacctttacaaacatggaggcccagctgatccggcagatggagagcgagggcatcttctccccctccgagcttgagacgcctaacctggcggagagagtgctggactggctcgagaagtacggggtggagcggctgaagcgcatggcaatctccggcgacgactgcgtcgtgaagcccatcgacgaccggttcgccactgcgctgactgcactgaatgatatggggaaagtgcggaaagacatcccccagtgggagccttcaaagggctggaacgactggcagcaggtccccttctgctctcaccatttccaccagctgatcatgaaagacggccgggagatagtggtgccttgccgcaaccaggatgagctggtcgggcgcgcaagggtgagtcagggcgccggttggagcctgcgggagaccgcctgcctgggcaagtcctacgcgcagatgtggcagctgatgtacttccaccgccgggacctccgcctggccgccaacgccatttgtagcgcggttcccgtagactggattcccacgtcccggacgacgtggagcattcacgcccaccaccagtggatgaccacggaagacatgctgtccgtttggaaccgtgtgtggatcgaggagaacccctggatggaggataagacccacatcagctcctggggcgacgtcccgtatctcggcaagcgcgaggatcagtggtgcggcagcctgatagggctgaccgcccgcgcgacctgggcaaccaacatccaggttgcgatcaatcaagtgcggcggctcatcggaaacgaaaactatctggattacatgacctcgatgaaacggttcaagaacgagagcgaccccgagggagccctgtggtaa

SEQ ID NO: 24620 - RNA, 9879 nt, synthetic construct
  misc_feature 1..9879: note = derived and/or modified CDS sequence (opt11) from DENV-1__JQ045632__SS-prME
  source 1..9879: mol_type = other RNA
tcggtcaccatgctgcttatgctgatgcccaccgccttggcctttcacttaaccacccgcgggggggaaccccacatgatcgtgtcaaagcaggagcgaggcaagagcctgctgttcaaaacgtccgccggggttaacatgtgcaccttaatcgccatggatctgggcgagttatgcgaggacaccatgacctacaagtgcccgcggattactgagacagaacccgacgacgttgactgctggtgcaatgctacggatacctgggtcacgtacgggacctgcagccaaactggagaacaccggcgagacaagaggtccgtggccctcgcaccccacgtgggcttaggtctggaaaccaggacagagacctggatgagctctgagggcgcatggaaacaaatacagcgagtcgagacgtgggccctccgccaccccgggttcacggtgatcgctctgttcctggcacacgcgatcggcacgagcatcacccagaagggaattatcttcatcctcctgatgttagttacgccttccatggccatgcgctgcgtcggcataggcagccgcgatttcgttgagggtctatccggcgccacctgggttgacgtcgtgctggagcacgggagttgcgtgacgaccatggccaaggacaagccgacgctagacatcgagcttctgaagaccgaggtcacgaacccagccgttctgcggaagctctgcatcgaggctaagatctccaacaccacgaccgactctcgctgcccaacccaaggcgaggcgacactcgtagaggaacaggacgccaatttcgtctgccggagaactttcgtggacagaggctggggtaacggatgcgggctgtttggcaaggggtccctcataacgtgcgccaagtttaagtgcgtgaccaagttagagggcaagattgtgcagtacgaaaacctgaagtattcggtaattgtcaccgtccacacgggcgaccagcatcaagtgggaaacgaatcgacagagcacggcacgaccgccaccatcacgccccaggcgcccacgaccgaaatacagttaaccgactatggggccctgacgctggactgctctccccgcaccggcctcgatttcaacgagatggtcctactgaccatgaaggagaagtcgtggctagtgcataagcagtggtttctggacctgccactcccctggactagcggagcatcaacgtcccaggaaacttggaacagacaggacctgcttgtgaccttcaagaccgctcatgccaaaaagcaggaggtcgtggtgctcggcagccaggagggcgcgatgcatacggccttgactggggctactgagatacagacttccggcacgaccaccatcttcgccgggcacctgaagtgccgcctgaagatggataaattaaccctaaagggcatgagctacgtcatgtgcaccgggagtttcaagctcgagaaggagctggccgagacccagcacggcaccgtgctcgtacagatcaagtacgagggcactgacgcgccctgcaagatccccttcttgacgcaggacgagaagggggtcacccagaacggtagactaataaccgccaacccaatcgttaccgacaaggaaaagcccgtgaacatcgaggcagagccgcccttcggggagagctacatcgtcattggcgccggagagaaggccctcaagctctcctggttcaaaaaggggagcagtatcggcaagatgttcgaggccacggcacgcggcgcccggcgcatggccatccttggagacactgcgtgggatttcgggagcatcggcggcgtattcaccagcatcgggaagctggtgcatcagatcttcgggaccgcctacggggtcctgttcagcggcgtgtcttggacgatgaaaatcgggataggcgtgctcctgacttggctgggcctcaacagccgctccacgagcttaagcatgacgtgtattgcagtcgggttggtgactctctacctgggcgtgatggtccaagccgactctgggtgcgttatcaattggaagggccgagagctgaaatgtgggtccggcatttttgtgacaaacgaagtccatacctggacagagcagtacaagtttcaggcggacagcccaaagcgcctcagcgcagccatcggtaaggcctgggaggagggggtgtgcggcattcggagcgccacccgcctagagaacatcatgtggaagcagataagcaacgagctgaaccacatcttactagaaaacgatatgaagttcacggtggttgtgggggatgtggccggcattctggcccaggggaaaaagatgatccggccccaaccaatggagcacaagtactcctggaaatcctggggcaaggctaagattatcggcgctgatgtccaaaacaccacgtttatcatcgatgggcctaacaccccggaatgccccgacgaccagcgcgcatggaacatctgggaggtcgaggattacggcttcgggatctttacgaccaacatctggctcaagctgcgagattcatacacccaggtgtgcgaccaccgcctgatgtcagcggccatcaaggactccaaggctgtccacgccgacatgggctattggatcgagagcgagaagaatgagacctggaagctcgctcgtgcgagttttatcgaggtgaagacttgcatttggccaaagagccacactctgtggtccaacggggtcctagagagcgagatgatcatccccaagatctacggaggcccgatctcccagcacaactaccgccccgggtacttcacccaaaccgcaggcccctggcacttaggtaagctggagctggactttgacctatgtgaaggcacgacagtcgtggtggacgagcactgcggcaatagaggtccgtctttgaggaccacgacggtcactggaaagataatacacgagtggtgctgccggtcctgcaccctaccgcctctacgcttccgcggggaggacggctgctggtacgggatggaaatccggcccgtgaaggagaaggaggaaaacctggtcaagagcatggtatctgccggcagcggtgaggtggactccttctccctggggctactgtgcataagcattatgatagaggaagtgatgcggtcccgctggagccggaagatgcttatgaccggcactctcgccgtctttttcctgctcattatgggtcagctcacctggaacgatctgatccgtctgtgcatcatggtgggcgccaacgcatccgaccggatggggatgggcactacctacctcgcgctgatggccacgttcaaaatgcggcctatgttcgccgttggtctcctgttccgccggctaacttcacgcgaggtcctgctcctgacaataggactgtcactcgtcgccagcgtggagctgcccaactccctggaagagctcggcgacggtttagcgatgggcatcatgatcctgaaactcctgaccgatttccaaagccaccaactgtgggccaccctcttaagcctcaccttcatcaagaccaccttcagcctgcactacgcatggaagacgatggccatggtccttagtattgtgagcctgttccccctctgtctgagcaccacctcgcagaagaccacttggctccccgtcctcctcggctccctagggtgtaagccgctcaccatgttcctcatcgctgagaataagatctggggccggcgcagctggccactgaacgaaggtataatggcagtaggcatcgtgagtatcctcttaagctcccttctcaagaacgacgtccccttggccggccccctgatcgccggagggatgctcatcgcatgttacgtgatatccgggtctagtgcggacctgagcctggaaaaagccgccgaggtgtcctgggaggaggaggcagagcatagcggtgcgtcccacaacatcctggtcgaggtacaggacgacgggaccatgaagataaaggacgaggagagggacgacacactgaccatcttactcaaagctaccctgcttgcagtgagcggcgtctatccgctgtccatccccgcgaccctgtttgtgtggtacttctggcagaagaagaagcagcgaagcggggtgctgtgggataccccttctccgccggaagtcgagcgggccgtcctggatgacgggatctaccggatcatgcagcggggcctcctggggcgctcccaagtgggcgtcggggtgttccaggagaatgtgttccacaccatgtggcacgtaacacggggagccgtgctgatgtaccaagggaaacgcctcgagccctcctgggcgtcagttaagaaagacctgatttcatacggcggcgggtggcggctgcagggctcgtggaacactggagaagaggtgcaagttatagccgttgaaccgggcaagaacccgaaaaacgtccaaaccgcccccggtaccttcaagacgcccgagggggaggtgggcgccatcgcccttgacttcaagcccgggaccagcggatcacccatagtgaaccgcgaggggaaaatcgtcggcctgtacggcaatggggtggtgaccacctccggaacgtacgtctcagccatcgcccaggcaaaggcatcacaagaggggccgcttcccgagatagaggacgaagtgttcaggaagaggaacctcaccatcatggacctccaccccggatccgggaaaaccagacgttacctaccggcgatcgtgcgggaggcgatcaagcggaagctccgaacgctgatcctggccccgactcgagttgtggcctcggagatggccgaggcgctcaaaggaatgccaatccgttaccagacaacagccgttaaatccgagcacaccggtaaagagattgtcgacttaatgtgccacgccactttcaccatgcggctgttgagtcccgtgcgcgtgccgaactacaatatgattatcatggacgaggctcacttcaccgatccctcatcgattgctgcgcgggggtacatctctacccgcgtcggaatgggggaagccgccgccatattcatgacggccacgccgcctggttccgtggaggcgttcccgcagtccaacgccgtgatccaagatgaggaacgggacattccggagcgctcctggaactccgggtacgaatggatcacggacttccccggcaaaactgtctggttcgtgcccagcataaagagtggtaacgatatcgctaactgcctgaagaaaaacgggaaaagagtgatccagctgagccgcaagacttttgacaccgagtaccagaagactaaaaacaacgactgggactatgtcgtgaccacggacatttccgaaatgggcgcaaatttcagagcggaccgcgtgatcgacccgcggcgctgcctcaagcccgtaattctgaaggacgggcccgagcgggtgatccttgccggccccatgccggtcaccgtggctagcgccgctcagcgccgggggcgaatcggccggaaccataacaaagagggcgaccagtacatctacatggggcaacccctaaacaacgatgaggaccacgcgcattggaccgaggctaagatgctcctcgataatatcaatactcccgaaggcataatacccgcactctttgagcctgagcgcgagaagtccgccgccatcgacggtgagtaccgtctccgtggcgaggcgcgtaagacgttcgttgagctgatgcggcgcggggatctccccgtatggctgtcctacaaggtcgccagtgagggcttccagtactctgatcggcgctggtgcttcgacggcgagcggaacaaccaggtgctcgaggaaaatatggacgttgaaatctggacgaaagagggagaacgcaaaaagctgcggcctcgctggctggatgcccgcacctacagcgaccccttagccttacgggagttcaaagagtttgcggctgggcggcgctccgtgagcggggacctaattctggagatcggcaagctcccgcagcacttaacccaacgggcccagaacgccctggacaatctcgtgatgctgcataactccgagcagggtgggcgtgcctatcggcacgctatggaggaacttcccgacacgatcgaaaccctcatcctgctggccctcatcgccgtactgaccgggggggtaaccttatttttcttatcagggcgcggtctggggaagacctccatcggcttattgtgtgtgatggccagctccgtcctcctgtggatggccagcgtggagccgcattggatcgcagcctcaatcatcctcgaattcttcttaatggtgctgttaattccggagccggatcggcagcgaacgccccaggacaaccagctggcctacgtcgttatcggtctcctattcatgatcctgaccgtggccgccaacgagatgggactgctcgagaccaccaagaaggatcttgggatcggccacgtagcggtagagaaccaccaccacgccgcaatgctggacgttgacctccaccccgccagtgcctggactctgtacgcggtagccaccactatcatcacgccaatgatgcgtcacacgatcgagaatacgaccgccaacatctccctgacagccatagccaaccaggcggccatcttgatggggcttgacaagggctggcccatcagcaagatggacatcggcgtgcctttattggccctggggtgctactcacaggtgaaccccctcacgctcaccgccgcggtcctgatgttggtggcccactatgcaattatcggcccggggctccaggccaaggccacccgcgaggcgcaaaagcgcaccgccgccggcatcatgaagaaccccacagtggacgggattgtcgccatcgacctggacccggtagtgtacgacgcgaagttcgagaagcagctcggccaaatcatgctattgatactgtgcaccagccaaatccttctaatgcggaccacatgggcgctgtgtgagtcaatcacgctcgccacagggcccctcaccacactgtgggagggcagcccggggaaattctggaatacgacgatcgcagtctccatggccaacatcttccgcgggtcgtatctcgcaggtgccgggctggccttcagcctgatgaagtcccttgggggggggcggaggggcaccggggcgcagggcgagaccctaggggagaaatggaagagacagctgaaccagttatccaaatccgagttcaacacgtacaagcgcagcgggatcatggaggtagatcggtccgaagctaaggaaggcctgaagaggggggagaccacgaagcacgcggtgagccggggcaccgccaagctgaggtggttcgtcgagcggaatctagtaaagcctgaggggaaagtgatcgacctaggctgcggtcgtgggggttggtcctactactgcgccgggttaaagaaggttacggaggtgaagggctacacgaaaggcgggcctgggcacgaagagccaatcccgatggccacctatggatggaatctggtgaagctccacagcggcaaggacgtcttctttataccgcctgagaagtgcgacaccctgttatgcgacatcggggagtcaagccccaatccaacgatcgaggaagggcggaccctgcgcgtgctgaagatggtggagccctggctgcgggggaaccagttctgtataaaggtccttaacccttatatgccctctgtggtggagaccctggagcagatgcagcgcaaacatggcggtatgctggtccggaacccgctcagccgcaactccacccacgagatgtattgggtgtcttgcgggaccggtaacatcgtgtctgcagttaacatgacgagcagaatgctgctcaaccgcttcaccatggcgcatcgcaaacccacgtacgagcgggatgtggacctcggggccggcacccgccacgtggccgtcgagcccgaggtggccaacctcgacatcatcggccagcggatcgagaacataaagcacgagcacaagagcacctggcattacgacgaggacaatccctacaagacgtgggcctaccacggcagctatgaggtaaagccgtccggcagcgcctcctcaatggtcaacggggtggtcaagctgttaacaaagccatgggatgtgatacccatggtgacccaaattgccatgacggacacaacccccttcggacaacaacgagtgttcaaggagaaggtggacacccggacaccgaaagctaagagggggacagcccagatcatggaggtgaccgccaaatggctgtggggcttcctgagccggaacaagaaaccccggatttgcacccgggaagagttcacgaggaaagttcgctccaacgcggccatcggcgccgtgtttgtcgacgagaaccaatggaacagcgccaaggaggccgtcgaggatgagcgcttctgggatctcgtgcaccgggaacgagagctgcacaagcaaggaaagtgcgcgacctgcgtgtacaacatgatgggaaagcgggagaaaaagttaggcgagttcggcaaagccaaggggtccagggccatctggtacatgtggctcggcgcccggttcctggagtttgaggcgctgggattcatgaacgaagatcattggttcagccgcgagaactcgctctcgggggtggagggtgaaggcctacacaagctgggctatatccttcgcgacatctccaagatcccaggcggcaacatgtatgccgacgacaccgcaggttgggatacccgcatcacagaggatgacctgcagaatgaagcccggatcaccgatatcatggaaccggagcacgcgcttctcgctaagagcatcttcaaactgacctaccagaacaaggtggtgcgcgtacagcgccccgcaaagaatggcaccgttatggacgtgatatcccggcgcgaccaacggggaagcggacaggtcgggacgtacggactgaacacctttaccaatatggaggcccagttgatccgtcaaatggaatcagaaggtatctttagcccttccgagctggagacccccaacctggccgagcgggtgctggactggctggagaagtacggcgtggagcgcctaaagcggatggccatttcgggggatgactgcgtcgtgaagcccatcgatgatagattcgctaccgccctcaccgcccttaacgacatggggaaggtgcgtaaggacatcccccagtgggagcccagcaaaggatggaacgactggcagcaggtcccgttttgcagccaccattttcatcagctgataatgaaggacggccgcgagatcgttgttccgtgccggaaccaggatgaattggtcggccgcgcacgggtgtcacagggcgccggttggtctctgcgcgagaccgcttgcttgggtaagagttacgcccagatgtggcaattgatgtacttccaccggcgcgacctgaggttagcagccaacgcgatatgttcagccgtgcccgtcgactggatccctacgagccgcactacctggtccatccacgcccaccaccagtggatgaccaccgaggacatgctctcggtgtggaaccgagtttggattgaggagaacccctggatggaagacaagacgcacatctccagctggggcgacgtcccttacctgggcaagcgcgaggaccagtggtgcgggtccctgatcggcctcacagctcgcgccacctgggcgaccaacatccaggttgccatcaatcaggtccggcgcctgatcgggaacgaaaactatttagactacatgaccagtatgaagcggttcaaaaacgaatccgatcccgagggcgctctctggtga

SEQ ID NO: 24621 - RNA, 9879 nt, synthetic construct
  misc_feature 1..9879: note = derived and/or modified CDS sequence (opt11) from DENV-1__JQ045633__SS-prME
  source 1..9879: mol_type = other RNA
tctgtgaccatgctgctcatgctgatgcccaccgccctggccttccacctgaccacgcggggcggggagccacacatgatcgtaagcaaacaggagcggggtaagagcctgttgtttaagacctccgccggggtgaacatgtgcaccctgatagccatggacctgggcgagctgtgcgaagatacgatgacatataagtgccctcgtatcacggagaccgagccggacgacgtggactgctggtgcaacgctacggacacctgggtgacttacggaacctgtagccaaacgggcgagcatcggcgggacaagcggagcgtggccctcgcaccccatgtggggttggggctcgaaaccagaaccgaaacctggatgagctccgagggcgcctggaagcagatccagcgggtagagacgtgggccctacggcatccggggttcaccgtgatcgccctattcctagcccacgcgataggaaccagcatcacgcagaaggggatcatcttcattctcttgatgctggtgacaccctcaatggccatgcggtgtgtcggtataggcagccgcgacttcgtggaggggctctcaggcgccacctgggtggacgtcgtgctggagcatgggagctgcgtaaccacgatggccaaagataagccaacgctggacatagagctcttgaagaccgaggtaacaaaccccgccgtcttacggaagttatgcatcgaggcgaagatctccaataccacgaccgacagccgctgccccacccaaggcgaggccaccctagtggaggaacaggacgcgaacttcgtctgccggcgcacgttcgtggatcgggggtgggggaacggctgcgggctgttcggcaaaggaagcctgatcacgtgcgccaagttcaagtgcgtgaccaagctggagggcaaaatcgtgcagtacgaaaacctgaagtactccgtgatcgtgaccgtccatacgggcgatcagcaccaagtagggaacgagagcaccgagcatggcaccaccgccacaatcacgccccaggcgcccactaccgagattcagctagccgattatggggccctgaccctggactgcagcccccgcacggggctagactttaacgagatggtcctgctcacgatgaaggaaaagtcttggctcgtccataagcagtggttcttagacctgccgctaccctggacctcaggtgccagtacctctcaggagacgtggaaccggcaagacctgttagtcacattcaagactgcccatgcgaagaaacaggaggtcgtggtcctcggtagtcaggagggagccatgcacactgccctgacgggagcaaccgagattcagacaagtggcaccacgaccatcttcgcaggccacctgaagtgtcgcctcaaaatggacaagctgaccttgaaaggcatgagctatgtcatgtgcaccgggtccttcaagctcgagaaggagctggcggagacgcaacacggcaccgtgctggtgcagatcaagtatgaagggaccgatgccccctgcaagatacctttctcgacccaggacgagaagggggtcacgcagaatggccggctgataactgcaaacccgatagtgaccgacaaggagaagcccgtgaacatcgaggctgagccgccgttcggggagtcctacattgtcataggggcaggcgagaaggcgctaaaactgagctggtttaagaaggggagtagcatcggcaagatgttcgaggccaccgcccgcggcgctcggcgcatggcgatcctgggtgatacggcctgggacttcgggagtatcggcggagtgttcaccagcgtgggaaagctcgtccaccagatctttggcgccgcctacggggtgctgttctccggtgtgtcttggaccatgaagatagggatcggcgtgctgctgacttggctgggccttaactcccgcagcacgtctctcagtatgacctgcatagccgtggggctggtgactctatacctcggcgttatggtgcaggcggactccgggtgcgtgatcaactggaagggccgggagctgaagtgcggaagcggcatcttcgtcaccaacgaagtacacacgtggaccgagcagtacaaatttcaggccgacagtcctaaacggctgtcggccgccataggtaaagcctgggaggaaggggtctgtggcatccgaagcgcgacacgcctcgagaacatcatgtggaagcagatcagcaatgagctgaaccacatccttttggagaatgacatgaagttcaccgtcgtggtcggcgacgtcgccggtatcctcgcccaggggaaaaagatgatccggcctcagcccatggagtacaagtacagctggaagagctggggcaaggcgaagatcataggggcggatgtgcaaaacaccactttcataatcgacgggcaaaacacccccgagtgcccggacgaccagcgggcctggaacatttgggaggtggaggactatggcttcggcatcttcaccaccaacatatggctgaagttacgggacagctacacccaggtctgcgatcaccgcctgatgtccgccgccatcaaagacagcaaggccgtgcacgcggacatgggctattggatcgagtccgagaagaacgaaacatggaagctggcccgggccagcttcatcgaggttaagacctgcatctggccgaagtcccataccctctggagcaacggcgtcctggagtccgagatgatcatccccaagatctacgggggccccataagccagcacaactaccgccctgggtacttcacgcagaccgccggaccctggcacctggggaagctcgaactggacttcgacctatgtgagggcactaccgtggtagtagacgagcactgcggcaatcgggggccctccttgcgcacgaccaccgtgacgggcaagatcatccacgagtggtgctgccggagctgtacgctgccgcccctgcgcttccgcggtgaggacggctgctggtatgggatggagatacgccccgtgaaggaaaaggaggagaacctcgtcaagtccatggtgagcgccggctctggagaggtagattcttttagcctcgggttgctctgcatctccatcatgatcgaggaggtcatgcggagccgatggtccaggaagatgctgatgaccggcaccttggctgtgttcctcctgttgatcatgggtcagttgacctggaacgacctcatcagactttgtatcatggtaggcgcgaacgcctccgacaggatgggcatgggcacgacgtacctggcgctgatggctacctttaagatgcgtcccatgtttgctgtcggcctgctgtttcgccggctgacctcccgcgaggtgctcctccttacgatagggctgagcctcgtggcctccgtcgagctgccgaatagcctggaggagttaggcgacgggctggccatgggcatcatgatcctgaagctcctaaccgactttcagtcccaccagctgtgggccacactgctgagcctgaccttcataaagaccacattctcactccactacgcgtggaagaccatggccatggtactgagcatcgtctccctattccctctctgtctgagcaccacgtcccagaagaccacctggctgcccgtgctcctgggcagcttaggttgtaagcctctcactatgttcctgatcgccgagaacaagatctggggccgccgcagctggccgctgaacgaggggataatggccgtggggattgtcagcatcctcctcagctccctactcaagaacgatgtgccgctggccggtcccctcatcgcgggcggcatgcttatcgcctgctacgtgatctctgggtccagcgccgatctttccctggagaaggccgccgaagtcagctgggaggaggaggctgagcattccggcgccagccacaacatcctggtggaagtccaggacgacgggacgatgaagatcaaagatgaggagcgtgatgataccctgaccattttattgaaggctacgctgctggccgtcagtggcgtctaccccttaagcatacccgcgaccctgttcgtgtggtacttctggcaaaagaagaagcagcgcagcggggttctgtgggacacgccctccccgcccgaagtggagcgggcggtgctggacgatggcatatatcgcatcatgcagcggggcctcctgggacgttcgcaagttggcgtcggtgtgtttcaggaaaatgtgttccacacaatgtggcacgtgacccggggcgccgtacttatgtaccaagggaagcgcttggaaccgagctgggcctccgtaaagaaggatctgatcagctacggcggcgggtggagactgcagggcagttggaacaccggggaggaggtccaggtcatcgcggtcgagcccggcaaaaaccccaaaaacgtgcaaacggcgcccggcaccttcaagacccccgagggagaagtgggcgcgatcgccctcgacttcaagccagggaccagcggctctccaatcgtaaaccgcgaagggaagatcgtcggcctgtacggcaatggggtggtcacgaccagcggtacgtacgtatccgccatcgcccaggcgaaggtgtcccaggaagggcccctgccggagatcgaggacgaagtcttccggaaacgcaacctcacaattatggacctgcaccccggcagcgggaagacccggcgatacctgcccgccatcgtgagggaggccatcaagcgcaagctcagaaccctgatcctggctcccacccgagtggtagcctccgaaatggcagaggccctcaaaggcatgcccatccgctaccagaccaccgccgtcaagagcgagcacaccggcaaggagatcgttgatctgatgtgccacgccaccttcactatgcggttgctttcccccgttcgcgtgcccaattataacatgatcataatggatgaggcgcacttcacggacccgagctcaatagcggccaggggttacatcagcacccgggtgggcatgggggaggccgccgccatcttcatgactgcgacaccgcctggctccgtcgaggccttcccccagagcaatgccgtgatccaggacgaggaacgggacatccctgagaggtcctggaactcggggtacgaatggataacggacttcccgggcaagaccgtgtggttcgtcccgtctatcaagagcggcaacgacatcgctaactgcctgagaaaaaatgggaaacgcgttatacagctgtcgcggaagacgttcgacaccgaataccaaaagactaagaacaatgattgggactatgtggtcacaacggacatcagcgagatgggcgcgaacttccgcgctgaccgggttatcgacccccggcggtgtttgaagccggttatcctgaaagacggtcctgagcgagtcatcctggccggccccatgcccgtaacggtcgcctccgccgcacaacggcgtggtcggatcggccgcaatcacaacaaggaaggcgaccagtacatctacatgggacagccgctcaacaacgacgaggaccacgcccactggactgaggcaaagatgttgctagacaatatcaacacccccgagggtattatccccgccctttttgagcccgagcgcgagaagtccgccgctatcgacggggagtaccggctgcgcggcgaggctagaaagacgttcgtggagctgatgcgccggggtgacctcccggtgtggttatcctacaaggtcgccagcgagggattccagtacagcgatcgccggtggtgcttcgacggcgagcgcaacaaccaggtgctagaggagaacatggatgtggagatctggacgaaggagggggagcggaagaagctccgcccccggtggctcgatgcccgcacgtactccgaccccttagcactccgtgagtttaaggaattcgcggccggcaggcggagcgtatccggggacctgatcttggagatcggcaagctaccacagcacttgacccagagagcccagaacgccctggacaacctcgtcatgttacacaacagcgagcagggaggtcgggcatacaggcatgccatggaggaacttccagacaccatcgagactctaatgctgctggccctcatcgccgtgctgacaggcggggttacgctgttctttctctccggccgcgggctgggcaaaacttcgatcggacttctatgcgtgatggcctccagcgtgctgctgtggatggcgtccgtggagccccactggatcgccgcgagtatcattctcgagttctttctgatggtgctgctgatccccgaacctgaccgccagagaaccccgcaggataatcagctggcgtacgtggttatcgggctcctgttcatgatcctgacggtggccgcaaacgagatgggcctgttggagacgactaagaaggacttagggattggccacgtggccgtcgagaatcaccaccacgccgcgatgctggacgttgacctccaccccgcttccgcgtggactctgtacgcggtagccaccacgataataactccgatgatgagacacaccattgagaacactacggccaatatcagcctgaccgccattgcgaaccaggccgccatcttgatggggctggacaagggctggcctatctccaagatggacatcggcgtgcccctgctcgccctggggtgctattctcaggtgaaccccttaaccctcaccgcggcagtgctgatgctggtcgcccactacgccatcatcggccccggtctccaggcaaaggcgacgcgcgaagcccagaagcgtaccgctgccggcatcatgaagaatcccaccgttgacggtatcgttgccatcgacctcgacccggtcgtgtacgacgcgaagttcgagaagcaattaggccagatcatgcttctaatactgtgtacctcccagatcctcctgatgaggacgacttgggccctgtgcgagtcgataacactcgccaccgggcccctgacgaccctgtgggaagggtcccccggcaagttctggaacaccaccatagctgtgagcatggctaatatcttccggggttcctaccttgcgggagccggcctggccttcagcctgatgaaatccctcggaggcgggcgccggggcacgggagcccagggcgagactctgggcgaaaagtggaaacgacagctgaaccagctctccaagagcgagttcaacacgtataagcggtccggaatcatggaggtcgatcgcagcgaggcgaaggagggcctgaagcgtggtgagaccacgaagtacgccgtatcccgcggcacggccaaactacggtggttcgtggagcgcaacctggtcaagcctgaggggaaggtgatagacctcggttgcggccgggggggctggtcctactactgcgctggtctgaagaaggtgacagaggttaagggttacaccaagggcggcccgggccacgaggagccgattcccatggccacgtacgggtggaacctcgtgaagctccactccggaaaagacgtgttcttcgtgccgcccgagaagtgcgacaccctcctttgcgacattggggagagctcccccaaccccactatcgaggaaggcaggaccctccgggtgctgaaaatggttgagccgtggctgcgcgggaaccagttctgcatcaagatcctcaacccctacatgccctcggtagtggaaacgctggagcagatgcaacggaagcacggtggcatgctggtgcgcaaccccctctcaaggaacagcacccacgagatgtactgggtctcctgcgggaccggcaacatcgtgagtgcggttaacatgacctcccgcatgctgctgaaccgcttcacaatggcccaccggaagccgacgtacgagcgcgacgtcgacctcggggcgggcacccggcacgtcgcggtggagccggaggtcgccaacctggacataatcggccagcgcattgaaaacatcaaacacgaacataagagcacatggcattacgacgaagacaatccctacaagacctgggcataccacgggtcctacgaggtgaagcccagcggctccgcctctagcatggtcaacggggtagtgaagctgctcaccaagccgtgggacgtcattcccatggtaactcagatcgccatgaccgacaccacgcctttcggccaacagcgggtgttcaaggagaaggtcgacacaagaacgcccaaggccaagaggggtaccgcccagattatggaggtgacggcgaagtggctgtggggattcctgtcgcgcaacaagaaaccgcggatctgtacgcgcgaggagtttacccggaaggtgcgcagcaatgccgccatcggcgccgtattcgtggacgagaaccagtggaactccgcgaaggaggccgtagaggacgaacgcttttgggacctcgtccaccgcgagagagagctgcacaagcaggggaagtgcgctacctgcgtgtacaacatgatgggcaaacgggagaagaagctgggggaattcggcaaggctaaggggagccgggccatctggtacatgtggttaggcgcgcgcttcctggagttcgaggccctcggcttcatgaatgaggaccattggttcagccgggaaaactccctcagtggtgtggagggcgagggtctgcacaaactgggctacatcctccgcgatatctcaaagatccccgggggcaatatgtatgcggatgatactgccggctgggacacacggatcacggaagacgacttgcagaatgaggcccgcataaccgatatcatggagcccgagcacgcgcttttagccaagtccatctttaagctgacgtaccagaacaaggtcgtgcgcgtgcagcgtccggccaagaacggcaccgtcatggacgtgataagccgccgggaccagcgcggcagcggccaagtgggtacatacggactgaacacctttacgaacatggaggcccagctcatccggcaaatggagtcggaggggatcttttccccctccgaattagagactcccaacctggccgagagggtcctcgactggttggagaaatacggcgtggagcggctgaagcgcatggctatctccggagatgactgcgtggttaaacccatcgatgatcggttcgccaccgccttgaccgccctgaacgacatgggcaaggtgcgcaaagacatcccgcagtgggagcccagcaaggggtggaacgattggcagcaggtccccttctgctcccaccacttccaccaactgatcatgaaggacggacgcgagatcgtcgtgccatgccgcaaccaagatgagctcgtgggacgggcccgagtaagtcaaggggcggggtggagcttgcgggagacagcatgcctggggaagtcctatgcccagatgtggcagctcatgtactttcaccgccgcgacctgcgactggccgcaaacgcgatctgtagcgccgttccggtggactggattcccaccagccggactacttggagcatccacgcccaccaccagtggatgacgaccgaggatatgctgtccgtatggaacagagtgtggatcgaggagaacccctggatggaagacaagacccacatcagctcctggggcgacgtgccctacttggggaagcgagaggaccagtggtgcggcagcttgatcggtcttaccgcccgggcgacatgggccacgaacatccaggtcgcgatcaaccaggtgaggcggcttatcggtaacgagaactacctggattacatgacatccatgaagcgcttcaagaacgagagcgatccggagggcgcactctggtga

SEQ ID NO: 24622 - RNA, 9879 nt, synthetic construct
  misc_feature 1..9879: note = derived and/or modified CDS sequence (opt11) from DENV-1__JQ045634__SS-prME
  source 1..9879: mol_type = other RNA
agcgtgactatgctgctgatgttaatgcccaccgcactggctttccatctcacgacgcggggcggggaaccacacatgatcgtgagcaagcaggagcggggcaaaagcctgcttttcaagacgagcgccggggtgaatatgtgcaccctcatcgccatggatctgggcgagttgtgcgaggataccatgacctacaaatgcccccggataactgagaccgagcccgatgatgtagactgctggtgcaatgccaccgacacctgggtgacctacggaacgtgcagccagacgggcgagcaccggcgtgacaaacggagcgtcgccctcgcgccccatgtgggcctgggactggagacccgcaccgagacctggatgagctccgagggcgcctggaagcagatccagcgggtggagacgtgggctctccggcatcccgggtttaccgtgatcgccctgtttctggcccatgcgataggcaccagcatcacgcagaaggggataatattcatcctcctgatgctggtcaccccctccatggcgatgcggtgcgttggcatcggcagccgcgactttgttgagggcttatcgggcgcgacctgggtagacgtcgtgctggagcacggaagctgcgtgaccaccatggccaaggacaagcccacgttagatatcgagctcctgaaaacggaagtcaccaacccagccgtgctgcggaagctctgcatcgaggcgaagatctccaacaccactaccgacagccgctgccccacccagggcgaagccactctggtcgaggagcaggacgcgaacttcgtctgcaggcgcacgttcgtggaccggggttgggggaatggctgcgggctgttcggcaaggggtccctcatcacgtgcgcgaagtttaagtgcgtgaccaaacttgaaggtaagatcgtgcagtacgagaatctgaagtacagcgtgatcgtgacggtccacacgggggaccaacaccaggtggggaacgagtccacagagcacggcacgaccgccaccatcacgccccaggcgcccactacggagatccagctcgccgactacggggccctgaccctggactgtagcccccgtacgggcctcgactttaatgagatggtcctgttgaccatgaaggaaaagtcatggttggtgcacaagcagtggttcttagacctaccgctcccctggaccagcggggcatcaacctcgcaggagacgtggaaccggcaggacctgctggtgaccttcaagaccgcccacgcgaagaagcaggaggtcgtggtgctcggcagccaggagggcgccatgcatacggccctcacgggggccacggagatccaaaccagcggcaccacgaccatattcgcggggcacctgaagtgcaggctcaagatggacaagctcaccctgaaggggatgagctacgtcatgtgtaccggatccttcaaactcgagaaggaactagcggaaacgcagcacggcaccgtgctggttcagatcaagtatgagggcaccgatgccccctgtaaaatccccttcagcacacaggacgaaaagggcgtcacgcagaacggccggctgatcacagccaacccaatcgtgaccgacaaggagaagcccgtgaacatagaggccgagccgcccttcggggagtcctacatcgtcatcggcgcaggcgagaaggccctcaaacttagctggttcaagaaggggtccagcatcggcaagatgttcgaggccaccgcccgcggggccaggcgcatggcgattctgggcgacacggcctgggactttgggtccatcggcggcgttttcactagcgtggggaagctcgtccaccagatcttcggcgccgcctacggcgtgttgttctcgggcgtcagctggaccatgaaaatcgggataggcgtactgctaacctggctgggcctgaactctcgcagcacgtccctctcgatgacctgcatcgccgtggggctggtgaccctgtacctcggcgtcatggttcaggcggactccggctgcgtaatcaactggaagggcagggaactgaagtgcgggtccggcatattcgtcaccaacgaagttcacacttggacagagcagtacaagttccaggccgatagcccgaagcgcctgtccgccgcaatcggaaaggcctgggaggagggagtttgtgggatcagaagcgcgacccgcctcgagaacatcatgtggaagcaaatctccaacgagctgaaccacatcctgctcgagaacgacatgaagttcaccgtggtggtgggcgacgtcgccggcatcctggcccaaggcaagaagatgatccggccccagcccatggagtacaagtactcgtggaagtcctggggcaaggccaagatcatcggcgcggacgtgcaaaacaccacgttcatcatcgacgggcagaacacccccgagtgtccggacgaccagcgcgcctggaacatctgggaggtcgaggactacggcttcgggatcttcaccaccaacatctggctgaaactccgggacagctacacgcaggtctgcgaccaccgcctgatgtccgccgcaataaaagacagcaaggccgtgcacgcggacatgggctactggatcgagagtgaaaagaacgagacttggaagctggcacgggccagctttattgaggtgaagacgtgtatctggcccaagtcccacacgctctggagcaatggggtcctagaatccgagatgatcatccccaagatctatgggggccccatcagccaacacaactaccgcccggggtacttcacgcaaaccgccggcccctggcacctggggaagctcgagctcgacttcgacctgtgtgagggcactaccgttgttgtcgacgagcactgcggtaaccgggggccctccctccgcacgactaccgtgacggggaagatcatccatgaatggtgttgccggagctgcacgctgccacccctgcgcttccgcggtgaggacggctgctggtacgggatggaaatccgccccgtgaaggagaaggaggagaacctcgtcaagtccatggtaagcgccggctctggcgaggtcgattctttcagcctggggcttctctgcatctccatcatgatcgaggaggtgatgcgtagccgctggtcccggaagatgctgatgaccggcaccctggcggttttcctccttcttatcatggggcagctcacctggaacgacctgatccgcttatgtataatggtgggggccaatgccagcgaccgcatggggatgggcacgacctacctcgccctaatggccaccttcaaaatgcggcccatgtttgcggtggggctcctgttccgccggctgacgtcccgcgaggtactgctcctgacgatcgggctgagcctcgtggcgtccgtcgagctccctaatagtctggaggaactcggcgacgggctggccatgggcatcatgatcctgaagctcctgaccgacttccagtcccaccagctgtgggccacgctactgagcctgactttcatcaagacgaccttctccctacactacgcgtggaagacaatggccatggtgctctcaatcgtctccctgtttcccctctgcctgagcactacctcccagaagaccacctggttgcccgttctcctgggcagtctggggtgcaagcctctcaccatgttcttaatcgccgagaacaaaatctggggccgtagatcctggccgttgaacgaggggataatggccgttggcatcgtcagcatcctcctgagctcccttctcaagaacgacgtgcccctggcaggaccccttatcgcgggcggcatgctcattgcctgctacgtgatcagcgggtccagcgccgatctgtctctggagaaggccgcggaggttagctgggaggaggaggcggagcactccggcgcgagccacaacatccttgtagaggtacaggacgacgggacgatgaaaatcaaggacgaggagcgggacgacaccctgaccatactgctcaaggccacactgttagccgtttccggcgtgtacccccttagcataccagcaaccctgttcgtgtggtatttttggcagaagaagaagcagcgctcaggggtcctgtgggacacgccctccccgcccgaggtcgagcgggcggtacttgacgacggcatataccgcatcatgcagcggggcctactggggcgttcccaggtcggagtgggcgtgttccaggaaaacgtcttccacaccatgtggcacgtgacccggggagccgtactgatgtatcaagggaaacggctcgagccgagttgggcctcagtgaaaaaggacctgatcagctatggcggtggttggcggctgcagggctcctggaacaccggtgaggaggtccaggtgatcgcagtcgagcccgggaagaaccccaagaacgtgcaaacggcccccgggaccttcaagactccggaaggtgaggtgggcgctatcgcccttgacttcaaaccggggacaagcggctcccccatcgttaaccgagaggggaagatcgtcggcctgtacggcaacggggtggttactacaagtggaacgtacgtgagcgccatcgcacaggcgaaagtatcccaggaggggcccctaccggagatcgaagacgaggtcttcagaaagagaaacctcaccatcatggacctgcaccccggcagcgggaagacgcggcgctacctgccagctatcgtgcgggaagccatcaagcgaaagctcagaactctgatcctggctcctacccgagtggtcgcctctgagatggcagaggctctaaagggaatgcccatccgctaccagaccacggccgtcaagagcgagcacaccggcaaggagatcgtggacctgatgtgccacgccacctttaccatgcggctgctctcacccgtccgcgtgcccaactacaacatgatcattatggacgaggctcacttcacggatccgagcagcatcgcggcacgggggtacatatcgacccgcgtgggcatgggggaggccgccgcaatcttcatgaccgccacgccgcccggctcagttgaggccttccctcagtcgaacgccgtgatccaggacgaggagcgggacatcccggagcgttcctggaactctgggtacgagtggatcacggacttccctgggaaaaccgtgtggttcgtcccctccatcaagagcggcaacgacatcgccaactgcctgcggaagaacgggaaacgagtgatccagctgtcccgtaagaccttcgacaccgaataccagaagacgaagaacaacgactgggattacgtggtcaccacagacataagcgaaatgggcgcgaacttccgcgccgaccgggtgatcgacccccgtcggtgcctcaagccggtgatcctgaaggacgggccagagcgcgtcatcctggcgggacccatgcccgttacagtcgcgtccgccgcgcagaggagggggcggatcggccgcaaccacaacaaggaaggcgaccaatacatttacatggggcagccgctcaacaacgacgaggaccacgcccactggacggaggccaagatgctgttggacaacattaacacccccgagggcataatcccagccctcttcgagcccgagagggagaagtccgccgcaatcgacggggagtaccggctgcgcggcgaggcgcggaagaccttcgtggagctgatgcgccgcggggacctccctgtgtggctgtcctacaaggttgcatctgagggcttccagtattcagaccgccggtggtgcttcgacggcgagcgcaacaaccaggtgctggaggagaacatggatgtggagatttggaccaaggagggggagcgtaagaaactccgtccacgatggctggacgcgcgtacgtactccgatcccttagccctccgggagttcaaggaatttgcggccggccgccggagcgtctcgggcgacctgattctggagatcggcaaactcccccagcacttaacccagcgcgcccagaacgccctggacaacctcgtgatgctgcataactccgagcagggcgggagagcgtaccgacacgccatggaggagctgccggataccattgagaccctaatgctcctggcactcatcgccgtgctgacaggcggggtcacacttttcttcctctccgggcgggggctcggcaaaaccagcatcggcctgctttgcgtaatggcctcgagcgtgctgctgtggatggcttccgtcgagccccattggatcgccgcaagcatcattctggagttcttcctgatggtactgctgatccccgagcccgaccgccagcggaccccgcaggacaaccagctggcctacgtggtcatcggtctcctgttcatgatactgaccgtggccgcgaacgagatgggcctgctcgagacgaccaagaaggacctggggatcggccacgtggccgtcgagaatcaccaccacgcggccatgttggacgtggacctccacccagcctctgcgtggaccctgtacgccgtggcaaccacgatcataactcccatgatgcgccacacaatcgagaacaccaccgccaacatcagcctgaccgccatcgcgaaccaggccgctatcctcatggggcttgacaaaggttggccgatctccaagatggacatcggggtccctctgctcgccctggggtgttacagccaggtgaaccccctcaccctaacggctgctgtgctgatgctagtcgcccactacgccatcataggacccgggctccaggccaaggccactcgcgaggcacagaagcggaccgcagccgggattatgaagaacccgactgtggacgggatcgtggccatcgacttggaccccgtcgtgtatgacgcgaagttcgagaagcagctggggcagatcatgttactgatcctgtgcacctcgcaaatcctcttaatgcgcacgacttgggccctgtgcgagtcaatcaccctcgcaaccggcccgttgacgaccctgtgggaggggtccccggggaagttttggaacaccaccatcgccgtgtctatggcaaacatattccgggggtcttacctcgcgggcgccggcctagccttcagcctgatgaagtccctcggaggcgggaggcgggggaccggggctcagggcgagaccctaggcgagaagtggaaacgccaactgaaccagttgtccaagagcgagttcaacacctataagcggtccgggatcatggaggttgaccgcagcgaggccaaagagggcctgaagcgcggtgaaaccacgaagtacgcggtgtcacgtggcacggccaagctgcggtggttcgtagagcgcaatctggtcaagccggagggtaaggtgatcgacctcggctgcggtcggggagggtgggcgtactactgcgccggcctaaagaaagtgaccgaggtcaaagggtacactaaaggcgggcccggccatgaggagcccatccctatggctacgtacgggtggaacttggtaaagctccacagcggcaaagacgtgttcttcgtcccgcccgagaagtgcgacaccttgctgtgtgacatcggggagtccagcccgaaccccaccatcgaggagggccgaaccctccgggtgctgaagatggtggaaccgtggctgcgcgggaaccagttttgcatcaagattctcaacccatacatgcccagcgtcgtcgagacgctggaacagatgcaacggaaacatggtggtatgctggtgcgcaaccccctaagccgcaactccacgcacgaaatgtactgggtgagctgcggtaccggcaacattgtatccgccgtaaacatgaccagccgaatgttgctgaaccgcttcactatggcccaccggaagccaacatacgaaagagacgtcgacttgggggcgggcacccggcacgtggccgtagagccggaggtcgcgaacctggatatcatcggccagagaatcgaaaacatcaagcacgagcacaagtccacgtggcactatgacgaggacaacccctacaagacctgggcctaccacgggtcctacgaggtgaagccctccggcagtgcgtccagcatggtcaacggggtggtgaagctgctcactaagccgtgggacgtcatccccatggtgacccagatagccatgactgacaccacgcccttcggccagcagagagtgttcaaggaaaaggtcgacacacgcacccccaaggccaagcgggggaccgcgcagatcatggaggtcacggccaagtggctgtggggctttctgagccgcaacaagaagccgcggatctgcacccgcgaggagttcacccgcaaggtgaggtccaacgccgccatcggtgcggtcttcgtggacgagaaccagtggaactctgccaaggaggccgtagaggacgagcggttttgggatctcgtccaccgcgagcgggagctgcacaagcaggggaagtgcgcgacctgtgtgtacaacatgatgggcaagcgcgagaagaagctgggtgagttcggcaaggccaaagggtccagagcaatctggtacatgtggctcggcgcccgcttcctggagttcgaagccctggggtttatgaacgaggaccactggttctcacgggagaactccctcagcggagttgagggagaggggttgcacaagttaggctacatcctcagagacatctccaaaatacctgggggcaacatgtatgccgatgataccgcaggatgggacacccgcataaccgaggacgacctgcagaacgaggcgcggatcaccgacatcatggagccagagcacgccctcctcgcgaagtctatcttcaagctgacgtaccaaaacaaggtcgtgcgcgtgcaacggccggctaagaacgggaccgttatggacgtgatctcccgccgggatcagcgcggcagcggacaggtgggcacctacggcctcaacacattcacgaacatggaggctcagctgatccggcagatggagtccgaggggatcttttccccatccgaactggagacccccaaccttgcagagcgcgttctcgattggttggagaagtacggtgtggagcggctgaaaagaatggccatcagcggggatgactgcgtggtcaagcccatcgacgaccggttcgccacagccctcaccgccctaaacgacatggggaaggttcgcaaggatattccgcagtgggagccgtccaaggggtggaacgactggcagcaggtccctttctgtagccaccacttccaccagctgatcatgaaggacggccgggaaatcgtagtgccctgcaggaatcaggatgaattagtgggccgggcacgcgtatcccaaggggccggctggagcctgcgggagacagcctgtctggggaaaagctacgcccagatgtggcagctcatgtacttccaccgccgtgacctgagactggcggccaacgccatctgcagcgcagtaccggtggactggatcccgacctcgagaaccacctggtccatccacgcccaccaccagtggatgacaaccgaggacatgttatcggtctggaaccgagtgtggattgaggagaacccatggatggaggacaagacccacatctcctcttggggtgacgtgccctacctgggcaagagagaggatcagtggtgcggctctctgatcggcctcaccgcgcgggccacgtgggccacgaacatccaagtcgccatcaaccaggtgcgccggctgatcggcaacgagaactacctggactatatgacctccatgaagcgcttcaagaacgagtccgatccggagggcgccctctggtga

SEQ ID NO: 24623 - RNA, 9879 nt, synthetic construct
  misc_feature 1..9879: note = derived and/or modified CDS sequence (opt11) from DENV-1__JQ045636__SS-prME
  source 1..9879: mol_type = other RNA
tcagtgaccatgctgctcatgctgatgcccaccgcccttgccttccacctcacgacccgcggcggggagccccatatgatcgtgagcaagcaggagcggggcaagagcttattgttcaagacctctgccggggtgaacatgtgtacactcatcgccatggacctgggtgaattctgcgaggataccatgacctacaagtgcccccgcatcaccgaggctgagcccgatgacgtggattgctggtgcaacgccaccgatacttgggtcacttacgggacctgctcccagaccggcgagcaccggagagacaagcggtccgtggccctggcgccccacgtggggctcgggctggagacgcgaaccgaaacctggatgagctccgagggcgcctggaagcagatccagcgggtcgagacctgggccctgcgccaccccgggttcacggtgatcgctctctttctggcgcacgccatcggcaccagcatcacccaaaaggggatcatcttcatcctgctcatgttagtcaccccctccatggccatgcggtgcgtcggcatcggctctagggacttcgtcgaagggctgtccggtgccacgtgggtggacgtcgtgctcgagcacgggagctgcgtcaccacaatggccaaggacaagcccaccctggacatcgagctcttaaagacggaggtcaccaaccccgcggtgctgcggaagctgtgtattgaggccaaaatcagtaacaccaccacggacagccgctgcccgacccagggcgaggccacgctcgtggaggaacaggacgccaacttcgtctgtcggcgcactttcgtggaccggggctgggggaacggctgcgggctgttcggcaaggggtccctgatcacgtgcgccaagttcaagtgcgtgaccaagctcgagggcaagatagtccagtacgagaatctgaagtacagcgtgatagtaaccgtccataccggggaccaacaccaggtcgggaacgaatccacggagcacggcaccatcgcgaccatcacaccccaggccccctcaactgaaatccagctgacggactatggggccctcacgctggactgcagcccgcggactggcctggacttcaacgaaatggtcctcctgaccatgaaggagaagagttggctcgttcacaagcaatggttcctggacttgccgctgccctggacgagcggggcctccaccagccaggagacctggaaccgccaggacctcctggtgacctttaagacggcccacgcgaagaagcaggaagtggtggtgttaggcagccaagagggcgccatgcacaccgccctcactggggccaccgagatccagacgagcggcaccaccacgatattcgccgggcacctgaagtgtcgcctgaagatggacaagctcacgcttaaaggcatgtcctacgtcatgtgtactgggagcttcaagctggaaaaggaggtggcggagacccagcatggcaccgtgctggtccagatcaagtacgaaggcacggacgcgccctgcaagatccctttctccacccaagacgagaagggagctacccaaaacggccggctgatcaccgccaaccccatcgtgacggacaaagagaagcccgtgaatatcgaagcggagccccccttcggggaaagctacatcgtcatcggtgccggcgagaaggccttgaagctgtcctggttcaagaaggggagctccatcggcaagatgttcgaggcaacagcccgaggagcgcggcgcatggcgatcctcggcgacaccgcctgggacttcgggtccatcggcggcgtattcacctccgtggggaagttagtccaccagatattcggaacggcctacggggtgctgttctccggtgtgtcctggaccatgaagatcgggatcggtgtcctcttaacatggctgggcctgaacagtcgctccacaagcctgtccatgacgtgcatcgccgtggggctggtaacactctacctgggtgtcatggtgcaggcggatagcgggtgcgtcatcaactggaagggccgggagctgaagtgcgggagcggcatcttcgtcaccaacgaggtccacacctggacggagcagtacaagttccaggcagacagccctaagagattgagcgccgccatcggaaaggcctgggaagaaggggtgtgcggcatccggtccgcgacccggctggagaacataatgtggaagcaaatctccaatgagctgaaccatatcctcctggagaacgacatgaagctgaccgtcgtggtgggggacgtcgcaggtatcttagcccaggggaagaagatgatccggccccaacccatggagtataagtactcctggaagtcctggggcaaggccaagatcatcggcgcggacgtgcagaacactaccttcataatcgacgggcccaacacgcctgagtgccctgacgaccagcgggcctggaacatctgggaggtggaggactacgggttcgggatcttcactaccaacatctggctgaagctccgggactcctacacccaggtctgcgaccatcgcctcatgagcgcagccatcaaggacagtaaggccgtgcacgctgatatgggctactggatcgagtctgagaagaatgagacgtggaagctagctcgggcctccttcatcgaggtaaagacctgcatatggcccaagagccacacgctgtggtcgaacggcgtcctcgagtcagagatgatcatacccaaaatctatgggggccccatctcccagcacaactatcgccccgggtatttcacccagacggccggcccatggcacctggggaagctggagctcgacttcgatctgtgcgaaggcaccacggtggtggtcgacgagcactgtggcaaccgggggccgtcgctacgcaccacgaccgtgaccggcaagatcatccacgagtggtgctgccggtcctgcacgttgccgcccctccgcttcaagggggaggacggctgctggtacgggatggaaatccggccggtgaaggagaaggaggagaacctagtcaagagcatggtgagcgccggttccggcgaggtggacagcttctccctcgggctgctgtgcataagcatcatgatcgaggaggtcatgcgctcccggtggagccgcaagatgctcatgacgggcaccctggcggtgttctttttactgatcatggggcagttaacttggaacgacctgatccggctctgcatcatggtgggggccgacgcctccgaccgcatggggatgggcaccacctacttagccctgatggccacattcaagatgcgcccgatgtttgcggtcggtctgctgttccgaaggctgaccagccgggaggtgctcctgctgaccatcgggctctccttagtggcttccgtcgagctgcccaactccttggaggagctgggcgatgggctggccatgggcatcatgatcctcaaactgctgacggacttccaaagccaccaactctgggccaccctgttgagtctcaccttcatccgcactacgttcagcctgcactacgcatggaaaacaatggccatggtgctgtctatagtcagcctcttcccgctgtgtctgtccaccacttcgcagaagacgacctggctcccggtgctgctgggctctctagggtgcaagccactgaccatgttcctaatcgccgagaacaagatctggggccgcaagtcgtggcccctcaacgaggggatcatggccgtaggcatcgtctcgatccttctgtccagcctcctgaagaacgacgtgcccctggcggggccccttattgcgggcggcatgctcatcgcctgctacgtcatttcggggagcagcgccgacttgtctctagagaaggccgccgttgtgtcctgggaggaggaagccgagcacagtggagcctcccacaacatcctagtggaggtccaggacgacgggaccatgaaaatcaaggacgaggaacgcgacgacacactgaccattctcctgaaagcgaccctgctcgccgtaagcggcgtttacccactgagcatccccgccacgctcttcgtctggtatttctggcagaagaaaaagcagcggagcggggtgctctgggatacccccagtccgccggaggtggagcgcgcggtactggacgacggcatctaccggataatgcagcgcggcctgctggggcggtcccaggtaggcgtgggggtcttccaggagaacgttttccacacaatgtggcacgtgacccgcggagccgtcctcatgtaccagggcaaaaggctggagccttcgtgggccagcgtgaagaaggacctgatctcctacgggggcgggtggcgtctccagggctcatggaataccggtgaggaagttcaggtcatcgcggtggagccagggaagaatcccaagaatgttcagaccgcccctgggacgtttaagacgtccgagggcgaggtgggcgcaatcgcgctggacttcaagcccggcaccagcggcagccccatcgtgaacagggaggggaagatcgtgggcctgtacgggaacggggtcgtgaccacatccggcacctacgtgagcgcgatagctcaggcgaaggcttcccaggaggggcccttaccagagatagaggacgaggtcttcagaaaacggaacctgacaatcatggacctgcaccccggcagcgggaagacccgccggtacctccccgccatcgtgcgcgaagccatcaagcggaagctgcgcacgcttattcttgcaccgacccgggtagtcgcgtccgagatggccgaagccctgaaaggcatgcccatacggtaccagaccacagccgttaagagcgagcacacgggcaaggagatcgtggatttgatgtgccatgccacctttaccatgcgactcctgtcccccgtccgggtgcctaactacaacatgattattatggacgaggcgcacttcaccgacccgagctccattgctgcccgcggttacatcagcacgcgggtgggcatgggggaggctgccgctatcttcatgaccgcaacgcctcccggttccgtcgaagcatttccccagagcaacgccgtgatccaagatgaggagcgcgatataccggagcggtcctggaatagcgggtacgagtggatcaccgattttccaggtaagacggtgtggttcgtaccctccatcaagagcggcaacgacatcgcgaactgcctgcgaaagaacgggaagcgggtgattcagctctcccgcaagactttcgacaccgagtatcagaaaacgaagaacaatgactgggactacgtggtcacaacagacatcagcgagatgggcgcaaacttccgggcagaccgcgtgattgaccctcggcgctgcttgaagccggtaatcctaaaggacgggcccgagcgggtcatcctcgccggccctatgcccgtgaccgtcgcgtcggcggcacagcgccgggggcgtatcggcaggaaccacaacaaggagggcgaccagtacatttacatgggtcagccgctgaacaacgatgaggatcacgctcactggaccgaagccaaaatgctgctcgacaacatcaacacgcccgaaggcattatccccgctctgttcgacccagagcgcgaaaagtccgcggccatcgacggggagtatcgcctgcggggcgaggcccgcaagacctttgtggaactcatgcggcgcggggacctgccggtgtggctgagctacaaggttgcgtccgagggcttccaatacagcgacagacgctggtgcttcgacggcgagcggaacaaccaggttctcgaagagaacatggatgtggagatctggaccaaagagggcgagcgcaagaagctgagaccccgctggctggacgcccggacctactccgacccactagcgctgcgcgaattcaaggagttcgccgccggccgccgtagcgtctccggggacctaatcttagagatcggcaaattgccccaacacctgacgcagcgggcccagaacgctctcgacaacctcgtgatgctgcacaatagcgagcagggcgggcgcgcctatcgacacgccatggaggaacttccggacaccattgaaaccctgatgctgctcgccttgatcgccgtgctgaccggcggagtcactcttttcttcctgtcaggccgcgggctgggcaaaactagcatcggcctcttatgcgtcatggcgtccagcgtgctcctctggatggcctccgtggaaccccactggatcgccgccagcatcatactggagtttttccttatggtgctactgatccccgagccggacagacagcgcactccgcaagacaatcaactggcctacgtggttatcgggctcctgttcatgatcctaaccgtggcggccaacgagatgggcctcttagaaaccaccaagaaggacctgggaataggccacgtggccgtcgagaatcaccaccatgccgctatgctcgacgtagatctgcaccccgctagtgcgtggaccctctacgcggtagccaccaccatcatcacgcccatgatgcgtcacaccatagaaaacaccaccgccaacattagcctcacggcgattgccaaccaggccgcaatcctgatggggctggacaaaggctggcctatctccaagatggacatcggcgtccccttattagcgttagggtgttacagccaggtgaacccactcaccctgactgctgccgtgttaatgctcgtggcccactacgccatcataggccccggactgcaagccaaggccacccgcgaggctcagaagcgcacggccgcgggcatcatgaagaacccgaccgtggacgggatcgtggcgatcgacctggaccccgtcgtgtacgacgccaagttcgagaagcagcttggccaaatcatgctgctgatcctgtgcacctcccagatattactgatgcggaccacgtgggccctttgtgagagcatcacactggccaccggccccctgaccacgctctgggaggggtccccgggcaagttctggaataccacaatcgccgtgtcgatggcgaacatatttcgcgggagctacctggccggcgcgggcctggccttctcccttatgaagtccctcggcggtgggcggagagggaccggtgcgcagggcgagacgctaggcgagaagtggaagcggcagctcaaccagctctccaaatctgagttcaacacctacaagcgctccggaatcatggaggtcgaccggagcgaagccaaggagggcctgaagcgcggagagaccaccaagcacgccgtgtcccggggcacggctaagctcagatggtttgtggagcgaaacttagtaaagcccgaagggaaggtgatcgacctgggctgcggccgcgggggctggagctattattgcgccgggttgaagaaggttaccgaggtcaagggctacaccaagggtggcccgggacacgaggagcccatcccaatggcgacctacgggtggaacctcgtgaagctccactcgggcaaagatgtgttcttcatcccgcccgaaaagtgcgacactctgctctgcgacattggggagagctcccccaatcccaccatcgaggaaggccggaccctgagagtcctgaagatggtggagccgtggttgcgtgggaaccagttctgcataaagattctgaatccctacatgccctcggtggttgagaccttggagcagatgcaacgcaaacatggcggcatgctcgtccggaaccccctgtcgcgcaacagtacgcacgagatgtactgggtgtcctgcggaaccgggaacatcgtcagcgccgtgaacatgacctcccggatgctgttaaacagatttaccatggcccaccgcaaaccgacctacgagcgggacgtggacctgggagccgggacgcgacacgtcgcagtggaacccgaggtggcgaacttggacataatcggccagcggatcgagaacataaagcacgaacacaagagcacctggcactacgacgaagacaatccgtacaagacctgggcctaccacgggagctacgaggtcaagcccagcggcagcgcgtccagcatggtgaacggggtggtcaagctcctgaccaagccgtgggacgtaatccctatggtcacgcaaatcgcgatgacagacacaaccccgttcggccagcagcgggtcttcaaagagaaggtagacacgcggacccccaaggccaagcgcggcaccgcgcagataatggaggtcaccgctaagtggctgtggggcttcctcagccggaacaaaaagccgcgcatatgcacgcgggaggagttcacccgaaaagtgcggagcaacgccgcaataggggcggtgttcgtcgacgagaaccagtggaactccgccaaggaggctgtggaggatgagcgcttctgggacctggtgcaccgagaacgcgagttacacaagcagggtaagtgcgcgacatgcgtctacaacatgatgggaaaacgggaaaagaagctcggggaattcggcaaggccaagggcagccgagcgatctggtacatgtggctgggtgcccggttcctggagttcgaggccctcggcttcatgaatgaggaccactggttctctcgcgaaaacagcctgtccggggtggagggggaggggttgcacaagctcggctacatcctgagagacattagcaagatccccgggggtaacatgtacgccgatgacaccgccgggtgggacactcgcatcaccgaggacgacctgcaaaacgaggcgaagatcactgacatcatggagcccgagcacgccctcctggccaagtccatcttcaagctgacatatcagaacaaggtggtccgtgtccaacgcccggccaagaatgggacggtgatggacgtgatcagccgccgggaccagcgcggctccggccaagtgggtacctacggcctcaacactttcaccaacatggaggcccagctgatacggcagatggagagcgaggggatcttctcccccagcgagcttgaaactcccaatctcgcgggtagagttctggactggctggagaaacacggggtcgagaggctcaagcgcatggcaatctctggcgatgactgcgtggtgaagcccatcgacgaccggttcgccaccgcgctgaccgccctgaacgacatgggtaaggtacgcaaagacatcccgcaatgggagcccagcaaggggtggaacgactggcagcaggtccccttctgcagccaccacttccaccagttgatcatgaaagacggccgggagatcgtggtaccctgtcgcaatcaggacgagctggtggggcgggcgcgcgtatcccagggcgccgggtggagtctgcgtgagaccgcctgcctcggtaagtcctacgctcagatgtggcagctgatgtacttccaccgccgggacctgcgcctcgcggccaacgccatctgtagcgccgtgccggtcgactgggtacccacgtcccggactacatggagcatccacgctcaccaccaatggatgacaactgaggacatgctgtccgtctggaaccgcgtgtggatcgaggagaacccctggatggaggacaagacccacatctcgtcctggggcgacgtgccatacctgggcaagcgggaagaccagtggtgcggcagcctcatcggcctaaccgcgcgcgccacctgggccacgaacatccaggtcgctatcaaccaggtgagacggctgctaggcaacgagaactatctagactacatgacatccatgaagcgattcaaaaatgaaagcgatccggagggggctctgtggtga

SEQ ID NO: 24624 - RNA, 9879 nt, synthetic construct
  misc_feature 1..9879: note = derived and/or modified CDS sequence (opt11) from DENV-1__JQ045635__SS-prME
  source 1..9879: mol_type = other RNA
tccgtcacaatgctgttaatgctgatgccgacagccttagccttccacctcaccacacggggaggtgaacctcatatgatagtcagcaaacaggagaggggtaagtccctgctgtttaagacctcagccggggtgaacatgtgtaccctcatcgccatggaccttggggagttctgcgaggacactatgacctacaaatgtccccgcatcacagaggccgagcctgacgatgtggattgctggtgcaacgctaccgacacttgggtgacctacggcacctgtagccagaccggcgagcaccggcgagacaaacggtccgtggctctggcgccccacgttggcctaggcctcgaaacccgcaccgaaacttggatgagctctgaaggtgcgtggaaacagatccagagagtcgagacctgggcgctcagacaccccgggttcacggtaattgcccttttcctggcccacgctatcggcacatctatcacccaaaaggggatcatattcattctattgatgttggttaccccctccatggccatgcggtgtgtcggtataggaagcagagactttgtagaggggttgtcaggcgccacatgggtggacgtcgtgctcgaacacggaagctgcgtgactaccatggccaaagacaagcccactctagacatcgagctgctcaagacggaagtaaccaacccggctgttttgcgtaagctgtgcatcgaagccaagatttccaacacaaccacggatagccggtgtcccacacaaggcgaggccacactcgtggaagaacaagatgccaatttcgtgtgcagacgcaccttcgtggaccgcggctgggggaacgggtgcgggctgttcggcaagggctccctgatcacatgtgcgaagtttaagtgcgtgaccaagctcgagggaaaaattgtccagtacgagaaccttaaatacagcgtgatcgtcactgtgcacaccggcgaccaacatcaggtggggaacgagtccactgagcacgggacgatcgcaaccataacgcctcaggcgccttcaaccgaaatccagttaacggattacggcgccttaacattggattgcagcccgaggactggcttagattttaacgagatggtcctcctgaccatgaaggagaagtcctggctggtgcacaaacagtggttcctcgacctgccccttccctggacgtcgggggcgagcaccagccaggaaacgtggaaccggcaggatctactcgtgacattcaagacagcacacgctaagaaacaggaggtcgtggtgctgggctcccaggaaggcgccatgcacaccgctttgaccggggccaccgaaatccagacaagcggcaccaccaccatcttcgccgggcacctgaaatgccgcctgaaaatggacaagctcactctgaagggcatgtcctatgtcatgtgtaccgggagcttcaagctggagaaggaggtggcggagacgcagcatggaaccgtcctcgtccagatcaaatatgaggggactgacgcgccctgcaagatccccttctcaacgcaggacgagaagggggccacgcagaatggtcggctgatcactgccaatcctatcgtaaccgacaaggaaaagcccgtcaacatcgaggccgaaccgccctttggagagtcgtatatcgtcatcggcgccggcgagaaggctttaaagctgtcctggttcaagaaggggagtagtatcggcaagatgttcgaggccactgcccgcggtgctcggcgcatggccattctcggcgacacagcctgggacttcgggtcaataggcggggtgttcacgtccgtagggaaactcgtccaccaaatcttcggcacggcctacggcgtgctcttttcgggggtgagctggacaatgaagatcgggatcggcgtcctgctgacttggctagggctcaattcacgctccaccagcctgtcaatgacgtgcatagccgtggggctggtgaccctctatcttggcgtcatggtgcaagctgacagtgggtgcgtgattaactggaagggacgtgagcttaaatgcgggtcgggcatcttcgtaacaaatgaagtccacacctggacggagcagtacaagttccaggcagactcccccaagcgcctctcggcggccatcggcaaggcctgggaggagggagtgtgtggtatacggtccgcgacccgtctggaaaacatcatgtggaagcagattagcaacgagctaaaccacatcctcctggaaaacgacatgaagctgaccgtggtggtaggagacgtcgctgggatcctcgcccaaggaaagaaaatgatccggccccaacctatggagtacaagtactcctggaagtcttggggcaaggctaagataataggcgctgacgtccagaacaccacgttcatcatcgatgggcctaacacgcctgaatgccccgacgaccagcgcgcctggaacatctgggaagtcgaggactatggctttgggattttcactaccaacatctggctgaaactgcgagacagttacacccaggtctgcgaccatcgcctcatgtctgccgccattaaggattcaaaagccgtgcacgcggacatgggttactggatcgagagcgagaagaatgagacgtggaagctcgcgcgggcctcctttatcgaggtgaagacctgtatttggcccaaatcccacaccctctggtccaatggggtcttggagagcgagatgattatccccaagatttatgggggcccaatctcccaacacaactaccgcccgggttactttacccagacggcggggccctggcacttgggcaagctggaactcgactttgatctctgcgagggcaccaccgtggtagtcgatgagcactgtggcaaccgggggccgagcctgcgaaccacaaccgtgaccggcaaaataatacacgagtggtgttgcagatcctgcaccttgcctccgctccgcttcaagggcgaggacggatgctggtacgggatggaaataaggccagttaaagaaaaggaggaaaacctggtaaaaagcatggtctctgccggctccggcgaggtggacagtttctccctcggcctgctgtgcatctccatcatgatcgaagaggtcatgcgctcgaggtggagtcgcaagatgctcatgacgggcaccttagctgtgttctttttactcataatgggacaactgacctggaacgacctgatacggctctgcattatggtgggggctgatgcatctgaccgcatgggaatgggcactacgtacctcgcgctgatggccacctttaagatgcgcccgatgttcgctgtcgggctactgtttcggcgcctgacgtcgcgggaggtgctcctgctgacaatcgggctctccctcgttgcctctgtcgaactacccaactccctcgaggaactgggtgacgggctggcaatgggcatcatgattctgaagttactgacggacttccagagccaccagctctgggccaccctgctaagcctcaccttcattcgtacaacgttcagcctgcactacgcttggaaaaccatggccatggtactctccatcgtatccctctttcccttgtgcctgtccacgacctcccaaaagacaacctggctccccgttctgctcggcagtttggggtgcaagccgctgactatgttcctcatcgccgaaaataagatctgggggcgcaaaagctggcccttgaacgaggggatcatggcggtagggatagtctcaatcctgctgtcctccctgctcaaaaacgacgtccccctagccgggcccctcatcgccggcggcatgctgatagcgtgttacgtgattagcggtagcagtgcagacctatctctcgaaaaggccgcggtggtatcctgggaagaggaggccgagcacagcggcgcctcgcacaatatccttgtggaagtccaggacgacgggacgatgaagattaaggatgaggaaagggacgatacgcttactatcctcctaaaagccaccctgctcgccgtgagcggagtttacccgctgtcgatccccgccaccctgttcgtctggtacttttggcagaagaagaagcagcgatcgggggtactgtgggacacaccctcccctcccgaagtggagagggcggtcttggacgacggcatctacaggatcatgcagcggggcctgctggggagatcccaggtgggcgtgggcgttttccaggagaacgtgttccacacgatgtggcacgtgacccgaggagccgtcctcatgtatcagggcaagcggttagagccctcctgggcgtcagtaaagaaggacctcatctcctacggcggcgggtggcggctccagggcagctggaatacaggggaggaggtgcaagttatcgccgttgagcctggcaagaatcccaagaacgtgcagacggcacccggtacattcaagacatccgagggtgaggtcggagctatcgccctggattttaagcccggtacaagcggcagccccattgtaaatagagaagggaagatagttggtctgtacggcaacggggtggttaccacttccggcacctacgtaagcgccatcgcgcaggcaaaggcctcacaggaagggcccctacccgaaatcgaggacgaggtctttcgaaaacgcaacctgaccatcatggacctgcacccaggttccggcaaaacccgccgttacctccctgcgatcgtgcgcgaggccatcaagagaaaactgcgcacgttaatcctcgcccctactcgcgtggtggcgtccgagatggctgaggctctgaagggcatgcccattaggtaccagaccacggccgtcaaatcggagcacacgggcaaggagatcgtggacctcatgtgccatgccaccttcactatgcgcctcctgtcacccgttcgggtgcccaactataacatgatcatcatggacgaggcgcatttcaccgaccccagctcgatcgccgcccgcgggtacatttccacgcgcgtgggcatgggggaggccgccgcgatattcatgaccgccacaccgcccggttccgtcgaggccttccctcagagcaacgccgtgatacaggacgaggagcgcgacatcccagagaggtcgtggaatagcggatacgagtggatcacggatttcccaggcaagaccgtgtggttcgtcccctccatcaaaagcggcaacgacatcgcgaactgcttaaggaagaacgggaaacgggtaattcagctctcccgcaaaaccttcgacaccgaataccaaaagaccaagaataatgactgggactacgtagtgacgacggacataagcgagatgggcgccaacttccgggctgaccgcgtcattgacccccgccgctgcctgaaacctgtgatactgaaggacgggcccgagcgggtaatcctcgccggccccatgcctgtcaccgtcgcctctgcggcccagcgtcggggacgtatcggccggaaccacaacaaagaaggcgaccagtacatctatatggggcagccgttaaacaacgatgaagatcacgcccactggaccgaggctaagatgctgctcgacaatattaacacgccggagggtatcatccctgctctattcgaccccgaacgcgagaagtccgcagcgatcgacggggagtataggctgagaggcgaggcccgcaagacctttgtggagctcatgcggcgtggggatttgcccgtgtggctgagctacaaggtcgcatccgagggctttcagtattcagaccgccgctggtgtttcgacggcgagaggaacaaccaggtgctcgaggagaacatggacgtagagatctggaccaaggagggggagcggaagaagttacgccccagatggctggacgcccggacttattcagatccacttgcgttgcgcgagttcaaagagttcgccgccgggcggcggagcgtcagcggggacctaatcttggagattggcaagctgccccagcacctaacgcaacgagcacagaacgcgctcgacaacctggtaatgctacacaacagcgagcagggcggtcgggcctaccggcacgccatggaggagttacccgacacaatagagacgctgatgctcctcgccttgatagccgttctgaccggcggtgtcacccttttcttcctgtccggacgcggcctgggcaagacctcaataggtttactgtgcgtgatggcatcttcggtgctgctctggatggcatcagtcgagccccactggattgctgcctctatcattctggagttcttcctaatggtactcctgatcccagagcccgatcggcagcgcactccgcaggacaaccagctggcgtacgtcgttatcggtctcctgttcatgatcctgaccgtagcggccaacgaaatgggtctccttgagaccacgaaaaaggatcttgggattggtcatgtggccgtcgaaaaccaccatcacgcggccatgctggacgtggacctgcaccctgcgagcgcctggaccctgtacgctgttgccacaactattataacgcccatgatgagacacaccatagaaaacacaaccgccaacatcagcctcacggctatcgctaatcaggccgcaatcctgatggggctggataagggttggccgatctctaagatggacatcggcgtcccgcttctcgccctggggtgctacagccaggttaaccccctcaccttgacagccgccgtgctaatgctcgtcgcccactatgccatcattgggcccggcctgcaggctaaggccactagggaggcccaaaaacgcacagcagccggaatcatgaagaacccgaccgtggatggaatcgttgcgatagacctggaccccgtagtttacgacgccaagtttgagaaacagctcggtcagatcatgttactcatcctctgcacctcacagatcctgctaatgcggacgacgtgggccctctgcgagagtattacgctcgctactgggcctctgactacactatgggaaggatctcccggtaagttctggaacaccacaatagcggtgagtatggccaacatctttcggggatcttacctggcaggcgcgggcctggccttctcgctaatgaaatccctcggcggcggtcggagaggtaccggagcacagggtgagacgctcggcgagaagtggaagaggcagctaaaccagctgtccaagagcgagttcaacacctacaagcgctcagggatcatggaagtcgaccggtcagaagcgaaggagggccttaagagaggggagactacaaagcacgccgtgagccggggaacagccaagctacgctggttcgtagagcggaaccttgtcaagccggaggggaaggtaatcgacctgggctgcggccgcggtggttgggcgtactattgcgcgggactgaagaaggtgaccgaggtcaaaggttacaccaagggtggccccggccacgaggagcccatccctatggcaacctacggatggaatctggtgaagctgcacagcggcaaggacgtgttctttataccacccgagaagtgtgatacgcttctgtgcgacatcggggagagttcgcccaatcccacgatcgaagagggtcggaccctacgcgtactgaagatggtggagccctggctccgggggaaccagttctgtatcaagatcctaaatccctatatgccatccgtggtggaaaccctcgaacagatgcaacgtaagcacgggggtatgttggtgcgtaaccccctgagccgcaattcaacgcatgagatgtattgggtgagctgcgggaccgggaacatcgtatccgcggtgaacatgacaagccggatgttactcaatcggtttacgatggcccaccgcaagccgacctacgagcgggatgttgacctcggggccggaacgcgacacgtcgcggtggagccagaggtggcaaacctcgacatcatcggccagcgcatcgagaacatcaagcacgagcataagtcaacctggcattatgacgaggataacccttacaagacctgggcctaccacgggagttacgaagtcaaaccatcaggctcggcctcttcaatggtgaatggggtggttaagctcctgaccaagccttgggacgtgatcccaatggtaacgcagatcgccatgaccgacacaaccccctttggccagcaacgggtctttaaagagaaagtggacacgcgaacccccaaggcaaagcgtggaaccgcccagatcatggaggtcaccgccaaatggctgtggggattcctcagcaggaacaagaaaccgagaatctgcacgcgggaggagttcactcgtaaggtgcggagcaacgccgctataggtgcggtattcgtcgacgaaaaccaatggaatagtgctaaggaggccgtagaagacgagcgattctgggatctggtacaccgggagagagagttacataaacagggtaagtgcgcaacctgtgtgtacaacatgatgggtaagcgggagaagaagttgggtgagttcggcaaggccaaggggtcccgcgctatttggtacatgtggctgggtgcacggttcctagagttcgaggcattgggcttcatgaacgaagaccactggttcagccgcgagaacagtctgtccggagtcgaaggcgaagggctgcacaaattaggctatatcctgcgcgacatctccaagatccccgggggtaacatgtacgccgacgacaccgcgggctgggacaccaggatcaccgaggacgatttacaaaacgaagccaagatcaccgacatcatggagccggagcacgccctcttagcgaaatccatctttaaactgacataccagaacaaagtcgtccgggtgcagcgtccggccaaaaatggaaccgtcatggacgtcatcagtcgccgcgaccagcgcggcagcggccaggtgggcacctacggcctcaacaccttcacgaacatggaggcacagttaatccggcagatggagtccgaaggtatcttctcccctagcgaactggagacccccaacctcgccgggcgagtcctagattggctggagaagcacggggtcgagcgcctaaagcggatggctatcagtggcgatgactgtgtggtgaaacccatcgatgaccgctttgccaccgccctgacggcgctgaatgatatggggaaagttagaaaagacattcctcaatgggaaccatccaagggctggaacgactggcaacaggtgcccttttgcagccaccacttccaccagctcatcatgaaagatgggcgtgaaatcgtggttccttgccgaaaccaggacgagctggtggggcgggcccgcgtgagccaaggggccggctggtctctgagagagaccgcctgtcttggcaaaagctacgcgcaaatgtggcagctgatgtactttcatcgccgggacctaaggctcgcggccaatgcaatctgcagtgctgtcccagtggactgggtgcctacaagtagaaccacgtggtcaattcacgcgcaccaccagtggatgactacagaagacatgctttcggtgtggaatcgcgtgtggatcgaagaaaacccctggatggaggacaagacccacatctccagctggggcgacgtgccctatctgggcaaacgggaggaccagtggtgtggttccctcatcgggttaaccgctcgcgcgacctgggccacgaatatacaggtcgccatcaaccaggtacgccgactgctcggtaacgagaattacctggactacatgaccagcatgaagagattcaagaatgaaagtgaccctgaaggggcactctggtga

SEQ ID NO: 24625 - RNA, 9879 nt, synthetic construct
  misc_feature 1..9879: note = derived and/or modified CDS sequence (opt11) from DENV-1__JQ045637__SS-prME
  source 1..9879: mol_type = other RNA
agcgtgaccatgttgctcatgctgatgccgaccgctctggcgttccacctcaccacccggggcggggagccccacatgatcgtgtccaagcaggagcggggcaagtcactgctgttcaagacctccgccggggtgaacatgtgcaccctcatcgccatggacctgggcgagctgtgcgaggacaccatgacctataagtgccctcggatcaccgagaccgagcccgacgatgtggactgctggtgtaacgccaccgacacctgggtcacgtacgggacctgcagccagaccggcgagcaccggcgggacaagcggtccgtggctctcgcgccgcatgtgggcctggggctggagacccgcacggagacctggatgagctccgagggtgcctggaagcagatccagcgggttgagacatgggccctccggcacccagggttcacagtgatcgccctgttcctggcccacgcgatcggcaccagcattacccaaaagggcatcatctttatcctcctcatgttagtgacgccatccatggcaatgaggtgtgtcggcatcggcagccgtgacttcgtcgaggggctctctggcgccacctgggtagacgtcgttttggagcacggaagctgcgtgaccaccatggctaaggacaagcccacgctggacatcgaattactgaagaccgaggtcaccaatcccgccgtgctgcggaagctctgcatcgaagcaaagatctccaacacgacgaccgacagccgctgcccgacccagggcgaggccaccctagtggaagaacaggacgccaactttgtctgtcgtcgcactttcgtggatcggggctgggggaacggctgcgggttgtttggcaaggggtccctcataacctgcgctaagttcaagtgtgtgaccaagctggagggcaagatcgttcagtacgagaacctgaagtactcggtgattgtgaccgtacacaccggcgaccagcatcaggtggggaacgagtccaccgagcacggcacgacggccaccatcaccccacaggcgccgaccaccgagatccagcttaccgactacggggccctgacacttgactgcagcccccgcaccggcctagacttcaacgagatggtcctgctgactatgaaggagaagtcctggctcgtacacaagcagtggttcctagacctgcccctaccctggaccagcggggcctcgacgtcccaggaaacttggaaccgacaggacctgctcgtaaccttcaagaccgcccatgccaagaagcaagaggtagtggtgttaggtagccaggagggcgcgatgcacactgcgctgaccggggccacagagatccagatgtccggcactacgaccatcttcgccggccacctgaagtgccggctgaagatggacaaactgaccctgaagggcatgagttacgtcatgtgcaccgggtcctttaagctcgagaaggaggtggccgaaacccaacacggcaccgttctggtccagattaaatatgagggcacggatgcgccgtgcaagatccctttttcaacccaggacgaaaagggggttactcagaacggccggctgatcaccgctaacccgatcgtgaccgacaaagagaagcccgtcaatatagaggcggagcctccttttggggagtcctacatagtgatcggcgcgggcgagaaagcgttgaagctctcttggttcaagaagggatcttccatcgggaagatgtttgaggccacggcccgtggggcccggcgtatggccatattgggtgacactgcatgggatttcgggtccatcggcggcgtgtttaccagcgtagggaagctggtccaccagatctttggcaccgcctacggagtgctgttctccggcgtgtcgtggactatgaagatcgggatcggcgtgctactcacctggctcggactgaacagtcgcagcacctccctgagcatgacgtgtatcgccgtagggctcgtcactctgtacctgggcgtgatggtgcaggctgactccgggtgcgtcatcaactggaagggtcgggagctcaagtgcgggagcgggatctttgtgacgaacgaagtccacacctggaccgagcagtacaaatttcaagccgacagtccgaagagactctccgcagcaattggcaaggcctgggaggagggtgtctgtggcatacggagcgccacccgcttggagaacatcatgtggaaacagatatccaatgagctgaaccacattcttctggagaacgacatgaagttcaccgtggtagtcggggacgtggcaggaatcctagcacaaggaaagaagatgatccggccccagcccatggagtacaagtatagctggaagtcctgggggaaggccaagatcatcggcgccgacgtgcaaaacacgacatttatcatcgacgggccaaacactccggagtgccccgacgaccaaagagcgtggaacatctgggaggtagaggactacgggttcggtatcttcaccacgaacatttggcttaagctgcgtgactcatacacacaggtgtgcgaccacagactcatgtccgcggccatcaaagatagcaaggccgtgcacgcagatatgggctactggatcgagtccgagaagaacgaaacctggaaacttgcccgggcgagcttcatcgaggtcaagacctgcatctggccaaagtcccataccctctggagcaacggagttctcgagtccgagatgatcatccccaagatctacgggggcccgatctcgcagcacaattacagacccggatacttcacgcagacggcgggcccctggcacctggggaagctggagctcgacttcgacctgtgcgaaggcactacggtggtcgtggacgagcactgcggttcacgggggccgagcctgcgcaccaccaccgtgacgggtaagatcatccatgagtggtgttgccgctcctgcactctgccgcccctccgcttccgtggggaggatggctgctggtacggtatggaaatccgccccgtcaaggagaaggaggagaacctggtgaagtcgatggtgagcgcgggcagcggcgaagtcgactcgttatccctggggctgctctgcatcagcatcatgatcgaggaggtgatgcgttcccgttggagtcggaaaatgctgatgaccggcaccctggccgttttcttcctcctaatcatggggcagcttacgtggaacgacctcatcaggctgtgcatcatggtcggcgctaacgcgtccgaccgcatggggatgggcacaacctacctagcgctcatggccgccttcaagatgcggccgatgtttgcagttggcctgttgtttcgccggttaacctcccgtgaggtgctgctgcttactatcgggctgtccctggtagcgtcggtggagctccccaactctctcgaggaactgggcgatggcctggccatgggcatcatgatcctgaagttactgaccgacttccaaagccaccagctatgggcgaccctgctgtccctgacctttatcaagacgacctttagcctccattacgcctggaagaccatggcgatggtgctctccattgtgtctttattccccctgtgcctctccaccactagccaaaagactacctggttgcccgtcctgctcggctccctgggctgtaaaccactgaccatgtttttaatcgccgagaacaaaatatggggcagacgtagctggccactgaacgaaggcatcatggcagtcggcatcgtaagcatccttctcagcagtctgctgaagaatgacgtgcccctcgcagggcccctgattgccggcggcatgcttatcgcgtgttacgtcatttccggaagctccgccgatctcagcctggagaaggccgccgaggtgtcctgggaggaggaggccgagcacagcggcgcgtcccacaacatcctggtagaggtccaggatgacggaacgatgaagatcaaggatgaggagcgggacgacaccctaaccatcttgctgaaggcaactcttctggccgtgagcggggtgtacccgttatccatccctgccaccctgttcgtctggtatttctggcagaagaagaagcaacgcagcggggtgctgtgggacaccccgtcgccacccgaggtcgagcgggccgtgctggacgacggcatctatcgcatcatgcaacggggtctgctcgggcgcagccaggtgggcgttggggtcttccaggagaacgtgttccacaccatgtggcacgtcacgaggggcgcggtcctgatgtaccaaggtaagcgcttggaaccctcctgggcctctgtgaagaaagacttaatctcatacggtggcgggtggcggctgcagggcagctggaataccggggaggaggtgcaggtcatcgctgtcgaacccggcaaaaaccccaagaacgtgcagactgcccctggtaccttcaaaaccccagaaggcgaagtcggggcaattgcgcttgacttcaagcccggtacctccggctcccccattgtaaaccgcgaagggaagatcgtgggcttatacgggaacggggtcgttacgaccagcggaacctacgtatccgctatcgcccaggccaaggcatcgcaggaggggccgctgcctgagatcgaggacgaggtctttcggaagcgcaacctgacaatcatggacctccaccccggatcggggaagactcggcgctatctgccggcgatagtacgcgaggccatcaagcgcaagctacgcaccctcatcttagcccccaccagagtggtggcttcagagatggcggaagcactgaagggcatgccgatccgataccagaccacggccgtgaagtcagagcacaccggtaaggagatcgtggacctcatgtgccacgccactttcaccatgcggctgcttagccccgtcagggtgccgaactacaatatgatcatcatggacgaggcgcacttcacagacccctccagcatcgcggcccgggggtatatcagcaccagagtcggcatgggggaggccgccgccatctttatgaccgcgactccgcccggcagcgtcgaggccttcccgcagtccaatgctgtgatccaggacgaggagcgggatatccccgagcgcagctggaacagcggatacgagtggatcacggacttccccggcaagaccgtctggttcgtccccagcatcaagtccgggaacgatatcgccaactgccttcggaagaacgggaagcgcgtcatccagttaagccggaaaaccttcgacaccgagtaccagaagacgaagaacaacgactgggattacgtggtcaccactgacatatccgagatgggcgcgaacttccgcgccgatcgcgtaatcgacccgcgccgctgcctgaagcccgtgatcctgaaggacgggcccgagcgtgtcatcctggccggtcccatgcccgtgacagtcgcgagcgccgctcagcggcgcgggcggatcggccgcaatcacaacaaggaaggcgatcagtacatatacatggggcagcctctgaacaacgatgaggaccacgcccactggacggaggccaagatgctcctggacaacatcaacaccccggagggcatcatacccgccctgttcgaaccggagcgtgagaaatccgccgctattgatggtgagtaccggcttcgcggagaagcgcggaagaccttcgtggagctgatgcgcagaggtgacttaccggtgtggctcagctacaaggtcgcaagcgaagggttccagtacagcgacagacggtggtgcttcgacggcgagcgcaacaaccaggtactggaagagaacatggacgtggaaatatggacaaaggagggagagcggaagaagctacgcccgcggtggctcgacgcccgcacatactcggaccctctggccctgcgggagttcaaggagttcgcagccggccgtcggtccgtcagcggggacctcatcctggaaatcggcaaacttccccagcacctcactcagcgcgcccagaacgccttagacaacctggtgatgcttcacaactccgagcagggcgggcgggcgtaccgccacgccatcgaggagctacccgacacgatagagaccctgatgctcctggccctgatcgccgtgctcacgggcggggtgactctgttcttcctgagcggccgggggctcggaaaaacctccatcggcctgctgtgtgtgatggcgagcagtgtgctcctgtggatggcgtcggtcgagccccactggattgccgcctccatcatcttggagttcttcctcatggtactgctgatacccgaaccggaccgccagcggacgccccaggacaaccagctagcttacgttgtcattgggctgctgttcatgattctcaccgtggccgcgaacgagatgggcctgctggagacgaccaagaaagacctcggcattggccacgtggcagtcgaaaatcaccaccacgcagccatgttagacgtggatctgcaccccgcaagcgcgtggaccctctacgccgtggccacaacgatcattaccccgatgatgcgacacaccattgaaaatacaacggccaatatctccctcaccgccatcgcgaaccaggccgccatcctgatggggctcgacaaaggatggcccatcagcaagatggacatcggtgtccccctgctggctttggggtgttactcccaagtgaacccccttaccctcacggctgccgtgttaatgctcgtcgcacactatgccattatcggtccggggctgcaggccaaagcgacgcgcgaggcccagaagcggaccgccgccggcatcatgaagaatcccacagtagacgggatcgtggcaatcgaccttgatcccgtcgtgtacgacgcgaagttcgagaagcagttaggccaaatcatgcttctcatattatgcaccagccagatcctgctcatgcgcacgacatgggccctgtgtgagtccattaccctggcgacaggccccctgactaccctgtgggagggaagcccgggcaaattctggaacacaaccatcgccgtctcgatggcaaacatcttccgtggaagctacctagccggcgcaggcctcgccttcagcttaatgaaatccttagggggcgggcgacgtgggactggggcacaaggcgaaaccctcggcgagaagtggaagcgccagctgaaccagctctccaagtctgagttcaacacctacaagcggtcggggatcatggaggtcgaccgcagtgaagcgaaggagggcttaaagcgcggggagaccacgaagcacgcggtgagccgcgggaccgccaagctgagatggttcgtggagcgcaacctggtcaagccggaggggaaagtgatcgatcttggatgcggccgcggcggctggtcctattactgcgcagggctcaagaaggtgacagaggtcaagggatacacgaagggcggcccgggccacgaggagcccatcccgatggccacgtacgggtggaacttggtgaagctgcactcaggcaaggacgtgttcttcatcccgcccgagaagtgcgacacactcctgtgcgacatcggagagtcaagccccaatccgaccatcgaggagggccgaaccctgcgggtcctcaagatggtggagccctggctgagagggaaccaattttgcatcaaaatcctgaatccatatatgccatccgttgtcgagacgctcgagcagatgcaacgcaagcacggcggcatgctcgtgcgcaacccgctgagccgaaattcaacccacgagatgtactgggttagctgcgggaccggtaatatagtctccgctgtgaacatgacctcgcgcatgctgctgaatcgcttcaccatggctcaccggaaacccacgtacgaacgcgacgtggatttaggggcgggcactcggcacgtagccgtggaacccgaagtcgccaatctcgatatcatcggccagcgcatcgagaatatcaagcatgagcacaagtccacctggcactacgacgaagacaacccctacaagacttgggcttaccatgggagctacgaagtcaagccgtccggcagcgcctcttccatggtcaacggggtcgtgaaacttctgacgaaaccctgggatgtgatcccaatggtaacccagatcgccatgacagacaccacgccctttggccagcagagggtgttcaaggagaaggtggacaccaggaccccgaaggccaagcggggaactgcacagatcatggaggtcacggcgaagtggctctgggggttcctgagccgcaacaagaagccacggatctgcacccgcgaggagtttaccagaaaagtgcgctccaacgccgcgatcggcgcagttttcgtcgacgagaatcaatggaatagcgcgaaagaggccgtagaggacgaaaggttctgggacttagtccaccgcgaacgcgagctccacaagcaagggaaatgcgcaacatgcgtttacaacatgatgggcaagcgcgagaagaaacttggggagtttggcaaggccaagggatcgcgggccatctggtacatgtggctaggagcgcgcttcctcgagtttgaagccctgggctttatgaacgaggatcattggttctcacgggagaactctctgagcggggtggagggagaagggctgcacaagctgggttacatcctgcgagatatctccaaaatcccagggggcaacatgtacgcagacgacacggcaggctgggacacccggatcaccgaggacgacctccagaacgaggcccggatcactgacataatggagcccgagcacgcgctgttggcccggagcatcttcaaacttacgtaccagaacaaggtggtccgggtacagcgacccgccaagaacgggaccgtgatggacgtcatctcgcggcgtgaccagcggggcagcggccaggtgggaacctacggtctgaataccttcacaaacatggaggcccagctgatacgccagatggagtccgagggtatcttcagccccagtgagctcgagacccccaacctggccgagcgagtgctggactggctcgagaagtacggcgttgagcgcctgaagcgaatggccatcagtggggacgactgcgtagtgaagcctatcgacgaccgttttgccaccgctctgaccgccctcaacgacatggggaaggtgcgcaaagacatcccccaatgggagccctctaaggggtggaacgactggcaacaagtcccgttttgcagccatcacttccaccagctgatcatgaaggacggccgcgagatcgtggtcccgtgccggaatcaagacgagctggtgggccgtgccagggtgagccagggggctggctggtccctgcgcgagacggcctgtttgggcaagtcgtacgcacagatgtggcagctgatgtattttcaccggcgcgacctccggctggccgcaaacgccatctgctccgcagtccccgtagactggattcccaccagcaggaccacctggtccatccacgcccaccaccagtggatgacaaccgaggacatgcttagcgtctggaaccgcgtctggattgaagagaacccctggatggaggacaagacccacatcagcagctggggcgacgtaccgtacctcgggaagcgggaggaccaatggtgcggttccctgatcggcctgaccgcgcgagcaacgtgggcgactaacattcaggtggccatcaaccaggtccggcgcctcatcgggaacgagaactacctggactacatgaccagcatgaagcggttcaagaatgagtcagaccccgagggggccctatggtag

SEQ ID NO: 24626 - RNA, 9879 nt, synthetic construct
  misc_feature 1..9879: note = derived and/or modified CDS sequence (opt11) from DENV-1__JQ045638__SS-prME
  source 1..9879: mol_type = other RNA
tcagtgaccatgctgctcatgctgatgcccaccgccctggccttccacctgaccacccgcgggggtgagccacacatgatagtgtccaagcaggagaggggcaagagcctcctgttcaagacctcagccggtgtcaatatgtgcaccctcatcgccatggacctgggcgagctgtgcgaggacaccatgacgtacaagtgcccgcggataaccgagaccgagcccgacgacgtagactgctggtgcaacgccaccgacacgtgggtcacctacgggacctgctctcagactggcgagcacaggcgagacaagcggtccgtggccctagcgccccacgtgggcctgggcctggaaacacgcaccgagacctggatgtcttccgagggcgcctggaagcagatccagcgggttgagacgtgggcgctcagacacccggggttcaccgtcatcgccctgttcctggcccacgcgatcggcacgagcatcacccagaaggggatcatcttcatcctcttaatgctggtgacgccatccatggccatgcggtgtgtcggcatcggcagccgcgacttcgtggaggggctctccggcgctacctgggtcgatgtcgtattggagcacggtagctgcgtgaccactatggctaaggataagcccacgctggacatcgaactcctgaagaccgaggtcaccaaccccgccgtgctgcggaagctctgcatcgaagctaagatctccaacaccactaccgacagccgctgtcccacccagggcgaggccaccctagtggaggagcaagatgccaacttcgtctgccggcgcacgtttgttgacaggggctgggggaacggctgcgggctgtttggcaaggggtccctcatcacgtgcgccaagttcaagtgcgtgaccaagctggaggggaaaatcgtccaatacgaaaacctgaagtactcggtcatcgtgaccgtacacacgggcgaccagcaccaggtggggaatgagtcaaccgaacatggcaccacggccaccataacgccccaggcccccaccaccgagatccagctcacagactacggcgccttgacgctggattgctctccccgcactggcctcgacttcaatgagatggtcctgctgaccatgaaggagaaatcctggctggtgcacaagcaatggttcttggacctgcccctcccttggaccagcggggccagcacgtcgcaggagacctggaaccgacaggacctgctggtgaccttcaagacagcccacgccaagaagcaagaggtcgtggtgctcggctcccaggaaggggcgatgcacacggccctgacgggggccaccgagatccagatgtcgggcaccacgaccatctttgccgggcacctgaaatgcaggctgaagatggacaagctcacactaaaaggcatgagctacgtcatgtgcaccgggtccttcaagctcgagaaggaagtggccgagacccagcacggcaccgtgctggtacagatcaagtacgaaggtacggacgcgccttgcaagatccccttctcgacccaggacgagaagggtgtaacgcagaatggccggctaatcaccgccaaccccatagtgaccgacaaggagaagccagtcaacatcgaggccgagccgcccttcggtgagtcctacatcgtaatcggcgccggcgagaaggccctgaaactcagctggttcaagaaggggtcgagcataggcaagatgttcgaggccaccgcccgcggggcgagacgaatggccatcctgggcgacacggcgtgggacttcgggtcgataggcggcgtgttcacctcggtcgggaagctggtgcatcaaattttcggtaccgcctatggggtgttgttctccggcgttagctggaccatgaagatcggcatcggcgtgctgctgacgtggctcggcctgaactcgcgaagcacctcgcttagcatgacctgtatcgcagtgggattggtcaccctatatttgggcgtgatggtgcaggccgactccggttgtgtcattaactggaaggggcgggaactcaagtgcgggtccggcatcttcgtgacgaacgaggtgcacacatggacagaacagtataaattccaggccgacagcccgaagcgcttgtccgcggccatcggcaaggcctgggaggagggtgtctgcggcatccggtcagccacccgcctggagaacatcatgtggaagcagatctccaacgaactcaaccacatcctactggagaatgacatgaagtttaccgtggttgtcggggacgtggccggtatcctcgcacaagggaagaagatgatccgccctcagcccatggagtacaagtacagctggaaatcctggggcaaagcaaagatcataggcgcagacgtgcaaaacacgacattcatcatcgacgggcccaacaccccggagtgccccgacgaccagagagcctggaacatatgggaggtcgaggattacggcttcgggatcttcaccaccaacatatggctgaaacttcgggactcgtacactcaagtttgcgaccatcgcctcatgtccgccgccatcaaggacagcaaagccgtccatgcagatatgggctactggatcgagtccgagaagaacgagacctggaagctggcccgggcgagctttatagaggtcaagacctgcatctggcccaaatcccacacgttgtggagcaacggtgtgctcgagtcggagatgatcatccctaagatctatggtggcccaatcagccagcacaactaccgcccggggtacttcacccagaccgccggcccctggcacctggggaagctggagttggactttgatctgtgcgagggcacaacggtggtcgtagatgagcactgcggctcccgggggccgtcattacggaccaccaccgtgacggggaagatcatccacgagtggtgctgcagatcctgtactctgccgcccctgcgattccgcggggaggatggctgttggtacggtatggagatccgtcccgtcaaggagaaggaggagaatctggtgaagtcgatggttagcgccggctccggcgaggtcgacagcctctccctagggctgctctgcatcagcatcatgatcgaggaagtgatgcggtcccgctggagccggaaaatgttgatgactggcaccctggcagtgttcttcctcctgatcatggggcagctaacgtggaacgacctcatccgcttatgcatcatggtgggggccaacgcatccgaccgcatggggatgggcacgacctacctggccctcatggccgctttcaagatgcggccgatgttcgcggtgggcctgctgttccgtcggctcacctctcgtgaggtgttactgctcacgatcgggttatccctggtcgcgagcgtggagctcccaaattccctggaggagctaggcgatggattggccatgggcatcatgatcctgaagctgttaaccgatttccagagccaccagctttgggccaccctgctttccctgaccttcatcaaaacaaccttcagcctgcactatgcctggaaaaccatggcgatggtcctctccattgtaagcctgttccccctgtgtctctccaccacaagtcagaaaaccacgtggctgcccgtgctgctcggctccctggggtgcaaaccactgacaatgtttttgatcgccgagaataagatctgggggcggcgtagctggccgctgaacgaggggattatggccgttggcatcgtgagcatcctgctctccagcctactcaagaacgacgtgcccctcgccgggcccttgatcgccggcggcatgcttatcgcttgctacgttatctccgggagcagcgcggacctcagccttgaaaaggccgccgaggtgtcctgggaggaggaggccgaacacagcggcgcgtcccacaacatcctggtggaggtgcaggacgacgggactatgaagataaaggacgaggagcgagacgacacccttaccatcctgctaaaggccaccctcctggcggtatcgggcgtctacccgctttccatccccgccactcttttcgtctggtacttttggcagaagaaaaagcaacgtagtggggtactgtgggacacgccgagcccgcccgaggtggaacgggccgtgctggacgacggcatctaccgcatcatgcagcggggcttactcgggcgctcgcaggttggcgtgggagtcttccaggagaatgtgttccacacgatgtggcacgttacccggggcgcggtcctgatgtaccagggaaaacgcctggaaccctcctgggcctctgtgaagaaagacctcatctcgtacggcggcgggtggcggctgcagggcagctggaacaccggggaggaggtgcaggtcatcgccgtggagcccggtaagaaccccaaaaatgtgcagacggcccccgggaccttcaagacccctgagggcgaagtcggcgccatcgcgctggacttcaagccggggacctccggctctcccatcgttaaccgggagggcaagatcgttggcttatatggcaacggggtagtgacgaccagcggcacctacgtgtccgccatcgcccaggccaaggccagccaggaggggccgctgcccgagatcgaggacgaggtattccggaagcgaaatctgaccatcatggacctacaccccggctccgggaagacacggcgataccttccggccatcgtgcgggaggccattaagcgaaagctgcgcaccttgattttagctcccacccgggtggtcgccagcgagatggcagaggccttaaagggcatgccaatccgctaccaaaccacggccgtgaaatccgaacacaccggcaaggagatcgtggacctcatgtgccatgctaccttcacaatgcggctgctgagccccgtgagagtaccaaactacaacatgattatcatggatgaggcccacttcacggacccctccagcatcgctgcccgggggtacatctctacccgcgtgggcatgggggaggccgccgcgatcttcatgaccgcgacgccgcccggcagcgtggaggctttcccccagtccaacgccgtgatccaggatgaggagcgagacattcccgagcgcagctggaactccgggtacgagtggatcacggactttcccggaaaaacggtttggttcgttccctcgatcaaatccggcaatgacatcgctaactgcctccggaaaaacgggaagagggtgattcagctcagccggaagaccttcgacacagaatatcagaagaccaagaacaacgactgggactacgtggtcacaaccgacatcagcgagatgggagctaacttccgggccgaccgggtgatcgacccgcgccggtgcctgaagcccgtcatcttaaaggacgggccggagcgcgtcatcctggccggtcccatgccggtgacagtcgcgagcgccgcgcagcggcgcgggcggataggccgcaaccacaacaaggaaggcgaccagtacatctacatggggcaacccttaaacaacgacgaggatcacgcccactggacggaggccaagatgctcctggacaacatcaacacacccgagggaatcatccctgccctgttcgagccggagcgcgagaaatcggccgcgatcgacggggagtatcgcctccggggcgaggcccgtaagacgttcgtggagcttatgcgaagaggtgacctgcccgtgtggctgtcttacaaagtggccagcgaaggcttccagtactccgatcgtcggtggtgcttcgacggcgagcgcaacaaccaggtgcttgaggagaatatggacgtggagatctggaccaaggaaggggagagaaagaaacttcgccctcgctggctcgacgcccgcacgtacagcgaccccctggccctgcgggagttcaaggagttcgcggccggtagacgttccgtgtcaggggacctcatcctggagatcggcaagctaccgcagcacctcacccagcgcgcccagaatgccctggataatctggtgatgctccacaactccgagcagggcggacgggcctaccgccacgccatcgaggagctgccggacaccatcgagaccctgatgctcctagccttaattgccgtgctcactggcggggtcacccttttcttcctgagcggccgggggctcggcaagacctccatcggcctgctgtgcgtgatggccagctccgtgctcctctggatggcgagcgtagagccccactggatcgccgccagcatcatactggagttcttcctcatggtgctgcttatccccgagccagaccgacagcggacgccacaagacaaccagttagcctacgtggtcatcggactgctgttcatgatcctcactgtggccgcgaacgaaatgggcctgctggagacgacgaagaaggacctcggaatcggccacgtggccgtcgaaaaccaccaccacgccgccatgcttgatgtagacctccaccccgccagcgcgtggaccctctacgccgtggccacgaccatcatcaccccaatgatgcgccataccatcgagaataccacggccaacatctccctgaccgccatcgccaaccaggctgcaatcttaatggggctcgacaagggctggcccatcagcaagatggatatcggcgtccctctgctggccctcgggtgttactcccaggtgaaccccctgaccctgaccgcggccgtgctcatgttagtagcccactatgccatcatcggcccagggctgcaggctaaggcgacgcgggaggcccagaagcggacagccgccggtataatgaaaaaccccaccgtagacgggatcgtggcgatcgaccttgaccccgtggtgtacgacgccaagttcgagaagcagttgggccagataatgttgctcatcctgtgcaccagtcagatcctgttgatgaggacgacctgggccctgtgcgaatccatcactctggccaccggccccctcaccaccctgtgggaggggtccccgggcaagttctggaacactaccatcgccgtgtccatggccaacatattccggggcagctacctggcgggtgccggcctggccttcagcctgatgaagtccctaggcggtgggcggcggggaacgggggcccaaggcgagaccctcggtgagaagtggaagagacaactgaaccaactgagcaagtccgagttcaacacctacaagcggtccgggatcatggaggtcgaccgatccgaggcgaaggagggcttaaaaagaggggagaccacgaagcacgccgtgagccgaggcaccgccaagctgcggtggttcgtagagcgtaacctggtaaagcccgagggtaaagtgatcgacctgggctgcggcaggggcggctgggcctactactgcgccggcctgaagaaggtgaccgaagtaaaggggtacaccaagggcggtcccggacacgaggaacccattccgatggcgacgtacgggtggaatctggtcaagttgcacagtggcaaggacgtgtttttcatcccgccagagaaatgcgacaccctcctgtgcgacattggtgagtcgtcccccaacccgaccatagaggagggccgcaccctgagagtcctcaaaatggtggagccgtggctgcgcgggaaccagttctgcatcaagatcctgaatccttacatgccaagcgtggttgagacgctcgagcagatgcagcgtaagcacggaggcatgttggtgcgcaacccgctgagccggaacagcacccacgagatgtattgggtgtcctgcgggaccggcaacatcgtcagcgcagttaacatgacttcgcgcatgctcctgaatcgcttcaccatggcccaccggaaacccacgtacgagcgcgacgtggacctaggggccggcacccggcacgtcgctgtcgagcccgaggtggcgaacctcgacatcatcggccagcgcatcgagaacatcaagcacgagcacaagagcacctggcactatgatgaagacaacccttacaagacctgggcctaccacgggtcgtacgaggtcaagccgagcggctctgccagcagcatggtgaacggggttgtgaagctgctaacgaagccgtgggacgtgatccccatggtcacccaaatcgccatgactgatactaccccctttggccaacaacgggtgttcaaggaaaaggtagacacccgcaccccgaaagccaagcgcgggaccgcgcagatcatggaggttacggccaagtggctctggggcttcctgtcccgcaacaagaagccccggatctgcacccgggaggagttcacccggaaggtacgcagcaacgccgctatcggcgcggtgtttgtcgacgagaatcagtggaactccgctaaggaggcggttgaggacgagcggttctgggaccttgtgcaccgcgagcgggagctccacaagcaggggaagtgcgcaacctgcgtctacaacatgatgggaaagcgcgagaagaagctgggagagttcggtaaggccaaggggagccgggctatttggtacatgtggctgggcgcccgcttcctcgagttcgaggcactgggatttatgaacgaggatcactggttctcccgggagaacagcctgtcaggcgtggagggcgaggggcttcacaaactgggctacattcttcgcgacatcagcaagatccccgggggcaacatgtatgcggacgacaccgcgggctgggacacccggataaccgaggacgacctccagaacgaggcgcgtatcaccgacatcatggagccggagcatgccctgctggcccgctccatcttcaagctcacgtaccaaaacaaggttgtacgggtacagcgtcccgccaagaatgggacagtaatggacgtcataagccggcgcgaccagcggggatccggacaggtggggacctacggcctcaacaccttcaccaacatggaagcgcagctgatcaggcagatggagagcgaggggatcttcagccccagcgagctcgagacccctaacctggcggagcgggtgttagactggctcgagaagtacggcgtcgagcgcctgaaacggatggccatctccggcgacgactgcgttgtgaagccgatcgacgaccgcttcgccaccgctctgaccgccctcaacgacatgggcaaggtccggaaggatatcccccaatgggagccctccaaggggtggaacgattggcagcaggtccccttctgttcccaccacttccaccagctgattatgaaggatggccgcgagatcgtggtcccgtgcaggaaccaggatgagctggtcggccgcgcgcgggtgagccagggggccggctggagcctcagagaaacggcctgcctgggtaagtcctacgcccagatgtggcagctgatgtactttcaccggcgggacctccggctggcggcaaacgccatctgcagcgccgtcccggtggactggattccgacctcacgcaccacgtggagcatccacgcccaccaccagtggatgacgaccgaagacatgctgtccgtgtggaaccgcgtctggatcgaggaaaatccctggatggaagacaagacccacatcagctcctggggcgacgtgccgtatttgggtaagcgggaggatcagtggtgcggcagtctgatcggcctgaccgcacgcgcaacgtgggccaccaacatccaggttgccataaaccaagtacggcgcctcatagggaacgagaactacctggactacatgacctccatgaagcggttcaagaacgagagcgaccccgagggcgccttgtggtga

SEQ ID NO: 24627 - RNA, 9879 nt, synthetic construct
  misc_feature 1..9879: note = derived and/or modified CDS sequence (opt11) from DENV-1__JQ045639__SS-prME
  source 1..9879: mol_type = other RNA
tcggtgaccatgttcctgatgctcatgccgaccgccctggcgttccacctgaccacgagaggaggggagccacacatgatcgtgagcaagcaggagcggggcaagagcctcctcttcaagacctcggccggggtgaatatgtgtaccctgatcgccatggacctcggcgagctgtgcgaggacaccatgacctataagtgcccccgcatcactgagacagaaccggatgacgtggattgctggtgcaacgccacggacacctgggtgacctacgggacctgctcacagacaggcgagcaccgccgcgacaagcgttccgtggcactggcgcctcacgtcggcttagggctggagacccgcaccgagacgtggatgagcagcgagggcgcttggaagcagatccagcgggtcgaaacgtgggccctgcgacatcccggattcaccgtgatcgcactcttcctggctcacgcaataggtaccagtatcacccagaaggggatcatcttcatcctgcttatgctggtgacgccctcgatggccatgcgttgcgtcggcattggcagccgcgattttgtagaagggctgtctggcgcaacctgggtggacgtggtgctcgagcacggctcatgcgtaacgaccatggccaaggataagcccacgctggacatcgaattgctgaagaccgaggttaccaatcctgccgtgctgcggaagctgtgcatcgaggcgaagatctccaacaccacgactgattctcgatgtccgacgcagggggaagccacgctcgtggaggagcaggatgccaactttgtttgccgtcgcactttcgtcgaccgcgggtgggggaacggatgcggactgttcggcaaggggagtctgatcacatgcgccaagttcaagtgcgtgaccaagttagagggtaagatcgttcagtatgagaacctgaagtacagcgtgatcgtgaccgtccacacgggtgaccagcatcaggttggaaacgagtcaaccgagcacggcaccactgccacaatcacgccccaggcgccgacaaccgagatccagttgaccgactacggggcgctcacgctagactgcagcccccgcaccggcctggacttcaatgagatggtgctcctgacaatgaaggagaagagttggcttgtgcacaagcagtggttcctagatctgcccctgccctggaccagcggcgcttcaacgtcccaggagacttggaatcggcaggacctcctggtcaccttcaagactgcacacgccaagaagcaggaggtcgttgtgctgggttctcaagagggggcgatgcatacggccctgacaggggctaccgaaatccagacctccggcacgaccaccatctttgccggccacttaaaatgccgtctgaaaatggacaagctcacgctgaaaggcatgtcatacgtcatgtgcacggggtccttcaagctcgagaaggaactcgctgaaacacagcatggaacggtcctggtgcagatcaaatacgagggcaccgacgcgccctgcaagatccccttctctacacaggacgagaagggcgtgacacagaacgggcggctgatcaccgcgaatcccatcgtaacagacaaggagaagcccgtgaatatcgaggcagagccgccattcggtgagagctacatagtcatcggcgccggggagaaggcgcttaaacttagctggttcaagaaggggtccagcatcggcaagatgttcgaggcaaccgcccgcggggcccggaggatggcaatcctgggcgataccgcgtgggacttcggatccataggcggcgtgtttacatctgtagggaagctcgtacaccagatctttggcaccgcctacggcgtgctgttttcgggcgtgagctggacgatgaagatcgggatcggcgttctcctgacttggctcggcctaaattcgcgctccacctccctgagcatgacctgcatcgctgtagggctcgttacgctctacctgggtgtcatggtgcaggccgactctgggtgcgtaatcaactggaagggccgcgaactgaagtgcgggagcggcattttcgtcacaaacgaggttcatacttggaccgaacaatacaaatttcaagccgacagcccgaagcgattgtccgcggccatcggcaaggcatgggaggagggggtgtgcggaatcagatcagcaacccggctggaaaacatcatgtggaaacagatctccaatgaactcaaccacatcctgctggagaacgacatgaagttcactgtcgtggtgggggacgtcgctggcatcttagctcaggggaagaagatgatccggccccaacccatggaatacaagtacagctggaaatcctggggcaaggcgaagatcataggcgccgacgtgcagaacactaccttcatcatagacgggcccaacacaccagagtgccccgacgaccagagagcatggaacatctgggaggtggaggactacggttttggaatcttcacaacaaacatctggttgaagctgcgcgacagctacacccaggtttgcgaccaccgcctgatgagtgcggcgatcaaggatagcaaagccgtgcacgctgatatgggctactggatcgagtccgagaagaacgagacatggaagttggcgagggcatcgtttatcgaggtgaaaacttgcatttggcctaagtcccacaccctgtggagcaacggcgtgctcgagagcgagatgatcatcccgaagatatatgggggcccgatcagtcagcacaactatcgaccggggtacttcacccagaccgccggcccctggcacctggggaagttagagttggacttcgatctgtgcgagggaacgaccgtcgtggtcgacgagcactgtggcaatcgggggccgtcactgcgcaccaccacggtgaccggcaagataatccatgagtggtgctgccggagctgcaccctgccacccctccgcttccgcggggaggacggctgctggtacgggatggagattcgccccgtgaaagaaaaggaggagaacttggtaaagtccatggttagcgccggcagcggggaagtggacagtttcagcctcgggttgctgtgcatctccatcatgatagaggaggtcatgcggagccgttggtcccggaagatgcttatgaccggcacgctggctgtgttctttctcctcatcatgggacagctgacgtggaacgatctaatccgcttgtgcattatggtgggtgccaacgcgagcgaccgcatggggatgggcaccacctacctggccctgatggccacgttcaaaatgcggccgatgttcgccgtaggactcctgtttcgccggctaacctcaagggaggtgctcctgctaacgatcggtctcagcttagttgcctccgtcgagctgcccaacagcctggaggaactgggcgacggactggcaatgggtatcatgatactcaagttgctgaccgacttccagtcccaccagttatgggccacgctgctgagcttgaccttcattaagacgaccttcagcttacactacgcctggaagacaatggccatggtgttgagcatcgtctccctgtttccactgtgcctgagcaccacctcccagaagaccacgtggctccccgtgcttctgggttcattgggatgcaagccgttaaccatgtttttgattgccgagaacaagatctggggccggcgatcctggcccctcaacgagggtatcatggccgttggcatcgtcagcatccttctaagctcgcttcttaagaacgacgtgccgctggctgggcccctaatcgctggcggcatgttaatcgcctgttacgtgattagcgggtccagcgccgacctatccctcgagaaggcggccgaggtctcttgggaggaggaggccgagcactccggcgccagccataacatcctggtggaggtacaggacgacggcacgatgaaaatcaaggatgaggagcgggatgacaccctgaccatactcttgaaagcgacgctgctcgccgtctctggcgtgtacccgttaagcatccctgctaccctgttcgtctggcacttctggcagaagaagaaacagcgcagcggggtcctctgggatacgccatcgcccccagaggtggagcgggcagtactggacgacggaatctatcgcattatgcagcgcggactcctggggcgctcccaggtcggcgtcggcgtattccaggagaacgtcttccacaccatgtggcacgtgacgcggggcgcggtgctcatgtaccaagggaagcgcctggagcccagctgggcgtctgtcaagaaggatctgatcagctacgggggcgggtggcggctccaaggctcctggaacacaggggaggaggtccaggtaatcgccgtcgagcccggcaagaaccccaagaacgtgcagaccgccccgggcaccttcaaaacgcctgagggcgaggtgggcgccatcgcgctggacttcaagcccgggacaagtggttccccgatcgtcaacagagaggggaagatagtgggcctgtacggcaatggggtggtgactacaagcggaacgtacgtcagcgcgatagctcaggcccgggcctcccaggaggggccgctccccgagattgaggacgaggtgttccgcaagcgaaacctgactattatggacctgcacccagggtccggcaagacccgccggtacctcccggccattgtccgcgaggccatcaagaggaagctgcggaccctgatactcgcccccactcgggtggtcgcctccgagatggccgaagcgttaaaggggatgccaatccgataccaaactaccgccgtcaagtccgagcacaccggcaaggagattgtggacctgatgtgccacgccacgttcaccatgcgcctcctgtcaccggtgcgggtccccaattacaatatgattattatggacgaggcccacttcaccgatccaagttccatcgccgctcgcgggtatataagcacccgggttggcatgggcgaggccgcggccatcttcatgacggccaccccgcccggctccgtggaggcgtttccgcaaagcaacgcggtcatccaggacgaggagcgcgacatccccgagcggtcctggaacagcgggtacgagtggattaccgacttccccggtaagacagtgtggtttgtgccctccatcaagagcggcaatgacatcgctaactgtctgcgcaaaaacggaaagcgagtcatacagttgtcccgcaagacctttgacaccgaatatcagaagaccaagaacaacgattgggactacgtggtgactacggacatctcagagatgggggccaacttcagggcggaccgcgtgatcgacccgcgtcgctgcctgaagccagtaatcctgaaagacgggcccgaacgggtgatcctcgccggacccatgccggtcactgtggcttctgcagctcagcgtcgagggcggattggcaggaaccacaataaggagggcgaccagtatatctacatgggacagcccctgaacaacgacgaggaccatgcgcactggacagaggccaagatgctgctagacaacatcaacaccccagaaggcataatccccgccctgttcgagccggaacgggagaagtctgccgccatagacggggaataccgcctacggggagaggcgcgcaagacattcgtcgaactcatgcggcgcggggaccttcccgtgtggctgtcctataaggtggcatccgaaggctttcagtacagcgatcgccgctggtgctttgacggcgagcggaacaaccaggtcctggaggaaaacatggacgtggagatttggaccaaggagggagaacgcaagaaactgcgtccccgctggctggacgcgcggacctacagcgaccctctcgccctgcgcgagttcaaggagttcgcggcgggccggcgctcggtgtccggggacctgatcctcgagataggaaagctgccccagcacctaacacaacgggcccaaaacgcgctcgataacctagtcatgctgcacaacagcgagcagggcgggcgcgcctataggcacgcgatggaggagcttcccgatactatcgaaaccctgatgctgctcgccctgatagcggtgctgaccggtggagtgaccctcttcttcctgtccggccgcgggctggggaaaaccagcatcggcctcctgtgtgtgatggcctccagcgcattactctggatggcttccgtggagccccactggatcgcagcgagcatcatcctggagttctttttgatggtgctcttgatacctgaaccggacaggcagcgcacgccgcaagataaccaacttgcgtacgttgtgatcgggttgctctttatgatacttacggtggcggctaatgaaatggggctcttagaaacgaccaaaaaggatctggggattggccacgccgcagtcgagaaccaccatcacgcggccatgctcgacgtggatctgcaccccgcgagcgcctggacgctgtacgcagtggccaccacgatcatcaccccgatgatgcgccacactatcgagaatacaacggcaaacatcagcctcaccgctatcgccaaccaggccgccatactgatgggtttagacaagggttggcctatctcaaagatggacatcggggtccccctgctggcactggggtgctacagccaggtgaacccactgaccctcacggccgcggtgctaatgctcgtcgcacactacgccatcatcggcccaggtttacaagcgaaggccacccgggaggcccagaagcgcaccgcggccggcatcatgaagaaccccacggtggatgggattgttgcgatcgatctggatccggtcgtgtacgacgccaagttcgagaagcaactcggccagatcatgttactaatcctctgcacctcccagatccttctgatgcgaaccacctgggccctctgcgagagcattacactggccacgggccccctgactaccctctgggaagggagtccggggaaattttggaacaccaccatcgccgtgtccatggcaaatatcttccgcggctcctacctggccggcgccggcttagcatttagcctcatgaagtccctagggggcgggagacgcgggaccggcgcgcagggcgagaccctgggcgagaagtggaagaggcagttgaaccaactgagcaagagcgagttcaacacgtacaagaggagtgggatcatggaagtcgaccggagcgaagctaaagaaggcctgaagcgaggagagacaaccaaacatgccgtgtcaaggggcaccgcgaagctccgctggttcgttgagcggaacctggttaaacccgaggggaaggtgattgacctgggctgcggccgcgggggctggagctactattgtgccgggctgaagaaggtgacggaggtgaagggctacaccaaaggcggcccgggccacgaggaacccatcccgatggcgacctatggttggaacttagtgaagctgcactccggcaaggacgtgtttttcattccacccgagaagtgcgacacgctgctctgtgacataggtgagagctcccccaacccgacgatcgaggagggccggacccttcgtgtcttaaagatggtggaaccctggctccggggtaaccagttctgtatcaagatactcaacccctatatgcctagcgtggtcgaaaccctggagcagatgcagcggaagcatggcggcatgctcgtgcggaacccgctgtcccgcaattccacccacgaaatgtactgggtgagctgcggtacgggcaacatcgttagcgctgtcaacatgacgagtcgcatgttactcaaccggttcacgatggcccaccgcaaacccacctacgagcgggatgtggacctgggggccggcacccgccacgtcgccgtggagcccgaggtggcaaaccttgatatcatcggccaacgtatcgagaatatcaagcacgaacacaagagcacgtggcactacgacgaggataatccatacaaaacttgggcctaccatgggtcctacgaagtcaagccgagcggatccgccagtagcatggtcaacggggtagtcaagctcctgacaaagccgtgggacgtgatccccatggtcactcagattgcaatgacggacaccacccccttcggccagcagcgcgtgttcaaagagaaggtcgacaccagaacgccgaaagccaagcgtggaaccgcgcagatcatggaagtcaccgcgaagtggctctggggcttcttgtcccggaacaagaagccaagaatctgcacacgggaggagttcacgcgcaaggtgaggtccaacgccgccataggcgctgtttttgtcgatgagaatcaatggaactccgccaaggaagctgtcgaggacgagcgattctgggacctggtgcaccgagaacgcgagcttcacaagcaggggcggtgcgcgacctgcgtctacaacatgatgggcaagcgtgagaagaagctcggagagtttggcaaggctaagggcagccgagctatctggtacatgtggctgggcgcccgcttcctggagttcgaagccctcgggtttatgaatgaagaccactggttctcccgagagaacagcttatccggggtggagggcgaagggttgcacaagttaggctatatcctgcgcgacatctcgaagatccccgggggtaacatgtacgccgacgataccgcaggctgggacaccaggattacagaagacgacctgcagaacgaggcgagaatcactgacatcatggaaccggagcacgccctcctggccaagtctatcttcaaactgacctatcagaacaaggtggttcgcgtgcagcggcccgccaaaaacgggacagtaatggatgttatcagccgtcgggaccagagagggtccggccaggtgggaacgtacggactcaacaccttcaccaacatggaagcccagctgatccggcaaatggagagcgagggcatcttctccccttcagagctggagacccccaacctcgcggaacgagtgctcgattggctggaaaagtacggcgtcgagcgactcaaacggatggccatttccggggacgactgtgtagtgaagccgatagatgatcgcttcgccactgccctgacggcgttaaacgatatgggaaaggtccgcaaggacataccacagtgggaacccagcaaggggtggaatgactggcaacaggtgcccttctgctcacaccacttccaccaattgataatgaaggacggccgggagatcgttgtaccgtgccgcaaccaagacgagctggtcggcagagcgcgcgtcagccagggggcaggatggagcctgcgtgagaccgcgtgcctcgggaaaagttacgcccaaatgtggcagctgatgtacttccaccgtcgggacctgcgccttgcggccaacgctatctgcagcgccgtccccgtggattggattcctacctcccgcacaacctggagcattcatgcccaccaccagtggatgaccaccgaagacatgctgtccgtgtggaatcgcgtctggatagaggagaacccctggatggaggacaagacgcacatcagctcctgggaggacgtaccgtacctgggcaagcgcgaagaccagtggtgcgggagcttgataggcctgacggcacgggccacctgggcgactaatattcaggtggccatcaatcaggttcggcggcttataggtaacgaaaactacctcgattacatgacatccatgaaacgtttcaaaaacgaaagtgaccctgagggggccctgtggtga

SEQ ID NO: 24628 - RNA, 9879 nt, synthetic construct
  misc_feature 1..9879: note = derived and/or modified CDS sequence (opt11) from DENV-1__JQ045641__SS-prME
  source 1..9879: mol_type = other RNA
agcgtgaccatgctgctcatgctgatgcctaccgccctggcattccacctaaccacccggggcggggagccgcatatgatcgtgagcaagcaggagcggggcaagagtctgctgtttaaaaccagcgccggggtgaacatgtgcaccctcatcgccatggacctgggcgagttgtgtgaggacaccatgacctacaagtgcccacggatcacggagacggagcccgacgatgtggactgctggtgcaacgccacggacacctgggtaacctatggtacctgctctcagactggcgagcatcggcgtgacaagcggtccgtggcgctcgctccgcacgtgggtctggggctggagactcgcaccgagacctggatgagctcggagggtgcctggaagcagatccagcgggtcgagacgtgggccctccggcatcccgggttcaccgtgatcgccctgttcctggcccacgcgatcgggaccagcatcacccagaaggggatcatcttcatcctgttgatgttggtgacgccctcgatggccatgcggtgcgtcggtatcggcagcagagatttcgtggaagggctctccggcgccacctgggtggacgtcgtgctggagcacgggagctgcgtgaccaccatggccaaagacaagcccacgctggacatcgagctcctcaagacggaggtcaccaatccggccgtgctgcggaagctctgcatcgaggcgaagatctcaaacacgacgaccgactctcgctgcccgacacagggcgaagcgaccttggtggaggagcaggacgccaactttgtctgccgtagaacgttcgtggaccggggctgggggaacggctgcgggctgttcggcaaggggagtctcatcacatgcgccaaatttaagtgtgtgaccaagctggagggaaagatcgtccagtacgagaaccttaagtactctgttatcgtgaccgtccacacgggcgaccagcaccaggtggggaacgagagtaccgagcacggtaccaccgccaccatcacgcctcaagccccaaccaccgagatccaactcaccgattacggggccctgacgctggactgcagcccccgcaccggactcgacttcaacgagatggtactactgaccatgaaggagaaatcctggctagtgcacaagcagtggttcctggacctgcccctcccctggacctcaggggccagcacttcccaggagacctggaaccggcaggacctgctggtgaccttcaaaaccgcccacgccaagaagcaggaggtcgtggtgttgggcagccaggaaggcgcgatgcatacggccctgaccggggccaccgagatccagacctccggcacgaccacaatcttcgccgggcacctgaagtgcagactcaagatggataagctgaccctgaagggcatgagctacgtcatgtgcacggggagcttcaagcttgagaaggagctggccgagacccagcacggcaccgtgctggtgcagataaagtacgagggcaccgacgcgccctgcaagatccccttcagcacgcaggacgagaagggcgttgcccagaacgggcggctgattaccgccaaccccatcgtgacagacaaggagaagcccgtgaacatcgaggccgagccgcccttcggggagagctacatcgtcattggcgcgggagagaaggcgctcaagctgtcctggttcaagaaggggtccagcatcgggaagatgttcgaggccaccgcccgcggggccagacgcatggcgatcctgggcgacacagcctgggatttcggatccatcggcggcgtgttcaccagcgtggggaagctcgtccaccagatctttgggaccgcctacggggtgctgttctcaggcgtgagctggaccatgaagatcggaatcggcgtcctcctcacgtggctgggcctgaactcccgcagcacctccctcagcatgacctgcatcgccgtcggcctggtgaccctgtacctcggagtcatggtgcaggccgactccgggtgcgtgatcaactggaaagggcgggaactgaaatgcgggagcggtatcttcgtcacgaacgaggtgcacacctggactgagcaatacaagttccaggcggactcaccgaagcgcctgagtgccgccatcggcaaggcctgggaggaaggtgtgtgcggcatcaggagcgccacccgcctcgagaacatcatgtggaagcagatctccaacgagctgaaccacatcctgctggagaacgacatgaagttcaccgtcgtggttggggacgtagcaggtatcctggcccaggggaagaagatgatccggccccagcctatggagtacaaatacagctggaagtcctggggcaaggctaagatcatcggcgcggacgtgcagaatacgaccttcatcattgacggccccaacactccggagtgccccgacgatcagcgcgcgtggaacatctgggaggtggaggactacggcttcgggatcttcaccactaacatttggctgaagttgcgggatagctacacccaggtctgcgaccaccgcctgatgtccgccgcaatcaaggatagcaaagccgtgcacgccgacatggggtactggatcgagtcggagaagaacgagacctggaaactggcgcgggcctctttcatcgaggtgaagacctgcatctggcctaagtcccacacgctatggagcaacggcgtccttgagtcagagatgatcatccccaaaatctacgggggcccgatcagccagcacaactaccgcccagggtacttcacccagaccgccggcccctggcacctggggaagctagagttagacttcgacctttgcgaaggtaccacggtggtggtagacgagcactgtggcaaccgggggccctccctccgcaccaccaccgtaacgggcaagatcatccacgagtggtgttgccggagctgcaccctgccgcccctgcgcttccgcggggaggacggctgctggtacgggatggagatccggcccgtgaaggagaaggaggagaaccttgtcaaatccatggtgagcgccggcagcggcgaggtggactccttcagcctggggctgctgtgcatctccatcatgatcgaggaggtcatgcgaagccgctggtcccggaagatgctgatgaccggcacactggctgtgtttttcctcctgatcatggggcagctgacctggaacgacctcatccgcctgtgcataatggtcggcgcgaacgccagcgaccgcatggggatgggcacgacctacctggccctcatggccactttcaaaatgcggccgatgttcgcagtcggcctgttgttcaggcggctcacttcccgcgaggtgctgctgctgaccatcgggctgagcctggtggcgtccgttgagctccccaatagcctggaggagctgggcgacgggctcgccatgggtatcatgatcctgaaactgttgaccgacttccagtcccatcagctgtgggccaccctgctctcccttacgtttatcaagaccaccctgtccctccactacgcctggaagaccatggcgatggtgttgagcatcgtctccctcttccccctttgcctgagcacaacctcgcagaagaccacctggctgcccgtgctcctgggctctctagggtgcaagccgctcacgatgtttctcatcgccgagaataagatatggggcagacgctcctggcccctgaacgagggcatcatggccgtcggcatcgtcagcatcctgctgagctccctgctaaagaacgacgtgcccctggccgggcccttgatagccggcggcatgctcatcgcgtgctacgtgatcagcgggtcgagcgccgacctgtccctggagaaagccgccgaggtaagctgggaggaggaggcagagcactccggcgcgtcccacaacatcctcgtggaggtgcaggacgacggaactatgaaaatcaaagacgaggagagggacgacactctgaccatcctgctcaaggccacccttctggcagtctccggagtgtacccgctcagcatccccgccacgctgttcgtgtggtacttctggcaaaagaagaaacagcgctcaggggtcctgtgggacacccccagcccgcccgaggtggagcgggccgtgctggacgacggcatctaccgcatcatgcagcggggcctcctggggcgctcccaggtcggcgtgggggtcttccaggagaacgtcttccacacgatgtggcacgtcacgcggggcgccgtgctgatgtaccaggggaagcgcctcgagcccagctgggcctccgtcaaaaaggatctgatcagctacgggggcgggtggagactgcagggttcctggaacacgggcgaggaagtccaggtaatcgccgtcgagcccggcaagaatcccaagaacgtgcagactgcccccgggactttcaagacccccgagggcgaggtgggcgccatcgcgttagactttaagccggggacgtcgggctcccccatcgtcaaccgcgaggggaagatcgtgggcctgtacgggaacggggtggtcacgaccagcggcacctacgtgagcgccatcgcccaagccaaagcgtcccaggaggggccgctgccggagatcgaagatgaagtgttccgaaagcgcaacctcacgatcatggacctgcacccaggcagcggtaaaacccggcgctacctgccggccatcgtccgggaggccatcaagaggaagctccgcaccctgatcctggccccaacccgtgtggtggcctccgagatggcggaggccttaaaaggcatgcccatccgctaccagacgaccgcagtcaagagcgagcataccggcaaggagatcgtcgacctgatgtgtcacaccacgtttaccatgcggctgctctcccccgtccgcgtcccgaactacaatatgatcatcatggatgaggcccacttcactgaccccagctccattgccgcgcgggggtacatcagcacccgcgtgggtatgggagaggccgccgccatcttcatgacggccacgccgcccggctctgtggaggcgttcccacagagcaacgcggtcattcaggatgaggagcgcgacatccccgagcgctcatggaacagcgggtacgagtggatcaccgatttccccggcaagaccgtgtggtttgtgccatccatcaagagcggcaacgacatcgccaactgcctgcggaagaacgggaagcgcgtcattcagctgtctcggaagacgttcgacacggagtaccagaagaccaagaacaacgactgggactacgtagtgaccacggacatcagcgagatgggcgccaacttccgcgcggatcgggtcatcgacccgcgcaggtgcctcaagcccgtgatcctgaaggacggacccgagcgcgtcatcctggctggccctatgccggtcaccgtggcgagcgccgcccagcggcgcggacggatcggccgcaaccacaacaaagagggcgaccagtacatttatatggggcagcccctcaacaacgatgaggatcacgcgcactggaccgaggccaaaatgctgctggacaacataaacactccagaggggatcatccccgccttgttcgagccggagcgcgagaagtccgccgcaatcgacggggagtaccggctgcggggcgaggcgcggaagacgttcgtcgagctgatgcgccgtggggatctccccgtgtggctgagctacaaagttgccagcgagggcttccagtactctgaccgccggtggtgcttcgacggcgagcgcaataatcaagtcttagaggagaacatggacgtggagatctggacgaaggagggtgagcggaagaagctccgcccccggtggctggacgcccgcacctactccgaccccctggccctccgggagttcaaggagttcgccgctggccgccgtagcgtgtccggtgacctgatactggagattggcaagctcccgcagcacctgacccaacgcgcccagaacgccctggacaacctcgtcatgctgcacaacagcgagcagggcgggcgggcctaccgacatgcgatggaggagctgcccgacacgatagagaccctcatgctgctggccctcattgccgtgctgacgggcggggtgacgttattcttcctctccggcagagggctgggaaagaccagcatcggcctcctctgcgtcatggccagcagcgtgctgctgtggatggcctccgtggagccacactggatcgcggcgagcatcatcctcgagttcttcctgatggtcttgctcatacccgagccagaccgacaacggacgccccaggacaaccaactggcgtacgtggtgattgggcttctcttcatgatcctgaccgtagccgccaacgagatgggcctgcttgagaccaccaagaaggacctgggtatcggccatgtggcggtcgaaaaccaccaccacgccgccatgctagacgtcgacctccacccagcctccgcctggacgctgtacgcggtggcaaccaccatcatcaccccgatgatgcgccacacgattgagaacaccaccgccaatatcagcctgaccgccatcgccaatcaagcggctatcctcatggggctggacaaaggctggcccatctcgaagatggacattggcgtgcctctgctcgccctggggtgctacagccaggtcaacccactgacgctcaccgccgcggtgcttatgcttgtggcccactatgccatcatcggcccagggctccaagccaaggccacccgcgaggcccagaagcggaccgccgccggcattatgaagaaccccacggtcgacgggattgtcgccatcgacctggatcccgtggtctacgacgccaagttcgagaagcagctaggccagatcatgctcttaatcctatgcacctcccagatacttctgatgcgcaccacctgggcgttgtgcgagtcgatcacgctagccaccggcccgctgaccaccctgtgggagggttccccgggcaagttctggaacacgaccatcgccgtgagcatggccaacatcttccgggggtcctatctagctggcgcgggcctggccttcagcctgatgaagtccttggggggcgggaggcggggcacgggggcccagggcgaaaccctgggcgagaaatggaagagacaactaaaccagctctccaagagcgagttcaacacgtacaagcggtccggtatcatggaggtggatcgcagcgaggccaaggagggcctgaagcgcggggaaacaactaagcacgccgtatcgcgaggcacggccaagttacggtggttcgtggagcgcaacctggtaaagcccgaagggaaggtcatcgacctcggctgcggccgcggcgggtggagctactattgcgccgggctgaagaaggtgaccgaggtgaaggggtacaccaagggcggccccgggcatgaggagcctattcccatggctacctacgggtggaacctggtcaagctccactccggcaaggacgtgttcttcataccgcccgagaagtgcgacaccctgctgtgcgacatcggggagagctcccccaacccgacgatcgaggagggccgcaccctccgggtgctgaagatggtcgagccctggctgcgtgggaaccagttctgcatcaagatcctcaacccctatatgcccagcgtggtggagaccttggagcagatgcagcggaaacacggcggtatgctggtccggaacccgttgtcccggaacagcacccacgagatgtactgggtttcctgtgggaccggtaacatcgtgagcgccgtgaatatgacttctcggatgcttctgaaccgcttcaccatggcacatcggaagcccacctacgagcgcgacgtggacctcggcgccggcacccggcacgtggccgttgagcccgaggtggccaatctggacataatcggccagcgcatagagaacatcaagcacgagcacaagtcgacttggcactacgacgaggataacccatacaagacctgggcctaccacgggtcctacgaagtgaagccgagcggctccgcgtctagcatggtcaatggtgtggtcaaactcctcaccaagccctgggacgtgatccccatggttacccagatagcaatgacggacaccaccccctttggccagcagcgggttttcaaggagaaggtcgacacccgcacgccaaaggctaagcggggcaccgcacagatcatggaggtaaccgccaagtggctgtggggattcctgtcccgcaacaagaagccaagaatctgcacccgcgaggagttcacaaggaaggtgcgcagcaacgcggccatcggcgccgtgtttgtggacgagaaccagtggaactccgccaaggaggcagtcgaggacgagcggttctgggacctcgttcaccgcgaacgggaactgcacaagcagggcaagtgcgcgacctgcgtttacaacatgatggggaagcgcgagaaaaagctgggggaattcggcaaggccaaggggagccgggccatctggtacatgtggctcggcgcccgctttctggagttcgaggcgctgggtttcatgaacgaagaccactggttctcccgggagaacagcttgtccggggttgagggggaggggctgcacaagctgggctacattctccgcgacatcagtaagatccccgggggaaacatgtacgcggacgacaccgccgggtgggacacccggattacggaggacgacctgcagaacgaggcccgcatcaccgatatcatggagccagagcacgccctgctcgcgaagtccatcttcaagctgacctaccaaaacaaggtggtgcgcgtccagcggcccgccaagaacgggacagtgatggacgtgatcagccgccgggaccagcgcggttccgggcaggtcggcacatacggcctgaacaccttcactaacatggaagcccaactaatccgccagatggagagcgaggggatcttttcccccagcgagctggagaccccaaacctggccgagcgcgtgctcgattggctggaaaagtacggcgtcgaaagactgaagcgcatggccatctccggggacgactgcgtcgtgaaaccaatcgacgatagattcgcgacggctcttaccgcactgaacgacatgggcaaggtccgcaaggatattccccagtgggagcccagcaaggggtggaacgactggcagcaggtccccttttgctcccaccatttccaccagctaatcatgaaggacggcagggaaatcgtggtgccatgccgcaaccaggacgagctcgtcggccgcgcccgcgtgtcacaaggagccggctggtccctgcgggagaccgcgtgcttagggaagtcctacgcccagatgtggcagttaatgtacttccaccgccgggacctgcgactagccgccaacgcgatctgcagcgctgtgccagtcgattggatccccacctcccggacgacctggtcaatccacgcccaccaccagtggatgaccacagaggacatgctctccgtgtggaaccgcgtgtggatcgaggagaacccctggatggaggacaagacgcacatcagctcctggggcgacgtcccgtacctggggaagcgcgaagaccagtggtgtggcagcctgattggcctcaccgcccgggccacctgggcgaccaacatccaggtggccatcaatcaggtgcgccggctgatcgggaatgagaattaccttgactacatgacctccatgaagcgcttcaagaacgaaagcgatcccgagggcgcgctctggtga

SEQ ID NO: 24629 - RNA, 9879 nt, synthetic construct
  misc_feature 1..9879: note = derived and/or modified CDS sequence (opt11) from DENV-1__JQ045642__SS-prME
  source 1..9879: mol_type = other RNA
agcgtgaccatgctactcatgctgatgcccacggccctggccttccacctcaccacccggggcggagagccccacatgatagtgagcaagcaggagagaggcaagagcctgttgttcaagaccagtgccggggtgaacatgtgtacactcatcgccatggacctgggcgagctgtgcgaggacaccatgacctacaagtgcccacgaatcaccgagacggagcccgacgacgtggactgctggtgcaacgccacggacacatgggtgacctacggaacctgcagccagacgggcgagcacagacgcgacaaaagatccgtggcccttgcgccccacgtgggcctggggctcgagacccgtaccgagacctggatgagctccgagggcgcctggaaacaaatccagcgggtggagacatgggccctccgccaccctgggttcaccgttatcgctcttttcctggcgcatgcgatcggcaccagtatcacgcagaaagggataatctttatcctcctgatgctggtaacaccctccatggccatgcggtgcgtcgggatcggtagccgcgacttcgtggaagggctctccggggccacctgggtggacgtcgttctggaacacgggagctgcgtgaccaccatggctaaggacaagcccacgctggacatcgaactcctgaagacggaggtcaccaaccccgccgtgctgcggaaactctgcattgaggcgaagatctccaacaccacgaccgacagccgctgcccgacccagggcgaggccaccctggtcgaagagcaggacgccaacttcgtttgccggcgcaccttcgtggaccggggctgggggaacggctgcgggctgttcggcaaagggtcgctcatcacgtgcgccaagttcaagtgcgtgactaaactggagggcaaaatcgtccagtgcgagaacttgaagtacagcgtgatcgtcacggtccacactggagaccagcaccaggtcgggaacgagtccaccgagcacggcacgaccgccaccatcaccccacaggctcccaccaccgagatccagttgaccgactacggcgccctgacgctggactgcagcccccgcaccggcctcgacttcaacgagatggtcctgctgaccatgaaggagaagtcctggctcgtgcacaagcagtggttccttgacctgccattaccctggacgagcggggccagcacttcccaggagacctggaaccggcaggacttgctagtaacctttaagaccgcccacgccaagaagcaggaggtcgttgtgctcggcagccaagagggcgcgatgcacaccgccctgaccggggccacggagatccagacgtctggcactacgaccatcttcgccgggcacctgaagtgccgcctcaagatggacaagttgaccctgaagggcatgagttacgtcatgtgcacgggatccttcaagttagagaaggaggtggctgaaactcagcacggcactgtgctggtccagatcaagtacgagggtacggacgcgccctgcaagatccccttcagcacacaggacgagaagggggtaacccagaacgggcgcctgatcaccgccaacccgatcgtgaccgataaggaaaagcccgttaacatcgaagccgaaccgcccttcggggagtcctacatcgtgatcggcgcaggcgagaaggcgttgaagctcagctggttcaagaaagggtcgagcatcggcaagatgttcgaggccacggcccgaggtgcccggcgcatggccatcctaggcgacactgcgtgggacttcgggtccatcggcggagtttttacctcagtcgggaaactggttcaccagatcttcggcaccgcctacggggtacttttctccggcgtcagctggacgatgaagatcggcatcggcgtcctgctgacgtggctcggcctgaactctcgttccacttccctttcgatgacctgcatcgccgtgggactcgtcacgctgtacctgggcgtgatggtccaagccgactccgggtgcgttatcaactggaagggccgggagctaaagtgcggcagcggcatcttcgtgaccaacgaggtgcacacatggactgagcagtacaagttccaggctgactcgcctaagcgcctgtccgcggccatcggcaaggcttgggaagagggggtttgcggcattagatctgccaccagactggagaacatcatgtggaagcagatttccaatgagctcaaccacatcctgctggagaacgacatgaagttcacggtggtggtcggtgacgtagccggcattctcgcgcaggggaagaaaatgatccggccccaacccatggagtacaagtacagctggaagtcatggggcaaggccaagataatcggagccgacgttcagaacaccaccttcatcatcgacggacccaataccccggaatgcccggacgaccagcgcgcctggaacatctgggaggtcgaggactacggcttcgggatcttcacgaccaacatctggctgaaactgcgggactcgtacacccaggtatgcgaccataggctcatgtccgcggccattaaggacagcaaggccgtgcacgcagacatgggctactggatcgagagcgagaagaacgagacctggaaactagcccgggcgagcttcatcgaagtcaagacgtgcatctggcccaagtcccacacgctgtggagcaacggtgtgctcgaaagtgagatgatcatccccaagatatacgggggcccgataagtcagcacaactaccgccccgggtatttcacccagacggccggcccctggcacttggggaagctggagctcgacttcgacctgtgcgagggcacgaccgtggtcgtcgacgagcactgcggcaatcgtggaccgtccctgcgcaccaccacggtgaccggcaagatcatccacgaatggtgctgtaggagctgcaccctgccaccactccggtttagaggcgaggacggctgctggtacgggatggagattcgccccgtgaaggagaaggaagagaacctggtcaagtccatggtctcggccggaagcggggaggtcgactccttcagccttgggctgctgtgcatctccatcatgatcgaggaagtgatgcggagccgttggtcccggaagatgctcatgaccgggacgcttgccgtgttcttcctactcatcatgggtcagctgacctggaatgacctgatccgcctctgcatcatggtaggtgccaacgcgagcgaccgcatggggatgggcacaacctacctggccctgatggctacgtttaagatgcggccgatgtttgcggtggggctcctgttccgccggctgacctcccgcgaggtgctccttctgaccatcgggctcagccttgtcgccagtgtcgagctgcccaacagcctcgaggagctgggcgacgggctggcaatgggcatcatgatcttaaagctgcttaccgattttcagtcccaccagctctgggccacgctgctgagcctcaccttcataaagaccaccttctccttgcactacgcttggaagacgatggctatggtcctgtctatcgtgtccctcttccctctgtgtctgagcacaacctcccagaagacgacgtggcttcccgtgctgctgggcagcttagggtgcaagccgctgaccatgttcctgatcgcggagaataagatctgggggagacggtcctggcccctcaacgaggggatcatggccgtcggaattgtgagcatcctgctgagctccctattaaaaaacgatgtgccccttgctggccccctaatcgccggcggaatgctgatcgcctgctacgtcatcagcgggtccagcgccgacctgtccctcgagaaggcagccgaggtgtcgtgggaggaggaggctgagcactcaggcgccagccacaacatcctggtggaggtacaggacgacgggaccatgaagatcaaggacgaggagcgggatgacaccctgaccatccttcttaaggcgacgctcctcgccgtgtccggtgtttatccactgtcaatccccgcgacgctcttcgtctggtacttttggcagaagaagaagcagcgctccggtgtcctctgggacacccccagcccgcccgaggtgggcagagctgtcctggacgacggaatctatcgcatcatgcagcgggggctgctaggccgctcccaggtgggggtgggagtctttcaggagaatgtattccacacaatgtggcacgtgacgcgcggggccgtcctcatgtatcagggcaagcgcctggagcccagctgggcgtctgtgaagaaggatctgatcagctatggagggggctggcggctacaagggtcctggaataccggcgaggaggtgcaggtcatcgccgtggagcccgggaagaaccccaagaatgtgcaaaccgcccccggcaccttcaagacgcccgagggcgaggtcggggccatcgccctggactttaagcccggaaccagcgggagtcccatcgtgaacagggagggtaagattgtcggcctatacgggaacggcgtagtgacgaccagcgggacgtatgtgtccgcaatcgcgcaggccaaggcttcccaggagggcccgttacccgagatcgaggacgaggtcttccggaagcgcaacctgaccatcatggaccttcaccccgggagtggcaagacccggcgctacctcccggcgatcgttcgggaggccattaagcgcaagctgcgcaccctgatcctcgcccccacgcgggtggtcgcctccgagatggccgaagcgctgaagggaatgccgatccgctaccagaccacggccgtcaagagcgaacacaccggtaaggagatcgtggatcttatgtgtcatgccacgttcacaatgcggctcctgtcccccgtccgcgtgccgaactacaacatgatcatcatggacgaggcgcacttcaccgaccccagcagcatagccgcgcgggggtacatcagcacccgagtggggatgggcgaggccgcggccatcttcatgacggccacgccacccgggtcagtcgaggcgttcccgcagagcaacgccgtgatccaagacgaggagagggacatccccgagcgctcctggaacagcggatacgagtggattaccgacttccccggcaaaaccgtgtggttcgtccccagcattaagagcgggaacgacatcgctaactgcctgcggaagaacggcaagagggtgatccagctttcgcggaagacgttcgacaccgagtatcagaagacgaagaacaacgactgggactacgtggtgaccacggacatcagcgagatgggcgctaacttccgcgcggaccgggtgatcgacccgcgccgttgcctgaagcccgtgattctaaaggacggacccgaacgcgtcatcctcgccggtcccatgccggtgaccgtcgcctccgccgcccagcgccgcggccgtatcggacgcaaccataacaaggagggtgaccagtacatctacatgggccaaccccttaacaacgacgaggaccacgcccactggaccgaggccaaaatgttactcgacaacataaacacccccgagggaatcatccccgccctgttcgagccggagcgcgagaagtccgccgcgatcgacggcgagtaccggttacggggggaggcgcggaagacgttcgtggaactcatgcgccggggcgacctgcccgtctggctgtcctataaggtcgccagcgagggcttccagtacagcgaccgccggtggtgctttgacggcgaacgcaacaaccaggtgctcgaggagaacatggacgtggagatctggaccaaagagggcgagcggaagaagcttcgccctaggtggctggacgcccgcacctactccgaccccctcgctctgcgggagtttaaagaattcgccgccggacgccggtccgtctcaggggacctgatcctcgagataggcaagctgccgcagcacctgacccaacgcgcccagaatgccctcgacaatctggtaatgctgcacaactctgaacaaggcggacgggcctaccgccacgcgatggaggagcttcccgacacgatcgagactctgatgctgctcgcactgatcgccgttctgacggggggcgtcaccctcttcttcctttccgggcgtggcctaggtaagacctcgatcgggttactgtgcgtaatggcctctagcgtgctgctctggatggcatccgtcgaaccccattggatcgcggccagcatcattctggaattcttcctgatggtgctcttaatacccgagccagaccgccagcggacaccgcaggacaaccagctggcgtacgtggtcatcggcctcctgttcatgatcctgaccgtggccgcaaacgagatggggctcctggagaccaccaagaaggacctgggcatcgggcacgtggcggtcgagaaccaccaccacgccgccatgctcgacgtggacctgcaccccgcctccgcctggacgctatatgcggtggcaaccaccatcatcacccctatgatgcgccacacgatcgagaacaccaccgccaatatttcactcaccgccatcgccaaccaggcggccatcctgatgggcctagacaagggctggcccatctcgaagatggacatcggtgtacccctcctggccctgggctgctattcccaggtgaaccccctcacactgaccgccgcggtgctgatgctcgtcgcccattacgctataatcggtccgggcctgcaggccaaggccacacgcgaggcgcagaaaaggacagctgccggaatcatgaaaaaccccacggtggacggtatcgtggccatcgacctggacccggtcgtgtatgatgcaaaattcgaaaagcagctcggtcagatcatgctcctaattctatgcactagtcaaatcctgcttatgcgaacgacctgggccctatgcgagagcatcacgttggccaccgggcccctgaccacgctctgggagggcagcccgggcaagttctggaatacgacaatcgccgtgagcatggccaacatattccgtggttcatacctagccggcgcggggctggccttcagcctcatgaagtccctgggcggcggccgccgggggaccggcgcccagggagagacccttggggagaagtggaagcgccagctcaaccagctgtccaagagcgagttcaacacgtataagcggtccggtatcatggaagttgaccgcagcgaagccaaagaagggctgaagcggggggagaccacgaagcacgccgtgtctcgcgggaccgccaagctccggtggtttgtggagaggaacctggtcaagcctgagggcaaggtgatcgacctgggctgtggtcggggagggtggagctattactgcgccggtctgaagaaggtgacggaagtcaaggggtacacgaagggcggccctgggcacgaggagcccataccgatggccacctacggctggaacctcgtgaagttacactcggggaaggacgttttcttcatcccgcccgagaagtgcgacaccctgttgtgcgatatcggcgagagctcccccaacccgacgatcgaagaaggtcgcaccctgcgtgtcctgaagatggtggagccctggctccgcggcaaccaattttgcatcaagatcctgaacccatacatgcccagcgtggtcgagacactagagcagatgcagcggaagcacggcgggatgcttgtgcgcaacccactatccaggaacagcacccacgagatgtactgggtcagttgcggcacagggaatatagtcagcgccgtgaacatgacgagccgcatgctgctcaaccgcttcaccatggctcaccggaaaccgacctacgagcgagacgtggacctgggcgcgggtaccaggcacgtcgccgtagagcccgaagtagccaacctggacatcatcgggcagcgcatcgagaatatcaagcatgaacacaagagcacgtggcactatgacgaggacaacccctacaagacctgggcctaccacggctcctacgaggtcaagccgtcggggtccgcgagctccatggtgaatggcgttgtgaagctcctgacgaagccctgggacgtgatccccatggtaacccagatcgctatgactgacaccaccccattcgggcagcagcgggtgttcaaggagaaggtggacacgcgcacgccgaaagccaagcggggcaccgcccagatcatggaagtcactgccaagtggttgtggggctttctctcccgcaacaagaagccccggatctgcacccgcgaggagttcacgcgcaaggtgcgcagcaacgcggccataggggccgtgttcgtcgacgagaatcagtggaactccgccaaggaggcggtggaggacgagcggttctgggatctcgtgcaccgcgagcgggagctgcacaagcagggcaaatgtgcgacctgcgtctacaacatgatgggtaagcgcgagaagaagctcggcgagttcggtaaagccaaaggaagtcgggccatctggtacatgtggctgggcgcccgcttcctggaattcgaggcgttagggttcatgaacgaggatcactggttctcccgggagaacagcctgtccggcgtcgagggagaaggcctgcacaagcttggttacattctgcgcgacatcagcaaaatcccaggcggaaacatgtacgccgacgacactgccgggtgggacacccggatcacggaagacgacctgcagaacgaggcccgaattaccgacataatggagccggagcatgccctcctggcgaagtcaatcttcaagctgacctaccagaataaggtggtccgcgtgcagcggcccgccaagaacggcaccgtgatggacgtcatttcacgccgggatcagaggggctccggccaagtgggtacctacgggctcaacaccttcaccaacatggaggcccagctgatccggcagatggagtctgagggtatcttctcccccagcgagctggagacgccgaacctagcagagcgcgtgctggactggctggagaaatatggggttgagcggctcaagcgcatggcgatttcgggcgacgactgcgtggtgaagccgatcgacgaccggttcgctacggccctgaccgccctgaacgatatggggaaggtccggaaagatatccctcagtgggagcctagcaaggggtggaacgactggcagcaggtcccgttctgttcacaccacttccaccaactcatcatgaaagatggccgggaaatcgtagtcccatgtcgtaaccaagacgagctggtggggcgggcgcgcgtgtcacagggcgctgggtggagcctccgggagaccgcgtgccttggcaagtcctacgcccagatgtggcagctgatgtatttccaccgaagagacttgaggctcgccgccaacgcgatctgctcagctgtacctgtggactggattccaacctcccggaccacatggagcatccacgcccatcaccagtggatgacaaccgaggacatgctgtccgtttggaaccgcgtctggatcgaggagaacccctggatggaggacaagacgcacatcagtagttggggcgatgtgccgtacctgggcaaacgtgaggaccagtggtgcggctcgctcatcggcctgaccgccagagcgacctgggcgaccaacatccaagtggccattaaccaggtacgacggctgatcggcaatgagaactacctagattacatgacctccatgaagcgtttcaagaacgagagcgatcccgaaggggccctttggtag

SEQ ID NO: 24630 - RNA, 9879 nt, synthetic construct
  misc_feature 1..9879: note = derived and/or modified CDS sequence (opt11) from DENV-1__JQ045644__SS-prME
  source 1..9879: mol_type = other RNA
tctgtgaccatgttactcatgctgatgcccactgctctagctttccacctcaccaccagaggaggggagccccacatgatcgttagcaagcaggagcggggcaagtcactgctgtttaagacgagcgccggcgtgaatatgtgcacccttatcgccatggacctgggagagctatgcgaggacaccatgacctataaatgcccccggatcaccgagaccgagccggatgacgtggactgctggtgcaacgccacggatacctgggtgacctacgggacgtgcagccagacaggcgagcaccggcgggacaaacgatccgtagccctcgcaccccatgtgggactggggctggagactcgcactgaaacttggatgagctccgaaggagcatggaagcagatccaacgggtagagacttgggccttgagacaccccgggttcaccgtgatcgccctgttcctggctcacgcgatcggcaccagtatcacacagaaggggatcatcttcatcttactgatgctggtcacgccctctatggcgatgcgatgtgtaggcatcggcagccgcgacttcgtggaggggctcagtggggccacctgggtggacgtcgtgctggagcacgggagctgtgtaaccaccatggccaaggataaacccactttggacatcgagcttctgaagaccgaagtcaccaaccccgcggtgctgcggaagctctgcatcgaggcgaagatctccaacaccacgaccgacagccgctgcccgacacagggagaggccaccctggtcgaggagcaggatgccaatttcgtctgccgccgaacgttcgtggaccgaggctgggggaacggctgcggactgttcggcaagggatctctcataacgtgcgcaaaattcaagtgcgtgaccaagttagaaggcaaaatagtccagtacgagaatctcaagtattcagtaatcgttaccgtccatacgggcgaccagcatcaggtggggaacgagtccacggaacacggtaccacagcgaccatcacgccccaagcgccgacgaccgaaatacagctcaccgactacggggccctaacgctcgactgctcccctagaacgggcctcgatttcaacgagatggtcttattaaccatgaaggaaaaatcctggctcgtccacaagcagtggttcttggacctgccgctcccctggaccagcggggcaagcacgtcccaggagacctggaaccggcaggacttgttagtgaccttcaaaaccgcccacgccaagaagcaggaggtcgtggtgctcgggagccaagagggcgcgatgcacacggccctgactggggcaaccgagatccagacctccggaacgacaaccatattcgccgggcacctaaagtgccgcctaaagatggacaagcttaccttaaagggcatgagctatgtaatgtgcacggggtccttcaagctcgagaaagaggtggccgagacccaacacggcaccgtgctggtccagatcaagtacgagggcaccgatgcgccctgcaagatcccctttagcactcaagacgagaagggggtgacacagaacggccggcttattaccgccaatcccatcgtgacagacaaggagaagccggtcaacatcgaggccgagccgcccttcggggagtcgtacatcgtgataggcgccggcgagaaggcgctaaagttgtcctggttcaagaaggggtccagcatcggcaagatgttcgaggccacagcgcgcggggcgcggcgcatggccatccttggcgacaccgcgtgggacttcgggtccatcggcggcgtattcacctcagtcgggaagctggttcaccaaatctttggcaccgcctacggagtgctgttctccggcgtctcatggactatgaagatcgggatcggcgtgctgctgacctggctcggcttaaacagtcgtagcacctccctaagcatgacatgcatcgccgtggggctcgtgaccctgtaccttggtgtgatggtgcaggctgactccgggtgcgttatcaactggaagggcagggagctcaagtgcgggagcggcatcttcgtgacgaacgaggtgcacacctggactgagcagtacaaattccaagccgacagtccgaagcgactgagtgcggccatcgggaaagcctgggaagagggggtctgcggcattcggagcgctacgcgcctggagaacatcatgtggaagcagatctccaatgagctcaaccacatccttctggagaacgacatgaagttcacagtggtggtaggggatgtggccgggatcctcgcgcagggtaagaagatgatccggccccagccaatggaatacaagtacagctggaagtcctggggcaaggccaagatcatcggagccgacgtgcagaacacgacgttcatcattgacgggcccaacacgccagagtgccccgacgatcagcgagcctggaacatctgggaggtagaggactacggcttcggaatcttcacgaccaacatatggctgaagctgcgggatagctacacccaggtctgcgaccatcgcctgatgtctgcggcaataaaggacagcaaggccgtccatgccgacatgggatattggatcgagtccgagaaaaacgaaacctggaagctggcccgggcttctttcattgaggtcaagacgtgcatctggcccaagtcccacaccctatggtctaacggcgtgctcgaatccgaaatgatcatccctaagatttacggcggtccgatcagccagcataactaccgccccgggtacttcacccagaccgccggcccctggcacctggggaaactggagttagacttcgatctgtgcgagggtacgacggtggtcgtggacgagcactgcggcaacagagggccgagcttgcgaaccaccacggtgacgggcaaaattatccacgagtggtgctgccggtcttgtactctaccgcccctgcgcttccgcggggaggatggttgctggtacgggatggagatccgccccgtcaaagaaaaggaggagaatctggtgaagtccatggtgtctgccggttcaggcgaggtggacagctttagcttagggttactgtgcatcagcataatgatcgaggaggtcatgcgtagccgctggtccagaaagatgcttatgaccggcacgctggccgtcttcttcctgctaattatggggcagctgacctggaacgatttaatccgcttatgcatcatggtcggggccaacgcatcagacaggatggggatgggcactacgtacctggctctgatggccgccttcaagatgcgaccgatgttcgccgtgggcctcctcttccgacggttaacgagccgcgaggtgctcctgctgaccatcgggctcagcctggtcgcctccgtggaactgccaaacagtctggaggagctgggcgacggactggccatgggcatcatgatcttgaagttgctgaccgacttccagtcccaccaactctgggccaccctgctgtccctcactttcatcaagactaccttctctctccactacgcatggaagaccatggcgatggtcctgtccatcgtgagtctcttccccctgtgcctgagcacaacctcgcagaagaccacgtggctccccgtgctgttaggcagcctcggctgtaagccgctgacgatgtttctgatcgccgagaacaagatttgggggcggcgctcgtggccgctcaacgaggggattatggctgtcgggatcgtcagcatcctgctctcttctttgctgaagaacgatgtcccccttgccgggcccctaatcgcgggcggcatgttaatcgcgtgttacgtcatcagcggatctagcgcggacctgtcgctcgagaaagcagctgaggtgtcgtgggaagaggaggccgagcactccggcgcttcccacaatattctggttgaggtgcaggacgatgggaccatgaaaatcaaggacgaggaacgggacgacactcttaccatcctcctgaaggccacactgttagccgtgtccggagtgtacccactgagtatcccagccacgctcttcgtctggtacttctggcagaagaagaagcaaaggtccggtgtgctctgggacaccccctcgcctcccgaagtggagcgggcagtcttagacgacgggatctaccgaatcatgcagcggggcttgctggggcgctcccaggtgggcgtaggggtcttccaagagaacgtgttccacacgatgtggcacgtgacacggggcgcagtcctcatgtatcaggggaagaggctggagcctagctgggccagtgtgaagaaagacctgatctcatacggcggcgggtggcggcttcagggctcctggaacacgggggaggaggtgcaggtaatcgcggtagaacccggcaagaaccccaaaaacgtgcagacggcccccgggacctttaagacccccgagggcgaggtcggcgcgatcgcgctggactttaagcccgggacgagcggctcccccattgtgaaccgcgagggcaaaatcgttggcctttacggcaatggggtcgtgaccaccagtggcacctacgtgagcgccatcgcccaggccaaggcctcccaggagggtccgctccccgaaatcgaggacgaagttttccggaagcgcaatctgactatcatggacctgcaccccggtagcgggaagacccggcgctacttaccagccatagtgcgagaggccatcaagcgcaagttacgcaccctaatcctcgccccgacgagggtagtcgcctctgagatggcggaggcactaaagggcatgcccatccgctaccaaacgaccgctgtcaagagcgagcacaccggtaaggagatcgtggacctgatgtgccacgccacgttcacaatgcggctcctgtcacccgtacgcgtgccgaactacaatatgattatcatggacgaggcccacttcactgacccaagctccatagcggcgcgggggtacattagcactcgggtcgggatgggggaggctgccgccatattcatgaccgccacgcctcccggctcagtcgaggcgttcccccagagtaacgccgtgatccaggacgaggagcgggacatccccgaacgctcctggaacagcgggtacgaatggataaccgacttccctggcaagaccgtgtggttcgtcccctccatcaagagcgggaatgacattgccaactgcctgcgcaagaacgggaagcgcgtgatccagttgtcacgcaagaccttcgatacggaatatcaaaagaccaaaaacaacgactgggattacgtggtcactaccgacatctcagagatgggcgcgaactttcgcgccgaccgtgtgatcgaccctcgccggtgcttgaagccagtgatcctgaaggacggccccgagagggtcatccttgccggcccgatgccggtgacggtcgcctccgcggcgcagcgaagagggcggattgggcgcaatcacaacaaggaaggcgaccagtacatctacatgggccagcccctcaacaacgacgaggatcacgcccactggaccgaggccaagatgctgctagataacattaatacccccgagggcataatccccgccctcttcgagccggagagggagaagtccgccgcaatcgacggggagtaccggctccgcggcgaagcccggaaaacctttgtcgaactcatgcggcgcggggacctgcccgtgtggctctcttacaaggtcgcctcggagggcttccagtatagcgacagacggtggtgcttcgatggagagcgcaataaccaggtgctcgaggaaaatatggatgttgagatctggacgaaggagggggagcggaagaagctccgcccgcggtggctggacgcccgcacctactctgaccccctcgcgcttcgagagttcaaggagtttgcggccgggcgccggagcgtctccggggatctgatactggagattggcaagctgccgcagcacctgactcagcgcgcccaaaacgcgctcgacaacctggtgatgttgcacaacagcgagcagggcgggcgggcttaccgccacgcgatggaagagctccccgacaccattgagaccctgatgttactcgcgcttatcgccgtgctgaccggcggggtcaccctcttcttcctgtcgggccgggggctgggcaagactagcatcggtctcttatgcgtgatggcctcctccgtgctgttatggatggcgtccgtcgagccccattggatcgcagccagcatcatccttgagttcttccttatggtgctcctaatccccgagccagaccgtcaaaggacgccccaagacaaccagctggcgtacgtggtcatcggactcctgtttatgatccttacggtggctgcgaacgagatgggcctcctcgagaccacaaagaaagacctcggaatcggccatgtagccgtcgagaaccaccaccacgccgctatgctcgacgtggacctgcatcccgcctccgcatggaccctatacgcggtggccaccacgatcataacccctatgatgcgacacaccatagagaacacaaccgccaacataagcctcacagccatcgcgaaccaggccgccatcctgatggggttggataagggctggcccatatccaagatggacatcggcgtacccctcttagccctcggctgttacagccaggtgaacccactcaccctgacggctgcagtgctaatgctcgtcgcccactacgcgatcatcggcccgggtttgcaggccaaggcgacccgcgaggcacagaagcggacggcagctggcatcatgaagaatcccacagtggacgggatcgttgccatcgacctggaccccgtggtatacgacgcgaagttcgagaagcagttgggacagatcatgttactgatcctctgtacgtctcagatactgctgatgcgcaccacctgggctctttgcgagtccatcacgctggccacgggtcccctgaccaccctctgggagggcagtcccgggaagttctggaacacaacgatcgccgtgagtatggccaacattttccgagggtcctatttggcgggtgctggcttagcttttagccttatgaagtccctcgggggtgggcgccgggggaccggggcccagggcgagaccctgggagagaagtggaagcgccagctcaaccagctctccaagagcgagttcaacacctacaagcggtccggtataatggaagtcgacagaagcgaagcgaaggagggcctgaagcgcggggaaacgaccaagcatgctgtatccaggggcaccgccaaactccggtggttcgtggagcgcaacctggtcaagcccgaggggaaggtcatcgacctgggttgcgggagggggggctggtcctactactgcgcaggcctaaagaaagtgaccgaggtcaaggggtacacgaagggcggccccggccacgaggagccaatccccatggccacatacgggtggaacctggtgaaattgcactccggaaaggacgtcttcttcatccctccggagaagtgcgacacgctgctctgtgacatcggggaaagctcaccgaatccgaccatcgaggaggggcgcacgctgcgggtcctgaaaatggtggagccctggctgcgcgggaaccaattctgcatcaagatccttaacccctacatgccctcagtggtcgagactttagagcagatgcagcggaagcacggcggcatgctcgttaggaatccgttgagtcggaacagcacgcacgagatgtattgggtgtcctgcggaactggcaacatcgttagcgcggtgaacatgacttcacgcatgttgttaaacaggtttacgatggcccacaggaagcccacgtacgagcgcgacgtggacctgggggcaggtacccgccacgtggccgtggagcccgaagtagccaatttagatatcattggccagcgcatcgagaacatcaagcacgagcacaagagcacctggcactacgacgaggataacccgtacaagacgtgggcgtaccacggtagttatgaggtcaagccgtctggcagtgcaagcagcatggtgaacggggttgtgaaattgctaaccaagccctgggacgtgatccccatggtcacccagatcgccatgaccgacactaccccctttggacagcagagggttttcaaggagaaggtagacacgcgcactccgaaggccaaacgggggacggcacagatcatggaagtgaccgcgaaatggctgtggggctttctcagccgcaacaaaaagccccggatctgcacccgcgaggagttcacccgtaaggtgcgcagcaacgccgcaatcggcgcggtgttcgtcgacgagaaccagtggaactccgcgaaggaggccgtggaggatgagcggttctgggaccttgtccatcgcgagcgggagctgcacaagcaggggaagtgcgccacgtgcgtctacaacatgatgggtaagcgcgagaagaaattgggtgagttcggcaaggcgaaggggtcacgtgccatctggtacatgtggctgggcgcgcgctttcttgagttcgaggccctaggattcatgaacgaggaccactggttctcccgggagaacagcctatccggggtggaaggcgaggggctgcacaaactcggatacatcctgcgcgacatctcgaagatcccagggggcaacatgtacgcagacgacactgccggctgggacacgcggatcaccgaggacgatttacagaacgaggcccgcatcacggatatcatggaaccggagcacgcgcttctggcgcgctccattttcaagcttacctaccagaacaaggtggtccgtgtgcagcgccccgccaagaatggtacggtgatggacgtcatcagccggcgcgatcagcggggttccggtcaggtcgggacctacggcctcaacaccttcacgaacatggaggcccagctgatcagacagatggagagcgaggggatcttctcccccagcgagctggaaacccccaacctcgcagagcgggtgctggactggctggagaagtacggcgtcgagcgccttaaaagaatggcgatctccggggatgactgcgtggtgaagccgatcgacgaccgcttcgcgaccgccctaacggccctgaacgacatgggcaaggtccggaaagacatcccccagtgggagcctagcaaggggtggaacgactggcagcaggtccccttctgctcccaccacttccatcagctaatcatgaaggacggccgcgagattgtcgtcccatgccggaatcaggacgagctggtgggccgagcccgggtgagccagggggcgggatggagcctccgggagaccgcctgccttgggaagtcgtacgcacagatgtggcagctgatgtactttcaccggcgcgacctgcgtctagccgcaaacgccatctgctcagctgtccccgtggactggatacccacgtcccgcaccacgtggagtatccacgcccatcaccagtggatgacgactgaggacatgctctccgtgtggaaccgtgtctggatagaagagaacccctggatggaggacaaaacccatatcagctcctggggcgacgtcccgtacctaggtaagcgggaagaccagtggtgcggtagcttaatcggccttaccgcgcgtgcgacctgggccaccaacatccaagtggccatcaaccaggtccggaggctgataggaaacgaaaactacctcgactacatgacgtccatgaaacggttcaagaacgagagtgacccggagggcgccctgtggtga

SEQ ID NO: 24631 - RNA, 9879 nt, synthetic construct
  misc_feature 1..9879: note = derived and/or modified CDS sequence (opt11) from DENV-1__JQ045648__SS-prME
  source 1..9879: mol_type = other RNA
tccgttaccatgctcttaatgctcatgccgaccgcgttggcattccacctcactaccagaggaggggaaccccatatgatcgtcagcaagcaggagcggggtaagagtctgctgttcaaaaccagcgccggtgtcaatatgtgcactttaatcgcaatggacctgggcgagctgtgcgaagatacaatgacctacaagtgcccccggattaccgagaccgagcccgacgacgtggactgctggtgtaacgcaacggatacctgggtcacctacggaacctgcagccagaccggcgagcacagacgtgacaagcgttcggtggccctcgcgcctcacgtcggcctcgggctggagacccgcacggagacttggatgagctccgagggggcctggaagcagatacaacgggtcgagacgtgggccctgcggcaccccgggttcaccgtgatcgccctgttcctagcccacgcaatcgggacatcgatcacccagaaggggatcatcttcatcctcctgatgctggtgaccccctccatggccatgcggtgcgtaggcatcggcagccgcgacttcgttgaggggctcagcggcgccacctgggtggacgtcgttttggagcacggcagctgcgtgactaccatggccaaggataagcccacgctggacatcgagctactgaaaaccgaagtcaccaaccccgccgtgctgcgaaagctctgcatcgaggccaagatctctaacaccacgaccgacagccgttgccctacccagggcgaggccacactggtggaggaacaggacgccaacttcgtctgccggaggaccttcgtggaccgggggtggggcaacggctgcgggctgttcggcaagggttcgcttatcacgtgcgccaagtttaaatgcgtcacgaagctggaggggaagatcgtccagtacgagaatctgaaatacagcgtgatcgttactgtgcatacgggcgaccagcaccaagtggggaacgaatccactgagcacggcaccacagccaccatcacgccccaagcgcccactaccgagatccaactcaccgattacggggcgctgacactggactgcagcccacgcaccggcctcgacttcaacgagatggtcctgctgaccatgaaggagaagtcctggctcgttcacaagcagtggttcctggacctgcccttaccctggaccagcggggccagcacgtcacaggagacatggaaccgccaggacctgctggtaacgttcaagaccgcccacgccaagaagcaagaagtagtggtgctcggcagccaggagggagcgatgcacacagctctgaccggggccaccgagatccaaacatccgggacgaccaccatcttcgccgggcacctaaagtgccgcctcaagatggacaagctgaccctgaagggaatgtcctatgtcatgtgcacggggtccttcaagctcgagaaggagctcgccgagacccaacacggcacggttttagtgcagatcaagtacgaaggcaccgacgctccgtgcaagatcccgtttagcacgcaggacgagaagggggtcgcccagaacggccggctgattacggccaacccgatcgtcactgacaaggaaaagcccgttaacatcgaggccgaaccgcccttcggggagagttacatcgttataggtgcgggcgagaaggcccttaaattgagctggttcaagaaggggagcagcataggtaagatgttcgaggccactgcccgcggggcccggcgtatggcaatcctcggcgacacggcatgggacttcgggtctataggcggagtattcaccagtgtggggaagctagttcatcaaatctttggcaccgcctacggggttctgttctccggggtgagctggaccatgaagatcgggatcggcgtgctgctcacgtggctggggctgaactcacgctccacttccctcagtatgacctgtatcgccgtcggcctggtgacgctgtacctcggtgtcatggtgcaggcggattccgggtgcgtaatcaattggaagggacgggagctgaagtgcggtagcggcattttcgtcactaacgaggtccacacctggaccgagcaatacaagttccaagcagatagcccgaagcgcctgtccgcagccattggaaaggcctgggaagagggggtgtgtggcattcggagcgccacccgcttggagaatatcatgtggaagcaaatctctaatgaactgaatcacatcctgctcgagaacgacatgaagtttaccgttgtggtgggggacgtggccggcatcctggctcaagggaagaaaatgatccggccccagccaatggaatacaagtacagctggaagtcctggggcaaggccaagatcattggcgctgacgtgcaaaacacgaccttcatcattgatgggcctaacaccccggagtgccccgacgatcaacgcgcgtggaacatctgggaggtggaagactacggctttgggatcttcaccactaatatctggttaaaacttcgggacagctacacccaagtgtgcgatcaccggctgatgtccgccgccatcaaagacagcaaggctgtgcacgccgacatgggctactggatcgagtctgagaagaatgagacctggaagctggcgcgcgcaagtttcatcgaggttaagacctgtatctggccgaaaagtcacacgctgtggagcaatggcgtactggagtccgaaatgatcatccccaagatctacgggggtccaataagccagcataactaccgccccgggtacttcacccagactgccggcccctggcacctggggaagctcgagctggatttcgacctgtgtgagggcacgacagtggtcgtcgacgagcactgcggcaaccggggcccgtctctgcgcaccacaaccgtgacgggcaagattatacacgagtggtgctgccggagctgcaccctgccacccttacgctttcgtggggaggacggctgctggtacggtatggagatccgccccgtgaaagagaaggaagagaacctcgtcaaatccatggtaagcgccggcagcggcgaggtagactccttctcgctggggctgctctgtatctccatcatgatcgaggaggtgatgcggtcacggtggtcccgtaaaatgttgatgaccggaaccctggccgtcttcttcctcctgatcatggggcaactgacgtggaacgacttaatccgtttgtgcattatggtgggtgcaaacgccagcgaccgcatggggatgggaacaacctacctggccctcatggccacgtttaaaatgagaccgatgttcgccgtagggctgctgtttcggcggctcacatcgagagaggtgctgctgctcaccatcggcttatcactggtggcgagcgtcgaactcccaaactcgctcgaggagttaggcgacgggctagccatgggcatcatgatccttaagctgctcacagacttccagtcccaccagctgtgggcaacgctgttgtcgctgacgttcatcaagaccacactgtcccttcactacgcttggaagaccatggcgatggtattgagtatcgtctccctattccccctctgtctgagcactaccagccagaagaccacctggttacccgtgctcctgggcagcttggggtgcaagccgctaacaatgttcttgatcgccgagaacaagatctggggcagacgcagttggcccctgaatgaaggtataatggccgtgggcatcgtcagcatcctgctgagctccctgctcaagaatgatgtgcctctggcagggcccctgatcgccggtggcatgctcattgcgtgctacgtgattagcgggagttcagcagacctgtccctggaaaaggccgcagaggtcagctgggaggaggaggccgagcactccggcgccagccacaatatcctcgtggaggtgcaggatgatggaactatgaagatcaaagacgaggagagggatgacaccctgaccattctcctcaaggcaactctgctggcggtatccggcgtgtacccgctcagcatccccgccacacttttcgtgtggtacttctggcagaagaagaaacaaagaagcggggtcttatgggacaccccgtctccgcccgaagtggaacgggcagtgctggacgacggcatttaccgtatcatgcagcgaggcttacttggcagaagccaggtaggcgtgggggtgttccaggaaaatgtattccataccatgtggcacgttacccggggcgcggtgctgatgtaccaagggaagcgcctcgagccgtcctgggcttccgtgaaaaaggaccttattagctacggcggcgggtggcggcttcagggctcatggaacacgggagaggaggtgcaagtgattgccgtcgaacccggcaaaaaccccaaaaacgtgcagaccgcccccgggaccttcaagacaccggagggcgaagtgggtgccatcgcgctcgacttcaagcccgggaccagcggatcccctatcgtcaaccgcgaagggaagatcgtggggttatacggcaacggcgtggtcaccacctcaggcacctatgtgagcgccattgcgcaggcaaaggcaagtcaggaggggccgctgccggagatcgaggatgaggtgttccggaagcgcaacctgacgatcatggacctgcatccaggctccggtaagacccggcgctacctgccggccatcgtccgtgaggccattaagcgcaagctccgcaccctgatcctggcgccgacccgtgtggtggcttccgagatggcggaggcactcaaggggatgcctatccgctatcaaacgacagcggtcaagagcgagcatacgggcaaggagattgtggacttaatgtgtcacaccactttcactatgaggctcctctcccccgttcgcgtgccgaattacaatatgattatcatggacgaggcacatttcaccgaccccagctccatagccgcgcggggttacatatcgacccgggtgggcatgggagaggcggccgccatatttatgacggccacgccgcccggttctgtggaagcgtttccacagagtaacgccgttatccaggatgaggagcgggatatcccagagcgctcctggaactcggggtacgagtggatcacggacttccccggtaagactgtgtggttcgtgccctctataaaatctggcaatgatatcgcgaactgtttacggaagaacgggaaacgcgttatacagctgtcccggaagacgttcgacaccgagtatcagaagactaagaacaacgattgggactacgtggtgactactgacattagcgagatgggcgccaattttcgcgcggaccgggtgatcgacccaaggcggtgcctcaaacccgtcatcttgaaggacgggcccgagcgcgtgatcttggcaggcccgatgccggtcaccgtggcgtccgctgcccaacggcgcgggcggatcggccgaaaccataataaggagggggatcagtacatctatatggggcaacccctcaacaatgacgaggaccacgcgcactggaccgaggcgaagatgctgctggacaatatcaatactcccgagggtatcatccccgcactcttcgagccggagagggagaagtccgcagctatcgacggggaatacaggctgcgcggcgaagcgcggaaaacgttcgttgagctgatgcgccgcggggacttacctgtctggttgtcatacaaagtggccagcgagggcttccagtatagcgaccgtcggtggtgcttcgacggcgagcgcaataatcaggtccttgaggagaacatggacgtggagatctggaccaaggagggggagcggaagaagctccgccctcgatggctggacgccaggacgtactccgaccccctggccctcagggagttcaaagagttcgctgctggtcgccggagcgtgtcaggtgacctgatcttggagataggaaaacttccgcagcacttaacgcagcgcgcccagaacgcgctggataacctcgtcatgctgcacaacagcgagcagggtgggcgggcctaccgccacgcgatggaggagctgcccgacacgatcgaaactctcatgctgctggcgttgatcgccgttttgactggcggcgtgaccctgttcttcctgtccggacgggggctggggaaaacaagcattggcctgctctgtgtgatggcatccagcgtcctcctctggatggcctcagtggagccccattggatagcagccagcattatcctcgagtttttcctgatggtcctcttgatccccgagccggaccgccagcggacgcctcaggacaaccagctcgcctatgtggtgattgggctcctgtttatgatcctcaccgtcgccgctaacgaaatgggcctgctagagaccaccaagaaggacctgggtatcggacacgtagcggtggagaaccaccatcacgccgccatgcttgacgttgacttgcaccccgcctccgcctggacgctctacgctgtggccaccacgatcattaccccgatgatgagacacacgatcgaaaatacaaccgccaacatcagcctgaccgccatcgccaaccaggcggcaatactcatgggtctggacaagggctggccgatctcaaagatggatatcggcgttcccctgttagccctggggtgttatagccaggtcaacccccttacgctcacggccgcggtgttaatgttagtggcccactacgccatcatcggacccgggctccaagctaaagccaccagggaggctcagaagcgaacggctgccggcatcatgaagaacccgacggtcgacgggatcgtcgccatagatctggacccagtggtctacgacgccaagtttgagaaacagcttggccagatcatgctcctgatcctttgtacctcccagatactcctaatgcgcaccacatgggcgctatgcgagagcataacgctagccaccggacccctgaccaccctgtgggaggggtcgcctggtaaattctggaacacgaccatcgccgtgagcatggcgaacatcttccgggggtcctaccttgccggtgcgggcctagccttcagccttatgaaatccctcgggggcgggagacggggaaccggggcccaaggcgagacactgggcgaaaaatggaaacgccagctcaaccaactgtcaaaaagcgagttcaacacttacaagaggtcgggcatcatggaagtggaccgctcggaggcaaaggagggccttaagcgcggggagacgaccaagcacgcggtctcccgcggcaccgcgaaacttagatggtttgtggagaggaacctggtgaagcccgagggaaaggtcatcgacctcggctgcggccgcggcgggtggagctactactgcgccgggctgaagaaggtgacggaggtgaaggggtatacaaagggcggacccggtcatgaggagcccatcccgatggccacctacgggtggaacctggtcaagctccactccggcaaggacgtgttctttatcccgcccgagaagtgtgataccctgctctgtgacatcggagagagctcccccaaccccacaatagaggagggccgaacgttacgggtcctcaagatggtggagccctggctgagagggaaccagttctgcatcaagatattgaacccctatatgcccagtgtagtcgagactctggaacagatgcagcggaagcacggcggcatgctggtacgaaatccgctctccagaaacagcacccacgaaatgtattgggtatcctgcgggacgggcaacatcgtgtcagcagtcaacatgacgtccaggatgctgctgaaccgcttcaccatggcgcaccggaaacccacctacgagagggacgtagatctaggggccggtaccagacacgtcgccgtcgagccggaggttgccaaccttgatataatcggacagcgcatagagaacatcaagcatgagcataagagcacgtggcactacgacgaggataacccctacaagacgtgggcgtatcacggctcctacgaagtgaaaccgagcggctccgcgagcagcatggtgaacggggtggtcaaactgctcaccaagccgtgggacgtgatacccatggtcacccagattgccatgacggatacaacgcccttcggccaacaacgggtcttcaaggagaaggtggacacaaggaccccgaaggcaaaacggggtaccgcccaaatcatggaggtaaccgccaagtggctctggggattcctgtccagaaacaagaagccccggatctgcacacgtgaggagttcacgcggaaggtacgctccaatgcagccattggcgctgtattcgttgacgagaaccagtggaactcagccaaggaagcggtagaggacgaaagattctgggatcttgtacaccgagagcgggagctgcataaacaagggaagtgcgcgacctgtgtctataacatgatgggaaaacgcgagaagaagttgggtgagttcggcaaggctaaaggttctcgggccatctggtacatgtggctcggagccaggttcctggagttcgaggcgctgggcttcatgaacgaggaccattggttttcccgggagaacagtctcagtggggttgagggcgagggtctccacaagctgggttacatcctccgcgacatcagtaagatccccgggggcaacatgtacgccgatgacacggccggctgggacactcgcatcacggaggatgacctgcagaatgaagcgcgcatcaccgacattatggaaccggaacatgcgcttctcgcgaagtccatctttaagctgacctaccagaacaaggtggtgcgcgtgcagcgccccgccaaaaacgggacagtgatggatgtgatcagccgcagggatcaacgcggctccggtcaagtcggaacatatggcttaaacactttcaccaacatggaagcacagctcatacgtcagatggagagcgaggggatcttctcgccctctgaactggagacccccaatctggcagagcgcgtactcgactggctggagaagtatggcgtcgagaggctgaagcggatggccatctccggggacgattgcgtggtgaagccaatcgacgaccggtttgcaacggccctcaccgcccttaacgacatgggtaaggtgcgcaaggacatcccgcagtgggaacccagcaaggggtggaacgattggcagcaggtcccattctgctcccaccacttccaccaattaatcatgaaggacggccgggagattgtagtgccgtgccggaaccaggacgagctcgtaggccgtgcccgcgtgagtcagggggccggctggtctctgcgggagaccgcatgcttagggaaatcatacgcccagatgtggcagctgatgtacttccaccgtcgggacctgaggttagccgccaacgcgatttgcagcgcggtccccgtcgattggatccccacgacgtgcactacctggagcatacacgcccaccatcagtggatgaccacggaggatatgctcagcgtgtggaaccgggtgtggattgaggagaacccctggatggaggacaaaacccacatctctagctggggagacgtcccttatctggggaagcgcgaggaccagtggtgcgggtccctgatcgggctaacggccagggccacctgggcgaccaacatccaagtggcaatcaaccaggtgcggcgcctgatcggcaacgagaactatctggactacatgacttccatgaagaggttcaagaacgagtcagaccccgagggcgcactctggtag

SEQ ID NO: 24632 - RNA, 9879 nt, synthetic construct
  misc_feature 1..9879: note = derived and/or modified CDS sequence (opt11) from DENV-1__JQ045649__SS-prME
  source 1..9879: mol_type = other RNA
agcgtcaccatgctgctcatgctgatgcccaccgccttagccttccacttgaccacaaggggcggggagccccacatgatcgtgtccaagcaggagcgggggaagagcctgctattcaagaccagcgcgggggtgaacatgtgtaccctcatcgccatggacctaggcgagctgtgtgaggacacaatgacatacaagtgcccccggatcacagaaacagagcccgatgatgtggactgttggtgcaacgccactgacacgtgggttacctacggtacctgcagccagactggcgaacaccggcgagataagcgaagtgtggcgctcgccccccacgtgggactcggactggagacccgcacagagacctggatgagctccgagggagcgtggaagcagatccaacgggtggagacgtgggccctccgccaccctgggttcaccgtcatcgccttgttcctagcacacgccataggcactagcataacccagaaggggatcatctttattctgctgatgctggtaacgccgtcaatggccatgagatgcgtcggcatcggcagccgcgatttcgttgaggggctctcgggtgccacctgggtggacgtcgtgcttgaacacgggtcctgcgttaccacaatggccaaggataagccgacgttagacatcgaactcctgaagaccgaggtaaccaaccccgccgtgttgcggaagctctgtatcgaggcgaagatctccaacaccacgaccgacagcagatgccctacccagggcgaggccaccctggtcgaggagcaggacgcgaacttcgtctgtcggcggacattcgtcgatcgcggctggggtaacggctgcgggctgttcggtaaggggtccctcatcacgtgtgccaagttcaagtgcgtcaccaagctggagggcaagatagtccagtacgagaacctgaagtactcggtgatcgttaccgtgcatacgggcgaccagcatcaggtgggcaacgagtccaccgagcacggcaccactgcaaccatcactccccaagcgcctacaaccgaaatccagctcactgactacggggccctaacgctggattgctctccgcgcaccggcctagacttcaacgagatggtcctgctgaccatgaaggagaagagttggttagttcacaagcagtggtttctggacctgcccctcccctggaccagcggggcgagcacctcccaggagacctggaatcggcaagacttgctggtaacctttaaaaccgcccacgcaaagaaacaagaagtcgtggtgctcgggtctcaagagggcgcgatgcacacggccttgaccggtgctaccgagatccaaacttcaggcacgaccaccattttcgccgggcacttaaaatgccgcctgaagatggacaagctgactttaaagggcatgtcgtacgtcatgtgtacggggtcctttaagctcgaaaaggaggtggccgaaacccagcacggcacagtgctggtccagatcaagtacgaaggcaccgacgcgccatgcaagattccattcagcacgcaggacgagaagggggtcacccaaaacgggcggctgatcaccgccaatccaatcgtcaccgataaggagaagcccgtcaacatcgaggccgagccaccattcggggagagctacatagtgatcggcgcaggggaaaaggcgctgaagctaagctggtttaagaagggatccagcatcggcaaaatgttcgaggcgacggcccgcggggcacggcgaatggccatcttaggggatacagcgtgggactttgggtccatcgggggcgtgttcaccagcgttggaaagctggttcatcagatcttcgggaccgcgtacggggttctgttcagtggtgtcagctggacgatgaaaatcgggattggcgtactgctgacgtggttgggcttaaactcccgcagcacctccctgagcatgacctgcatcgcggtgggcctcgtcacgctgtatctgggcgtgatggtgcaggccgacagcgggtgcgtcataaactggaagggacgggagctgaagtgcggcagcggcatcttcgtgaccaacgaggtgcatacctggaccgagcagtacaagttccaggctgatagcccgaagcgtctgtccgcggcgatcgggaaagcgtgggaggagggagtctgcggtatccgctccgccacacgcttggagaacataatgtggaagcagatctctaacgagttgaaccacatactactggaaaacgacatgaagttcaccgtggtggtcggagacgtggctggcatcttagcccaggggaagaagatgatacggccccagcccatggagcacaagtatagctggaagtcttggggtaaagccaagatcataggcgccgatgtgcagaacaccacttttatcatcgacgggcccaacaccccggagtgtcccgatgaccagcgcgcctggaacatatgggaagtcgaggattacggcttcgggatcttcacgaccaacatctggctaaaactgcgggactcatacacccaggtgtgtgaccatcgcctgatgtccgcggccatcaaggacagcaaggccgtgcacgctgatatgggctactggatcgagtccgagaaaaacgaaacctggaagctggcaagggcgtcattcatcgaagtcaaaacctgtatatggcccaagtcacacacactgtggagcaacggcgtattagaatccgagatgatcatacccaaaatctacgggggcccgatcagccagcacaactaccgccccgggtatttcacccagacggcaggcccatggcacctgggtaagctggagctcgatttcgacctctgcgaaggcacgacagtagtcgtcgatgagcattgcggcaaccgggggccgtccctgcgcaccaccacagtgacgggcaagatcatccacgagtggtgttgcaggagctgcacgctgccgcccttacgcttccgcggggaggacggctgctggtacgggatggaaatccgccccgtccgggagaaggaggaaaacctagtgaagtccatggtctcggccggcagcggcgaggtcgactccttcagcctcggtctgctctgcatctccatcatgatcgaggaggtgatgcgctcacggtggtcccgaaagatgctcatgaccggcactttggctgtattctttttactcattgtcgggcaactgacatggaacgaccttattcgcctctgcattatggtgggcgctaacgcgagcgataggatggggatgggcaccacctacctggccctgatggcgacttttaaaatgcgcccgatgttcgccgtggggctcctgttccggcgcctaacctcccgggaggtcttactcctgaccatcgggctcagcctagtagcctccgtcgaactgccgaatagcctcgaagagttgggcgacgggctggctatgggcatcatgatacttaagcttctaaccgactttcaatcgcaccagctctgggccagcctgctgtcccttacgttcatcaagaccaccttcagcctgcattacgcctggaagaccatggccatggtgctatccgtagttagcctcttccccctgtgcctgtccacgaccagccaaaagaccacttggctccccgtattgctgggctccctcgggtgtaaacctctgaccatgttcctgatcgctgaaaacaagatctggggtcgccggagctggcccctcaacgaggggatcatggccgtgggcatcgtctcaatcctgctatcctcgctcctgaagaacgacgtgcccctcgccgggccgctcatcgccggaggcatgttaatcgcgtgctacgtcatctccggaagctccgcggacctgagcctcgagaaggccgccgaggtctcttgggaggaagaggccgaacacagcggtgcatcccacaacatactggtggaggtgcaggacgacgggacgatgaagattaaggatgaggaacgcgacgacaccctgactatcctcctgaaggctaccctgctagccgtctctggggtgtaccccctgtccattcccgcaacgctgttcgtctggtatttttggcagaaaaagaaacagcggagcggagtcctttgggacacccccagcccgcccgaggttgagcgcgccgtactcgacgacggcatctaccggatcatgcaacgaggcctgcttgggcggagccaggtaggcgtgggggtgttccaggagaacgtcttccacacgatgtggcacgtgacccgcggcgccgttctcatgtaccagggcaagcggctggaaccctcctgggcgtccgtcaagaaggaccttatttcctacggcggcgggtggaggctccaaggctcgtggaacactggggaggaggtacaggtaatagccgtcgagcccggcaagaacccaaagaatgtgcaaaccgcaccggggacattcaagacacccgaaggcgaagtgggcgcaatcgccctggacttcaagcccgggacgtccggaagccccatcgtgaatagagaggggaagatcgtgggcctgtacggcaacggggtggtcaccaccagtgggacgtacgtgtccgcgatcgcccaggccaaggcgtcccaggagggtccgctccccgagattgaggatgaggtgttccgcaagcggaacctgacgattatggacttgcaccccggatccgggaagacccgcaggtacctcccggcaatcgtccgcgaggccatcaagcgcaagttacggacccttatcctcgccccgacccgcgtggtggctagcgagatggctgaagcgctcaagggaatgcccatccggtaccagacgaccgcggtcaagtccgagcacaccggcaaggagatcgtggacctgatgtgtcatgccaccttcacgatgcggctcctgagccccgtgcgggtcccgaactataacatgatcataatggacgaggcccatttcaccgaccccagcagcatcgccgcgcgcggttacatctccacccgggttggcatgggggaagccgccgctatattcatgaccgcaacgccgcccgggagcgtggaggccttcccgcaaagtaacgcggttatccaggacgaggagcgcgacatccccgagaggagctggaactcaggttatgagtggatcaccgatttccccggtaagactgtgtggttcgtgcccagcatcaagtccggcaacgacatcgccaattgccttaggaagaacggtaagcgggtcatacagcttagccgcaaaaccttcgacacggagtaccagaagaccaaaaacaacgattgggattatgtagttacgacggacatatccgagatgggcgccaacttccgggcggatcgggtcatagacccgagacgctgcctaaagcccgtaatcctcaaagatggtcccgagcgggtcatcctcgccggccccatgccggtgacagtcgcgtccgcggctcagcgccgagggaggatcggccgcaaccacaacaaagagggcgatcagtatatttacatggggcagcctctaaataacgacgaagaccatgcgcattggaccgaagccaaaatgctgctcgacaatatcaacacacccgaggggataatccccgccctgttcgaaccagagcgggagaaatccgccgccatagacggtgagtaccgcctccggggcgaggcacgcaagacctttgttgagctgatgcggagaggggacctgcccgtgtggctaagctacaaggtggcaagtgaggggttccagtacagtgaccggcgctggtgcttcgacggcgagcggaacaatcaggtcttggaggagaacatggacgtggaaatctggaccaaggagggggaacgtaaaaagctgcggccccgctggctggacgctcggacctattccgaccccctcgccctgagagagtttaaggagttcgccgcgggccggcgctctgtgtcaggggatctgatactcgagataggaaagctgccgcagcatctgacccagagagcacagaacgccctcgacaatctggtcatgctgcacaactccgagcagggggggcgcgcctaccgacacgcgatggaggagctccctgacacaattgagacactcatgcttctagctctgatcgcagtgctgaccggcggggtgaccctcttcttcctaagcggtcgagggctgggcaaaacctcaattggcctcctgtgcgtgatggccagctccgtgctgctctggatggcctcggtggagccccactggatcgcggcgagcatcattctggagttcttcttgatggtcttactgatcccggagccggaccggcagcgcacgccacaggataaccaactggcctatgtagtgatcgggctgctgttcatgatcctgaccgtcgcagctaatgagatggggctcctggagacaacaaagaaggacctgggcataggccatgtcgcagtggagaaccaccaccacgccgccatgctcgacgtcgacttgcaccccgccagcgcgtggaccctatacgcggtggcgacgaccatcattaccccgatgatgcgccacacaatcgaaaacacgaccgccaacatctccctcactgcaatcgcgaaccaggcagccattctgatggggctggataagggctggcccatcagcaagatggatataggggtaccgctccttgccctgggttgctactcccaggtcaatcccctcacacttacggctgcggtactgatgctcgtggcccactatgccatcattggcccgggtctgcaagccaaagccacccgtgaggcgcagaagcgcaccgctgcaggcatcatgaagaaccccaccgtcgacggcattgtggccatcgacctggaccctgtggtctacgacgccaaattcgagaagcaactcggccagatcatgctgctgattctctgcacgagtcagatcctgttgatgcggaccacctgggccctttgcgagtccatcacgctggccacgggccccctgacaacactttgggaggggagcccgggcaagttctggaacacgacgatcgcagtatccatggcgaacatcttcagggggagctacctggccggcgcgggacttgcctttagcctcatgaagtcactagggggcggtcgtcgcggtaccggggcccagggcgagaccctgggcgagaaatggaagcgacaactcaaccagctaagcaaatcagagtttaacacttacaagcgctccgggattatggaagttgatcggagtgaggccaaagaaggcctgaaacggggggagacaactaagcacgccgtctcgagagggaccgcgaagctgcgctggttcgtggagaggaatctagttaagccggaggggaaggtcatcgatctaggctgcgggcgcgggggctggtcatactactgtgcggggctgaaaaaggtgacagaagtgaagggctacacgaaagggggacctgggcacgaggagcccatccctatggccacgtacgggtggaacttagtcaaactgcacagcggcaaggacgtcttcttcattccgcccgagaagtgcgacaccctgctctgcgatatcggggagtccagccccaacccgaccatagaggagggccgtactctgcgcgtactgaagatggtcgaaccctggctccgggggaaccagttctgcatcaaaatacttaacccgtacatgccttctgtcgttgaaaccctggaacaaatgcagcgcaagcacggcggtatgctggtccggaacccgctgagtcgcaactccacccacgagatgtactgggtgtcctgcgggaccggcaacatcgtgagcgccgtcaacatgacctcacgcatgctcctcaaccggttcacgatggcgcaccgtaagcccacctacgagcgggacgtggatctgggggctggcacacgccacgtggccgtcgagcctgaggtggccaacctggacatcatcggccagcggatcgagaacataaaacacgagcacaagtccacctggcactatgacgaggataacccctacaaaacgtgggcataccacgggtcatacgaggtcaagccctccggcagtgcatccagtatggtgaacggggtggtcaagctcctgaccaagccctgggacgtgatccccatggtcacacagatcgccatgacagatacgaccccgttcgggcaacagcgggtcttcaaagagaaggtggatacgcggaccccgaaggccaaaagggggacggctcagatcatggaggtcacagccaagtggctttggggcttcctgagccggaacaaaaagccccgcatatgcactcgagaggagttcacccgtaaggtccggagtaatgccgccatcggcgctgtgttcgtggacgagaaccagtggaactcagccaaagaggctgtcgaggacgagaggttctgggacctggtacatcgggagcgcgagctgcacaagcaagggaagtgcgccacgtgcgtgtacaacatgatgggcaagcgggaaaagaaactgggggagtttggcaaagcgaaagggtcccgagcaatctggtacatgtggctgggcgctcggttccttgaattcgaggctctcggtttcatgaacgaggatcactggttctctagagaaaattccctgagcggggtggaaggcgaggggttacacaagctcggctacatccttcgggacatcagcaagatcccggggggcaatatgtatgctgatgacacagccggctgggacactcgcatcaccgaggacgacctaaagaacgaggcccgcattacggacatcatggagccggagcacgccctcctcgcaaagtccattttcaaactgacctaccaaaacaaggtggtgcgggtccagagacccgccaagaatgggacagtgatggacgtgatttcccgccgcgaccagcggggaagcggtcaggtcggcacctatggcctcaacaccttcaccaacatggaagcccagctgatccgccagatggagtccgaagggatctttagcccctccgagctggagactcccaacctggccgagcgggtgctccactggctggaaaagtacggcgtggagcgcctgaaacggatggccatctccggcgacgactgcgtcgtgaagcccatcgacgaccgcttcgcgacggccctgacggccctgaacgacatgggcaaggtacggaaggacatcccccagtgggaacccagtaaggggtggaacgattggcagcaggtccccttctgcagccaccacttccaccaactcatcatgaaggacggcagagagatcgtggtaccgtgccggaaccaggacgaactcgtcggaagggcacgcgtgagccagggggctggatggtccttacgcgaaaccgcgtgcctcggcaaatcatacgcacagatgtggcagctgatgtacttccaccggcgcgaccttaggctcgcggctaacgcgatctgcagtgccgtgcccgttgattggatccccacgagccgcaccacgtggtccatccacgcccaccaccaatggatgaccacggaagacatgctgagcgtatggaaccgcgtctggatcgaagagaatccctggatggaggacaaaacccacatatccagctggggggatgtcccataccttgggaagcgcgaagatcaatggtgcggctcgctcatcgggcttacggcacgcgccacctgggcgaccaacatccaggtggccatcaaccaggtcagacgcctgatcggaaatgaaaattacctcgactatatgacttcaatgaaacggtttaaaaacgagtccgatccggagggcgccttatggtaa

SEQ ID NO: 24633 - RNA, 9879 nt, synthetic construct
  misc_feature 1..9879: note = derived and/or modified CDS sequence (opt11) from DENV-1__JQ045650__SS-prME
  source 1..9879: mol_type = other RNA
agcgtgaccatgctattaatgctgatgccgaccgctctggccttccacctcactacccggggcggcgaaccgcacatgatagtgagtaaacaggagcggggaaagagcctgctgttcaagacctctgccggggtgaacatgtgcaccctcatcgccatggacctaggcgagctgtgcgaggacacgatgacctacaaatgcccacgcataacagagactgagccggacgacgtggattgctggtgcaacgccacggacacctgggtgacttatggtacctgcagccaaacgggcgagcaccggcgcgacaagcgctcggtcgccctcgcgccgcacgtgggacttgggctggagacccgcaccgagacctggatgagctccgagggcgcgtggaagcagatccagcgagtggagacgtgggctctccgccaccccgggttcactgtgatcgccctgttcctggcccacgctatcggcaccagcataacccagaagggcattatcttcatcctcctgatgctggtgacgccctcgatggctatgcggtgcgtcgggattgggagccgtgatttcgtggaggggctctcaggcgccacctgggtggacgtcgtactagagcatggaagctgtgtcactactatggcgaaggacaagcccacgcttgacatcgagctcctgaagaccgaggtgaccaatcctgccgtcctgcgaaagctctgcatcgaggcaaagataagtaacacaactacagacagccgctgcccgactcagggcgaggccacactggtggaagagcaggatgccaacttcgtatgccgacggacgtttgtggacagaggatgggggaacggctgcggtctattcggaaaagggagtttgatcacgtgcgccaaattcaagtgcgttaccaagctggaaggcaagatcgtccagtatgagaatttaaaatactcagtgatcgtaaccgtccacacgggtgaccaacaccaagttggtaacgagtctaccgagcatggcaccaccgccaccattacgccccaggcgccgaccacagaaatccagctcacagattatggggccctgaccctggactgctcgccccgcactggcctcgacttcaacgagatggttctgctgactatgaaggagaagtcttggctcgtgcacaagcagtggttcttagacctgcccctcccgtggaccagcggggccagcacgtcccaggaaacctggaaccggcaggacttgctggtaacttttaagacagcacacgcgaagaaacaagaggttgtggtgctcgggagccaggagggcgcgatgcacaccgccctgactggggccaccgagatccaaacctccggcacgacaacgatcttcgccggtcacctgaagtgccgcctaaagatggacaagctgacactgaaaggcatgtcttatgtcatgtgcacggggtccttcaaactggaaaaggaactggccgaaacccagcacggcaccgtactggtgcagatcaagtatgagggcaccgacgcgccctgcaagatcccttttagcacgcaagacgagaagggtgtcacccagaacggccggttgatcaccgccaacccgatcgttaccgacaaggagaagcccgtaaacatcgaggccgagccgccctttggggagtcctacatcgtaatcggcgccggcgagaaggccctcaagctgagctggttcaaaaaggggtccagcatcggcaagatgttcgaagccacagcccgcggggcgcgccgcatggcaatccttggtgacacagcgtgggacttcgggtccatcggcggtgtgttcacctcggtcgggaagctggtccaccagatcttcggcacggcctacggagtcctgttctccggggtatcttggacgatgaaaatcgggatcggggtacttctcacgtggctgggcctgaactccaggagcacctccttaagcatgacctgcatcgccgtggggctggtgactctttacctcggtgttatggtgcaggccgactcaggttgcgtgatcaactggaagggccgggaactgaagtgcgggtcgggcatcttcgtaactaacgaggtacatacctggacggaacagtacaagttccaggccgatagccctaagaggctgagtgcggcaatcggcaaggcctgggaggagggggtgtgcggaatccggagcgccacccgcctcgagaacatcatgtggaaacaaatctcaaacgaacttaaccacatcctgctcgaaaatgacatgaagttcacagttgtggtcggagatgtcgcaggcatcctcgcgcaaggaaagaagatgatccggccccagcctatggagcacaaatacagctggaaatcatgggggaaggccaaaatcatcggcgccgacgtccagaataccacattcatcattgacgggccgaatactccggagtgcccggacgatcagcgagcgtggaacatatgggaggtggaggactatggcttcggcatattcacgaccaatatctggctgaagctccgggatagctacacccaggtctgcgaccaccgcctcatgtctgcggccatcaaggactcgaaagctgtgcacgccgacatgggttactggatcgaaagtgagaagaatgaaacctggaagttagcccgcgcctcgttcatagaggtcaagacgtgcatctggcccaaatcccacaccctctggagcaatggcgtcctggagtccgagatgatcatcccgaagatttacggcgggccgatctcacagcataactatcgcccagggtacttcacgcagaccgcgggcccctggcacctgggaaagctcgagctcgacttcgacctgtgcgaggggacgaccgtagtggtcgacgaacattgcggcaacagggggccctccctccgcactaccacagtgacaggtaagatcatccatgagtggtgctgccgtagctgcacgctgccgccgctgcggttcagaggggaagatggatgctggtatggaatggagatccgccccgtcagggagaaggaggagaacctagttaagtctatggtgagcgccggcagtggagaggtggacagttttagcctcgggctgctctgtatctcgatcatgatcgaggaagtcatgcgtagccggtggtcgagaaaaatgctgatgaccggtacgctggccgtgttcttcctcctgatcgtggggcagctgacctggaatgacctcatccgcctgtgcattatggtcggcgccaacgcgagcgaccgtatggggatggggacgacctacttggccctcatggccactttcaagatgcgcccgatgtttgcggtgggccttttgttccggagattgacgagccgcgaagtgctgctgttgaccatagggttatctctggtcgcttccgttgaattaccaaacagcttggaggaactgggtgacggcttggctatgggtatcatgatcttgaaattgctaaccgacttccagtcccaccagttatgggccagcctcctctccctgacattcattaagacaaccttcagcctgcactacgcctggaagacgatggcgatggtcctttccgtggtgagcctgttcccactttgtttgtccacaaccagccagaagacaacctggctgccagtcctgctcggctccctgggttgcaaaccgcttacgatgtttctcatcgcggagaataagatctggggaagacggtcgtggccactgaacgaggggatcatggccgtgggcatcgtaagtattttgctctccagcctgctaaagaatgacgttccccttgctgggccgctgatcgcggggggcatgctgatcgcttgctatgtgatctcagggtcgtccgcggacctctcgctggagaaagccgcagaggtgtcctgggaggaggaagccgagcacagcggcgcctctcataacatcctggtcgaggttcaagacgatggaacaatgaagatcaaggacgaggagcgcgacgataccctcaccatacttctgaaagctactctcctggcagtaagcggggtatacccgttatcaatccccgctaccctcttcgtgtggtacttctggcagaagaagaagcagcggagcggagtgctctgggacacccccagccctcccgaggtcgagagggccgtgttggacgacggcatctacagaatcatgcagagaggcctgctcgggcgatcccaggtgggtgttggggtatttcaagagaacgtgttccatacgatgtggcacgtgacccgcggcgctgttcttatgtaccaggggaagcggctggagccttcctgggcgagcgtcaagaaggacctcatctcctacggcggcgggtggcgcttacagggatcgtggaatacgggcgaggaagtccaagtgatagctgtggagcccggcaaaaaccccaaaaacgtgcagaccgccccggggaccttcaagacccccgagggcgaggtgggcgccattgccctggactttaagccggggacgtccggcagcccgatcgtgaaccgggaagggaagatcgtcggcctctacggcaatggcgtggttaccacgtcaggaacatacgtctccgccatagcccaggccaaggccagccaggaagggccgctgcccgaaatcgaggacgaggtgttcagaaagagaaacctgaccatcatggacttacaccccgggagtgggaagacccgccggtacctgccagcgatcgtgcgcgaggcgattaagcgcaagctccggaccctcatcctggcccccacccgcgtcgtggccagcgagatggccgaggcgttgaaaggaatgcccatcagataccagactaccgctgtgaaatccgagcacacgggcaaggagatagtcgacctcatgtgccatgccacgttcacgatgaggctgctgagccctgtgcgggttccgaattataacatgataattatggacgaggcccacttcactgacccctcctctatcgccgcgcgcgggtacatctccacgcgggtcggcatgggggaggccgccgcaatctttatgaccgctacgcccccggggtcagtcgaagcattcccgcagtctaacgccgtgatccaggacgaggaacgtgacataccggagcggtcgtggaactccgggtacgaatggatcaccgacttccccggcaaaaccgtctggttcgtgcctagcatcaagtccggtaacgacatcgctaactgtctccgcaagaacggcaagcgtgtgattcagctgagccgcaagacgtttgacacggagtaccagaagaccaagaacaatgactgggactatgttgtcactaccgacatatccgagatgggcgccaacttccgggcggaccgcgtgatcgatccgcgaagatgcctgaagcccgtcatcctaaaggatgggccagaacgggtgatcctggcgggccccatgccggtgacagtggcttccgcggctcagcgccgagggcgcatcggcaggaaccacaacaaagagggcgaccagtacatctatatggggcagcccctgaacaacgacgaggatcatgcgcactggaccgaggccaagatgctcctggacaacatcaatactccagaggggataataccagcactgttcgaaccggaaagggagaagagtgccgccatcgatggcgagtaccgcctccggggcgaggcgcgaaagactttcgtggagttgatgcggcgcggggacctgcctgtatggctcagctataaggtggcctcggagggatttcagtattccgaccgacgctggtgtttcgatggtgagcggaataaccaggttttagaagagaatatggacgtagaaatctggacgaaggagggggagcgcaagaagctacgtccccgctggcttgacgcccggacctatagcgaccccctggccctgcgcgaattcaaggaattcgccgcgggccggaggtccgtgtcgggggacctcatactggagatcgggaagctgccacagcacctgacccagcgggcccagaacgccctggataacctggtgatgctccacaactccgagcagggcggtcgcgcctaccggcacgcgatggaagagctgcccgacaccatcgagacgctcatgctcctggctttaatcgcagtcttgaccggcggggtgaccctgttcttcctgagcgggcgcgggctcggcaagacgtcgatcggcctactgtgcgtgatggcctcatcggtcttgttgtggatggcctcagtggagccccactggattgctgcctccatcatcctggagttcttcttgatggtgctgctgatcccagagccggatcggcagcgcactccccaagacaaccagctcgcctatgttgtgatcgggctgctcttcatgattctcacagtggccgctaacgagatggggcttctggaaactaccaaaaaggacctcgggatcggccacgttgcggtggagaaccatcaccacgccgctatgctggacgttgacctgcaccctgcaagcgcgtggaccctctacgcggtggccacgacaattatcaccccgatgatgcgccacactatcgaaaatacgaccgccaacatttccctgaccgccatcgccaaccaggcggccatcctaatggggctcgacaagggctggccaatctctaagatggatatcggcgtgcccctgctagccctcgggtgctactcccaggtgaaccccctcactctaacggccgcggtcctcatgctggttgcccactatgctatcatcggcccggggctgcaggcgaaggccacccgagaagcgcaaaagcgcactgccgcaggcatcatgaagaatcccaccgtggatgggatcgtggccattgatctcgatcccgtggtgtatgatgccaagttcgaaaaacagttaggccagatcatgctgctcattctatgtacaagccagatcctgcttatgcggaccacctgggcgttgtgcgaatccattacactggcaacgggtcccctaactaccctgtgggaggggagcccggggaaattctggaataccacgattgccgtaagtatggctaacatcttcagggggagctacctggccggcgctggtttagcattcagcctgatgaagagcctcgggggcgggagacgcgggaccggggcgcaaggcgagactcttggcgaaaagtggaagcggcaacttaatcaactgagcaagagcgagttcaatacatacaagaggagcgggatcatggaggtggaccggtccgaggccaaggagggcttgaagcgcggagagacgactaagcacgcggtgtcgcggggcaccgccaagctgcggtggttcgttgagcggaacctagtgaagcccgaagggaaggtgatcgacctagggtgtggacgcggcggctgggcgtattactgcgccgggctcaagaaggtcaccgaggtgaaaggatacaccaagggcggccccggccacgaggaacccatccctatggccacctatgggtggaacctggtgaagctacactccggtaaagacgtgttctttatcccccccgagaagtgcgatacattgctgtgtgacatcggggagagcagtcccaaccccaccatcgaggagggccggacgctgcgggtgctgaagatggtagagccctggctgcgggggaaccaattctgcatcaagatactgaacccctacatgccaagcgtcgtagagaccttggaacagatgcagagaaagcacggcggtatgctggtgcgtaacccactgtcccgcaatagcacccatgaaatgtactgggtctcttgtggtacgggcaacatagtgagcgcggtgaacatgacctcccgcatgctcctgaaccggtttacgatggcccaccgaaagccgacgtacgagcgagatgtcgaccttggggccggcacacgccacgtcgccgtcgagcccgaagtcgccaaccttgatatcatcggtcagcggattgagaacattaagcacgagcataagagcacttggcattacgacgaggacaacccgtacaagacgtgggcgtaccacgggtcctacgaagtaaaacccagcggctccgccagcagcatggtcaacggggtggtgaagttactcacaaagccctgggacgtcatccccatggtgacccaaatcgcgatgaccgacacgacccccttcggtcagcagagggtgttcaaggagaaggttgacacccggaccccgaaggccaagcgcgggacagcgcagatcatggaggtgacggcaaagtggctctggggcttcctatcacggaataagaagcccagaatctgcacccgagaagaattcacccgcaaggtgagaagcaacgccgccattggagccgtcttcgtggacgagaatcagtggaactccgcgaaagaagcggtggaggatgagcgcttctgggacctggtgcatagagagcgtgagctccacaagcaggggaagtgtgccacgtgcgtctataatatgatgggcaagcgggagaagaagttaggcgagttcggcaaagccaaggggtctcgcgctatctggtacatgtggctaggtgcacggtttcttgagttcgaagcactgggcttcatgaacgaagaccactggttctcgcgcgagaacagcctctcaggggtggagggtgaggggctccacaagttaggctacatcctccgggacatctccaagatccccgggggcaacatgtatgccgacgataccgccgggtgggacacccgcataaccgaggacgacctcaagaacgaggcccgcatcacggatatcatggagccggagcacgcgctgctagccaagtccatcttcaagctaacataccagaacaaggtggtccgggtacagagacccgccaagaacgggaccgtgatggacgtgatatctcggcgcgaccagcggggctcaggccaagtgggcacctatggcctaaacacattcaccaacatggaagcccagctgatccgccaaatggagagcgaggggattttttcacccagcgagctcgagacccccaatctggctgagagagtcttgcactggttggagaagtatggggtggaaaggctaaagcggatggcgatctccggcgacgactgcgttgtcaagcccattgacgatcgtttcgccactgccctgacggccctcaacgatatgggcaaggtgcggaaagacattccgcagtgggaaccaagcaaggggtggaatgactggcagcaggtccccttctgctcccaccacttccaccagctgatcatgaaggacggccgcgaaatcgtcgtgccctgccggaaccaagacgagctggtgggtcgcgccagggttagccagggagcgggctggagcctcagagagactgcctgtcttggaaaatcctatgcacagatgtggcagctcatgtacttccaccggcgcgatctaagactggccgcgaacgccatatgttccgccgtacccgttgactggatccccacctcccgcacgacgtggagtatccacgcccaccatcagtggatgactaccgaggatatgctgtccgtatggaatcgtgtatggatcgaggaaaatccctggatggaagacaagacccacatctcatcctggggcgacgtgccgtacctcgggaaacgagaggaccagtggtgcgggagtctgattggcctgacggcccgggcgacatgggcaaccaacatacaggtggccattaaccaagtgcgacgcctcatcgggaatgagaactacttagactacatgacctccatgaagcggttcaaaaatgaaagcgacccggaaggagccctatggtag

SEQ ID NO: 24634 - RNA, 9879 nt, synthetic construct
  misc_feature 1..9879: note = derived and/or modified CDS sequence (opt11) from DENV-1__JQ045651__SS-prME
  source 1..9879: mol_type = other RNA
agtgtgacaatgctcctgatgttaatgcccactgccctggctttccacctcaccacgcgcggcggggaaccccacatgatcgttagcaaacaggaacggggcaagagcctgctgttcaagaccagtgccggcgtgaatatgtgcacactcatcgcgatggacctgggcgaactgtgcgaagacaccatgacgtacaagtgcccccggattaccgaaactgaaccagacgatgtagattgctggtgcaacgccacggacacctgggtgacctatggaacctgcagccagacgggcgaacaccggcgggataagcgctccgtggccctcgcgccgcacgtaggcctggggctagagaccaggaccgagacatggatgtcctccgaaggcgcgtggaagcagatccagcgggtggaaacgtgggcgctccggcacccagggttcacggtgatcgccctgtttttagcgcatgccatcggcacctctatcacccagaaggggatcatcttcatactactgatgttagtgacaccctccatggcaatgcggtgcgttggcatcgggagccgagacttcgtagaggggttatccggggccacttgggtagacgtcgtgctggagcacggctcatgtgtgacaaccatggccaaggacaaacctacgctggatatcgagctcctgaagaccgaggtcaccaaccccgccgtgctgcgaaagctctgcatcgaagccaaaatttccaacacaactaccgactcacggtgtcccacgcagggcgaggccacactggttgaagaacaagacgccaatttcgtctgtcgacgcacgtttgtggaccgaggctgggggaacggatgcgggctgttcggcaaaggatctctcatcacgtgcgccaagtttaagtgcgtaaccaaactggagggcaagatcgtccaatacgaaaatctaaagtacagtgtgatcgttaccgtccacacgggcgaccaacaccaggtggggaacgagtcgacagagcacggcactaccgccaccatcactccccaggcgcccaccaccgagatccagctcacggactacggggccctgacgctggactgctccccgcgcaccggcctcgacttcaacgagatggtcttgctgaccatgaaggaaaagtcctggttagtccacaagcaatggttcctggacctgccgttaccctggaccagcggggcctccacgtcccaggagacctggaataggcaggatctgctggttaccttcaaaaccgctcacgccaagaagcaagaggtcgtggtgctaggcagccaggagggcgcgatgcacactgcgctgaccggagccaccgaaattcagacctccggcactaccaccatattcgccgggcacctgaagtgccgcctcaagatggacaagctgaccctgaagggcatgtcttatgtaatgtgcacggggtctttcaaattagaaaaggagctagccgagacccaacacggtaccgtgctggtgcagataaagtacgaaggcaccgacgcgccctgtaagatccccttcagtacgcaggacgagaagggggtcacgcagaacggccggctgatcaccgctaatccgatcgtgaccgacaaggagaagcccgtgaacatcgaggcggagccgcccttcggggagtcttacatcgtcataggcgctggggagaaggcgctcaagttgagctggttcaagaaaggttcgagcataggtaaaatgttcgaggccacggcccgtggggcgagacgcatggccatcctgggcgacaccgcgtgggatttcgggtccatcggcggcgtctttactagcgtaggaaagctcgtccaccagatctttggaactgcctatggggttctgttctccggagtgagctggacgatgaagatcgggattggcgtcctgttgacctggctgggtttgaactcccgtagcacctccttaagcatgacctgtatcgccgtggggctggtgactctatacctcggcgtcatggtgcaggccgattccggttgcgtgatcaactggaagggccgggaattaaagtgcgggagcggcattttcgtcaccaatgaagtgcacacctggaccgagcagtacaagttccaggcggatagcccgaagagactgtccgcggcgatcggcaaggcctgggaggagggcgtgtgcggcatccggagcgcaacccgcctcgagaacataatgtggaagcagatctctaacgagctgaatcatatacttctagaaaacgacatgaagttcacggtcgttgtaggggacgtcgccggcatcctcgctcaagggaagaagatgatccggccccagccaatggaatacaaatatagctggaagtcctggggcaaggctaagatcatcggcgctgatgtgcagaataccacgttcattatcgacgggcctaacaccccagagtgccccgacgaccagcgcgcctggaacatctgggaggtggaagactatgggttcgggatcttcacgaccaacatctggctaaagctccgggactcgtatacccaggtctgcgaccaccgtcttatgtcggctgctatcaaggattcgaaggctgtgcatgcagatatgggctactggatcgagtccgagaagaacgagacctggaagctggcccgcgcgagcttcatcgaggtgaagacgtgcatctggcccaagtcccacaccctctggagcaacggcgtactggaatccgagatgatcattcccaagatttacggagggccgatctctcagcacaattaccgccccggttacttcacccagaccgccggcccctggcatctggggaaactcgagctggacttcgacctgtgtgagggcacgaccgtcgtcgtcgacgagcactgcggcaaccgcggacctagcctcagaaccaccacggtgaccggcaagatcatccacgaatggtgttgccggagctgcaccctgcccccgctgcgcttccgaggggaggatggttgctggtacggaatggagatccgtccggtgaaagagaaggaggaaaacctcgtcaagagtatggttagcgccggtagcggcgaagtggattccttcagcctggggctgctgtgcatctccatcatgatcgaagaggttatgagatcccgctggtcccgtaaaatgctgatgaccggaacgctcgctgtgtttttcctcttgatcatgggtcaattgacgtggaacgacctcatccgcctgtgcatcatggtgggagccaatgctagcgatcgaatggggatgggtaccacctacctggccttaatggctaccttcaagatgcgaccgatgttcgctgtcggcttgctgtttcgcaggctaacatcccgcgaggtgttgcttctgaccattgggctgagcttggtggcctccgtcgaactccccaacagtcttgaggagctcggcgacggcctcgcgatgggcatcatgattttaaagctgctcaccgacttccagtcccaccagctgtgggccactctgctcagcctgaccttcatcaagaccacgttctccctgcactacgcttggaagacgatggcaatggtactcagcatagtctctctattccctctgtgtctcagtacgacctcccagaagaccacttggctgcctgtcctgcttggcagcttagggtgcaagccgctgacgatgttcctcatagccgagaacaagatatggggccggcgctcctggcccctgaacgaaggcattatggccgtgggaatcgtcagcatccttctctcatcgctgttgaaaaatgacgtccccctagcagggcccctgatcgccggcggcatgctgattgcctgctacgtgatcagcgggtcctcggcggacctctccctggaaaaggctgctgaggtcagctgggaagaggaggccgagcattccggcgcctcgcacaacatactggttgaggtgcaggacgacggcaccatgaaaatcaaggacgaggaacgggacgacaccctcaccatcctgctgaaagcgacacttctggctgtctcgggagtctacccgttgtcgataccggccacactcttcgtctggtacttctggcaaaagaagaagcagcgctctggggtcctgtgggacaccccaagcccacccgaggtagagagggccgtgctggacgacggcatctaccgcattatgcagcgtgggcttttaggaagatcccaggtgggcgtgggagtgttccaagagaacgtgttccataccatgtggcatgtgacgcggggcgccgtgctgatgtaccaaggaaagcgcctggagccctcctgggcgtccgtcaagaaggatctcatctcgtatggaggagggtggcggctgcagggctcctggaacaccggtgaagaggtccaggtgatcgccgtggaaccagggaagaaccccaagaacgtgcaaaccgcgcccgggaccttcaagacgcccgagggcgaagtgggagccatcgccctggacttcaagccaggtacgagcggctccccaatcgttaatcgcgagggaaaaatcgtgggcctctacggcaacggggtggtcactaccagcggaacgtacgtaagtgcgattgcccaggccaaggcgtcccaggaggggcccttgcccgagatcgaagacgaggtgtttaggaagcgcaatcttaccattatggatttacatcccggcagcgggaagacccgccgatacctgccggcgatagtccgggaggccatcaagcgcaagctgcgcacgctcattctggcccccacgcgggtggtggccagcgaaatggccgaggcgctgaagggcatgccaatccgctaccagactaccgccgtcaaaagcgagcacaccggcaaggagatcgtggacctcatgtgtcacgccacgttcactatgcggctgctgtccccggtaagggtccccaactacaatatgatcataatggatgaggcacatttcaccgacccatcgtccattgctgcacgtgggtacataagcacccgcgtgggcatgggggaagccgccgccatcttcatgacggccacgccgccaggctccgtggaggccttcccgcagagcaacgccgtcatccaagacgaggagcgggacattcccgagcgctcctggaactcggggtacgagtggatcactgacttccccggcaagaccgtgtggtttgtgccttccatcaagtcaggcaacgacatcgccaactgtttacggaaaaacgggaagcgtgttatccagctttcccggaaaacgttcgataccgagtaccagaagaccaagaacaacgactgggattatgtggtcaccacggacatcagcgagatgggcgcaaacttccgagcggaccgtgtcatcgatccgcgccggtgcttaaagccagtgatcttaaaggatgggcccgagcgcgtgatcctggcgggtccaatgccggtcacagtggcgtctgccgcgcaaagacgcgggcgtataggtcgcaaccacaacaaggagggcgatcagtacatctatatggggcagcccctgaataatgacgaggaccacgcccactggaccgaggcaaagatgctactggacaatatcaatacccccgagggcatcataccggccctgttcgagccagagcgcgaaaagtccgccgcgatcgacggtgaataccggcttcgcggcgaggcacgcaagaccttcgtcgagttgatgcgcagaggggacctgcccgtgtggctgtcctacaaagtggcctcggagggcttccaatacagcgaccgccggtggtgcttcgacggagagcggaacaatcaggtcctggaagagaatatggacgtggagatatggacgaaggagggggagcggaagaaactgcgaccccgttggctcgacgcgcgaacctacagtgacccactcgccctgcgggagtttaaggagttcgccgcgggccgccggagcgtgtccggggatctcatcctggagatcggcaagctgccgcagcacctcacccagcgcgcccagaacgccctggacaacttagtcatgctccacaacagcgagcagggcgggcgagcctaccgccatgcgatggaggagctgcctgacaccatcgagaccctaatgctcctggccctgatcgccgtcttaaccggcggggtgaccctgttcttcctgtccggacggggtctcggcaagaccagtatcggcctgttatgcgtaatggccagctctgtgttgttatggatggcttccgtggagccacattggatcgcggcaagcatcatcctggagttcttcctcatggtcttactcatacctgagccagaccgccagcggacgccccaggacaaccagttggcttacgttgttatcgggctgctgttcatgattctcactgtggcggccaacgaaatgggcctgctggagaccaccaaaaaggacttagggataggccacgtggcggtggagaaccaccaccacgccgccatgctggacgttgatctgcaccccgcgtccgcgtggacgctctacgcagtagcgaccaccatcatcactccgatgatgcgccacacgatcgagaacaccaccgctaacattagcctgacggccatcgccaaccaggcggccattctgatggggctcgacaagggctggcctatatccaagatggacattggcgtgccactgctggctttgggatgctatagccaagtcaacccccttacgcttaccgcagccgtcctcatgctggttgcacactacgccataataggccctggcctgcaagcaaaggctacgcgcgaggcccagaagcggactgccgccgggatcatgaaaaacccaacggtcgacggaatcgtggcaatagacctcgaccccgtggtctacgacgccaagtttgagaagcaactagggcaaatcatgctgctcatcttatgcacgtcgcagatcctgctcatgcgcaccacctgggcactgtgtgaaagcattacgctggccaccggcccactcaccacgttatgggaagggtctccgggcaagttttggaacacaaccattgccgtgagcatggccaacatctttagagggtcctacctggccggcgcgggcttagccttcagcctcatgaagagtcttgggggcggccgccgggggacgggtgcccagggcgagactctcggcgagaagtggaagcgccaactgaatcagttgtccaagagcgagttcaacacctataaacgatccgggatcatggaagtagacagaagcgaggccaaggagggcctcaagcgcggggagaccaccaagtacgcagtctcccgcggtaccgcgaagctgcggtggtttgtggagcgcaacctggtcaagcccgaggggaaggtcattgacctggggtgtggccgcgggggctggtcctactattgcgccgggctgaagaaggtgacggaggtcaagggctacacaaagggcggtcccggccacgaggagcccattccgatggctacctacgggtggaacctagtcaagttacactcgggaaaagatgtgtttttcgtgccgcccgagaaatgcgacaccctcctgtgcgacatcggggaaagcagtcccaacccgacgatcgaggaggggcgcaccctgcgggtcttaaaaatggtggagccgtggctgaggggaaatcagttctgtatcaagatcctgaatccctacatgccaagcgttgtcgagaccctggagcagatgcagcggaagcacggtggcatgctagtgcggaacccactgagtaggaactcgacccacgaaatgtactgggtgtcctgcggcacaggcaacatcgtcagcgccgtgaacatgacgtcaagaatgctccttaaccgcttcactatggcgcacaggaaacccacctacgagcgcgacgtagaccttggggccggcacgcgccacgtcgccgtagaaccagaagtggccaacctggacatcattgggcagcgcatcgagaacattaagcacgagcacaagagcacttggcattatgatgaggataacccttacaagacctgggcttaccacgggagttatgaggtcaagcctagcggctccgcaagcagcatggtgaatggggtcgtgaagttattgaccaaaccctgggacgtcatccccatggtcacccagatagccatgacggacacgacccccttcggccagcagcgggtatttaaggaaaaggtagacactcgcacgccgaaggccaagagagggaccgcgcaaatcatggaggttaccgcaaaatggctctggggctttctgtcccgcaataagaaaccccgaatctgcaccagggaggagttcacgcgtaaggtacgatcgaatgcggccataggcgccgtgtttgtcgacgagaaccagtggaacagcgccaaggaggcggtggaggacgaacgattttgggatttagtgcacagagagcgggagctacacaagcagggtaagtgcgcaacctgcgtctacaacatgatgggcaagcgtgagaagaagctgggtgagtttggtaaggccaagggcagccgcgcaatctggtacatgtggcttggcgcccgcttcctcgagttcgaggctctgggctttatgaacgaagatcattggttctcccgggagaatagcctgtccggagtagagggcgagggtctccacaagctgggctacatcctgcgcgatatcagcaagatccccgggggcaacatgtacgccgatgacaccgcaggctgggacacccggatcacggaggatgacctccagaacgaagctcgcatcaccgatatcatggagccggaacacgcgctgctggccaagtccatattcaagctcacctatcaaaacaaggtggtccgcgttcagaggccagccaagaacggaactgtgatggacgtaatctctagacgggaccagcgcggctccggtcaggtcgggacatacgggctgaataccttcactaacatggaagcccagctgatccggcagatggagtctgaaggaatcttctccccctccgaactcgagacccccaacctggccgaacgtgttctggactggttagagaagtatggagtcgaacggttaaagcgcatggccatctccggagatgactgcgtggtgaagccgattgacgacagattcgcgacggccctgaccgccctcaacgacatgggcaaagtccgcaaagacatcccccaatgggagcccagcaaggggtggaacgattggcagcaagtcccattctgctcccatcattttcaccagctgatcatgaaagacggccgggagatcgtggtcccctgccgcaaccaggacgaactggtcggccgcgcccgcgtcagccagggggccggctggagcctccgggagaccgcgtgcctggggaagagttacgcacaaatgtggcagctaatgtacttccatcgccgggacctacgcctggctgccaatgcgatctgcagcgctgtccccgtcgattggatcccgacctctcgtacgacctggtccatccatgcgcaccatcagtggatgaccaccgaggacatgttatccgtgtggaaccgcgtctggattgaggagaacccttggatggaggacaagacccacatcagctcctgggaggacgtgccgtacctcggtaaacgcgaggaccagtggtgcgggagcctgatcggcctgaccgcccgagctacgtgggccacaaacatccaggttgcaatcaaccaagtgcgtcggctcatcggcaacgaaaattatctggactacatgacctcaatgaaacggttcaagaacgagagcgacccagaaggggccctgtggtga

SEQ ID NO: 24635 - RNA, 9879 nt, synthetic construct
  misc_feature 1..9879: note = derived and/or modified CDS sequence (opt11) from DENV-1__JQ045652__SS-prME
  source 1..9879: mol_type = other RNA
agtgtgaccatgctgctgatgctaatgcccaccgccctggcattccacctcaccacccggggcggcgagccgcacatgatcgtgtctaagcaggagcgtggaaagtcgctgctgttcaagaccagcgccggggtaaacatgtgcaccctcatagccatggacctgggcgagctgtgcgaggacactatgacgtacaagtgcccccggataaccgagacagagcccgatgacgtcgactgttggtgcaacgcgacggacacctgggtgacctacgggacctgcagccagacgggcgagcaccggagggacaagcggtctgtcgcgctcgcgccccacgtgggtctggggttagagacccgcaccgagacctggatgagctccgagggcgcctggaagcagatccagcgggtcgagacgtgggccctgcggcacccagggttcaccgtgatcgccctattccttgcccacgccatcggcaccagcattacccagaaggggatcatattcatcctcctgatgctggtgacgccctctatggccatgcggtgcgtcggcatcgggtcccgcgactttgtggaagggctctccggcgccacctgggtggacgtagtgttagagcacgggtcatgcgtgacaaccatggccaaggataagcccacgctcgacattgagttactgaagaccgaggtcaccaatcccgccgtgttgcggaaactgtgcatcgaggctaaaatctccaacacgaccaccgactcccgctgccccacccagggggaagccactctggtggaggaacaggacgccaacttcgtctgtcggaggaccttcgtcgacagaggatgggggaacggatgtgggttattcggcaaggggtccctgataacgtgcgccaagttcaagtgcgtgactaagttggaggggaagatcgtccagtacgagaacctcaagtattcagtgatcgtgactgtccacacaggtgatcagcaccaggtgggtaacgaatccaccgagcacggcactaccgccaccatcactccccaagcgcccacaaccgagattcaactcaccgactacggggccctgactctggactgtagccctcgcaccggactcgacttcaacgaaatggtcctgctgaccatgaaagagaaaagttggctggtgcacaagcagtggttcctggacctgccactcccctggaccagcggggccagcacctcccaggagacctggaaccgtcaggatctgctcgtgacctttaagacagcccacgccaaaaagcaggaggtcgtggtgctgggcagccaagagggcgcgatgcacacggctctaacaggagctaccgagatccagacctccggcacgaccaccatctttgccgggcatctgaaatgccgcctgaagatggacaagctgaccctgaaggggatgagctacgtaatgtgcacggggtcgttcaagctcgagaaggagctggccgagacccagcacggcaccgtgctggtgcagatcaagtacgagggcaccgacgcgccgtgcaaaatcccctttagcacgcaggacgagaagggggtcacccaaaacggccggctgatcactgccaacccgatcgtgactgacaaggagaagcccgtgaacatcgaggccgagccgccgtttggggagtcctacatcgtgatcggcgccggcgagaaggcgctaaagctaagctggttcaaaaagggaagcagcatcggcaagatgttcgaggccacggcccgcggtgcccggcgcatggccatcctgggggacaccgcatgggacttcgggtccatcggtggcgtcttcacctccgtgggtaagctcgtccatcaaatcttcggcacagcgtatggggtgctgttctctggcgtaagctggaccatgaaaatcggaatcggcgtcctgctcacctggctgggactgaactcccgctctacgtccctcagcatgacctgcatcgccgtggggctggtgacgctgtatttgggcgtcatggtacaggccgactccgggtgcgtgatcaactggaaaggcagagagctgaagtgcgggagcggaattttcgtcacaaacgaggtgcacacctggacggagcagtacaagttccaggcggacagcccgaagcgcctcagtgcggccatcggcaaggcatgggaggagggggtgtgtggcatccggagcgcgacacgcctcgagaatatcatgtggaagcaaatctccaacgagctgaaccacatcctcctcgagaacgacatgaagttcacggtcgtggtgggggatgtcgccggcatcctggcgcagggaaagaagatgatccgcccccagccgatggagtacaaatactcgtggaaaagctggggcaaggccaaaatcattggcgccgacgtgcagaacacgaccttcatcatagatggccccaacaccccggaatgtcccgacgatcagagagcctggaacatctgggaagtggaggactacggcttcgggatctttacgaccaacatctggctgaagctcagggacagctacacccaggtctgcgaccaccggctgatgtccgcggccatcaaggatagcaaggccgtgcacgccgacatgggctactggatcgagtccgagaagaacgagacttggaagctggcccgcgcgagcttcatcgaggtgaagacgtgcatttggcccaagtcacacacactatggtccaacggcgtcctggagtccgagatgatcatccctaagatctacgggggcccgatctcccagcacaattaccgccccggctacttcacccagaccgccggcccctggcacctgggtaagttggagttagactttgacctgtgcgagggaacgaccgtggtggtagacgaacactgcggcaatcggggcccgtccctccgcaccaccacggtgaccggcaagatcatccacgagtggtgctgtcggagctgcaccctgccgcccctgcgcttccgcggggaggacggctgctggtacgggatggagatccgacccgtgaaggagaaggaggagaaccttgttaagtctatggtgagcgccggttcgggagaggtggactcattctccctggggctgctctgtatctctatcatgatcgaggaggtcatgcggagccgctggtcccggaagatgctgatgacaggcacgctggcagtcttcttcctcctgatcatggggcagctgacctggaacgacctcatccgtctgtgcatcatggtgggcgccaacgcgagcgaccgcatgggcatgggcaccacttacctggcgctcatggccacgttcaagatgcggccgatgttcgccgttggcttactgttccgccgactcaccagtcgcgaggtgctgcttctcaccatcgggctctcgctggtggcctccgtcgagctccccaacagcctggaggagctgggcgacggcttagcgatgggcatcatgatcctgaagttactcaccgactttcagtcccaccagctgtgggccacgctgttaagcctgaccttcatcaagaccaccttctccctgcactatgcgtggaagacgatggccatggtcctctcaatcgtatccctgttcccactgtgtctcagcaccacctcccagaaaacaacgtggcttcccgtgctgctcggcagcctggggtgcaagccgctgaccatgttcctcatcgcggagaacaagatatggggcaggcgttcatggccactgaacgagggtataatggccgttggtatcgtcagcatcctgctctcctccctgcttaaaaacgacgtgcctctcgccgggcccctgatcgccggaggcatgctcatcgcctgctacgtcattagtggatccagcgcggacctctccctggaaaaggccgccgaggtcagttgggaagaggaggccgagcactccggggcttctcacaacatcctggtggaggtgcaggacgacgggaccatgaagattaaggacgaggagagagacgacaccctcaccatcttactgaaggcgacgttactagccgtcagcggagtgtatccgcttagcatccccgccacgctcttcgtgtggtatttttggcagaagaagaaacagcgctcgggggttctgtgggacacccccagcccgcccgaggtagagagagcggtgttagatgacggcatctaccgcatcatgcagagaggccttctcgggcgctcccaggtcggagtgggggtgttccaggagaacgttttccacaccatgtggcatgtgacgcggggcgccgttctgatgtaccaggggaaacgcctggagcccagctgggctagtgtcaagaaagatctcatctcctacggcggagggtggaggctgcagggctcgtggaacaccggggaggaggtccaggtgatcgctgtcgagcctggcaagaaccccaagaacgtgcagacggcccccgggaccttcaaaacgccagagggcgaggtgggcgccatcgccctggattttaagcccgggacgagtggcagccccatcgtcaaccgcgagggaaaaatcgtgggcctctacggcaatggggtggtcaccacgagcggaacgtacgtgagcgctatcgcccaggcgaaggcctctcaggaggggccgctgcccgagatcgaagacgaagtgtttcgaaagcgcaacctgaccatcatggacctgcaccccggcagcggtaagactcgccgctacctgcccgcgatcgtccgggaagccatcaagcgcaagcttagaacgttgatccttgcgcccacgcgggtcgtggccagtgagatggccgaggctctgaagggcatgcccatccgataccagaccactgccgtcaagagcgagcacaccggcaaggagatcgtggacctaatgtgccatgccacgtttaccatgcgcctgctgtcacccgtacgagtccctaactacaacatgatcattatggacgaggcccacttcaccgaccccagctccatcgccgctcggggatacatcagcactcgcgtgggcatgggggaggccgccgcaatcttcatgacggccacgccccccggcagtgtagaggccttcccgcagagcaacgccgtcattcaggacgaggagcgggacatccccgagcgctcctggaatagcgggtacgaatggataaccgattttcccggcaaaacggtgtggttcgtgccatccattaagagtggcaacgacatcgcgaattgtctccgtaagaacgggaagcgcgtcattcagctgtcccgtaagacgttcgacaccgagtaccagaagaccaagaacaacgactgggactacgtggttacaacggacatctctgagatgggcgctaactttcgcgcggacagggtcatcgacccgcgccggtgcctgaagccagtgatcctgaaggacgggcccgagcgcgtaatccttgccgggcccatgccggtcacggtggcctccgctgcccaacggcgcgggagaatcggccgcaaccacaacaaagagggcgaccagtacatttacatgggtcagcccctgaacaacgacgaagaccacgcgcactggaccgaggccaagatgttactggacaacatcaacacaccagagggcatcatcccagccctgttcgagccggaacgcgagaagtccgccgccatcgacggggagtaccgactccgcggcgaggcgcggaagacgttcgtagaactgatgcgccgcggagacctccccgtgtggctctcctacaaggtggcgagcgagggcttccagtactccgaccgccgctggtgcttcgacggtgagcgaaacaaccaggtcttagaggaaaacatggacgtagagatctggaccaaggagggggagcggaaaaagctgcgcccccgctggctcgacgcccgcacctactcagaccccttagccctgcgcgagttcaaagaattcgccgccggccgccggagcgtgtccggggacctgatcctggagataggcaagctgccgcagcacctcacccagcgggcccagaatgccctggacaacctcgtcatgctccacaacagcgagcagggcgggcgggcgtaccgccacgccatggaggagctgcccgacacgatagagacgctgatgctcctggccctgatcgccgtgctcaccggaggtgtgaccctgttctttctatccggacgggggctcggaaagacaagcatcggcctgctatgcgttatggcctccagcgtgctcttatggatggcctctgtggagccccactggatcgcggccagcatcatcctggagttctttctaatggtactgttaatcccagagcctgatcgtcagcggacgccacaggacaaccagctcgcctatgtggtgatcggtctgctgttcatgatcctcaccgtcgccgcaaacgagatgggcctactggagaccactaaaaaggacctcggcattggccacgtggcggtggagaaccaccaccacgcagccatgctggacgtcgacctgcatccggcctccgcctggacgctctacgctgtggccacgaccatcatcaccccgatgatgcgccacacgatcgagaacaccaccgccaacatcagcctgaccgccatcgccaaccaggcagcgatcctgatggggttagacaaggggtggccaatctccaaaatggacatcggcgtccccctgctggccctcgggtgctatagccaggtcaacccactgactctgactgccgcggtgctcatgttagtggcccactacgccatcatcggcccggggctgcaggccaaagcgacccgcgaggcgcaaaagcggaccgccgccggcatcatgaagaatcccacggtcgacgggatcgtggctatcgacctcgaccccgtggtctacgacgctaagtttgagaagcagctgggccagatcatgctgctcatcctgtgcacctcccaaatcctgctgatgcggaccacctgggcgctgtgcgaaagcattacgctggccaccggccccctcaccaccctttgggagggctccccgggcaagttttggaacacgaccattgccgtgagcatggccaacatcttccgggggtcgtacctggccggcgcgggcctcgccttctcgctgatgaagtccctagggggcggtcggcgcgggacaggggcccagggcgagaccctcggcgaaaagtggaagcgacaattgaaccagctgtccaagagcgagtttaacacgtacaagcggtccgggatcatggaggtggacagaagcgaggccaaagaaggcctcaagcgcggggagacaacaaaatacgcggtatcccgcggaaccgccaagctgcgatggttcgtggagcgcaatctggtgaaacccgaggggaaggttatcgacctgggctgcggccgcgggggttggagctactactgcgctggactcaagaaggtaacggaggtgaagggctacacgaagggcggcccaggccacgaggagcccatcccgatggccacctacgggtggaacctggtcaagctgcactccggtaaggacgtgtttttcgtgccgcccgagaagtgcgacaccctgttgtgcgacattggggagtcttcccccaacccgacgattgaggagggccgcaccctgcgtgtcctcaagatggtggagccctggcttcgcgggaatcagttctgcatcaagatcctgaacccctatatgcccagcgtggtcgagacactcgagcagatgcagcggaagcatggcggcatgctggtgcgcaacccgctgtctcggaacagcacccatgagatgtactgggtatcctgtgggaccggtaacatcgtcagcgccgtgaacatgacgagccgcatgctcctgaaccgatttaccatggcgcaccggaagcccacttacgagcgcgacgtggacctgggggctggcacccggcacgtcgccgtggagcccgaggtcgccaacctcgacatcatcggccagcgcatagagaacatcaagcacgagcataagagcacgtggcattacgacgaagacaacccgtacaagacctgggcctaccacgggtcctacgaggtaaagcctagcgggagcgcgagcagcatggtgaacggtgtcgtgaagctgctgaccaagccctgggacgtgatcccgatggtcacccagatcgccatgacggacaccacccccttcggtcagcagagagtgttcaaggagaaggtggacacccgcacgccgaaggccaagcgcggaaccgcccagattatggaggtcaccgcgaagtggttatggggcttcctgtcccgcaacaagaagcccaggatctgcactcgcgaggagtttacgcggaaggtgcgcagcaacgctgccatcggcgcggtgttcgttgacgagaatcagtggaacagtgccaaggaggcagtggaggacgaacggttttgggacctggtgcacagggagcgggagctacacaagcaggggaagtgcgccacttgcgtctacaacatgatgggcaagcgtgagaagaagctgggagagtttggcaaggccaaggggagccgggccatctggtacatgtggttgggagctcgcttcctggagtttgaggcgctgggcttcatgaatgaggaccactggttctcccgtgaaaacagcctgtccggggtggagggcgagggcctgcacaagctgggctacattctgcgcgacatttcaaaaatccccgggggcaacatgtacgccgacgacaccgccggctgggacacccggattacggaagacgatctccaaaacgaagctcgcataactgacatcatggagcctgaacacgccctgttggctaagtccatcttcaagctcacctatcagaataaggtggtccgggtgcagcggcccgccaagaacgggactgtgatggacgtcattagccgccgtgaccagcgcggctccggccaggtagggacgtacggcctgaatacgttcaccaacatggaggcccagctgattcgtcagatggaatcagaggggatcttctcgcccagcgaactcgagaccccaaatctggccgaacgtgtgctagactggctcgagaagtacggcgtcgagcggctgaagcgcatggccatctcgggggacgactgcgtggtgaaaccgatcgacgaccggttcgcgacggcactgacggctctcaacgacatgggcaaggtccgtaaggacatcccccagtgggagcccagcaaggggtggaacgattggcaacaagtgcccttctgctcccaccacttccatcagttgatcatgaaggatggacgggagatcgtggtgccgtgccggaaccaggacgagctggttgggcgggcccgcgtgagccaaggggccggctggagcctccgggagaccgcgtgtctgggcaagtcctacgcccagatgtggcaactgatgtacttccatcgccgggacctccgcctggcagccaacgcgatctgcagcgccgtcccggtagactggatccccacctcccggaccacctggagcatccacgcccaccaccagtggatgaccaccgaggacatgctgtctgtgtggaatagggtctggatcgaggagaacccctggatggaggacaagacgcacatcagctcctggggcgacgtaccatacttagggaagcgcgaggaccagtggtgcggcagcctgatcgggctgacggcccgtgcgacctgggcgaccaatatccaagtggccatcaaccaggtccgccggctaatcgggaatgagaactacctggactacatgacctccatgaagcgcttcaagaacgaaagtgacccagagggcgccctgtggtga

SEQ ID NO: 24636 - RNA, 9879 nt, synthetic construct
  misc_feature 1..9879: note = derived and/or modified CDS sequence (opt11) from DENV-1__JQ045653__SS-prME
  source 1..9879: mol_type = other RNA
agcgtcaccatgctgctgatgctaatgcccaccgccctggccttccacttaaccacacgcggcggggaaccccacatgatcgtgagcaagcaggagcggggaaagagcttgttgttcaagaccagcgctggggtgaacatgtgcaccctcatcgctatggacctaggagagctatgcgaggacaccatgacctacaagtgcccccggataaccgagaccgagcccgacgatgtggactgctggtgtaatgccacagacacctgggtgacctatgggacatgcagccaaacaggagagcaccggcgcgacaaacggtccgtggctttggcgccgcacgtggggctgggactggagacccggacggagacctggatgagctccgagggcgcctggaagcagatccagcgcgtcgagacgtgggccctgcgccaccccgggttcaccgtgatcgcgctgttcctggcccacgcgatcggcacaagcattacccagaaggggataatctttatcctcctgatgctggtgacaccctccatggcaatgcggtgcgtcggcatcggaagcagggactttgtggaggggctctccggcgccacgtgggtggacgtcgtcctggagcacgggagctgcgtaaccaccatggctaaggacaagccaacactggacatcgagttgctgaagaccgaagtcacgaatcccgccgtgctgcggaagctatgcatcgaagcgaagatttctaacaccacgaccgatagccgctgcccgacgcagggcgaggcaaccctggtggaggaacaagacgccaacttcgtctgccggcgcacgctagtggaccggggctgggggaacggctgcggtctcttcggcaaggggtccctgattacgtgcgccaagttcaagtgcgtgaccaagcttgaggggaagatcgtccagtacgagaacctcaagtactctgttatcgtgaccgtccacacgggcgaccagcaccaggtcgggaacgagtctaccgaacacggcactactgctaccataacgccccaggcgcccaccaccgagatccagctgaccgactacggcgccctgacgttggactgctctccccgcacgggcctagacttcaacgagatggtccttctcacaatgaaggagaagtcctggctggttcacaagcaatggttcctggacctccccctgccctggaccagcggggccagcacgtcccaggagacctggaatcggcaggacctgctcgtcacctttaaaaccgcccacgccaagaagcaggaggtcgtagtgctgggcagtcaggagggcgcgatgcatacggccctgacgggagccaccgagatacaaaccagtggcacgaccaccatctttgccgggcatctcaagtgccggctgaagatggacaagctgaccctcaagggcatgtcctacgtcatgtgcacggggtccttcaagctggagaaggagctggctgagacccagcacggcaccgtgctggtgcagatcaagtacgaaggcaccgacgcgccctgcaaaatacccttctccacccaggacgagaagggtgtcacccaaaacggccggctcatcaccgcaaatcctatcgtgaccgacaaagagaagcccgtgaacatcgaggccgagccgcccttcggggaaagttacattgtgatcggcgccggcgagaaggcgctgaagctgagctggttcaaaaaggggtccagcatcggcaagatgttcgaggctacggcacgcggggcccgccgcatggccatcctcggcgatactgcgtgggacttcggttcgatcggcggcgtgttcacgagcgtggggaagctggtgcaccagatcttcggcacggcctacggggtcttgttctccggcgtgagctggacgatgaagattgggataggcgtcctcctgacctggttgggcctcaattccagatctacctccctgagtatgacctgtatcgccgtgggtctggtgacactgtacctgggcgtcatggtccaggccgactccggatgcgtgatcaactggaagggccgggagttaaaatgcgggagcggcatcttcgtcaccaacgaggtgcatacttggacggaacagtataagttccaggccgacagcccgaagcgcctctcagcggccattggtaaggcctgggaggagggggtatgcggaatccggagcgccacccgcctggaaaacatcatgtggaaacagatcagcaacgagcttaaccacatcctcctcgagaacgacatgaagttcacagtcgtggtgggcgatgtggctggcatactggcgcaggggaagaagatgatccggccccagcccatggagtacaagtacagctggaagtcctggggaaaggccaagatcatcggcgccgacgtgcagaacactaccttcatcatcgacgggccgaacaccccggaatgccccgacgaccagcgggcctggaatatctgggaggtggaggactacggcttcgggatcttcacgaccaacatctggctcaagttgcgagatagctacacccaggtctgtgaccaccggctgatgtcggcggcgatcaaagacagcaaggccgtgcatgctgacatgggctattggatagagtccgagaagaacgagacatggaagctcgcccgggcgagcttcatagaagtgaagacatgcatctggccccgcagtcacaccctgtggtccaacggcgtcctggagagcgagatgatcatccccaaaatctacgggggccctataagccagcacaactaccggcccgggtatttcacccagaccgcggggccctggcacctcgggaagctggagctggatttcgatctatgcgagggaaccacggtagtggtcgacgagcattgtggtaaccgcggcccgtctctgcgcaccaccaccgtgaccggcaaaattattcacgaatggtgttgcaggagctgtaccctgccgccgctgcggttccgcggggaggacggctgctggtacggtatggagatccggcccgtgaaagagaaggaagagaatctggtcaagtccatggtaagcgccggcagcggagaggtcgactctttcagcctggggctcctgtgtatttccatcatgatcgaggaggtcatgaggagccggtggagcaagaagatgctgatgactggcacgctcgcggtcttcttcctactaatcatggggcagctcacctggaatgacctgatccgcctgtgcataatggtgggggccaatgcgagcgaccggatgggaatggggaccacctatctcgcactgatggccacgttcaagatgcggccgatgttcgccgtggggttgctcttccgcagactgacctcccgagaggtgctgctactgaccatcgggctgagcctcgtggcctccgtcgagctccccaattctttggaggagctaggcgacgggctggctatgggtatcatgattctgaagttgctgactgactttcagtcccaccagctgtgggccacgctcctgtcgctgacctttatcaagacaacttttagtctccattgcgcctggaagacaatggcgatgatccttagcatcgtgtctttattccccctctgcctgagtaccacctcccagaagaccacgtggctgcccgtcttgctaggaagcctggggtgcaaaccgttgaccatgttcctgatcgcggagaacaagatctggggccggcgctcctggcccctgaacgaagggataatggccgtaggcatcgtgtcaattctactgagctccttgctcaagaatgatgttcccctggcggggccgctgattgccggcgggatgctcatcgcctgttacgtcataagcgggtccagcgctgatctgagtctggagaaagcggccgaggtgagctgggaagaggaagccgaacactccggcgcgagccacaacatcctcgtcgaggtgcaggacgacggtacaatgaagatcaaggacgaggaacgggacgacaccctgaccatcctgctcaaggcgacgctactggcggtgtccggcgtctacccgctcagcatccctgctacgctgtttgtgtggtatttctggcagaagaaaaagcagcgctccggggtgctctgggacacccccagcccgcccgaggtcgagcgtgccgtgctggatgatggaatctaccgcatcatgcagcgcggactcctggggcgctcccaggtgggcgtaggggtgttccaagaggacgtgtttcacacgatgtggcatgtcacacggggcgccgtgctgatgtaccaagggaagcgcctcgagccaagctgggcgagcgtcaagaaagacctgatcagctatggcggcgggtggcggttgcagggctcctggaacaccggtgaagaggtccaggtgatcgccgtggaacctggcaagaacccgaagaacgtccaaaccgccccggggacattcaagacgccagaaggagaggtgggggccatcgcgctcgatttcaagcccgggacttctgggtccccgatcgtcaatcgcgagggcaagatcgtgggcttgtacggcaatggagtggtgaccaccagcggcacgtacgtaagcgcaatcgcccaggccaaggcctcccaggaagggccgctccccgagatagaggacgaggtctttcgtaaacgcaatctcaccatcatggacctgcacccaggcagtgggaagacgcggcgctacctgcccgcgatcgtgcgggaggctatcaagcgcaagctccgtaccctgattttggcccccactagagtcgtggccagtgagatggccgaggcgctcaagggtatgcccatccgctaccagaccaccgccgtcaaaagcgaacacaccggcaaggagatcgtcgacctgatgtgccacgccacgttcaccatgcgcctgctctcccccgtgcgcgtgccgaactataacatgatcatcatggacgaggctcatttcaccgaccccagctccattgccgctcgggggtacatcagcacccgcgtcggaatgggcgaggccgccgccatcttcatgacggccacaccgcccggctccgtggaggcattcccgcaaagcaacgccgtgattcaggacgaggagcgagacatccccgagcgctcctggaactctggatacgagtggatcaccgatttcccagggaagaccgtctggttcgtgccgtctatcaagagcggaaacgacatcgccaactgtctgcggaagaacgggaagcgcgtaattcagctgagtcggaaaactttcgacaccgagtaccaaaagacaaagaacaacgactgggactacgtagtgaccacggacataagcgaaatgggtgccaattttagagcggaccgggttatcgatccgcgccggtgcctcaagcccgtcatcctgaaggacgggcccgagagagttatactggcgggccctatgccagttaccgtcgcctccgccgcacaacggcgcgggcggatcggtagaaaccacaacaaggagggcgaccagtatatttacatggggcagcccttgaacaacgatgaagaccacgcgcattggacggaagccaagatgttgctagacaacatcaacacccccgagggcataatccccgccctcttcgagccggagcgcgagaaatccgccgcaatagacggggagtatcggctgcgaggagaagcgagaaagacgtttgtggagctgatgcgccgcggggacttacccgtctggctgtcctacaaggtggccagcgagggcttccagtatagtgaccgccggtggtgctttgacggcgagagaaacaaccaggtgctggaagagaacatggatgtggagatctggacgaaggagggagaacggaagaagctccgccccagatggcttgacgccagaacctactccgacccactggcccttcgggagttcaaagagttcgccgccggccgccggagcgtgtcgggagatctcatcctggagattggcaaacttccgcagcacctgacccagcgcgcccagaacgccctggacaacctcgtgatgctgcacaattctgagcaaggcgggagagcatatcgccacgcgatggaagagctgccagatacaattgagactttgatgctgctggccctcatcgccgtcctgaccggcggggtgaccttattcttcctctccggacgcggactgggaaagaccagcataggcctgttgtgcgtgatggcctccagcgtcctgctgtggatggcttcagtggagcctcattggatcgcggccagcataatattagagttcttcctaatggtgctgctcatacccgagccggatcgccagcgaacgccgcaggacaaccagctggcctacgtcgttatcgggctcttatttatgatcctgaccgtggccgcaaatgagatgggcttgctcgagaccaccaaaaaggacctggggataggccacgtggcggtggagaaccatcatcatgccgccatgctggatgtagacctccatcccgcatccgcttggacgctctacgcggtcgctaccactattatcacccctatgatgcggcacacaatcgagaatacgacggcaaacatttccctgaccgcaatagcgaaccaggcggccatcctcatggggctggacaagggctggcccatcagcaagatggacataggcgtacccctactcgccttaggctgctacagccaagtcaacccgctgacgctcaccgctgctgtcctgatgctagtggcccactacgcgatcataggcccggggctccaggccaaggccaccagggaggcgcagaagcgtaccgccgctgggattatgaaaaaccccacggttgacggtatcgtcgccatcgacctggaccccgtcgtgtacgacgctaagttcgagaagcagctagggcagatcatgctcctgatcctgtgtacctcgcagatcctcctgatgcgcaccacctgggcgctgtgcgagtcaatcacgctcgccaccgggcccctgaccaccctgtgggaggggtccccgggcaaattctggaacacgacgattgccgttagtatggccaacatcttccgggggtcctatcttgcgggtgcaggcctggccttcagcctgatgaagagtctcggtggcggccggcggggcaccggggctcaaggcgaaacactgggcgagaagtggaaacgccagctgaaccagctcagtaagtcggagttcaacacctacaaacgatccggtatcatggaggtggatcgcagcgaggccaaagagggcctcaagcgcggcgaaaccaccaagcatgcggtctcccgcggcacagccaaactgcgatggttcgttgagagaaacttggtaaagcccgaggggaaggtgatcgatctcggctgcggccgtggtggttggagctactactgcgccggattaaaaaaggtcacggaggtgaaggggtacactaaaggcggtccggggcacgaggagcccatacctatggctacctacggttggaacctggtgaagctccactccggcaaagacgtattctttatccctccagaaaagtgcgacaccctgctatgcgacatcggggagtcatcgccgaacccgacaatcgaggaggggcgcaccctgcgggtgctgaaaatggtggagccctggctgcgagggaaccagttctgcatcaagatcctcaacccgtacatgccgagcgtcgtggagacccttgagcagatgcagcgaaagcacggcggcatgctggtacgcaatccgctctcccgtaacagcacccacgagatgtactgggtctcctgtgggacgggcaacatcgtcagcgccgtgaatatgacgtcacgcatgctcctaaatcgcttcacaatggctcacaggaagcctacatacgaaagggacgttgacctcggagccggcacccggcacgtggccgtggagcctgaggttgccaacctggacatcataggccagcgcatcgagaacatcaagcacgaacacaagtcaacctggcactacgacgaggacaacccctacaagacctgggcttaccacggttcctacgaggtgaagcccagcggatccgcgagctccatggtgaacggtgtcgtcaagctactcaccaagccctgggacgtcatccccatggtaacccagatcgccatgactgataccacccccttcggccaacagcgggtgtttaaggaaaaggtcgacacgcgcacgccgaaggccaagcggggaaccgcccaaatcatggaggtgaccgccaagtggctctggggtttcctgtcccgcaataagaagccccgtatctgcacccgcgaggagttcacgcggaaggtgcgcagcaacgcggcgattggagccgtcttcgtggacgagaaccagtggaactccgcaaaagaggcggttgaggacgagcggttttgggacctcgtccaccgggagcgggagctgcacaaacagggaaagtgcgcgacctgcgtatacaacatgatgggcaagcgcgaaaagaagctgggggagttcggcaaggccaaggggagccgcgcgatctggtacatgtggctcggcgcacgctttctggagttcgaggcgctgggcttcatgaatgaggaccactggttttcccgggagaacagtctctccggtgtggaaggcgagggcctgcacaagctgggctatatcctccgcgacatcagcaaaatccccgggggcaatatgtatgcggacgacaccgcaggctgggacacacggatcacggaggacgatctgcaaaacgaagccagaatcacggatatcatggagcccgagcacgccctgttagcgaaatccatcttcaagctaacctaccagaacaaggtcgtgcgcgtacagcgccccgccaagaacgggaccgtcatggacgtaataagccgcagggaccagcgcggctccggccaggtgggtacgtacggtctgaacaccttcaccaacatggaggcccagctcatccgacagatggagtccgagggtatcttctccccctctgagctcgagacccccaacctcgccgaacgcgtcctcgactggttagagaagtatggagtggaacggctgaagcggatggccatctccggagacgactgcgtagtcaagccgatcgatgacaggttcgcgacggccctcaccgccttaaatgacatgggtaaggtgcgcaaggatatcccccagtgggagcccagtaaggggtggaatgactggcagcaagtcccattttgcagccaccacttccatcagctgattatgaaggacggacgggaaatagttgtaccgtgtcgcaaccaggacgaattggtgggccgggcacgcgtcagccagggggccggctggagcttacgggagaccgcgtgccttgggaaatcctacgcccagatgtggcagctcatgtacttccaccgacgcgacctgcgcctggcggcaaacgcgatctgcagcgcagtgcccgttgactggatcccgacctccaggaccacctggagcatacacgcccaccaccaatggatgacaaccgaggacatgttgagtgtctggaaccgcgtatggatcgaggagaatccgtggatggaagacaagacccacattagctcctggggcgacgtgccctacctagggaagcgcgaggaccagtggtgcggaagcctgatcggcctcactgcacgagccacgtgggcgaccaacatacaggttgccatcaatcaggtgcgccggctgatagggaacgagaactaccttgactacatgacctccatgaaacgcttcaagaacgagtccgaccccgagggcgccctctggtga

SEQ ID NO: 24637 - RNA, 9879 nt, synthetic construct
  misc_feature 1..9879: note = derived and/or modified CDS sequence (opt11) from DENV-1__JQ045657__SS-prME
  source 1..9879: mol_type = other RNA
tctgtaaccatgctgctcatgctgatgcctaccgccctggccttccacctcacaacccggggcggggaaccgcacatgatcgtatccaagcaggaacggggcaagagcctgctgttcaagacgagcgcgggggttaatatgtgcaccctcatcgccatggatctgggtgagttctgcgaagacacgatgacatacaagtgtccccgcatcaccgaagcggaaccagacgacgtggattgctggtgtaacgccactgacacgtgggtgacctacgggacgtgcagccagactggcgagcaccggcgggacaagcggagcgtagccctcgcgccccacgtggggcttgggctggagacgcgcactgagacctggatgagctccgagggcgcatggaagcagatccaaagagtggagacctgggccctgcgccaccccggattcacggtgatcgcactcttcctggctcatgctatcggcaccagcatcacccagaaggggatcatcttcatcctgctcatgctggtcacgccctccatggccatgcggtgcgtaggcataggcagccgagacttcgtggaggggctgtccggagcgacctgggtcgatgtcgtgctagagcacggaagctgtgttaccacgatggcaaaggacaagcccacgctggatatcgagctgctcaagacagaggtcacgaaccccgccgtgctgcgcaagctgtgcatcgaggccaagatctccaacaccacgacggacagccgctgccccacccagggcgaggctaccctcgtggaggagcaggacgccaacttcgtctgccggcgcactttcgttgacagaggctggggaaacggctgcggcctattcgggaagggaagtctgataacctgcgccaagttcaagtgcgtgacgaaactcgagggcaagattgtccagtacgagaacctgaagtacagcgtgatcgtaacagtccacacaggcgaccagcaccaggtaggaaacgagtccacagagcacggaaccactgccaccatcacgccccaggcccccagcaccgagatacagttaaccgattacggggccctcacactggactgttccccgcgaactggcttagacttcaacgagatggtcctcctgacgatgaaggagaagtcgtggctagtgcacaagcaatggtttttagacctgccgctgccgtggaccagcggggcatcaaccagccaagagacgtggaaccggaaggatctcctggtcacgttcaaaactgcgcacgccaaaaagcaggaagtggtagtcctgggttcccaggagggcgcaatgcatacggcccttaccggggccacggagatccagacttccggcaccactacgattttcgcagggcacctgaagtgccgcctgaagatggataagctcactctgaaggggatgtcctacgtcatgtgcaccggctctttcaagctggagaaggaggtggctgagacccagcatgggacggtgctcgtccagattaagtacgagggcaccgacgccccctgcaagatccctttctccacccaggacgaaaagggggtcacccagaacggccgccttattacagctaatccgattgttacggacaaagagaaacccgttaacatcgaggcagagccgcccttcggggagtcatatatcgtgatcggagcgggcgagaaggccctgaaactttcctggttcaagaaggggtcatccatcggcaaaatgttcgaggccaccgcgcgtggggcccggcgcatggcgatcctcggtgacaccgcctgggacttcggctcaatcggcggtgtgttcacgtccgtcgggaagctggtgcaccaaatcttcgggaccgcctacggcgtgctgttcagcggcgtctcctggactatgaaaatcgggatcggcgtactcctcacgtggctggggctcaactcacgctccacgtcgctatccatgacttgcatcgccgtgggtctggtcaccctctaccttggcgtgatggtgcaggccgatagcgggtgcgtcatcaactggaagggccgggagctgaaatgcgggagcggcatcttcgtgaccaacgaggtacacacgtggaccgaacagtataaattccaggctgactccccgaagcgcctcagcgcagccataggcaaggcctgggaggagggggtctgcggcatccggtccaccacaaggctggagaatatcatgtggaagcagatcagcaacgaactgaaccacatcctcctggagaacgacatgaagttcaccgtagtggtcggggacgtggccggcatcctggcgcaggggaagaagatgatccggccccagcccatggagtacaagtactcctggaaaagctggggcaaggccaagatcatcggcgccgacgtgcagaacacgaccttcatcatagacggacccaacacccctgagtgcccggacgaccagcgcgcctggaacatttgggaggtcgaggactacggcttcgggatcttcaccacgaacatctggctcaagctgcgggactcatacacccaagtttgcgaccatcgcctgatgagcgcggccatcaaggactctaaagccgtgcatgccgacatgggctactggatcgaaagtgagaagaatgagacctggaagctcgctcgggcgtccttcatcgaggtcaagacgtgcatctggcccaagagccacacgttatggtccaacggcgtgctggagagcgagatgatcatccccaagatctacgggggcccgatctcgcagcataactacagacccgggtacttcacccagaccgccggcccctggcacctcgggaagctggagctggacttcgacctctgcgaaggaaccacggtggtagtggacgaacactgcggcaaccgggggccgagcctgcgcaccaccaccgttactggcaagataatccacgagtggtgctgccggagctgcaccttaccgcccctgcgcttcaagggagaggacggttgctggtacgggatggagatccgacccgtgaaggagaaggaggagaacctcgtcaagagcatggtgagcgctggctccggcgaggtcgacagcttcagtctgggactcctgtgcatcagcatcatgatcgaggaggtgatgcgcagccggtggagccgcaagatgctgatgaccggcaccttggccgtgttctttctgctgatcatgggacagctcacttggaacgacctgatacgcttatgcatcatggtcggggccaatgcatccgaccgcatgggaatgggcaccacctacctcgccctgatggctaccttcaagatgagaccgatgttcgccgtaggactcctgttccggcgcctcacgagccgggaggtactgctcctgaccattggtttgtccctcgtcgccagcgtggagctgcccaactccctggaggaactcggcgacgggttggctatgggcatcatgatcctgaagctccttaccgatttccaatctcaccagctatgggccactctcctgtcgctaacgtttattaagacaacattctcgctccactatgcctggaagacaatggccatggtacttagcattgtgagcctgttccctctctgcctgtccacgaccagccagaagaccacatggttgcccgtccttctgggctccctggggtgtaagccgctcaccatgttcctgatcgctgagaacaaaatctggggacgcaagagctggcccctgaacgagggcatcatggccgtcgggatcgtgtcaatcttgctgtccagtctgctaaagaacgacgtgcccttagccggacccctgatcgccggcggcatgctgatcgcctgctacgtcatctccgggtcgtccgcggacctcagcctggagaaggccgccgaggtgtcctgggaagaggaagccgagcatagcggcgcatcccacaacatcctcgtggaggtccaggacgacggaacaatgaagatcaaggacgaggagcgggacgataccctgacaatcctgctcaaggcgactctcttagctgtatccggcgtgtacccgctctccatccccgctacgctattcgtctggtacttctggcagaagaagaagcagcgcagcggggtgctgtgggatacccccagtccccctgaggtggagcgggccgtcctcgacgacggcatctatcgcataatgcagcggggccttttggggcgcagccaagtgggcgtgggtgtcttccaggagaacgtcttccacaccatgtggcatgttactcgaggcgccgtcctgatgtaccaggggaagcgccttgagcccagctgggcaagcgtgaaaaaggatctgatctcctacggtggcgggtggcggctgcaaggaagctggaacacaggcgaggaggtgcaggtcatcgccgtagagccgggcaagaaccccaagaacgtgcagaccgcgcccggaacctttaagaccagcgaaggcgaagtcggcgccatcgccttggacttcaagcccggtacgagcggctcaccgatcgtgaaccgggaggggaagattgttggactgtacggaaatggggtagtgactacctcgggcacctacgtgagcgcgatcgcccaagccaaggcctcccaggagggtcctctcccagagatagaggacgaggtgttccggaagcgcaacctgacgattatggacctgcatcccggcagcgggaagacccgccgctacctgcccgcgatcgtgcgggaggctatcaagcgaaagctccggaccctcatcctggcccccacccgcgtggtcgcgtccgagatggctgaggcgctcaagggcatgcctattagataccagacgaccgccgtcaagagcgaacacaccggcaaggagatcgttgacctaatgtgccacgcaacgttcacgatgcggctgctgtcccccgtccgcgtccccaattacaacatgatcatcatggacgaggcccacttcaccgaccctagctcgatcgccgcgcgggggtacatcagcacccgagtggggatgggggaggccgccgccatcttcatgaccgccacgccgcccggctcggtcgaggcgttcccccagagcaacgcggttatccaagatgaggaaagggacatccctgaacgctcctggaactccgggtatgagtggatcaccgactttcccggcaagactgtgtggttcgtcccctccataaagagcggcaatgacattgctaactgcctgaggaagaacgggaagcgcgtgatccagctgtccagaaagaccttcgacacagagtaccaaaagaccaagaacaacgactgggattatgttgtcacaaccgacatctcagagatgggcgcaaactttcgcgcagaccgtgtgattgacccccgtcgatgtctcaagccggtgatactgaaggatgggccggagcgcgtaatcctggccggacccatgcctgtgaccgtcgcctccgccgcgcagcggcgcggaagaatcggccgcaaccacaacaaggagggtgaccagtatatttacatgggccagccgctgaataatgacgaggaccatgcgcattggacagaggcaaagatgctgctggataacatcaacacgcccgagggcatcatccccgctctcttcgagccagaacgggagaagtcggccgccatcgatggggagtaccgccttcgcggcgaggcgcggaagaccttcgtcgagctgatgcggcgcggggacctcccggtgtggttaagctacaaggtcgcgtctgagggcttccagtactctgatcgccggtggtgcttcgacggtgagcgcaacaaccaggtgctggaagagaacatggatgtggagatctggacgaaggagggggaacggaaaaagctccgtccccggtggctagacgcccgaacatactccgaccccctagcactccgcgagttcaaagagttcgcggcggggcgccggagcgtatccggcgacctgatcctggagataggcaagctcccacagcacctgacccagagagcccagaatgccctggacaacctcgtgatgctgcacaacagcgagcaaggagggcgggcctatcgccatgcgatggaggagttgccggacaccatcgagacgctgatgctgctggccctcattgccgtgctgacgggcggggtcaccctgttcttcctttcgggccgggggctgggcaaaacgagcatcggtctgctctgcgtgatggcctccagcgtgctgttgtggatggcctccgtcgagccacattggatagctgccagcatcatccttgagttcttcttaatggtgctactcatacccgagcccgaccgccagcggaccccgcaggataaccaactggcttacgtggtcatcgggctcctcttcatgatactgacggtggctgccaacgagatgggcctgttggagacgaccaagaaggacctgggcattggccacgtggcggcagagaatcaccatcatgccgccatgctggacgtcgacctgcaccccgcctccgcttggaccttgtacgctgtggctacaaccatcatcacccccatgatgcgacatacaattgaaaacacgacagcgaacattagcttaaccgcgattgctaaccaggccgcgatactcatgggtttagacaagggttggccgatcagcaagatggacatcggagttcccctgctagcactggggtgctatagtcaggtcaaccctctgaccctaactgcggcggtgctaatgctagtggcccactacgccattatcggccccgggctccaagccaaggcgacccgggaggcccagaagcggaccgccgccggcatcatgaagaaccccaccgttgacgggatcgtggcgatcgatctggatcccgtggtctacgacgctaagttcgagaagcagcttggacagatcatgcttcttattctgtgcacctcccagatcctcctgatgcgcaccacttgggccttatgcgagagcatcaccctcgccacgggtcccctgaccaccttgtgggagggttcccccggcaagttctggaacaccacgatcgccgttagcatggcaaacatcttccgggggagctacctcgcgggcgctggcttagcgttttccctgatgaaatcgctaggcggcggccgccggggcaccggcgcacagggcgagacactgggcgagaaatggaagcgacagttgaaccagctcagtaagagcgagtttaacacctacaagcggtccggcatcatggaggtagaccgcagcgaggcgaaggaaggccttaaacgcggggagacgaccaagcacgcggtctcgcgcggcaccgctaagctgcggtggttcgtcgagcgtaacctcgtgaaacccgaggggaaggtcatcgacttgggatgcggtcgcggcgggtggagctattattgcgccgggctgaagaaggtgaccgaggtgaaggggtacacgaagggtgggcccggccacgaggagcccatccccatggccacatacgggtggaacctggtcaagttgcactctggcaaggatgtgttcttcgttccgcccgagaagtgtgacaccctgctttgcgacatcggggagtcttcccccaaccccaccattgaggagggccgcacgctccgggtcctaaagatggtagagccgtggctgcgcgggaaccaattctgcattaaaatattaaacccgtacatgcctagcgtggttgaaactttggaacaaatgcagagaaaacacggcggaatgctggtgcgcaaccccctatcccgtaacagcacccacgagatgtactgggtgtcctgcgggaccggcaatatcgtcagcgcggtcaacatgacctcccgcatgttactgaaccggttcacaatggcgcatcgaaaacccacctatgaacgcgatgtggacttgggggctggcacgaggcacgtcgctgtggagcccgaggtggccaacctggatattatcggccaacgtatcgagaacatcaaacatgagcataagagcacttggcactacgatgaggacaacccttacaaaacgtgggcctaccacgggagttacgaggtcaagcccagcggctctgcctccagcatggtgaacggggtcgtgaaacttctcaccaagccgtgggacgtcatccccatggtcacgcagatcgcaatgaccgacaccacaccattcggccagcagagggtgttcaaggagaaggtggacacccgcactcctaaggcgaagcgggggaccgcacagatcatggaagtcactgcgaagtggctatggggcttcctgtcccgcaacaagaagccgcggatctgtacccgcgaggagttcacccggaaggtgcgctcaaacgcagccatcggggccgtgttcgtcgacgaaaatcagtggaactccgcgaaggaggccgtggaggatgaacggttctgggaccttgttcacagagagcgcgagctgcacaagcagggcaaatgcgccacgtgcgtctacaatatgatgggcaagcgcgagaagaaactgggggagttcggcaaagccaaggggagccgggcgatttggtacatgtggctcggcgcgcgcttcctggagttcgaggcattgggcttcatgaacgaggaccactggttctccagggagaacagcctctccggggtggagggcgaggggctccacaagctgggctacatcctccgcgatatcagcaaaatcccagggggcaacatgtacgctgacgacaccgccggctgggacacccgaatcaccgaggacgaccttcaaaatgaggcgcgcatcacggacatcatggagcccgaacacgcgctactcgctaaatccatcttcaagctgacctaccagaacaaggtggttcgcgtacagagaccggccaagaatgggactgtgatggacgtcatcagcaggcgggaccagcgcggatctggccaggttggcacatacgggctgaacacgtttacgaatatggaggcccaactcatccgccagatggagagcgaagagattttctccccgagcgagcttgagacccccaacctggccggtcgagtgctggactggttggagaagcacggagtggagcggctgaagcgcatggcaatctccggggacgactgcgtggtcaagcccatagacgaccggttcgccacagccttaacggctctgaacgacatgggcaaagtccggaaggatatcccgcagtgggagcccagcaaagggtggaacgactggcagcaggtccccttttgctcccaccactttcatcagctcatcatgaaggacggccgggagatcgtagtcccctgccgaaaccaggacgagcttgtgggcagggcgcgcgtgtcccagggggcgggctggagcctgagggaaaccgcatgcctgggtaagtcctatgcccagatgtggcaactcatgtacttccaccgccgggatctgcgccttgccgcgaatgccatatgcagcgccgtccctgtggattgggtgcccacttcccgtactacgtggagcatccatgcccatcatcagtggatgaccaccgaggacatgctctccgtgtggaatcgcgtgtggatcgaggagaatccgtggatggaggataaaacccacatcagctcctggggcgacgtcccatatttgggaaagagagaggaccagtggtgcgggagcctaatcggcctcaccgcccgcgcgacctgggcaaccaacatacaggtcgccataaaccaggtgaggcgcttaatcggaaacgagaactacctggattacatgacctccatgaagcgcttcaagaacgagtcagacccggagggggccctctggtga

SEQ ID NO: 24638 - RNA, 9879 nt, synthetic construct
  misc_feature 1..9879: note = derived and/or modified CDS sequence (opt11) from DENV-1__JQ045659__SS-prME
  source 1..9879: mol_type = other RNA
agcgttaccatgctgctcatgttgatgccaacagctcttgcctttcacctaactacccgaggcggggagccccacatgattgtgtcaaagcaggagcgcggcaagtccctattattcaaaaccagcgccggggtgaatatgtgcactctcatcgcaatggatttaggcgagctctgcgaggacaccatgacctataagtgcccccgcatcaccgagaccgaaccagacgacgtcgactgctggtgcaacgccaccgatacctgggtgacctatggcacgtgcagccagaccggcgagcaccggcgcgacaagcgatcggtggccctcgcgccccacgtgggacttggactggaaaccaggaccgagacttggatgagctccgagggcgcttggaaacagatccaaagggtggaaacgtgggccttgaggcaccccggattcacagttattgcactcttcctggcacacgctataggcacctcgataacccagaaaggcataatcttcatcctcttaatgctggtgacgccctccatggctatgaggtgcgtcgggatagggagccgcgattttgtggaggggctctccggcgcgacctgggtggacgtggtgttggaacacgggagttgcgtgaccactatggccaaggacaagcccaccctagacatcgagcttttgaagactgaggtcactaaccccgccgtgctgcgaaaactttgcatcgaggcgaagattagtaacactacgacagattcgagatgcccgacgcaaggggaggccacgctagtggaagaacaagacgccaacttcgtgtgccggaggacgttcgtggatcgcggctgggggaatggctgtgggctatttggcaaagggtctctgatcacttgtgccaaattcaagtgcgttaccaagctggagggcaagattgttcagtacgagaacctgaagtacagtgtgattgttaccgttcacacgggcgatcagcaccaggtagggaacgaaagtactgaacacggcacaactgccaccataactccccaggcgccgaccaccgagatccaactcaccgattatggggcactgaccctggattgcagcccacgtaccggcctcgacttcaacgagatggtcctgcttacgatgaaagagaagtcatggctcgtccacaagcaatggttcctggacctacccttgccatggacaagcggcgctagcacgagccaggagacctggaaccggcaggacctactggttaccttcaagaccgcccatgcaaagaagcaggaagtcgtggtgctcggcagccaggagggtgcgatgcacacggcgctaaccggagccactgagatccagaccagtggcactaccacaattttcgctggacatctgaagtgccgcctcaagatggacaagctaaccctaaagggcatgtcatacgtcatgtgcacagggtctttcaagcttgagaaggaggtagcggagacccagcacggcactgtgttggtccagatcaagtatgagggcaccgacgcaccctgcaaaataccctttagcactcaggacgagaaaggggcgacccaaaatggccggctaatcacggccaacccgatagttactgacaaggagaagcccgtgaacatcgaggctgagcctccctttggggaatcctatatcgtcataggcgctggcgaaaaggccctgaagctcagctggttcaagaaggggtcctccataggaaaaatgttcgaagctacggcccgcggggccaggcgcatggcgatactgggcgacaccgcttgggacttcggtagcataggcggcgtttttaccagcgtgggaaagttagtccatcagatcttcggtactgcgtatggtgtcctcttttccggcgtaagctggacgatgaagatcgggatcggggtcctgctgacgtggcttggcctaaactcccgttctacctccctgagcatgacctgtatcgccgtgggactcgtaacgctgtatttgggagtcatggtacaggccgactcgggatgcgtgatcaactggaaggggcgagaactgaaatgcgggtcgggaatcttcgtgaccaatgaggtgcacacctggaccgaacaatataagtttcaggcggacagtccgaaacgcctgtcagccgccatcggcaaagcatgggaggagggtgtttgcggcatccgaagcgctacccgcctggaaaacatcatgtggaagcagatttccaatgagctcaaccatatcctactcgagaatgatatgaaatttaccgtagtagttggtgacgtaacgggaatcctcgcccaaggaaagaagatgatcagaccgcagcccatggagtacaagtactcatggaagtcctggggcaaggccaagattatcggagccgacgtgcagaacaccactttcataattgacggccccaatacgccggagtgccccgacgaccagcgcgcctggaacatttgggaagtcgaggactacggcttcgggatattcacgacgaacatctggcttaaactgagagacagccacactcaagtctgtgaccaccgcctcatgagtgctgcgataaaggacagcaaagccgtgcacgcggacatgggctattggatcgagtccgagaaaaacgaaacgtggaagttggcgcgggcgagcttcatagaggtgaagacgtgtatctggcccaaatcccacaccctctggtccaacggcgtcttggaatccgagatgatcatccccaagatctatggcgggccgataagccagcataactatcgccccgggtacttcacccaaaccgctgggccttggcacctagggaagctggagctggacttcgacctgtgcgaagggaccactgtggcggtggatgagcattgcggcaaccgcgggccgtccttacgcaccacgactgtcacggggaagatcatacacgagtggtgctgccgttcttgcaccctgccgcccctccgcttccgcggggaggacgggtgctggtacggaatggaaatccggcccgtgaaagagaaggaagagaacctcgtgaaatctatggttagcgctggcagcggagaggtcgatagcttcagcttgggtctgttgtgcatctccattatgatcgaggaggtaatgcgaagcaggtggtcccgaaagatgctcatgactggcaccctggccgtattcttcctgctgatcatggggcagctgacctggaacgacctgatccgcctctgcataatggttggcgcgaacgcctctgaccgtatgggcatgggcactacgtatctcgccttgatggcaacttttaaaatgcggccgatgtttgcggttgggctattatttagacgtctgacttcgcgggaagtcttgctgctgactataggtctaagcctggtggcgtccatggagctgcccaacagcttggaggagctaggggacggactggcgatgggcattatgattctcaaactgttaacggatttccaatcccaccagctctgggccaccttactatctctcacctttatcaagaccacgttctcccttcactatgcctggaagacaatggccatggtgctgagcatcgtgtccctcttcccgctgtgtctttcgaccacttcccagaagacgacctggctccccgtactcctgggtagcctcgggtgtaaaccgctgaccatgtttctaatcgccgagaacaagatttggggccgccgctcatggcccctcaatgaggggattatggctgtcggcatagtgtcaatcttgttgtcttccctcctgaagaatgacgtgcccctcgccggtcccctcatcgccggcgggatgctcatcgcgtgttacgtgatatcagggtcgtctgccgacctctcacttgaaaaggccgccgaggttagctgggagaaggaggccgaacactccggcgcgagccacaacatactggtggaagtccaggacgatgggactatgaagataaaggacgaggagagagacgacactttgacgatcctcctgaaggccaccctactggccgtgagtggcgtatatccgctgagcatcccagcaacgctgttcgtctggtatttttggcagaagaagaagcagcgcagcggagtgctctgggacacaccttcgccgcccgaggttggcagggccgtactggacgacggtatataccgcatcatgcagcggggactgctaggccgcagtcaggttggggtaggcgtcttccaggaaaacgtatttcacacgatgtggcatgtaacccgcggggcagttctcatgtaccagggcaagcggctggagccctcgtgggcttccgtaaagaaggacttaatcagctatggtggaggctggcggcttcaggggtcctggaatactggtgaggaggtccaggttatagccgtggaacctgggaagaaccccaaaaacgtgcaaaccgctcccggcacttttaaaaccccggagggcgaggtgggggccatcgctttagacttcaagcccgggacctcgggcagtcccatcgtgaaccgcgagggtaaaatagttggcctgtacggcaacggcgtcgtaaccacgtccgggacttacgtgtccgccatcgctcaggccaaggcgtctcaggaaggccctcttccggagatcgaggacgaggtcttccggaagaggaacctgaccatcatggacctgcacccggggagcggcaaaacccgacgatacctaccggccatcgtgcgggaggccataaagcggaaactacgcacgctgatcctcgcccccacccgggtggtcgcgtctgagatggccgaggccctgaagggaatgcccatacgttatcagactaccgctgtcaagtccgagcacacggggaaggaaatcgttgaccttatgtgccacgccacattcactatgcgtctcctatcccccgtgcgtgtaccgaattacaacatgatcattatggatgaggcacacttcaccgatccaagtagtatcgccgcccggggctacatttcgacccgtgtgggaatgggggaagcagccgccatcttcatgaccgcgacgcctcctgggtccgttgaggccttcccgcagtccaacgccgtgatccaggacgaggagcgagacatccccgagcgctcctggaactcaggttatgagtggatcaccgacttccccggcaagacggtctggttcgtcccttcgataaagtcggggaacgacatcgcaaactgcctgcggaaaaacggcaaacgcgttatacagctgtcccgcaagaccttcgacaccgagtaccagaagaccaagaataacgactgggactacgtggtcacgaccgacatcagtgagatgggggcgaatttccgcgcagaccgggtgattgacccgcgccggtgcctgaagccggtgatcctgaaggacggccccgaacgcgtcatcctggcagggcctatgcctgtgaccgtggcctccgcagcgcagcggcgcggcaggatcgggcgaaaccacaacaaagagggtgaccagtatatatacatgggccagcccctgaacaacgatgaggaccacgcacattggaccgaggccaagatgctactggacaatatcaacacgcccgaggggatcattccggcactgttcgaaccggagcgggagaagtccgccgcaatcgatggtgaatataggctgcgcggggaggcccgtaagacctttgtagagttgatgcgccggggcgatctgccggtatggctgtcctacaaagtcgccagcgaagggttccaatattctgacaggcgctggtgcttcgacggggagcgcaacaaccaggtgctcgaggagaatatggacgtagaaatatggaccaaggagggggagcggaaaaagctgcgcccccgttggctagacgcccgtacctactccgatcccctggccctgcgagagttcaaggagttcgcggccggaaggcgcagtgtctccggagacctgatcctcgagattggcaagctgccccaacacctgacgcagcgcgcccagaacgcactagataacctggtgatgctgcacaatagtgaacagggtgggcgggcgtaccgacatgctatggaagagttgcccgacaccatcgagacacttatgctgctcgccctgatcgcagttctcaccggaggagtaaccctcttcttcctgtccgggcggggcctgggcaaaacaagcattggcttactgtgtgtgatggccagctcagtgttgctctggatggcgtccgtcgaacctcactggatcgccgcctccattattctcgagttttttcttatggtactcctgatcccggaaccggaccgtcagcggacgccccaggataaccaactagcctacgtggtaataggattgctcttcatgatcctcactgtggcggctaacgagatggggctgcttgagaccacgaagaaggacctggggattgggcacgtggctgtcgagaatcatcatcatgcagccatgctagacgtcgacctgcatcctgcttccgcatggaccttgtacgccgtggccaccaccatcatcacgccaatgatgaggcacaccattgagaacaccaccgcaaacatcagcctcacggccatcgcgaaccaggcggccatcctaatgggtttagacaagggatggcctatctccaagatggacatcggtgtacccctactggccttaggctgctatagccaagtcaaccccctaaccctgacagcggccgttctgatgctcgttgctcactacgcaatcatcggcccagggctgcaggctaaagcaacaagagaagcccagaagaggacggctgccggaatcatgaagaaccccaccgtagatggcatcgtggccatcgacctggaccccgttgtgtacgacgccaaattcgagaaacagctcgggcagattatgctgctgatcctttgcacctcccagattctcctgatgcgcaccacgtgggccctctgcgagagcatcaccctggctaccgggccactgaccactctttgggaaggatcgccgggtaaattttggaacacaacaattgccgttagcatggccaacatcttccgggggtcctatttagcgggcgccgggctggccttcagcttaatgaagtcactgggcggcggccgccgtgggacgggcgctcagggcgaaacactgggcgagaagtggaagcgccagctcaaccagctgtcgaaaagcgagttcaacacctacaagcgcagcgggataatggaagtagatcgctcagaagctaaggagggtttgaaacgcggcgagaccaccaaacacgccgtgagccgcgggacggccaaactccgatggtttgtggagcggaacctggtaaagcccgagggcaaggtgattgacctgggctgtgggaggggagggtggtcctactactgtgctgggctgaaaaaagtgaccgaggtcaaagggtacaccaaggggggccccgggcacgaggaacccatccccatggcgacctacggatggaacctcgtgaagttgcactcggggaaggacgtgttcttcatcccacccgagaagtgcgacacacttttgtgtgacatcggcgagtcttcccccaacccgaccatcgaggagggacgcacgctgcgggtcctgaagatggtggaaccatggctacgtggtaaccagttctgcatcaagatcctgaacccctatatgcccagcgtggtagaaacgctggagcaaatgcagcggaaacacggcgggatgctggtacgcaatccgctttcccgaaattcgacgcacgagatgtactgggtttcatgcggcactgggaacattgtcagcgcggttaatatgacctcccggatgctgcttaaccggttcaccatggcgcatcgcaagcctacctacgaacgcgacgtggacctgggagccggcactcggcacgtagccgtggagcccgaggtggctaacttggacatcatcggacagcgcattgaaaatataaagcatgagcacaagtcaacctggcactacgacgaagataacccctataagacctgggcgtaccacggctcctacgaggtgaagcctagcgggtcggccagcagcatggtgaatggcgtagtgaagctcttgaccaagccgtgggacgttatacccatggtcacacagattgccatgaccgacacaacacccttcgggcaacaacgggtgtttaaagagaaggtagacacgcgcacgccgaaggccaaacgggggaccgcccagatcatggaggtgaccgcgaagtggttatggggcttcctctcaagaaataagcggccaaggatctgcactcgggaggagttcactcgcaaggttcgaagcaacgccgccatcggcgctgtgtttgtcgacgagaaccaatggaactccgctaaagaggccgtggaggacgagaggttctgggacctggtgcacagggagcgcgagctccataaacagggcaagtgcgcaacctgcgtctacaacatgatgggcaagcgggaaaagaagctcggggagttcgggaaggcgaagggaagccgggcgatctggtacatgtggttgggagcccggttcttggagttcgaggcccttggcttcatgaacgaggaccactggttttcccgcgagaacagcctgtccggcgtggagggggagggcttacacaaactcggttacattctgcgggacatatcgaagatcccgggcggcaacatgtatgccgacgacacggctggttgggatacgagaataaccgaggatgatttacagaacgaggcccgcattaccgacatcatggagccggagcacgcgttgctggctaagagtatcttcaaattgacttatcagaacaaggtggtacgggttcagcgccccgccaagaacggcacggtgatggacgtcatctctcgacgggatcagcgtgggtccggccaggtgggcacgtacggacttaacacattcaccaacatggaagcgcagctgatccgccagatggagagcgagggcatattcagcccaagcgagctggagacccccaacttagccgagcgggttctggactggctggaaaagtacggcgtcgagagactcaagcgtatggcgatatctggcgacgactgcgtggtgaaaccgattgacgaccgctttgccaccgccttgactgcactgaatgacatgggtaaagtcagaaaggatatcccccaatgggaaccaagcaaaggctggaacgactggcaacaggtcccattctgttcccaccacttccaccaacttataatgaaagacggacgagagatagtagttccctgtcgaaaccaagacgagctagtgggccgcgcccgtgttagccaaggagcggggtggagcctacgcgagactgcctgcctcggaaagtcctacgcccagatgtggcaactgatgtactttcaccggcgcgatctccggctcgcagcgaacgccatctgctctgctgtccccgtagactggatacccacctcacggaccacttggtcaatccatgcccatcaccagtggatgaccacagaggacatgctgtcagtttggaaccgcgtctggatcgaggagaacccatggatggaggacaagacccacatcagttcctggggcgacgtgccatatctcggcaaacgcgaggaccagtggtgcggctctctcatcggcttgaccgctagggcgacgtgggccaccaatatccaggtggccatcaaccaggtccggcggctgatcggcaatgagaactacctcgactatatgacgagcatgaaacggttcaaaaacgagagcgatcccgagggagccttgtggtga

SEQ ID NO: 24639 - RNA, 9879 nt, synthetic construct
  misc_feature 1..9879: note = derived and/or modified CDS sequence (opt11) from DENV-1__JQ045661__SS-prME
  source 1..9879: mol_type = other RNA
agcgtgacaatgctgctgatgttaatgcccaccgctctcgcttttcacctaaccactcggggaggggaaccccacatgatcgtgagcaaacaagagcggggcaaaagcctcctgttcaagacctctgccggggtcaacatgtgcaccctcatcgccatggacttaggcgagctgtgcgaggacacaatgacatacaaatgcccccggatcaccgagactgagcccgacgacgtggactgttggtgcaacgccactgacacctgggtgacatacgggacctgctctcaaacgggggagcatcgacgggacaaaagatcggtggccttagcaccccacgtgggcctgggcctggagactcgcaccgagacctggatgtcatcggagggcgcctggaaacaaatccaacgggtcgagacgtgggccctccgacatcccggcttcaccgtgatcgccctgttcctggcacacgcaatcggcaccagcatcacccaaaaggggatcatatttatcctcctgatgctggttacgccctccatggctatgcgatgtgtcggcataggcagcagagacttcgtggagggtctctccggcgccacgtgggtggatgtcgtactggagcacgggtcctgcgtgacgacaatggccaaggacaagcccacgctggacatcgagctcctgaaaaccgaagtcaccaaccctgcggtgctgcggaagctctgcattgaagcgaaaatctcaaacaccactacggatagcagatgtccgacccagggcgaggccacgctcgtggaggagcaggatgcgaacttcgtctgccggcggacgttcgtggatcggggatggggcaacggctgcgggctgttcgggaaaggtagtctcatcacgtgtgccaagttcaagtgtgtgaccaaactggagggcaaaatcgtccaatacgagaacctcaagtacagcgtgatcgtgactgtccatacgggggaccaacaccaggtgggtaacgagagtaccgagcacgggacaaccgcaacaatcactccccaagcgccgactactgagatccaactcaccgactacggggccctaaccctcgattgcagcccccgaaccggcctcgacttcaatgagatggtccttctgaccatgaaggagaaatcctggctcgtgcacaagcagtggttcctagacctgcccctcccatggaccagcggggcgagcacgagccaagagacctggaataggcaggacctgttagtgacgttcaagaccgcccacgctaagaagcaggaggtcgtggtgctcggctctcaggagggtgcgatgcataccgccttgacgggcgcgaccgagatccagacatctggcacgactaccatcttcgccgggcaccttaagtgcaggctgaagatggacaaattgaccttaaagggcatgagctacgtgatgtgcacagggagctttaagctcgagaaagaactggctgagacccagcacgggacagtgctggtgcagataaagtacgaaggcaccgacgcgccgtgcaaaattccgttcagtacacaggacgagaagggggtcacccagaacgggcggttgatcaccgccaacccaatcgtgaccgacaaggagaagcccgtgaacatcgaggccgaaccacccttcggggaatcctacatcgtaataggcgcgggtgaaaaggcgctcaagctgtcatggttcaagaagggctccagcatcggcaagatgttcgaggcgacggcgagaggggcccggcggatggccatcctgggcgacacggcgtgggacttcggatccatcggcggcgtcttcacctcagtggggaagctcgtccaccagatattcggtacggcgtatggggttctattcagcggggtgagctggacaatgaagatcgggatcggcgtgctgctcacctggctgggcctcaactcccgcagtacctcactcagcatgacatgcattgccgtggggttggtgacgctgtacctcggcgtcatggtgcaggccgactccgggtgcgtgatcaactggaaaggcagggagctcaagtgcgggtccggcatctttgtcaccaacgaggtgcatacatggaccgagcagtacaagttccaggccgacagcccaaagcgcctgtccgcggccataggcaaagcctgggaggaaggggtgtgcggcatccggagcgccacccgactcgagaacatcatgtggaaacagatctccaacgaactgaaccacattctgctcgagaacgacatgaagttcacagtggtcgtgggggacgtcgccggcatcctggcgcaagggaagaagatgatccgcccccaaccaatggagcataagtacagctggaagtcgtggggcaaggccaagattatcggcgctgacgtccagaacaccaccttcatcatagacgggccaaacaccccagagtgccccgacgaccaacgcgcgtggaatatctgggaagtggaggattatggtttcgggatattcacgaccaacatctggctcaagctccgggacagctacacacaagtctgcgaccaccgactgatgtctgcggccatcaaggacagcaaagccgtgcacgccgacatgggctactggatcgaatcggagaaaaacgaaacctggaagctggcgcgggcgagcttcatcgaggtgaaaacgtgcacctggcccaagtcgcacaccctctggagcaacggcgtcctcgagtccgagatgatcattcccaagatttatggcggcccgatctcgcagcataactacagacccgggtacttcactcagacggcagggccttggcatctagggaagttagagctggacttcgacttgtgcgagggcaccaccgtggtcgtcgacgagcactgtggcaaccgggggcccagtttacgcaccacgaccgtgacgggcaagatcatacacgagtggtgctgcagaagctgtacactgccgcccttgcgcttcagaggggaagacggctgctggtacggaatggagattcgcccagtgaaagagaaggaggagaacctcgtcaagtccatggtgtctgccggttccggcgaggtggactccttcagccttgggctgttatgcatctccatcatgatcgaggaagtaatgcggagccgctggtcccggaagatgctgatgacaggcacgctggccgtgttcttcctcctgatagtcgggcagctaacgtggaacgatcttatccgtctttgcatcatgattggcgccaacgcgtcagatcgcatggggatgggaaccacttacctggccctcatggccacctttaagatgcgtccgatgttcgccgtcggcctgttattccgccggctcacctcccgcgaggtgctgctgttaaccattgggctgagcttggtggcctccgtggagctccctaacagcttggaggagctgggtgacgggctagcgatgggcatcatgatcctgaagttgctcacggacttccaatcccatcaactgtgggccaccctactttcgcttaccttcattaagaccactttctcgctgcactatgcctggaagactatggccatggtactctcagtcgtgtccctattcccgctttgtctcagcaccacttcccagaagacgacctggctgcctgtgttgctcggttccctgggttgcaagccgctgaccatgtttttgatcgcagagaataagatatggggccggcgatcgtggcccctgaacgaagggatcatggccgtcggcatagtgagcatcctcttaagctccctgctcaagaacgatgtgcccctcgccgggcccctgatcgccggcggcatgctgatcgcttgctatgttatctcagggtcctccgccgacctaagcctggagaaagctgccgaagttagctgggaggaggaggccgagcattccggcgccagccataatatcttagtggaggtccaggacgacggaacgatgaagatcaaggacgaggagcgtgacgacaccctgacgatcctactgaaagcaactcttctggccgtgagtggcgtgtacccgctaagcatccccgcaaccctcttcgtctggtacttctggcagaagaagaaacagcgctctggggtgctgtgggacacccccagcccgcccgaggtggaacgggccgtccttgacgatgggatctaccgcatcatgcaacggggcctgctcgggcgctcccaggtgggcgtgggggtcttccaggagaacgtgttccacactatgtggcatgtaacccggggcgccgtcctgatgtaccaggggaaacgtctggagccctcgtgggcgagcgtgaagaaggacctcatcagctacggcggcgggtggcggctgcagggctcctggaacaccggagaagaggttcaggtcatcgccgtggagcccgggaagaaccccaagaacgtgcagactgcgcccggcacgtttaagacacccgagggcgaggtcggcgccatagccctggacttcaagccagggacctcaggctcccccattgtgaacagggagggcaagatcgtaggcctctacggtaacggggtcgtaaccacgagcggcacctacgtgagcgcgatcgcccaagccaaggcgtcccaggagggaccgctgcccgagatcgaggatgaggtcttccggaagcgcaatctaaccatcatggacctccacccgggctcaggaaagactcggcgctacctgccggcgatcgtgcgggaggccataaaacgcaagctgaggaccctcatactggctcccacccgggtcgtcgcctcagagatggccgaggcactgaagggcatgccgatccgctaccagaccaccgccgtcaaaagcgagcacacgggcaaggagatagttgacctcatgtgccatgccaccttcaccatgcggctgctgtcccccgtccgcgtgccgaactacaacatgatcataatggacgaggcccactttaccgaccccagctccatcgcagcgagggggtacatcagtacaagagtgggcatgggggaagccgccgcaatcttcatgactgctacgccgcccggctccgtcgaggcgttcccgcagtccaacgcggtgatccaggatgaggagcgggacatcccggaacgctcctggaactctggttacgagtggattacagacttccccggcaaaacggtgtggtttgttccgtccattaagagcgggaatgacatcgccaactgcttgcggaagaacgggaagcgcgtgatccagctgtcccggaagaccttcgacaccgagtatcagaagaccaaaaacaacgattgggactatgttgtcacgaccgacatcagcgagatgggcgccaatttccgggcggaccgggtgatagatccccgccgctgcctgaagcccgtaatcctgaaggatgggcccgagcgcgtcatcctggccggccccatgcctgtgaccgtcgcctctgctgcccagcggcgcggtcgcatcggccgcaaccacaacaaagagggcgaccaatacatctacatgggacaaccgctgaacaacgatgaggaccatgcccactggactgaggccaagatgcttctggacaacatcaacacgccagagggcattatccccgccctgttcgagccggagcgtgagaaatccgccgccatcgacggggagtacaggctccgaggcgaggcgcgtaagaccttcgtggagctaatgcgcagaggagatctccccgtgtggctctcctataaggttgcctcagagggcttccagtattcagaccgccggtggtgcttcgacggcgagcgcaataatcaggtgctggaagaaaacatggatgtggagatctggacaaaggagggggagcggaagaagctgcgcccccggtggctcgacgcccgcacatactccgaccccctggcactgcgggagttcaaggagttcgctgctgggcgtcggagcgtctcgggggacctcatcctggagataggcaagctaccgcagcatctcacgcagcgcgcccagaacgccctggacaacctggtgatgctccacaattcggagcagggtgggcgggcttaccgccatgcgatggaggaactgcctgacactattgagacgcttatgctcctagccctgatcgcagttctcaccggcggtgttaccttattcttcctgtcgggcagagggctgggcaagacgagcatagggctgctgtgcgtgatggcttcaagtgtactcctgtggatggcgtcggttgagccccactggattgcggcgagtatcatcctggaatttttcctcatggtgctgctgatccccgaacccgaccgccagcgcacgccacaagacaaccagctcgcctacgttgtcatcgggctgctgttcatgatcttgacggtcgcagccaacgagatgggtctgcttgagaccacgaagaaggacttagggatcggccatgtggcggttgaaaaccatcaccacgccgcgatgctggacgtagacctacaccccgcctccgcctggacactatacgcagtcgcaaccaccatcatcactccgatgatgcgtcataccatcgagaacaccacggccaacatcagcctgacggccatcgcaaaccaggcggccatcctgatggggctggacaagggctggcccatctccaagatggatattggcgtcccgctgctggcacttgggtgctactcccaggtgaatcccttgaccctgaccgccgcggtgctgatgctagtcgctcattacgccatcatcgggccgggactgcaagctaaggccactcgggaggcgcagaagcggacggccgccggcatcatgaagaacccaaccgtggatggtatcgtggcgattgacctcgacccagtcgtgtacgacgccaagttcgagaagcagttaggccagattatgctgcttatcctgtgcacgtcccagatcctgctcatgagaaccacgtgggcgctgtgtgagagcatcaccctggccaccggccccctcacgacgctatgggaggggtccccgggcaagttctggaacactaccatcgccgtaagcatggccaacatcttccggggtagctatctggccggcgccggcctcgcatttagcctcatgaagtccctcgggggcgggagacgggggaccggggcacagggcgagaccctcggagagaagtggaagcgccagctgaaccagctgtccaaaagtgagttcaacacctacaagcgtagtgggataatggaggtcgaccggagcgaggctaaggagggccttaagcgcggggagactaccaaatacgcggtatctcgtggcacggccaagttgcgttggttcgtggaaagaaacctggtcaagcccgaggggaaggtgatcgacctgggctgcggccgcgggggctggagctattattgcgccgggctcaagaaagtgacagaggtcaagggctataccaagggcggccccggccacgaggagcccataccgatggccacttacggctggaatttggtgaagctgcactccggcaaggacgtattcttcatcccgcccgaaaagtgcgacacgctcttgtgcgacatcggggagagttctcccaacccgaccatcgaagagggccgcaccctgagggttctcaagatggtggaaccctggttacggggcaatcagttctgcattaagatcctgaacccctatatgcccagcgtggtggaaaccctcgagcaaatgcagagaaagcacggtggcatgcttgtgagaaacccgttatcccggaacagcacccacgagatgtattgggtgagttgcgggacgggcaacatcgtcagcgcagtgaatatgactagcaggatgcttttaaacagattcacgatggcgcatcggaaacccacctacgagcgcgacgtggatctgggggctggcactcggcatgtcgccgtggagcctgaggtagccaacctcgacatcatcggccagaggatcgagaacatcaagcacgagcacaagagcacctggcactacgacgaggacaacccctacaagacctgggcctaccacgggtcctacgaggtcaagccgtcgggctccgctagcagcatggtcaatggggtcgtgaaactcttaaccaagccctgggacgtgatccccatggtcacgcagatcgccatgaccgataccactccgttcggccagcagagggtgtttaaagaaaaggttgatacccgcaccccgaaagccaagagagggaccgcccagattatggaagtcaccgccaagtggctctggggctttctgtcacgcaacaagaagccccggatctgcacgcgagaggagtttacccggaaggtgcgcagcaacgcggctatcggcgccgtgtttgtcgacgagaaccagtggaactccgccaaggaggcagtggaggacgaaaggttctgggacctggtgcatcgcgagcgggagctccataagcaggggaagtgcgcgacctgcgtctacaacatgatgggcaaacgagagaagaaactgggggagttcgggaaggccaaaggcagccgggccatctggtacatgtggctgggcgcgcgcttcctcgagttcgaggcgctcggcttcatgaacgaggaccattggttctcccgcgagaacagcctgtccggggttgagggggagggactccacaagttaggctatatcctgcgcgacattagcaaaatcccagggggcaacatgtacgccgacgacaccgccggctgggacacgcgcatcactgaggacgacttgcagaacgaggcccgcatcaccgacattatggagccagagcacgccctgctcgcgaagtccatcttcaaactcacctaccagaataaagtggtgcgggtgcagcgccccgccaagaacgggacggtgatggacgttatctcgcgccgggaccaacgcggcagcggccaagtggggacctatggcctgaacaccttcaccaacatggaggcccaattaatccggcagatggaaagcgaaggaatcttcagcccctctgagctcgaaacacccaacttggccgaacgcgtgctggactggctcgagaaatacggcgtcgagcggctgaagcggatggccatctccggggacgactgcgtggttaagccgatagacgatcgattcgcgacagcgctgacagccctgaatgacatgggcaaggtccgcaaggacatcccccagtgggagcccagcaaaggatggaacgattggcagcaggtccccttttgttcccaccacttccaccagctgattatgaaggacggccgggagattgtggtcccgtgtaggaaccaggacgagttggtgggccgggcccgcgtgagccaaggggcgggctggtcccttcgggaaaccgcgtgcctcgggaagagttacgcccaaatgtggcagttaatgtacttccaccgccgggacctccgcctggctgccaacgcaatctgctctgcagtccccgtcgactggatcccaacatctcggaccacctggagcatccatgcccatcaccagtggatgacaacggaggacatgctgtccgtttggaaccgcgtctggatagaggaaaacccctggatggaggacaagactcacatctcgtcctggggagacgtgccatacctcgggaagcgcgaagatcagtggtgcgggtctctcatcgggctgaccgcccgggccacctgggcgactaatatccaggttgctatcaatcaggtacgccggctcatcgggaacgaaaactacctggactacatgacgagcatgaaacgcttcaagaatgagagcgaccccgagggcgcactgtggtga

SEQ ID NO: 24640 - RNA, 9879 nt, synthetic construct
  misc_feature 1..9879: note = derived and/or modified CDS sequence (opt11) from DENV-1__JQ045663__SS-prME
  source 1..9879: mol_type = other RNA
agcgtgaccatgttgttaatgttgatgcccaccgccctggccttccacctcaccacccgcggcggcgaaccccatatgatcgtcagcaagcaggaacggggcaagagcctcttgtttaagaccagcgccggggtgaacatgtgcaccctaatcgccatggacctgggcgagctctgcgaggataccatgacctacaagtgcccccgaatcaccgagaccgaacccgacgacgtagattgctggtgtaacgccacggatacttgggtcacatacgggacgtgctcccagacgggcgagcaccgccgggataaacgttccgtggccctggcgccccacgtaggcctggggctggagacccgcaccgaaacctggatgagctccgagggcgcctggaagcaaattcaacgggtagaaacctgggccctccggcacccggggttcacggtgatcgcactgttcctggcacacgcgatcggcaccagcatcacacaaaaagggatcatatttatcctcctcatgctggtaacgcccagtatggcaatgcggtgcgtaggaattggcagccgcgatttcgtggaggggttgtctggcgccacctgggtcgacgtcgttttggagcacgggtcgtgcgtgaccaccatggcgaaggataagcccacgctagacatcgaattgctgaagactgaggtgaccaaccccgccgttctccgtaagctctgtatcgaggccaagatctccaacaccacgaccgacagccgctgcccgacccagggagaggccaccctcgtggaagagcaggacgccaacttcgtctgcaggagaaccttcgttgaccgaggttgggggaacggctgcggcctgttcggcaagggttcactaattacctgcgcaaagttcaagtgcgtgaccaagcttgagggcaagatcgtccagtacgagaacctgaagtacagtgtaatcgtgactgtccacactggcgaccagcatcaggtcgggaacgagtccaccgagcacgggactacagccaccatcaccccccaagcgcctaccaccgagattcagctcaccgactatggagccttaacgctggattgcagcccccgcaccgggctcgacttcaacgagatggtcctgctaaccatgaaggaaaagtcctggctcgtacacaagcagtggtttctagacctgcctctcccctggacgagcggtgcgagcacgtcacaggaaacgtggaaccggcaggacctgcttgtgacgttcaaaaccgctcacgccaagaagcaggaggtcgtggtcctcggcagccaggagggcgcgatgcacacggccctgaccggggccactgaaatccagacatccggtacaaccaccatctttgcagggcatctgaaatgtcgcctgaagatggacaagctgactctgaaagggatgagctacgtcatgtgcacgggaagctttaaactcgagaaagaactggccgaaacccagcacggcacagtgctggtccaaataaagtacgagggtaccgacgctccctgcaagattcccttctcgactcaggatgagaagggggtgacccaaaacgggcggcttataaccgccaatccgattgttacagacaaggagaagcccgtgaacatcgaggccgagcctccctttggggagagttacatcgttatcggcgccggcgagaaagcgctcaagcttagctggttcaagaaggggtcgagcattggtaagatgttcgaggccacggcccgcggagccaggcgcatggccatactgggcgacaccgcgtgggactttgggtccattggcggagtgttcacttcggtggggaagctcgtccatcagatcttcggcacagcctacggggtgttattcagcggcgtgagttggacgatgaagattgggatcggcgttctgctgacgtggctggggctgaattcccgtagtacgtccctctccatgacctgcatcgccgtggggttggtgacgctgtacctcggagttatggtgcaggccgattccgggtgcgtgatcaattggaagggccgggagttaaagtgtgggagcggcatcttcgtcaccaacgaagtccacacttggaccgagcagtacaagttccaagccgactccccgaaacggctgtccgcggccatcggcaaggcctgggaggagggagtgtgtggaatccggagcgccacccgactcgagaacataatgtggaagcagatctccaacgaactgaaccacatcctgctcgagaacgacatgaagctcacggtcgttgtcggggacgttgccggcatcctggcgcaaggtaagaagatgatccggccccagccaatggagtacaagtatagctggaagtcctggggcaaagctaagatcataggggccgacgtccagaataccactttcatcattgacggccccagcacccctgagtgccccgatgaccagcgcgcttggaacatctgggaggtggaggactacggcttcgggatcttcacgactaatatatggcttaagctgcgggactcccacacccaggtctgcgatcaccgcctgatgtcagcggccatcaaggacagcaaggctgtgcatgcggacatgggctactggatcgagagtgagaagaacgaaacctggaagctcgcccgggcgtccttcatcgaggtgaagacgtgcatttggcccaagagccacacgctgtggagtaatggcgtcctggagagtgagatgattatcccaaagatctacggcggcccgatctcccaacataactaccggcccgggtactttacccaaacagccggcccatggcacctcgggaagctggagcttgacttcgacctctgtgaaggcacgaccgtggtcgtcgacgagcactgcggtaatcggggtccgagcctgcgcaccaccacggtcaccggcaagatcatccacgaatggtgctgtcggtcttgcaccctgccccccctccgattccgcggggaggacggttgctggtatggcatggagatccggcccgtgaaagaaaaggaggagaacctggtcaagagcatggtctccgcaggctctggcgaggtggatagcttctccctggggttactgtgcatcagcatcatgatcgaggaggtaatgcggtcccgctggtctcggaagatgcttatgactgggacgctcgccgttttttttcttcttatcatgggccaattaacctggaacgacctgatccgtctatgcatcatggtcggcgcaaatgcgtcggaccgcatgggaatgggcaccacatacctcgccctgatggccacattcaagatgcggcccatgttcgccgtcgggttactgttccgccggttgaccagtagagaggtgctgctcttaaccatcgggctgtcactcgttgccagcgtggagttgccaaactcgcttgaggagctcggcgacgggctggcgatgggcataatgatcttgaagctcctgacagattttcaaagccaccagctgtgggccacgttgctgtccttgaccttcatcaaaaccactttcagcctccactacgcctggaagacgatggcaatggtgttatccatcgtctcgctgttccctctttgcctttccaccaccagccagaagaccacgtggcttcccgtgctcctgggttccctggggtgcaagcctctcaccatgttcctgatcgcggagaacaagatttggggcaggcgcagctggccgctcaacgaggggatcatggccgtgggcatcgtcagcatcctcctgtccagcctcttgaagaatgacgtgccgctcgcgggtcccctgatcgccggaggaatgctcatcgcctgctatgtgataagcgggtcctccgcggacctgtccctggagaaggccgcggaggtttcctgggaggaggaggccgagcacagcggcgcgtcccacaacatacttgtggaagtgcaggacgacggaacgatgaaaatcaaggacgaggaacgggacgacaccctaaccatcctgctcaaggcgacgctgctggccgtcagcggcgtatatccgctctccatccccgctaccctgttcgtgtggtatttctggcagaagaagaagcagcgcagcggggtactatgggacaccccatctccgcccgaagtggagcgggccgtactggacgacggcatctatcgcattatgcagagaggattgctgggccgctctcaggtgggcgtgggggtgttccaagagaacgtctttcacaccatgtggcacgttacgcgcggggccgtgctgatgtaccaggggaagagattagaacccagctgggcgtccgtcaagaaggacctgatctcgtacggcggcgggtggcggctgcagggcagctggaataccggcgaggaggtccaggtcatcgccgtcgagcccggcaagaattctaaaaacgtgcagaccgcccccgggaccttcaagacgccagaaggcgaggtcggcgcaatcgcactcgacttcaagcccggtaccagtggcagccccatcgtcaatcgcgaagggaagatagtcggactatatgggaacggggttgtcaccaccagtggcacttacgttagcgcgatcgcccaagctaaggcctcgcaggagggacccttaccggagatcgaagacgaagtattccggaagcgcaacttaacgataatggacctgcaccccgggtcggggaaaacacggagatacctgcccgcgatcgtgagggaggctatcaagcgcaagctccgcaccctgatactggccccgacgagggtggtcgcttccgagatggctgaggctctcaagggcatgcccatacgttaccagaccaccgccgttaagtccgaacacactggcaaagaaattgtagacctgatgtgtcacgcgacgttcaccatgcggttgctctcacccgtgcgcgtacccaactacaacatgattatcatggacgaggctcacttcaccgacccgagcagtatcgctgcccggggctacatctcgacccgcgtgggcatgggggaggctgcggccatattcatgacggctacgcctcccggcagtgtggaggctttcccccagtccaacgccgtcatccaggacgaggaacgggacatccccgagcgctcttggaacagcggatacgagtggatcaccgacttccccggcaagaccgtatggttcgtgccctccatcaagagcggtaacgacatagccaactgtctgcgcaagaacggaaagcgcgtcatccagctctcccggaagactttcgataccgaataccaaaagaccaagaacaacgactgggattacgtagtcaccacggacatcagcgagatgggcgctaactttcgcgcagaccgggtgatcgacccccgccgatgcctcaaacctgtgattttgaaggacgggcctgagcgcgtgatactggccggcccaatgccagtcaccgtcgcctccgcggcccagcggagagggcggatcgggagaaaccataataaggagggcgaccagtacatctacatggggcagccgttaaataacgacgaggaccacgcacactggaccgaggcgaagatgctgctggacaacattaacacccctgagggtatcatccccgccctctttgagcctgaacgcgagaagtccgccgcgatcgacggggagtaccggttgcgcggcgaggcgcggaagacgttcgtagagttgatgagaaggggcgatttaccggtttggctgagctacaaggtcgcctccgagggtttccagtacagcgaccgccggtggtgcttcgacggcgagcgcaacaaccaagttctagaggagaacatggacgtggagatctggaccaaggaaggggagcggaaaaagctcaggccccggtggctggatgcccgcacctactcagaccccctggccctccgcgagtttaaagagttcgccgcgggtcgccgatcagtgtccggggacctcatcttagaaatcggcaagctcccccaacacctgacccagcgcgcccagaatgctctggacaacctagtgatgttgcataacagcgaacagggagggcgggcctatcgccacgcgatggaggagcttccggacacgatcgagacgttgatgctgctggccctcattgcagtgctgaccggcggggtgaccctgttccttttatccggccggggactggggaagaccagcattggccttctgtgcgtcatggcttccagcgtacttctctggatggcgagcgtggagccacactggatcgccgccagtataattctggagttctttctgatggtgctcctgattcccgagccggacagacagaggacgccgcaggataaccagctggcctatgtcgtgatcgggctcctgttcatgattctgaccgttgctgccaacgagatgggcctcctggagaccaccaaaaaggacctagggatcggccacgttgcggtggagaatcaccaccacgccgccatgctcgacgtcgacctgcacccggcctccgcttggacgctgtatgctgtggccacgacaatcatcacccccatgatgcgccatacgatagagaataccaccgccaacatcagccttaccgccatcgccaaccaggctgccatacttatggggctggacaagggatggcctatctccaagatggatattggcgtgcccctgttagccctggggtgctactcgcaggtcaaccccctcacgttaacagccgcagtactgatgttagtagcccactacgccatcatcggccccgggctgcaggccaaagccacccgggaggcgcagaagaggacagccgccggcatcatgaagaatccgacggtcgacggtatcgtggccatcgatctcgaccccgtggtgtacgacgccaagtttgaaaaacagctcggccaaatcatgctgctgatactctgcacctcccaaatcctgctgatgcgcacaacctgggcgctttgcgagagtatcacgctggccaccggccccttgaccaccctctgggaggggtcccccggcaagttctggaacacgaccatcgccgttagcatggcgaacatctttagggggtcctacctcgccggcgcgggcctggccttctccctcatgaagtccctcggtgggggacgacgggggaccggggcccagggtgaaaccttgggagaaaagtggaaacgccagctcaaccagctgtccaaatctgagttcaacacgtacaaacggagtgggatcatggaggtcgaccgcagcgaagccaaggaagggctgaagcgcggggagaccaccaagcacgcggtctcccgcggcacagccaagttaaggtggttcgtggagcgtaacctcgtcaagccggaggggaaggtgatcgatctgggctgcggccgcgggggctggtcctactactgcgctgggctaaagaaggtgaccgaggtgaagggctacactaagggcggccccggccacgaggaacccatcccgatggccacctacgggtggaaccttgtcaagctgcactccggcaaggacgtattcttcatccctccggagaagtgcgacaccttgctctgcgatataggggagagctcccccaaccccacgatcgaggagggtaggacgctgcgggtgctgaagatggtcgagccgtggcttcgcgggaatcagttctgcataaagatcctgaacccctacatgcccagtgtggtagaaaccctggagcagatgcaacgaaaacacggcggcatgcttgtccgaaaccccctgtcacggaactcaacccacgaaatgtactgggtgagctgcgggactggcaatatagtatctgcggtcaacatgacctcccgaatgctgctcaaccggtttactatggcccaccggaaaccgacctacgaacgagatgtggacctcggagccggcacccggcatgtggccgtcgaacccgaggttgccaacctagacatcatcggccagcgcatcgaaaacatcaagcacgagcacaaaagcacatggcattacgacgaggacaacccgtataagacctgggcctaccatgggtcctacgaagtgaaacccagcggcagcgcgtcctccatggtcaacggggtggtaaaactcttaaccaaaccgtgggatgtgatccccatggtcacccagatcgctatgacggacacgacccctttcggacaacagcgggtatttaaggagaaggtggacacccgcacgcccaaggccaagcggggtactgcccagattatggaggtgacagccaagtggctctggggcttcctcagtcgaaataagaagccgcgcatctgcaccagagaggagttcacccggaaggtccgcagcaacgcggctatcggcgccgtcttcgtggacgagaatcagtggaactctgccaaagaagccgtcgaggacgagagattttgggacctggtgcaccgcgagcgagagctgcataagcagggtaagtgcgcgacctgcgtgtacaacatgatgggcaagcgagagaagaagctcggtgagttcgggaaggccaaggggtctcgggccatctggtacatgtggctaggcgcccgcttcttggagttcgaggcgctcggcttcatgaacgaggaccattggttctccagggagaacagcctgtccggggtcgagggcgagggattacacaagctcggctacattctgcgcgacatttccaaaatcccgggtggcaacatgtacgccgacgacaccgccggctgggatacacgcatcacggaggacgatttgcaaaacgaggccaggatcaccgacatcatggagcccgagcacgcactcttagcgaagtcaatcttcaaactgacctatcagaacaaagtggtccgcgtccagcggccggctaagaacggtaccgtgatggacgtgatcagtcgccgggatcagcgcgggtccgggcaggtaggcacatacggcctaaacaccttcaccaacatggaagcacagctaatccggcagatggagagcgaggggatcttctccccctctgagctggaaacgccgaaccttgcagagcgagtgctcgactggttggaaaaatacggcgtggaacggctcaagcgcatggccatcagtggggacgattgcgtcgtgaagccaatcgacgaccgattcgcgacggccctgaccgccttaaacgacatgggcaaggtgcgcaaggacatccctcaatgggaaccatcgaaaggatggaacgactggcagcaggtacccttctgctcgcaccacttccaccaactcattatgaaagacggccgggagatagttgtcccctgccgcaatcaggacgaactggtcggtcgggcaagagtgtcgcagggggctggctggagtttgcgggagacagcctgcttggggaagtcctatgcccaaatgtggcagctgatgtatttccatcgccgcgatctgcgcctcgctgccaatgcgatttgcagcgcggtgccagtggactggattccaacctcccggacaacctggagcatccacgcccatcatcaatggatgacaaccgaggacatgctgtcagtgtggaaccgcgtgtggattgaggagaacccttggatggaggacaagacgcacattagctcctggggcgacgtcccctacttagggaaacgcgaagaccagtggtgtgggagcttaatcggcctcaccgctcgggccacgtgggcgaccaacatacaggttgccatcaaccaggtgcggcggttgatcgggaatgagaactacttagactatatgacgtcaatgaaacgcttcaagaacgaatccgatcccgagggcgccttatggtag

SEQ ID NO: 24641 - RNA, 9879 nt, synthetic construct
  misc_feature 1..9879: note = derived and/or modified CDS sequence (opt11) from DENV-1__JQ045665__SS-prME
  source 1..9879: mol_type = other RNA
agcgtgaccatgctgctgatgctgatgcccacggccctggccttccaccttaccgcgcgcggcggggagccacacatgattgtgagcaaacaggagcgtgggaagtccctgctctttaagacatccgccggggtgaacatgtgtacgttaatcgccatggacctgggcgagctgtgcgaggatactatgacctataaatgtccgcggatcacggaaaccgagcccgacgacgtcgactgttggtgcaacgccaccgacacctgggtgacttacgggacgtgctcccagacgggggagcaccggcgggacaagcggtccgtcgccctcgcgccccacgttggtctgggcctggaaacgcgcaccgaaacgtggatgagctccgaaggtgcttggaaacaaattcaacgggttgagacatgggccctccgtcatcccgggttcactgtaatcgccttatttttggcgcatgccatcggcaccagcatcacgcagaaagggattatctttatactcctgatgttagttaccccttccatggccatgcggtgcgtcggcatcggcagccgcgacttcgtagagggactctcaggcgccacgtgggtcgacgtcgtgctggaacacgggagctgcgtaaccactatggccaaagataaaccgaccctggatatcgaactcctgaagacagaggtcacaaacccagctgtactccggaaactctgtatcgaggcgaagatctcaaatactactacggatagtcggtgtccgacccagggcgaggcgactctggtggaggagcaggacgcaaacttcgtctgtcggcgcaccttcgtggaccggggctgggggaacggctgcgggttattcggaaaaggttccctcatcacgtgtgccaagttcaagtgcgtcaccaaactggaaggcaaaatcgtacagtacgagaacctgaagtactccgtgatcgtgaccgtccacaccggagaccagcaccaggttgggaacgagagcactgaacacggcaccactgctactatcacaccccaggccccgactacagagattcagctcaccgactacggggccctcaccctggactgctcgcccaggacgggattagattttaacgagatggtcctcctgaccatgaaggagaagtcatggctcgtccacaagcagtggttcttggacctgcctctcccgtggacctccggggccagcacatcccaggagacctggaatcggcaggacctgctggtgacatttaagaccgcccacgcgaaaaagcaggaggttgttgtgttaggtagccaggaaggcgccatgcatacggctctgacgggcgccacagaaattcaaacctcgggtaccaccactatcttcgctggtcacctgaagtgccgcctcaagatggacaagttgaccctgaaaggcatgagctacgttatgtgtaccgggagttttaagctcgagaaggagctagcagaaacgcagcacggcaccgtgttggttcagatcaagtacgaggggactgacgccccgtgcaagatcccattcagcacacaggatgagaagggggccacgcaaaacggccggctgattaccgccaacccgattgtcaccgataaggagaagcccgtgaacatcgaagccgagccgcctttcggggaaagctacatcgtgatcggggcgggagagaaagccctcaagttatcctggtttaagaagggctccagcatcggcaagatgttcgaggccaccgcccgcggcgcgcggcgaatggccatcttaggcgacacggcctgggattttggctccatcgggggagtcttcacctcagtgggcaagctggtacaccagatcttcggcaccgcctatggggtcctgttctccggtgtgtcctggaccatgaagatcggcatcggcgtcctgctcacatggctgggcctgaactcccgcagcaccagcctcagcatgacgtgcatcgccgtcgggctggtgaccctgtacctcggggtgatggtccaggcagattcagggtgcgtgatcaattggaagggccgggagctgaaatgcgggagcgggatcttcgtgacgaatgaagtgcacacctggaccgagcagtataagttccaggctgactccccgaagcgcctgtccgccgccatcggcaaggcatgggaggagggtgtgtgtggaatacggagcgcgacccgccttgagaatatcatgtggaaacagatcagtaacgaactcaatcacattttgttagagaacgacatgaaatttactgtggtcgtaggggacgtggccggcatcctggcccaaggcaagaaaatgatacgtccccagccaatggaatacaaatacagctggaaatcctggggtaaggccaaaatcataggcgcggatgtccagaacacgaccttcatcatagatgggccgaacacccctgaatgtcctgacgatcagcgtgcgtggaacatctgggaggtagaggactacgggttcgggatcttcactacgaacatctggctaaagctgcgggactcttacacccaggtgtgtgaccatcgcctgatgtcggctgccatcaaggacagcaaggccgtgcatgcggacatggggtattggattgagtccgagaagaatgagacctggaaactggcccgggccagcttcatcgaggtgaagacctgtatctggccgaaatcccatacgctctggtcaaatggcgtactggagtccgagatgatcatcccgaagatttacggtggcccgataagccagcataactatcgacccgggtacttcactcagaccgctggaccctggcacttagggaagttagagttagattttgatctatgtgaaggcacgacggtcgtggtgaatgagcactgtggtaacagagggccatccctgagaaccaccaccgtcacgggcaaaatcatacacgagtggtgctgccggagctgtaccctgccacccttacggttccgaggggaggacggctgctggtatgggatggagatccgacccgtgaaggagaaggaagagaacctggtgaagtccatggtctccgcgggctcaggtgaggtagactctttttccctgggactcctgtgtatatccataatgatcgaagaggtcatgcggtcccgcctgtcccggaagatgttgatgacaggcaccctggcggtcttcttcctgctgataatggggcagttgacatggaacgacttgatccgcctgtgcatcatggtgggcgccaacgcaagtgacaggatggggatgggcaccacctacctcgcactgatggccactttcaaaatgaggccgatgttcgctgtgggactgcttttccgccggctgacgtcacgcgaagtccttttactgacaattgggctgagcctcgtggcatccgtggaactgcccaacagcctcgaagagctcggcgacgggctggccatgggcattatgatcctgaaactcctcaccgatttccagtcccaccaactgtgggccaccttgctgagcctgacgttcatcaagaccaccttcagtctccaccacgcgtggaagactatggccatgatcctgagcattgtttctctctttcctctctgcctgagcacgacctctcagaagacgacgtggctgcccgtgttactgggcagtttggggtgcaagcctctcacgatgttcctaatcgccgagaacaagatctggggtcggcgctcctggccccttaacgagggaattatggccgtaggtatagtgagcatcctcctctcgtccctcctcaaaaacgacgttcccctggcagggcccttaatcgcgggcgggatgctcatcgcgtgctacgtcatttctggatcctctgccgacctgtccctggagaaggccgcagaggtgagctgggaggaggaggcggaacactccggcgcctcccacaatatactcgtcgaggttcaggacgacggtaccatgaaaataaaagacgaggagcgggatgacaccctgacgattttgctcaaggctacccttctggccgtgtcaggcgtctacccgctaagcatccccgccacacttttcgtctggtatttttggcagaagaaaaagcagcgttctggagtgctatgggatacccccagcccgcccgaggtcgagcgtgccgtcttagacgacggaatctaccgcataatgcagcgtggactcctcgggagaagtcaggtgggcgtgggggtttttcaggagaacgttttccacactatgtggcacgtaacccgaggcgcggtcctgatgtaccaggggaagcggctcgaaccttcgtgggcatccgttaaaaaggacctcatcagctacggaggtgggtggcggctacaaggctcatggaacacgggcgaggaagtgcaggtcatcgcggtggagcccggaaagaaccccaagaacgtacagaccgccccgggaacattcaagacccccgagggtgaggtcggcgcaatcgccctcgacttcaagccggggacgtcaggttcgcccatagtgaaccgagaggggaagatagtaggactgtacggaaatggggtcgtgacaaccagcgggacctatgtctctgcaatagcccaggcgaaggcctcccaggaggggcctctgccagagattgaggacgaggtcttccgtaagaggaacctcacgataatggatctacacccgggaagcgggaagacacggcgctacctccccgcaatcgtgcgcgaagccataaagcgcaagctcaggacactgatcctagccccgacccgcgtagtggctagtgaaatggctgaggcactcaagggcatgcccatcaggtaccagacgaccgccgtaaagtctgagcacactggcaaggagatcgttgacctgatgtgccatgccaccttcaccatgaggctgctgtcgcccgtccgagtgcccaactacaacatgatcatcatggacgaggcacacttcaccgaccccagctccattgcggccagaggctacattagcacacgcgtggggatgggggaggccgccgctatcttcatgaccgctactccgcccggctccgtcgaagcctttccccaaagcaatgcggtgatccaggacgaagagcgggacatccccgagcgcagctggaatagcggatatgagtggatcaccgactttccgggaaagaccgtttggttcgtcccctccattaagtccggcaacgacattgcaaactgcctgcggaagaatggcaagagggtaatccaactgtcccggaagacgttcgacaccgagtaccaaaagaccaaaaacaacgattgggactacgtggtcaccaccgacatttcggagatgggtgcgaacttccgcgcagaccgggtcatcgacccgcgccggtgcctcaagcctgtgatacttaaggacggacccgagcgcgtaatcctggccggccccatgcccgtgacggtggcctccgcggcgcagagacgagggcgtatcggtcgcaaccataacaaggagggcgaccaatacatatacatgggtcagcccctgaacaacgacgaagaccacgcccactggaccgaggccaagatgctgctggacaacataaacaccccggaggggatcatccccgccctcttcgagccggaacgcgaaaagtccgcggcgatcgatggggagtaccggttacgcggagaggcacggaaatccttcgtcgagctgatgcgccgcggcgacctcccagtttggctaagctacaaggttgcctccgaaggtttccagtactccgaccgccggtggtgcttcgacggtgagcgcaataaccaagtacttgaggagaacatggacgtggagatctggacaaaagagggcgagcggaagaagctccgcccacgatggttagacgcacgaacgtacagcgaccccctggcgctgcgggaattcaaggagtttgccgctggcagacgttccgtgagcggggacctgatactggagatcggcaaattgccgcagcatctgacccagcgcgcccagaacgctctggataacttagttatgctccacaactctgaacagggtgggcgggcctaccgccatgcgatggaggagctacccgacaccattgaaactttgatgctgctggcgctcatcgccgtgctgacgggcggggtcacacttttcttcttaagcggacgggggctgggtaagacgtccatcggactgttatgcgtgatggcgtctagcgtgttgctgtggatggcgagcgtcgagccccactggatcgctgcttccatcatcctcgagttcttcctcatggtgcttttgatcccagagccggatcgccaacgaacgccccaggacaatcagctggcttacgtggtcatcggtctcctgtttatgattctgaccgttgcggcgaacgaaatgggcttactcgagacgactaagaaggacctggggatcggtcacgttgcggtggaaaaccaccaccatgccgccatgctggacgtggacttgcatccggccagcgcctggacgctgtacgcggtggccaccacgatcatcacgccgatgatgcgccacacaatagagaataccacggccaacatctccttgaccgccattgctaatcaggccgctattctcatggggctagacaaggggtggcccattagtaaaatggatatcggcgtacccttactcgcgctggggtgctactcgcaggtgaaccccctgaccctaactgccgccgtgctgatgctggtcgcacactatgcgatcatcggacctggcctccaagcaaaggccacgagagaagcccaaaagcggaccgccgccggaatcatgaagaaccccaccgtggatgggatcgtggcgatcgatctggaccctgtagtgtacgacgcgaagttcgagaaacaactgggccagatcatgctcctgatcttgtgtaccagccaaatcctactgatgaggaccacctgggccctgtgcgagtccatcaccttggctacaggccccctgacgacgctttgggaggggagcccgggcaagttctggaacaccaccatcgccgtctccatggcgaacatctttcgtgggagctacttagccggcgccggcttggcgttttcgctgatgaagtccctcgggggcggtcgtaggggcacgggggcgcagggcgagaccctgggcgagaagtggaaacgccagctcaaccagctcagcaagtccgagttcaacacgtacaaacggagcggaataatggaggtagaccgcagtgaggccaaggagggcctgaagcgcggcgagaccactaaacacgcggtctcgcgtggcaccgccaaactgcggtggttcgtcgagcgcaacctggtcaaacccgaagggaaggtgatcgatcttggctgcggccggggcgggtggtcctactactgcgccgggttgaaaaaagttaccgaggtcaaagggtacaccaagggtgggccaggtcacgaggaacccataccgatggcgacgtacggttggaacctggtgaagcttcacagcggtaaggacgtgttcttcatccctcccgagaagtgtgacaccctgctgtgcgacatcggggaaagctcgccgaacccgaccatagaggaaggccgcacactccgcgttctgaagatggtggagccctggctgcgcggcaaccaattttgcataaaaatcctcaacccctacatgccctcggtggtagagacactggagcagatgcaaaggcgccacggggggatgcttgttcgcaacccgctatcacgcaactcgacccatgagatgtactgggtgagctgcgggaccggcaacatcgtctcggcagtgaatatgaccagccggatgttgttaaaccgtttcaccatggcccaccgcaagcccacgtacgagcgggatgtagaccttggcgccggtacacgccacgttgccgtagagcccgaagtggcgaacctggacatcatcggccagcggatcgagaacatcaagcacgagcacaagagcacctggcactacgatgaggataacccctacaagacctgggcctatcacgggtcttatgaagtaaagccgtctggcagcgccagctccatggtgaacggagtcgtgaaactgcttacgaagccatgggacgtcatacccatggtgactcagatcgccatgactgataccacgccgttcgggcagcaaagagtatttaaggagaaagtggacacccggaccccgaaggccaagcgggggaccgcacaaataatggaggtaacagcgaagtggttatggggcttcctgtcgcgaaataaaaagccccgcatttgcacacgagaggagtttacacggaaggtacggtccaacgccgcgatcggcgcggtgttcgtagacgagaaccagtggaacagcgcgaaggaggccgtggaggacgaaagattttgggacctcgtacaccgtgagcgcgagctgcacaagcagggaaaatgtgcgacctgtgtatacaatatgatgggcaagcgggagaagaagctgggggagttcggaaaagctaaggggtccagggctatctggtacatgtggctcggtgccagatttttggagttcgaagcccttggtttcatgaacgaggaccactggttcagccgcgagaactccctctctggggtggagggcgagggcttacataaattgggctacatattacgggacatatccaaaatccccgggggaaatatgtacgccgatgacacggctggctgggataccaggattactgaggacgacctgcaaaacgaagcgcgcatcactgacatcatggaacctgagcacgccttactcgcaaagagcatcttcaagctcacgtatcagaacaaggtcgtgcgggttcagcgccccgccaagaacggcactgtgatggacgtcatcagtcggcgcgaccagcggggcagtggccaggttgggacctatggcctcaacacgttcactaatatggaggctcagctaatccgccagatggagtccgaagggatattctccccatccgaattggagacgccaaacctggcagaacgggtcctcgattggcttgagaagtacggcgttgagcgactcaagcggatggcaatctcgggagacgactgcgtggttaagccgatcgacgatcgcttcgccaccgcactcacagccctgaacgacatgggcaaagtccgaaaggacattccccagtgggaaccctccaaggggtggaacgactggcagcaggtccccttctgcagccaccacttccaccagctaatcatgaaggacggtcgcgagatagtggttccgtgtcggaaccaagacgagctcgtgggacgcgcacgggtgagccagggggccggctggtcccttcgcgagaccgcatgtctgggcaaaagttacgcccaaatgtggcagctcatgtatttccaccggagggatctccggctcgcggccaatgcgatctgctcggccgtacccgtcgactggatacctacgacctgtaccacgtggtctatccacgcccaccatcagtggatgacgaccgaggacatgctcagcgtttggaaccgcgtctggatagaggagaacccctggatggaggacaagacacacatatcatcctggggggacgtgccgtacctgggcaaacgcgaggaccagtggtgcggcagcctcataggactcacggcgcgagccacctgggccaccaatatccaagtggccataaatcaggtacgtcggctcatcgggaacgagaactatttagactacatgacttccatgaagcgcttcaagaacgagagcgaccccgagggcgccctctggtag

SEQ ID NO: 24642 - RNA, 9879 nt, synthetic construct
  misc_feature 1..9879: note = derived and/or modified CDS sequence (opt11) from DENV-1__JQ045666__SS-prME
  source 1..9879: mol_type = other RNA
tcagttactatgttgctcatgctgatgcccacggcgctagccttccatctcaccgcccggggcggtgaaccccacatgattgtgtctaagcaggagcggggcaagagcctgttgttcaagacctccgccggggtgaacatgtgcaccctcatcgccatggacttaggcgagctatgcgaggacaccatgacctacaagtgcccccggatcaccgagaccgaacctgacgacgtggactgctggtgcaacgctaccgacacgtgggtgacctacggtacctgcagccagactggggagcaccggcgcgataagcggtctgtggccctagcaccccatgtcgggttggggctggagactcgaactgagacctggatgtcttccgagggcgcctggaagcagattcagcgggtcgagacctgggccctccgtcaccccgggttcacggtaatcgccctgtttctagcgcacgcgattggtacgagcatcacccagaaggggattatcttcatcctccttatgctggtgaccccctcgatggcgatgcggtgcgtcggcatcggctctcgtgacttcgtcgaagggctctcaggcgcaacgtgggtggacgttgtccttgagcacgggagctgcgtgaccaccatggccaaggacaagcccactctggacatcgagctcctgaaaactgaagtcaccaaccctgccgtcctaagaaagctctgcatcgaggccaaaatctcaaataccaccacagacagtcgttgtcctacccagggcgaggccactctcgtggaggaacaggatgccaatttcgtctgccgccgcacattcgtggaccggggttgggggaatgggtgcgggctattcgggaaggggtccctcatcacctgtgccaagtttaagtgcgtgaccaagctggaaggcaagatcgtccaatacgagaacctcaagtacagcgtgatcgtgaccgtccacaccggcgatcagcatcaggtggggaacgagtccacggagcacggcaccaccgcgaccatcacgccacaggcccccacgactgagatccagctgaccgactacggtgccctgacactggactgcagcccccgcacaggcctcgacttcaacgaaatggtcctgttgaccatgaaggagaagagttggctcgtccataagcagtggttcctggacctgcccctgccgtggaccagcggggccagcacctcccaggagacgtggaaccgtcaagacctgctcgtcacgttcaaaaccgcccatgcgaagaagcaggaggtagtggtgctcggctcccaggagggtgccatgcacaccgccctgacgggagccaccgagattcagacttccgggaccacgaccatcttcgccggccacctcaagtgccgcctcaagatggacaaactgacgctgaagggtatgagctacgttatgtgcacggggagcttcaagttggagaaagaactggccgaaacccaacatggcacggtgctggtgcaaattaagtacgagggcaccgacgcaccgtgcaagatccccttcagcacccaggacgagaagggcgccacgcaaaacggtcggctcattacggccaacccgatcgtcactgacaaagagaaacccgtaaacatcgaggcggagccgccctttggcgagtcctacatcgttattggggccggtgagaaggccctcaagttgtcatggttcaagaaagggtcaagcatcggcaagatgttcgaagccacagcccgcggggcgcggcgcatggccatactgggcgacacggcctgggacttcgggtccatcggtggcgtcttcaccagcgtgggaaagctcgtgcaccagatcttcggcaccgcctacggcgtcctcttttctggcgtgagttggaccatgaagatcgggatcggtgtgctgctcacgtggctgggcctcaattcccggtcaacctccctcagcatgacctgtatcgccgtaggactggtgaccctgtacctcggcgtgatggtccaggcggacagtgggtgcgtgattaactggaagggtcgggagctgaagtgcggaagtggaatcttcgtgacaaacgaagtacacacatggaccgagcagtacaagttccaggccgacagccccaaacgcctttccgccgcgataggcaaggcctgggaggagggggtgtgcggcatccggtccgcgacccgcctcgagaacatcatgtggaagcagatctccaacgagctcaatcacatcctgctcgagaatgatatgaaattcaccgtggtggtgggggacgtggcaggaatcctggcccaagggaagaaaatgatccgtccccagcccatggagtacaagtactcttggaagtcttggggtaaagcgaaaatcatcggcgcggatgtccagaacacgacctttataatcgacggtcctaacaccccggagtgcccagacgaccagcgcgcctggaacatctgggaggtggaggactacggcttcggtatttttacaacgaacatttggctcaagctcagagactcgtacacccaggtgtgtgatcatcgcctgatgtcagcggccattaaggattctaaggccgtccatgcggacatgggctactggatagaaagtgagaagaacgagacctggaagctggctcgggccagcttcatcgaggtgaaaacctgcatctggccgaaatcgcacacgctctggtcgaacggcgttctggaaagtgagatgataatccccaagatctacggagggccgatcagccagcacaactatcgccccggatacttcacccagacggctggcccctggcacttggggaagctcgagttagatttcgacctgtgtgagggcaccacggttgtggtcaatgagcactgcggcaaccgcgggccctcactccgcacgaccaccgtaactggaaagataattcacgagtggtgctgccggagctgcaccctgccacccctgcgcttccggggtgaggacggctgctggtacgggatggaaatcagacccgtgaaggagaaagaggagaacctcgtgaagtctatggtcagcgccggcagcggcgaggttgacagtttcagcctcggtcttctttgtatatccatcatgatcgaggaggtgatgcggagccgactgtcccggaagatgcttatgaccggcactttagccgtctttttcctgctgatcatgggccagctcacgtggaacgacctcatccgcctgtgcatcatggtgggcgcaaacgccagcgaccgtatgggtatgggcacaacctacctcgccctgatggccaccttcaagatgcggccgatgtttgccgttggcctcctattcagacggctgacgtctcgcgaggttcttctcctgacaatcgggctgagcttagtcgccagcgtcgagttgccgaacagcctggaagaactcggcgacgggctggccatgggtatcatgatccttaagctcttaaccgacttccagtctcaccagctgtgggccaccctactgagcctgacgtttatcaaaaccaccttttcattacaccacgcgtggaagaccatggccatgattctctcgatcgtgagtctgttccccctctgcttgagcactaccagtcaaaagaccacctggctccctgtactattgggcagcctggggtgcaagccgctcacaatgttcctcatcgccgagaacaagatatgggggcggaggtcctggcccctgaacgagggtatcatggcggtcggcatcgtgagcatcctcctgagctctctgcttaaaaacgacgtgcctctcgccgggccactgatcgcgggcgggatgctaatcgcctgttacgtcataagcggatcttctgccgacctttcccttgaaaaggccgccgaggttagttgggaagaggaagctgagcacagtggagctagccacaatatcctagttgaggtccaggacgatggtaccatgaagatcaaggacgaggaacgggacgatacactgaccatcctgcttaaagccacactactggctgtgtcgggcgtgtatccgctctcaatacccgccacgctgtttgtctggtacttctggcaaaagaagaagcagagaagtggggtcctgtgggatacccccagcccgcctgaggtagagcgggcggtcctggacgacggcatctaccgcatcatgcagcggggcctcctgggacgctcccaagtaggcgtgggggtcttccaggagaacgtcttccacacgatgtggcacgttactcggggcgccgtcctgatgtatcaggggaagcgattggagccctcatgggcctccgtgaagaaggaccttatcagctacggcggcgggtggcggttacagggctcctggaacacgggagaggaggtccaggttatagccgtggaacccggcaagaaccccaagaacgttcagaccgcccccgggacattcaagacgcccgagggcgaggtcggcgcgatcgccctcgacttcaaacctgggacaagcgggtcccccatcgttaaccgcgaaggcaagatcgtgggactgtacggtaacggtgtcgtgaccacaagcggcacctacgtttccgccatcgcgcaggcgaaggcctcgcaggaggggccgcttcccgagatcgaggacgaggtctttaggaaacgcaacctcacaattatggacctgcaccccggcagcggcaagacccggcgttacttgccggccatcgtgcgggaggccatcaagcgcaaacttaggacactgatcttggccccaacccgagtggtcgcgtccgaaatggcggaggctctcaaagggatgcccatacgataccaaaccaccgccgtaaagtccgagcacactggcaaggagattgtggacctaatgtgccatgccacgttcaccatgcgcctgctctcgcccgtccgggtgccaaactacaatatgatcatcatggacgaagcgcattttaccgatccatcatccatcgcggcccgggggtacatcagcacccgcgtaggcatgggcgaggccgcggcgatcttcatgaccgccacgccgcccgggtcggtcgaagccttcccgcagagcaacgctgtgatccaagatgaggagcgggatattccagagcgctcctggaatagcgggtacgagtggatcaccgatttcccaggcaaaaccgtatggttcgtaccatccatcaagagcggcaacgacattgcgaactgtctgcggaagaatgggaaacgcgtgattcagctgtcccgcaagacctttgacacggagtaccagaagacgaaaaacaacgattgggattacgtggtaaccaccgacatcagcgagatgggcgctaatttccgggccgaccgcgtgatcgacccgaggcgctgcctcaaacccgtgatattgaaggacggccccgagcgcgttatactggccgggccgatgccggtgacggtggcgtccgcggcccaacgtcgagggcggattggccgcaaccacaacaaggagggagatcagtacatctatatggggcagccactcaacaacgacgaagaccacgcacattggaccgaggccaagatgttactggacaacattaacacccccgagggcatcatcccggccctcttcgagccggagcgcgaaaagtccgctgccattgacggggagtaccgactacgaggcgaggcccggaagagtttcgtcgagctcatgcggcgcggggacttgcccgtgtggctcagctataaagtcgctagcgaaggctttcagtactccgatcgccggtggtgcttcgatggagagcgcaacaaccaggttctagaggagaacatggacgtagagatatggaccaaggagggggagaggaagaagctacgcccccggtggctggacgcccgcacgtactcggaccccctagcgcttcgtgagttcaaagagttcgcggcgggccgcagatccgtcagtggggacctgatcctcgagatcggcaagctcccgcagcacctgacccagcgcgcccagaacgcgttggacaacctcgtaatgctgcacaactccgagcagggcgggcgggcctacagacacgccatggaggagttacccgacaccatcgagaccctcatgctgcttgccttaatagccgtcctgacgggtggcgtcaccctgttctttctctctggccgggggctgggcaagacaagtattggtctgctttgtgtgatggcttcatccgtacttctgtggatggcctccgtcgagccgcactggattgccgcctccattatcctcgagtttttcctcatggtactgctcatccctgagccggatcgccagcggacgccccaggacaatcaactggcttacgtggtaatcgggttactatttatgatcctgacggtcgccgccaacgagatgggtcttctggaaacgactaagaaagatctaggtatcgggcatgtggccgtggaaaaccaccaccacgccgccatgctggacgtggacctccaccctgcgagcgcatggaccctgtacgccgtagcgaccaccatcatcacaccaatgatgcgccacacgatcgagaataccacggccaacatctccctaaccgcgatcgccaaccaggcagcaatcctcatggggctggataagggctggcccatcagcaagatggacatcggcgtcccgctgcttgctctggggtgctattcccaggtcaaccccctgaccctcacagccgccgttctgatgctggtcgcacattatgccatcataggccccggcctgcaggcgaaggccacgcgcgaggcccagaagcgtaccgccgctggcataatgaagaatcctaccgttgacgggatagtggcgatcgacctagacccggtagtctacgacgccaagttcgagaagcagctaggacagatcatgctactgatcctatgtacgagccagatcctcctgatgcggacgacctgggccctgtgcgagtctataacgctcgccacgggccccctgacgaccttatgggagggaagcccgggcaaattctggaacacaaccatcgcggtgtcgatggcgaatatcttccgagggtcgtatctcgctggggctggcctggccttcagcctgatgaaatccctcgggggcgggcgcagaggcaccggtgctcaaggcgaaactctgggcgagaaatggaagcgtcagttaaaccagctctcgaaatccgagtttaacacctacaagcggagcgggatcatggaggtcgaccgctcagaggccaaggagggcctgaagcgcggtgagactacaaagcacgcagtgagccgcggcaccgccaaacttagatggttcgtggagcgcaacctcgtcaagccagagggaaaggtgatcgacctaggctgcggccgcggcggttggtcctattactgtgccgggctgaagaaggtgacggaggtcaagggatatacgaagggaggacccggccacgaggagcccattccgatggcgacatatgggtggaacctagtgaagttacacagcggcaaggacgtgtttttcatcccgcccgagaaatgcgacaccctgctctgcgacatcggggagtctagccccaaccctacgattgaggagggccgcaccttacgggtgctgaagatggtggagccctggctacgcggtaatcagttttgcatcaagatactcaacccctacatgccctccgtggtcgagacgctggagcagatgcagcggagacacggaggaatgctggtgcgtaaccctctcagccgcaattccacacatgaaatgtactgggtcagttgtgggaccggcaacatcgtctccgctgttaacatgaccagccgtatgctccttaaccggttcacgatggcgcatcgcaaaccaacgtacgagcgggacgtggacctaggagccggcacacgccacgtcgccgtagagcccgaggtggcgaacttagacatcatcggccagcggatcgagaacattaagcacgagcacaagagcacctggcactatgacgaggacaacccatacaaaacctgggcctaccacgggagctacgaagttaagccgtcagggagcgccagctccatggtaaacggggtcgtcaagctgctaacgaagccctgggacgtcatcccaatggtaacccagatcgctatgacggataccactcctttcgggcagcagcgtgtgtttaaggaaaaagtggacacacggacccctaaggccaaacgcgggaccgcccagatcatggaggtcactgctaagtggctgtggggcttcctttcgcgaaataaaaagccccgcatctgcacccgggaggagtttacccggaaggtgaggagcaacgccgccataggcgcggttttcgtcgatgagaaccaatggaacagcgccaaggaggccgtggaggacgagcgcttctgggacctcgtgcaccgggagcgcgagctgcacaagcaggggaagtgcgcgacatgtgtctacaatatgatgggaaaacgcgaaaagaagctcggggagttcggcaaggccaaagggtcccgggcaatatggtatatgtggttgggcgcacggttcttggagttcgaggccctgggatttatgaatgaggaccattggttcagccgcgagaacagcctcagcggcgtggagggcgaggggttacacaagctggggtatatcctccgggacatctccaaaatccccggagggaacatgtacgctgacgacacggccggatgggacacccgcataaccgaggacgatctccagaacgaggcgcgcatcaccgacatcatggagccggagcatgcgctgctcgccaagagtatcttcaaactcacgtaccagaataaggttgttagggtacagaggcccgccaagaacggaaccgtcatggatgtcatctcgcggcgagaccagagagggagcggccaggtggggacctacggactgaacacattcacgaacatggaagcacagctcataaggcagatggagtccgaagggatcttctcgccctcggagctggagacccccaacctggcggagcgggtgctagactggttagagaaatacggcgtggagcgtctcaagcgcatggccatcagcggggatgactgcgtggtgaagccgatcgacgaccgctttgccactgccctgacggcgctgaatgacatgggtaaggtccggaaggacatcccccagtgggagccctcgaagggatggaacgactggcagcaggttcccttctgctcgcaccatttccaccagctgatcatgaaggatggtcgagagatagtcgtcccgtgtcggaaccaagacgagcttgtgggacgcgcaagagtgagccagggggctgggtggtcactgcgcgagacggcctgcctaggcaagagttacgcccagatgtggcagctcatgtactttcacaggcgcgacctgcgactggcggccaacgccatctgctccgccgtgcccgtggattggattcccaccagccgcactacttggtccatccacgcccaccaccagtggatgacgaccgaggacatgttaagcgtgtggaatcgcgtttggatagaagagaacccctggatggaggataagactcatatctccagctggggagatgtgccgtatctggggaaacgggaggaccagtggtgcgggtccctgataggcctcaccgcgcgcgccacgtgggccaccaacatccaagtggcgataaaccaggttcggcgcctgatcgggaatgaaaactatcttgactatatgacaagcatgaagcggttcaagaacgagtccgaccccgagggtgctctctggtga

SEQ ID NO: 24643 - RNA, 9879 nt, synthetic construct
  misc_feature 1..9879: note = derived and/or modified CDS sequence (opt11) from DENV-1__JQ045667__SS-prME
  source 1..9879: mol_type = other RNA
agcgtgacgatgctgctcatgctgatgcccaccgctctggccttccatttgaccacccggggcggggagccccacatgatagtgtcaaaacaggagcggggcaagagcctgctgttcaagaccagcgccggggtcaacatgtgtaccctgatagccatggacttgggtgagctgtgcgaggacaccatgacctacaagtgtccccgcatcactgaaaccgagccagacgacgtggactgctggtgtaacgcgacggatacctgggtgacctacgggacctgcagccagacgggcgagcaccggcgcgataaacggtccgtggcgctcgcgccccacgtgggcctgggactggagaccagaaccgagacctggatgagctccgagggcgcatggaagcaaatccagcgggtagaaacgtgggccctccgccaccccggttttaccgtgatcgccctctttctggcccacgctatcggcaccagcatcacccagaaggggatcatctttatcctcctgatgctagtcacgccgagtatggccatgcgctgcgtaggcatcggctcacgagactttgtagaaggactctccggcgccacctgggtggacgtcgttctggagcacggcagctgcgtgacgaccatggcaaaggacaagcctaccttagacatcgagctcctgaagaccgaggtcacgaaccccgccatcctgagaaagctctgcatcgaagcgaagataagcaacaccacgaccaacagccgctgcccgacccaaggcgaggcaaccctcgtggaggagcaggacgcgaacttcgtctgcaggcgcacgttcgtcgacaggggctgggggaacggctgcgggctttttggaaaggggtccctcatcacgtgcgccaagttcaagtgcgtcacgaagctggagggcaagatcgtgcagtatgagaacctgaaatactcagtcatcgtcaccgtacacacaggcgaccagcatcaagtcgggaacgagtccaccgagcacggtaccacagccacaatcacgccccaggcgcccacgaccgaaatccaactcaccgactatggggccctgacgctggattgcagccccagaaccggcctcgacttcaacgaaatggttttgctgaccatgaagggaaaatcctggttggtccacaaacaatggttcctggacctgccactcccttggacctccggcgccagcacgtcccaggagacctggaaccggcaggatctgttagttaccttcaagaccgcccacgccaagaagcaagaggtggtcgtgctcggctctcaagagggagcgatgcacacggccctgaccggggccaccgagatccagacctcaggtacgaccaccatattcgccggccacctgaagtgcaggctcaaaatggacaagctgaccctgaaggggatgagctacgtgatgtgtacggggtccttcaagctggagaaggaggtcgccgagacccagcacggcactgtcctggtgcagatcaaatacgaagggactgacgccccctgcaagatccccttcagcacgcaggatgaaaagggcgttacgcaaaacggtcggctgatcaccgccaacccgatcgtgacggacaaggagaagcccgtgaacatagaggccgagccgccattcggcgagtcctacattgtgattggcgccggggagaaggcgctgaaattaagctggttcaagaagggaagtagcattgggaagatgtttgaggccactgccagaggcgcgaggcggatggccatcctgggggacacagcgtgggacttcggttccatcggcggcgtgttcacaagcgtaggcaagctggtccaccagatattcgggaccgcctacggagtcttattctccggagtgagctggacaatgaagatagggatcggcgttctgctgacctggttagggctgaattcccggtccacctccttaagcatgacgtgtatagccgtgggccttgtgactttatacctgggggtcatggtgcaggcggactccggctgcgtcattaattggaaggggcgggagctcaagtgcggaagcggcatcttcgtcaccaacgaagtgcacacctggacagagcagtataagtttcaggccgactccccgaagcgcctgtccgccgccatcgggaaggcctgggaggagggagtgtgtgggattcggagcgcgacccgcttggagaatatcatgtggaagcagatttccaacgagttaaaccatatcctgctggagaacgatatgaagttcacggttgtagtaggcgacgttgccgggatcctcgcgcagggcaagaagatgatccggccccagcccatggagtataaatacagctggaaatcttggggcaaggccaagatcatcggagctgacgtgcagaacacaacctttatcatcgacggccccaataccccggaatgccccgacgaccagcgtgcctggaatatctgggaggtggaggattacgggttcggcatcttcacgaccaacatctggctgaagctgagggacagctacacccaggtctgcgaccaccggctcatgtccgcggccatcaaggacagcaaggccgtccacgccgacatgggttactggatcgagagcgagaagaacgagacctggaagctggccagagcctctttcatcgaagtgaagacgtgcatctggcctaaatcccataccctgtggagcaatggcgtgctcgaatccgagatgattatcccgaaaatatacggcggtcccatcagccagcacaactaccgccccggctacttcacacagacagccgggccctggcacctggggaagctggagctcgacttcgacctgtgtgagggcacaacggtggtggtcgatgaacattgtgggaaccgcggcccgtccctgcgcaccaccacagtaaccgggaagatcatccatgaatggtgctgccggagttgcaccctgccacccctccgcttccggggcgaagacgggtgctggtacggcatggaaatccgccccgtgaaagagaaggaggagaacctggtcaagagtatggtgagtgccgggtcaggagaggtggattcgttctccctgggcctattatgcatctccattatgatcgaggaggtcatgcgctcacgctggtccaggaagatgcttatgaccgggacgttagccgtgttcttcctcctcataatgggccagctcacctggaacgatctcatccgactctgcatcatggtcggtgccaacgcgagcgatcgcatgggcatgggcaccacctatcttgccctgatggcgacgttcaaaatgcggccaatgttcgccgtgggcctcctgttccgacgcctgacctcccgcgaggtgctactactgacaatcggcctcagcctggtggcatccgtcgagttgcctaactcactcgaggagctgggggacgggctggcgatgggcattatgatcctcaagctgctgacagactttcaatcatatcagctgtgggcgacacttctaagcctcaccttcatcaagacaaccttttcccttcattacgcctggaagacgatggccatggtgctgtcaatcgtatcgctcttccccctgtgtctgagcaccacttcccagaagaccacttggctccccgtcctgctcgggagcctcggctgtaagccgctaactatgtttttaattgccgaaaacaagatttgggggcggaggtcctggcccctcaacgagggtataatggccgtcgggatagtaagtatcttactgagctccctcctgaagaatgatgtacccttggccgggccactcatcgccggagggatgctgatggcctgctacgtgatcagcggctccagcgcggacctgtccctcgagaaggccgcggaggtttcatgggaggaggaggccgagcactccggggcaagccacaacatcttagttgaagttcaaggcgatgggactatgaagatcaaggacgaggaacgggacgataccctgaccatcttactgaaggcgacgctgctcgccgtctcaggcgtgtacccgctgagcatccccgcaaccctgttcgtgtggtacttctggcaaaagaagaagcagcgctccggcgtcttatgggacaccccctctccgcctgaggtgggacgggcagtactggacgacggcatctacagaatcatgcagcggggtctgcttggacgttcccaggtcggggtgggcgtgtttcaggagaacgtcttccacaccatgtggcacgtcacgcggggcgccgtacttatgtaccaggggaagcgcctggagcctagctgggcgagcgtcaagaaggacctaattagctacggcggtggctggcggctccaggggagttggaataccggcgaggaggtccaggtgatcgcagtagagcccggcaagaatcccaagaacgtgcagaccgcgcccgggacgtttaagacgccagagggcgaggtcggggccatcgcccttgacttcaaacccggcaccagtggttcccctatcgtcaaccgcgaggggaagatcgtgggcctgtacgggaacggcgtggtgacaaccagcggtacgtatgtgagcgcgatcgcacaagctaaggcatcccaggagggcccgctgcccgagattgaggatgaggtgttcagaaagagaaacttgaccatcatggacctgcaccccggcagcgggaagacccggcgctacctcccggcgatagtccgggaggctatcaagcgcaagcttcgcaccctcatcctcgcccccaccagagtcgtagcctccgagatggccgaggcgttaaagggcatgccaatacggtaccagaccacggccgtgaagagcgagcacactgggaaggagatcgtggacctgatgtgccacgccacgttcaccatgcgtctcctgtcccccgtgcgcgtcccgaactacaacatgatcatcatggacgaggcccacttcaccgaccccagctctatcgccgcgagagggtacatctctacacgcgttgggatgggagaagccgccgccatcttcatgacggctacgcctcctggctccgtggaggcgtttccgcaaagcaacgccgtcatccaggacgaggaaagagacatccccgagcgcagttggaatagcggttacgagtggatcaccgatttccccggtaagaccgtgtggttcgtgccatccatcaagagcggcaacgacattgctaattgcctccgcaaaaacggcaagcgcgtcatccagctctcccgaaagacttttgacactgagtaccagaagacgaagaacaatgactgggactacgttgtgaccacggacatcagcgagatgggggcaaacttccgcgcggacagagtaatcgacccgaggaggtgcctgaagcccgtgatactgaaggacggcccggagcgtgtgattctcgccggacccatgccggtgacggtggcatccgccgcccagcggcgcgggcggattggccgtaatcataataaggagggggaccagtacatatatatgggccagcccctgaacaatgacgaggaccatgcgcattggactgaagctaagatgttgttggacaacatcaacacccccgaggggattatccccgccctgttcgagccggagcgcgagaaaagtgctgcaatcgacggcgagtaccggctgaggggcgaggcgcggaagacgtttgtcgagctcatgcgccgaggggacttacccgtgtggctgtcctacaaggtggctagcgagggcttccagtactcggaccgccggtggtgcttcgacggggaacggaacaatcaggtcctggaggagaacatggacgtggagatctggaccaaggagggcgagcggaagaagctaaggccccggtggctggacgcccgcacctactccgacccgctcgctctgcgggagttcaaggagttcgccgctggccgcagaagcgtgtccggtgatttgatcctcgagatcggcaagctcccgcagcatctaacccagagggcccagaacgcactcgataacttggtcatgttgcacaacagtgagcagggcgggcgcgcctaccggcacgcaatggaggaactccccgacacgatcgagaccctgatgctgctggccctaatcgccgtcctgacggggggcgtgaccctcttcttcctgtccgggcggggtctaggcaagaccagcatcggcctcctatgcgtaatggcctccagcgtgctgctatggatggcctccgtggagccccactggatcgcggccagcattatcctggaattcttcctgatggtcctattgattcccgagccggaccgccagcggacgccccaggacaaccagctggcctacgtggttatcggcctcctgttcatgatcctgacggtagccgccaacgagatggggcttctggagacaaccaagaaggacctgggcatcggtcacgtggccgtagagaatcaccaccacgccgccatgctcgacgtggacctgcaccccgcatccgcctggacgctgtacgcggtggccaccaccatcataaccccgatgatgcgccacacgatcgaaaacaccaccgccaatataagtctcaccgccatcgccaaccaagcggccatcctgatgggcctggataaaggctggcccatctccaagatggacatcggggtgcctctactagccctgggctgctacagtcaggtcaaccccctcacgctgaccgctgcggtgctgatgctcgtggcccactacgccattatcggacctggcctgcaggccaaggcgacccgcgaggcgcagaagcggaccgccgccgggattatgaagaaccccacggtcgatgggattgtggccatcgacctggacccggtggtttacgacgctaagttcgagaagcagttgggacagatcatgttacttatcttatgcacttcccagatccttctcatgcgtaccacctgggcgttatgtgagagcatcacgctggccaccgggcccctgaccaccctttgggagggttccccgggaaagttctggaacacaacaattgccgtgagcatggccaacatatttcgaggttcctacctagccggcgcggggttggccttcagcttaatgaagtccctcggcgggggccgccgtggcacgggggcccagggcgaaaccttgggggagaagtggaaacgccagctcaatcagctgtccaaaagcgagtttaacatctacaagcggtcgggcatcatggaggtggaccgcagcgaggccaaggaagggctcaaacggggagagacgaccaagcacgcggtctccagaggcactgccaagctccggtggtttgtggagcgaaacctggtgaagcccgaagggaaagtcatcgaccttggctgcggccggggcgggtggagctactactgcgcgggtctgaagaaagtgacggaggtcaagggctatacgaagggcgggcccggacacgaggagcccatcccgatggccacctacggctggaatcttgttaagttacactccgggaaggacgtgttcttcatcccgccggagaagtgcgatactctgctttgtgatatcggagagagctccccaaacccgaccatcgaggagggcaggacgcttcgtgtgcttaagatggtcgagccctggttacgcggtaaccagttctgcattaagatccttaacccatatatgccgagcgtggtggagaccctagagcaaatgcagcggaaacacggggggatgctagtccgcaacccgctgagccgtaactcaacccacgagatgtattgggtgtcctgtggcaccggcaacatcgtatcggccgtgaacatgacctcccgaatgctactcaatcgcttcacgatggcccacagaaagcccacctacgagcgtgacgtggacctgggggcgggcacccggcacgtggccgtcgagccagaggtggcaaatctggacatcatcggccagcgcattgagaacatcaagcacgagcataagagcacgtggcactacgacgaagataacccctacaagacgtgggcataccacggctcctacgaggtgaagccgagcgggtccgcgtcgtctatggtgaacggagtcgtgaagcttctgaccaagccctgggacgtgatccccatggtgacccagatcgccatgaccgatacgactccctttggccagcagcgggtctttaaggaaaaggtagacacacgcacccctaaggcgaagcggggcacgatccagatcatggaggtaaccgccaagtggctgtggggcttcctctcccgcaataagaaaccccgcatatgtacccgagaagagttcacccggaaagtgcggagcaacgcggcaatcggggccgtattcgtggacgagaaccaatggaactccgctaaggaagccgtcgaggacgagcggttctgggacttggtgcaccgcgaacgcgagctgcacaagcagggaaagtgcgcgacgtgtgtgtacaacatgatgggcaagcgcgagaaaaaactcggcgagttcggaaaggccaaggggtcccgggccatctggtacatgtggctgggggcccggttcttggagttcgaggccctcgggttcatgaacgaggaccactggttcagccgggagaactcgctgtccggggtcgaaggggaaggactccacaagttgggatacatcctgcgcgacataagcaaaatccccggaggcaatatgtacgcggacgacactgccgggtgggatacccgtattaccgaagacgacctgcaaaacgaggcccggatcacggacattatggagccggagcacgcgctgttggccaaatccatattcaagctaacctaccaaaataaggtggtgcgcgttcagcggccagcgaagaacggcaccgtgatggacgtgatcagcaggagggatcaaagaggctccggtcaggtcggcacttacgggctcaacacattcacgaatatggaggcccagctgatccgacagatggagagtgagggaatcttctcccccagcgagttagaaaccccgaatcttgccgagcgcgtgctagactggctcgagaagtatggggtggaaaggctcaaacgcatggccatctccggagacgactgcgtagtgaaaccaatcgacgaccggttcgccacggccctgacggccctgaatgacatgggcaaggtccgcaaggatatcccccagtgggagcccagcaaagggtggaacgactggcagcaggtccccttctgcagccaccacttccaccagctcatcatgaaagacggccgggagattgtggtgccgtgtcgaaatcaggacgagctggtggggcgggcccgagtgagccagggcgccgggtggtcactgcgggagaccgcgtgcctcgggaagtcctacgcgcagatgtggcagctgatgtacttccaccgccgggatctgcgcctcgctgctaacgcaatctgcagcgctgtgcccgtcgattggatccctacctcccggaccacatggagcatccacgcccaccaccagtggatgactaccgaagatatgctatccgtgtggaaccgcgtttggatcgaggagaacccctggatggaggataagacccatataagctcctggggcgacgtcccgtacctggggaagcgagaggaccagtggtgcggcagcctcatcggactgacagcacgcgctacctgggccactaacatccaggtggcgatcaaccaggtgcgccggctgatcggcaacgagaactacctggactacatgacttcaatgaagcgcttcaagaacgagagcgatccagagggggccctgtggtga

SEQ ID NO: 24644 - RNA, 9879 nt, synthetic construct
  misc_feature 1..9879: note = derived and/or modified CDS sequence (opt11) from DENV-1__KU094071__SS-prME
  source 1..9879: mol_type = other RNA
agtgtgaccatgctgctcatgctcctgcccaccgccctcgccttccacctcacaacccgcggcggggaaccgcacatgatcgtctccaaacaggagcggggcaaaagcctgctttttaagacttccgcgggtgtgaacatgtgcaccttgattgccatggacttgggggagctctgcgaggatacgatgacctacaagtgtccccgcatcaccaaggctgagccggatgacgtggactgctggtgcaacgcgaccgacacgtgggtaacctacggaacctgttcccagaccggcgagcaccggcgagacaaacggtccgtggccctagccccacatgtgggacttggcctggagacgcgcgcagagacctggatgagctccgagggggcctggaagcagatccagaaggtcgagacctgggccctgcgccacccggggtttaccgttatcgcgctgttcctcgcccatgccatcgggacaagcattacccagaaggggataatcttcatcctcctgatgctagtgacaccctcaatggccatgcgatgcgtcggcatcggcaaccgcgatttcgtggaggggctgtccggcggaacctgggttgatgtcgtgctggaacacggtagctgcgtgacgacaatggctaaggacaagccgaccctcgacattgagctactgaagaccgaggttacaaacccggcggtactccgcaaactgtgtatcgaggcaaagatctcaaacaccacgaccgactcccgctgcccgacgcagggcgaggcaaccctggtggaggagcaggacgctaacttcgtatgccgtcggaccttcgtggaccgcgggtggggcaacgggtgcggcctcttcgggaagggcagtctgataacctgcgccaaattcaagtgcgttacgaagctggaaggcaaaatcgtgcaatacgagaacctgaagtattccgttatcgtgactgtccacaccggggaccagcaccaggtcggcaacgagaccactgagcacgggacgatcgcgaccatcacccctcaagcgccaactagcgagatccagctgacagattacggcgccctgactctcgactgctccccgcggaccgggctggacttcaacgagatggtcctgctcaccatgaagagaaagagctggctggtgcacaagcagtggttcttagatctgccgttgccatggacgtccggcgccagcacaccccaggagacctggaatcgtgaggacctgctcgtgacgttcaagacggcacacgcgaagaaacaggaggtcgtggtacttggcagccaggagggtgccatgcacaccgcccttaccggagccaccgaaatacagacgagcgggacaaccaaaatcttcgccggccacctcaagtgtcgactgaaaatggacaagctgaccctcaaggggatgagctacgtcatgtgcaccggctccttcaaactggagaaggaggtggccgaaacgcagcacggcacggtactggtccaggtcaagtacgaaggtacggacgcgccctgcaagatcccgttctcaacgcaggacgagaagggtgttacccaaaacggtcggctgatcaccgccaaccccattgtcacagacaaggaaaagcccgtaaacatcgaagcagagccaccatttggcgagtcctacatcgtagtcggtgcgggggagaaggccctgaagctgagctggttcaagaagggctccagcatcggaaaaatgctggaagcgaccgcccgcggcgccaggcgcatggcgatattgggggacacggcctgggatttcggctccatcggcggggtttttaccagcgtaggcaaattagtccaccagatctttgggaccgcctacggtgtgctgttctccggggtgagctggacgatgaagatcggcattggtatccttctgacctggctggggctcaactcgaggagcgcttccctttcaatgacctgtatagccgttggcatggtgaccttgtatctcggtgtgatggttcaggctgactccggctgcgtaatcaactggaaggggcgtgagctgaagtgcggcagcggcatctttgtgactaacgaggtccacacgtggaccgagcagtacaagttccgcgccgattccccgaagcgcctgagcgccgcaatcgggaaggcttgggaggagggtgtgtgtgggattcgaagcgcgacccgtctcgagaacataatgtggaagcagatctccaacgagctgaatcatattctgctggaaaacgacatgaagtttacggtggtagtgggggacgtgtcagggatcctgacccagggcagaaaaatgatcggcccccagcccatggagcataagtactcctggaagtcgtgggggaaggcgaagattatcggcgccgacgttcaaaataccaccttcatcatcgacggcccgaacacacccgagtgccccgatgatcaacgggcctggaatatctgggaagtagaagattatggctttggcattttcacgaccaacatctggctcaagttgagggattcctatacccaggtgtgcgacccgaggctgatgagcgctgccattaaggacagtaaggccgtacacgccgacatgggatactggatcgagagcgagaagaacgagacctggcgcctagcgcgggcgtcctttatcgaagtcaagacatgcgtgtggccgaagagtcacaccctctggtccaacggggtcctggaatccgagatgataatcccaaagatttacggaggccccatctcccaacacaactaccgaccagggtatagcacccagaccgccggtccatggcatctgggcaagctcgagctggactttgacctgtgcgaaggtacgacagtggtggtcgacgagcattgcggcaaccgggggccatccctccgcacaaccaccgtaaccggcaagatcatccacgagtggtgttgccggagctgtacgctacccccgctccgcttcaagggagaagacggctgctggtacggcatggaaatccgtcccgttaaggacaaagaggaaaacctcgtcaaatccctggtgagcgccggtagcggtgaggtggacagtttctcactggggttactttgcgtctccatcatgatcgaggaggttatgcgcagccggtggagtcgcaagatgctgatgaccggcactctcgccgtgtttctcttactcataatggggcagttgacatggaacgacctaatccgcctctgtattatggtcggcgccaacgcttctgaccgcatgggcatggggaccacatacctggctctcatcgccacgtttaagatgcgccccatgttcgccgtgggcctcctgttcagacgcctaacctcccgggaggtcttactgctaacgatcgggcttagtctggtggcctccgtggagctgccaaactcacttgaggagctgggcgacggcttggcgatgggtatcatgatcctcaagctgctgaccgacttccaatcgcaccagctctgggccgccctgcttagccttacgttcatcaagactacattctccctacactatgcctggaagaccatggctatggtcctgagcacggtgtccctcttcccgctatgtctgagcaccacatcccgtaagaccacatggctcccagtgttgctgggcagcctcggatgtaagccccttaccatgttcctgatcgctgagaacaagatctggggacggaagtcgtggccgctcaacgaggggatcatggccgtcggcatcgtgagcatcctactgtcttccttactgaagaacgacgtaccgctggcgggccccctcatagccgggggcatgctaatcgcgtgctatgtcataagcgggtccagcgccgatctgtccctcgagaaagccgccgaagtgagctgggaggaggaggcggagcattccggcgctagccacaatatcctggttgaagtccaggacgatgggaccatgaaaatcaaggacgaggagcgagacgatacgctgacgatcctcctaaaggccacgctactagccgtgtccggagtgtacccaatttccatccccgccactctgttcgtctggtactttcgacagaaaaagaagcagcgctccggcgtgctgtgggacaccccgtcgccacccgaggtggagagggccgtactcgacgacggcatttaccgtatcctccagcggggcctgctggggagatcccaggtgggcgtaggggtctttcaagagggggtgttccacaccatgtggcacgtgactaggggcgcggtcctcatgtaccaagggaaacgcctggagcccagctgggcctccgtgaagaaggacttaattagctacggagggggatggagattccagggttcctggaataccggcgaggaagtccaagtgatcgccgtagaaccgggcaagaacccgaagaacgtacaaaccgcccccggtactttcaagacgcccgaaggcgaggttggagtgatcgccctcgactttaagcctggcaccagcggctctcctatcgtaaatcgcgaagggaagatcgttggcctgtacgggaacggcgtagtaaccaccagcggaacgtatgtgtcggcgattgcccaggccaaggcctcccaagagggccccttaccggagatcgaggacgaggtttttcggaagagaaacctcacaatcatggacttgcaccccggcagtgggaaaacccggcggtatctgcctgcgatcgtgcgcgaagccatcaaacgaaaactccgaaccttgatcttggcccccacaagagtcgtggcatccgaaatggccgaggcgctcaagggcatgccgatccgctaccagactaccgccgtcaagagcgagcacacagggcgggagatagtcgacctgatgtgccacgctacgttcacgatgcgcctgctctcccccgtgcgggtgcccaactataacatgattatcatggacgaagcccacttcaccgaccccgcctctatcgctgcccgtggctacatttcgacacgggtcgggatgggagaggctgccgccatcttcatgacggcgaccccgcctggctctgtggaggcattcccccaatccaacgcagtgatccaggacgaggagcgcgacatccccgaacgttcatggaactccggttacgactggatcaccgacttcccaggtaagaccgtttggttcgtgcccagcattaagtccgggaacgacatcgctaactgcctgcgcaagaacggtaagcgagtgatccagctcagtcgcaagacattcgacaccgaataccagaagacaaagaacaacgactgggactacgtcgtaaccacggacatctccgagatgggcgccaacttccgggccgaccgtgtcatcgaccccaggcgctgtagcaagcccgtgatcctaaaggacggtccggagcgggtgatcctggccggcccgatgcccgtcaccgtggcttcagcagcgcagcgccgcggccggatcggccgcaaccagaacaaggagggcgaccagtacatatatatgggacagccgctgaacaacgacgaagaccatgcccactggactgaggccaagatgttactggacaatatcaacacccctgagggaatcatcccagccctgttcgagcccgagcgcggtaagagcgcggcgatcgacggcgaataccgcttacggggcgaggcccgcaagactttcgtggagctgatgcggcgtggcgacctacccgtctggctctcctacaaggtggccagcgaaggcttccagtactccgaccggaagtggtgcttcgatggagaacgaaacaatcaggtgctggaggagaacatggatgtcgaaatctggaccaaggaaggggagcgcaagaagctgagaccgcgttggctggacgcccgtacctattcagacccccaggccctccgggagttcaaagagttcgcggcagggcgccggagcgtgtccggagacctcatcctcgagatcgggaagctgccacaacacctaacccaacgcgcacagaatgccttggacaacctggtgatgttgcacaatagcgaacaaggaggcaaggcttaccggcacgccatggaggagttgcctgacacgatcgagactctgatgctgctcgcgctgatcgccgtgctgaccggcggcgtgaccctcttcttcctttccgggcgcggcctgggaaagacgagtatcggtcttctgtgcgtgatggcgtccagcgtccttctatgggtggcgtccgtcgagccccactggatagcggcgagcatcatattggagtttttcctgatggtcctcctgatccccgaaccagaccgacaaagaacaccgcaggacaaccaactggcctacgtggtgattggcctgctgttcatgatcctgaccgtggccgcgaacgagatggggctgctggagaccactaagaaggacctgggcatcggacacgtggccgtagaaaatcaccatcacgccacgatgctcgacgtagaccttcgccccgcttccgcctggaccttatacgcggtggcaaccacaatcatcacccccatgatgcggcacaccatcgaaaacaccaccgccaacatcagcctcacggccatcgctaaccaggccgccatcctgatgggcttagataaggggtggcccatctccaagatggacatcggggtgcctctcctagccctggggtgctatagccaggtaaatccacccaccctcatcgccgcggtcctgatgcttgtggcccactacgccatcatcggccccggcctacaggccaaggccacccgcgaggcgcagaagcgtaccgcggctgggatcatgaagaaccccacggtcgacggcatcgtggccatcgatttagaccccgtggtttatgacgctaaatttgagaagcagctgggccagataatgctcctgatcctgtgcacctcacagatactcagtatgaggaccacctgggctttgtgcgagtccatcacgctagccaccggcccactcaccaccctgtgggaagggtcaccggggaagttctggaacactactatagccgtgtcaatggcgaacatcttccggggcagctatctggccggggcgggcctggccttcccgctgatgaaaagcctagggggtggccgccgcgggaccggcgcccagggggagacactcggcgagaagtggaagcgccaactgaaccagctttccaaaagcgagttcaacacatacaagagatccgggattatggaggtcgatcgcagcgaggctaaggaaggcctcaagcgaggggagacgactaagcacgcggtttcacgagggaccgctaagctgcggtggttcgtcgaacgcaacctggtcaagccggagggcaaggtcatcgacctcgggtgtggccgcgggggctggagctactattgcgcaggtctgaagaaggtgacggaggtgaaggggtacaccaagggagggcccggccacgaggagcccatacctatggccacctacgggtggaacctggtcaagttacactccggtaaggacgtgtttttcacaccacccgagaaatgcgacacgctattatgtgacatcggcgagagctccccgaatccgacgatagaggagggaaggacgctaagagtactaaagatggtggagccttggctccgcggaaaccaattctgcataaagattctgaacccctatatgcccagcgtagtggaaaccctcgagcagatgcagcggaagcacgggggcatgctggtccgaaacccgctgtcccgcaattctacgcacgagatgtactgggtgtcctgtggtaccgggaacatcgtgagcgccgttaacatgacttccagaatgttacttaatcgcttcaccatggcgcatcgaaaacctacctacgaacgcgacgtggacctgggcgccgggacgcggcacgtcgctgttgagccggaggttgcaaacttagacatcatcggccagaggatcgagaacatcaagaacgagcataagagtacctggcactacgacgaggacaacccctacaaaacctgggcctatcacggatcgtatgaggtcaagccgtcaggctccgccagcagcatggtgaacggcgtggtgcggctcctaaccaagccctgggacgtgattccgatggtaacgcagatcgccatgaccgataccacaccctttgggcagcagcgcgttttcaaagagaaggtggacacgcggacccccaaggccaagcgcggcaccgcccagatcatggaggttactgctcggtggttatgggggttcctgagcaggaacaaaaagccccggatctgcacgagggaggagttcacacggaaagtcaggagcaacgcagccatcggcgccgtgttcgtcgacgagaaccagtggaactccgccaaagaggcggtagaggacgagcggttctgggacctggtgcacagggaaagggagctacacaagcagggtaaatgcgcaacctgcgtgtacaacatgatgggcaagcgcgagaagaagctgggcgagttcggtaaagccaaaggctctcgggccatctggtacatgtggctgggggcccgcttcctcgagttcgaggcgctgggtttcatgaacgaggatcattggttctcacgcgagaacagcttatccggggtcgagggcgagggtttacataagctgggttacatcctacgggacatctcgaagatcccaggcgggaacatgtacgcggacgacactgccggctgggacacgcgaattaccgaagacgacctacagaacgaggccaagatcacggacatcatggagccggaacacgccctgctggcgacctcaatcttcaagctcacgtaccagaacaaggtcgtgcgggtgcagcgcccggcgaagaacgggaccgtgatggacgttatttcccggcgcgaccaacgcgggtccggccaagtcgggacctacgggctgaacacctttacgaacatggaagtacagcttatccgccagatggagagcgaggggatattctcccccagcgaactagagacccccaacctggcagaacgcgtgctagactggctcgagaagcacggcgtcgagcgcctgaaacggatggccatttcgggcgatgactgcgtggtgaagcctaccgatgatcgctttgccaccgcgttaacggccctaaacgatatgggtaaagtccggaaagatatcccccagtgggagccaagcaagggctggaacgactggcaacaggtgccgttctgctcccaccatttccaccaactgattatgaaggacgggcgggagatcgttgtcccttgccggaaccaagatgagctggtgggtcgggcccgtgtctcgcaaggagccggctggagcctgagagagaccgcttgcctgggcaagtcctacgcgcagatgtggcagctgatgtacttccaccggcgggatctccggctggccgccaacgccatctgctcggcggtccccatagactgggtgccaacctcccggactacgtggagcatacatgcccaccaccaatggatgaccaccgaggatatgttgtccgtctggaaccgagtctggatcgaagagaatccctggatggaggacaagacccatgtgtcttcctgggaagacgtgccatacctgggtaagagggaggaccagtggtgcggcagccttatcgggctgacggccagagccacctgggccaccaatatccaggttgcgatcaatcaggtccggcggctcatcgggaacgagaactacctggactacatgacctccatgaaaagattcaaagacgaaagcgacctggagggagccctatggtga

SEQ ID NO: 24645 - RNA, 9879 nt, synthetic construct
  misc_feature 1..9879: note = derived and/or modified CDS sequence (opt11) from DENV-1__HQ624983__SS-prME
  source 1..9879: mol_type = other RNA
agcgtgaccatgctgttaatgctggtgcccaccgccctggccttccacctcaccacccgagggggggagccgcacatgatcgtaagcaagcaggagcgaggcaaaagcctgcttttcaagacgagcgctggggtaaacatgtgcaccctgatcgccatggacctgggcgaattttgtgaggacaccatgacctacaagtgcccccgaatctcggaggccgagcccgacgatgtcgactgttggtgtaacgccaccgacacctgggtgacctacgggacctgcagccagaccggagagcaccgtagggataagaggagcgtggccctcgcgccccacgtcggactcggtctggaaacccgaaccgagacttggatgtcgtctgagggcgcctggaagcagattcagcgggtggagacctgggcactgcgccatcccgggttcaccgtcatcgctctctttttggcgcatgccatcggcacctccatcactcagaaggggattatcttcatccttctaatgctcgtcacgccatctatggctatgcggtgcgttggcataggctcccgcgacttcgtcgaaggactgagcggagctacctgggtcgacgtggtgctcgagcacgggtcctgcgtcacgactatggccaaggacaagccaaccttagacatcgagctgttgaagaccgaggtgacgaaccccgcggtgctgcggaagctgtgtattgaggctaaaatcagcaacaccaccaccgactcacgctgcccaacgcagggggaggccacgcttgtcgaggagcaggacgccaacttcgtatgtcggcgtaccttcgtggataggggttgggggaacgggtgcgggctcttcggcaaaggcagcctgatcacctgtgccaagttcaagtgcgtcacgaagctcgagggcaagattgtgcagtacgagaacctgaagtactccgtcatcgtcaccgtacacaccggcgaccagcaccaggtcgggaacgagagcacggagcacggaacgacggcgaccataacgccccaggctccctctactgagatccagcttacggactatggggccctcacactggactgcagccccaggacgggtctggactttaacgagatggtgctcctgactatgaaggagaagtcctggctggttcataagcagtggttcctcgacctgccgctcccttggacgtccggggccagcacatcccaagagacctggaaccggcaggatctccttgtcacgttcaagacggcgcacgcgaagaagcaggaagtggtggtgttaggcagccaggaaggcgccatgcacaccgccctcaccggggctaccgagatccaaacgtccggcaccaccacgattttcgcggggcacctgaagtgtcggctgaagatggacaaactcactctgaagggcatgagctacgtgatgtgcaccggttcattcaagctggagaaggaggtggcagaaacccagcacggcacggtcttagtccaaatcaagtacgagggcacggacgccccctgcaagatccccttcagcacgcaggacgaaaagggggttacccagaatggccggctgatcacggccaacccgatcgtcacggataaggagaaaccagtgaacatagaggccgagccgcccttcggggagtcgtacattgtgataggcgcgggtgagaaggccctgaaattaagctggttcaagaagggctcctctatcggcaagatgttcgaggccaccgcccgcggggcccggcgcatggcgatcctcggtgataccgcttgggacttcgggtccataggcggtgtcttcacgtccgtggggaagttagtgcaccagatcttcggtacggcctacggggtcctgttctccggcgtgtcatggaccatgaagataggtatcggcgtgctcctgacctggcttggcttaaattcccgaagtacatccctgagcatgacgtgcatcgccgtcgggttggtgactctctatctgggcgtgatggtccaggccgacagcgggtgcgtgataaactggaagggccgggaattgaagtgtgggtccggcatcttcgtgaccaacgaagtccacacttggacagaacaatacaagttccaggcggactcacctaagcgcctctccgccgcgatcggcaaagcctgggaggagggtgtctgcgggattcggagcgcaacccgcctggagaacatcatgtggaagcagatctccaatgagctgaaccacattctgctggagaacgatatgaagttcaccgtagtcgtcggagacgtggcgggcatcctggcgcaggggaagaagatgatccggccgcagccgatggaatacaagtatagctggaagtcctggggaaaggcgaagatcatcggcgctgacgtccagaacacgacttttatcatcgacgggcccaacacgccggagtgccccgacgaccagcgcgcgtggaatatctgggaggttgaggactacggcttcggtatcttcacgacgaacatttggctcaagctccgggacagctacacccaagtgtgcgatcaccgcctgatgtccgccgcgatcaaggacagcaaggcggtccacgcagacatgggctactggattgagtctgagaagaatgagacgtggaaactagccagggcgagctttatcgaagtgaagacatgcatctggcccaagtcccacaccctgtggagcaacggcgtgttagagtccgagatgattatacccaagatctacggtggcccgatcagccagcacaactaccggcctgggtacttcacccagacggcaggcccctggcacttaggtaaactggagctggacttcgacctctgcgaaggcaccaccgtagtcgttgacgagcactgcgggaatagggggccaagcctgcgcaccacgacggtcaccggcaagatcatccatgagtggtgctgtcggagctgcaccctgccgcccttacgcttcaaaggggaggacggctgctggtacgggatggagatacggcccgtgaaggagaaggaggaaaacctggtcaagagcatggtctccgctggcagcggtgaggttgactccttcagcttgggactcctctgcatatccatcatgatcgaggaggtaatgcgctcacgttggtcccgcaagatgttgatgacgggtacgctcgcagtcttcttcctgctgatcatggggcagctcacctggaacgaccttatccggctgtgcatcatggtgggcgcaaacgcctctgaccgcatggggatgggcatgacctacctcgccctgatggcgaccttcaagatgcgccccatgtttgcggtgggactgctgttccggcgcttaaccagtcgggaggtcctactcctgaccatcggtctgagcctcgtggcgtctgtcgaactgcccaatagcctggaggaactcggcgacggactggctatgggcattatgatcctgaagcttctgaccgactttcagtcccaccagctgtgggccacgctactgagcctgaccttcatcaaaaccaccttctccttgcactacgcctggaaaaccatggcgatggtgctgtcgattgtgagccttttcccgctctgcctttccaccacctcccagaagaccacgtggctgccggtactccttgggagcctggggtgcaaacccctcaccatgttcctgatcgccgagaataagatttggggacgcaagagctggcccctgaacgaggggattatggcggtggggatcgtatccatactcctgagcagtcttctcaagaacgacgtcccccttgcggggcccctgatcgcaggcggcatgctcattgcgtgctacgtgatcagcgggtccagcgcggacctaagcctggagaaagcagccgaggtgagctgggaggaagaagcagagcactccggcgcgagccacaacatcctcgtcgaggtgcaggacgacgggaccatgaagatcaaggatgaggagcgggacgacaccctgacaatcctgctcaaggcgactctgctggccgtgtctggggtctacccgctcagcatccccgccaccctgtttgtgtggtacttctggcagaagaagaagcaacgttccggggtcctgtgggacactccctcaccgcccgaggtcgagcgtgcggtgttggacgacggcatctacaggatcatgcaacggggtcttctggggcgatcccaggtgggtgtcggggtgtttcaagagaacgtgttccacacaatgtggcacgtcacgcggggcgcggtgttgatgtaccaggggaaacgcctcgagccaagctgggcctccgtcaagaaggacttgatcagctacgggggcgggtggagactgcagggctcctggaacaccggggaggaggtccaggtgatagccgtggagcctggcaaaaacccgaagaacgtccaaaccgcccccgggaccttcaagacgagcgagggcgaggtgggcgcaatcgcgctcgatttcaaacccgggacaagcggctcccccatcgtgaaccgcgagggtaaaatcgtcggcctatacggcaacggggtggtaaccaccagcggcacgtacgtctccgccatcgcccaagctaaggcaagccaggagggccccctgccggagatcgaggacgaggtatttagaaaacgcaacctcaccatcatggatctgcaccccggctccgggaagaccaggcgctacctgcccgccatcgtccgcgaggccatcaagcgcaagttacgaacactcatcctggcccctacgcgggtcgtcgccagcgaaatggctgaggccctgaagggcatgcccatccgctaccagaccaccgccgtgaagtccgagcacacagggaaagagatcgtcgacctgatgtgtcatgccactttcacgatgcggctgctcagccccgttcgtgtgccgaactacaacatgatcataatggatgaggcccacttcactgacccttccagtatcgcggctagagggtacatcagtacccgcgtcggcatgggggaggcagccgccatctttatgacggcaacgccgcccgggagcgttgaggccttccctcagtccaatgccgtcatccaggacgaagaacgtgacatcccggagcgcagctggaactccggctatgagtggataaccgacttcccaggcaagaccgtatggttcgtgcccagcatcaagtccggaaacgacatcgcaaactgcctgcgaaagaacgggaagcgcgtcatccaactgagccggaagacgttcgacaccgaataccagaagactaagaacaacgactgggactatgtggtgacaacggacatatccgagatgggcgcgaactttcgcgccgaccgcgttatagatccccgccggtgcttaaagccggttatcctgaaggatgggcccgagagagtcatcctggccggtcctatgcccgtcacggtggcctccgccgcgcaacgacgcggccggatcggccgcaatcacaacaaggaaggcgaccaatacatctatatgggacagcccttaaacaatgacgaggaccacgcccactggactgaagccaaaatgctgctcgacaacataaacaccccagagggcataatccctgccctcttcgagcccgagcgggagaagtccgccgcaatcgacggcgaataccgcctgcgcggcgaggcccggaagacgtttgtggagctgatgcgcagaggggatctcccggtctggctgtcatacaaggtggccagcgagggattccaatactccgaccgccgctggtgcttcgatggcgagaggaacaaccaggtcttagaagagaacatggacgtcgagatctggacaaaggagggggagcggaagaagctccgcccgcggtggctggacgcgcgcacgtactcagaccccctggccctgcgtgagttcaaggagtttgcggcgggccgccggtccgtgagcggggatctgattctggagatcggaaagctcccccagcacctaacccagcgggcccagaacgccctggacaatctcgtgatgttacataactccgagcagggcggccgggcgtatcgccacgcaatggaagaactgccggacacgatcgagacgctcatgctattggccctcatcgccgtcttaaccgggggagtgacgctgttcttccttagcggccgggggctgggtaaaacgagcattggactgttgtgcgtgatggccagctcagtactcctgtggatggcgagcgtggagccccactggatcgccgcctccatcattctcgagttcttcctgatggtgctcctcatccccgagcccgaccgccagagaaccccgcaggataaccagctcgcctacgtcgtaatcgggctcctctttatgatcttaaccgtagcagcgaacgaaatgggcctgctcgaaacaaccaagaaggacctcggcattggccacgtcgccgtcgagaaccaccaccacgccgccatgcttgacgtagatttgcaccccgccagtgcgtggacgttgtatgccgtcgctaccaccatcattactccgatgatgagacacactatagagaataccaccgccaacatctccctgaccgccatcgcgaaccaagccgctatcctcatggggctggacaagggctggccgatttccaaaatggacatcggcgtgcccctgctcgccctagggtgctactcccaggtgaaccccctcacgctaaccgcggccgtcctgatgctggtggcccactacgcaatcatagggcccggactgcaggccaaggcgacccgggaggcacagaagcgcaccgccgccggcatcatgaagaacccgactgtggacgggatcgtcgctattgatctcgaccccgtcgtgtacgacgcgaaatttgaaaagcagctgggccaaatcatgctcctgatcctgtgcaccagccaaatcctacttatgcgcaccacttgggccctgtgtgagtctatcacgctagcaaccggaccactgaccaccctgtgggagggatctcccggaaagttctggaacacgaccatcgccgttagcatggcaaacatcttccgagggtcctacctcgcaggagccggcctagcctttagcctgatgaagtctctcgggggcgggcgacggggcaccggggcccagggcgagaccttgggcgagaagtggaaacgccagctgaaccacctcagcaagtccgaattcaacacatacaagcgcagcgggataatggaggtggacagatccgaggctaaagaaggcctgaagcgcggggagaccacgaaacacgccgtgagccgcggaaccgccaagctgcgatggtttgtcgagagaaacctcgtgaaaccggagggtaaggtgatcgacctgggctgcggccgcggcggatggagctactactgcgccggcctgaagaaggtcacagaggttaaggggtacacaaagggcggccccggccacgaagaacccattcccatggcgacttatgggtggaacctggtgaaactccacagcggcaaggatgtcttcttcgtgccgcccgaaaagtgcgacaccctgctgtgcgacatcggggaatccagcccaaaccccactatcgaagagggccgcaccttacgggtcttgaagatggttgagccttggctacgtgggaaccagttttgcatcaaaatcttgaacccctacatgccctccgtggtggagaccctggagcagatgcagcggaagcacggcggcatgctagtccgcaatcccctcagcagaaactccacccacgagatgtattgggtgagctgcgggactggcaacatcgtgtccgctgtcaacatgaccagccgcatgctgctgaatcgtttcacaatggcccatcgcaagccgacatacgagcgcgacgtggatctaggcgcgggaacccggcacgtggcagtcgagccagaggtggccaatctggacatcatcggccagagaatcgagaatatcaaacacgagcacaagtccacctggcattacgacgaggacaacccatataagacttgggcgtaccacgggagctacgaagtcaaaccctcaggcagcgccagctccatggtgaacggcgttgtgaaactgttaaccaagccttgggatgttatcccgatggtgacccagatcgcaatgacggacaccacccccttcggccagcagagggtcttcaaggaaaaggtggataccagaacgcccaaggcaaagcggggaacagcccagatcatggaggtcaccgcgaaatggctttggggcttcctgagccgcaataagaagccgcggatctgcacccgagaagaattcacgcggaaagttagatccaacgccgccatcggcgccgtgttcgtggacgagaaccagtggaacagcgcgaaagaggccgtcgaggacgagcggttttgggacctcgtccacagggagcgcgaactgcacaagcaggggaagtgcgcgacctgcgtgtacaacatgatgggtaagcgcgagaagaagctgggcgagtttggaaaggcgaagggaagtcgggccatctggtacatgtggctgggcgcgcgcttcctggagttcgaggcactgggctttatgaacgaggaccattggttcagccgcgagaattccctcagcggggtggagggcgaggggttgcacaagctgggctacatcctccgcgacatcagtaagatcagcgggggcaacatgtacgcagacgacaccgccggctgggacaccaggatcacggaggatgatttgcagaatgaggcaaaaattaccgacatcatggaacccgagcacgcgttgctggccaactccatcttcaaactgacctaccagaataaggtcgtgcgtgtccaaagaccggcgaagaatggaaccgtgatggatgtgatttcccgccgcgatcagcgcggctccgggcaggtaggcacgtacggcctgaacaccttcaccaacatggaggcccagctcatccgccaaatggagtccgaggggatcttcagcccgagcgagctggagacccccaacttagcggagcgggtgctcgattggctggaaaagtacggcgtagaacgcctgaagcggatggctatcagcggagacgactgcgtggtgaagcccatagacgaccgcttcgccacggccctcacagccctgaacgacatgggcaaggtgagaaaggacataccacagtgggagccgtccaaggggtggaacgactggcaacaggtccccttctgttcccaccacttccaccagctgataatgaaagacggcagggagatcgtagtgccctgccggaaccaagacgagctcgtcggccgcgctcgggtgtctcagggggcgggctggtccctccgtgagaccgcatgcctggggaagtcctacgcccaaatgtggcagctaatgtactttcacagacgcgacctgcggctggccgcgaacgccatatgttcagcagtgccagtcgactgggtgccgacctcccgcacgacctggagcatccacgcccaccaccaatggatgaccgcggaggacatgctctccgtatggaaccgggtctggatcgaggaaaacccctggatggaagacaagacccacatcagctcctgggaggatgtgccgtacctcggcaagcgggaggaccagtggtgcggaagcctgatcggcctcacggcgagggccacctgggccaccaacatccaggttgccattaaccaggtccgtcgcctgatcggcaacgagaattacctggactacatgacctccatgaagcggttcaagaacgaaagcgaccctgagggggccctctggtga

SEQ ID NO: 24646 - RNA, 9879 nt, synthetic construct
  misc_feature 1..9879: note = derived and/or modified CDS sequence (opt11) from DENV-1__FJ384655__SS-prME
  source 1..9879: mol_type = other RNA
agcgtcacaatgcttctcatgctgctaccaacggccttagcattccatttaactacccgcggtggcgaaccgcacatgatagtaagcaaacaagagcggggcaaatccctgctattcaaaacatcggcgggcgtaaacatgtgcacgctgatcgccatggatctaggggagctctgcgaagatacaatgacctacaaatgcccacggataacggaagcggaaccggatgatgtggattgctggtgcaacgcaaccgacacgtgggtaacctacgggacctgcagtcaaacgggagagcacaggagagacaaaaggagcgtggccctcgcaccacatgttgggctaggattagaaaccaggaccgagacatggatgtcgtcggaaggcgcatggaaacagatacagaaggtggaaacatgggcactccgccacccaggattcaccgtgatagcactcttcctagcccatgccattggaaccagtataacccaaaagggcataatattcatactactaatgttagtaactccctcaatggcgatgcgttgcgtaggtattggaaatagggacttcgtcgaagggctaagcggggcaacttgggtagacgtagtgctagagcacggctcgtgcgtaacaacgatggcgaagaataagcccactctggacatcgagctcttaaagacagaggtaactaaccctgcagtgctccgcaaattatgcattgaagcaaagataagcaacacaacgacagattctcgatgcccgacccaaggcgaagcaacgctcgtggaagagcaggacgctaacttcgtctgccgacggacattcgtggaccgtgggtgggggaacggatgtggcttgttcggaaaaggtagtttacttacgtgtgccaagttcaaatgcgtcaccaaactcgagggcaaaatagtccaatatgaaaacctcaagtacagcgtcatagtcacagtacacacgggagatcaacatcaggtcggaaacgagacgaccgagcacgggacaatagctacgataacgccgcaagccccaacgtccgaaatacaactgacggactacggcgcacttacactggattgctccccaaggacggggcttgacttcaacgaaatggtactacttacaatgaaggagaagagctggctcgtacacaaacaatggttcttagatttacccctcccatggactagcggggccagcacttcacaagaaacgtggaaccggcaagacctcctcgtcacgttcaaaacggcgcacgcaaaaaaacaagaagtggtcgtgctgggaagccaggaaggggcgatgcacacggcactcactggagctacggagatacagaccagcggcactacaacaatattcgccgggcacttaaagtgccggctcaaaatggacaagttaacccttaaaggaacgtcgtatgtcatgtgcacgggaagctttaagctcgagaaggaggtcgcggaaacacaacatgggaccgtactcgtccaggtcaaatacgagggtaccgatgccccgtgcaagatacctttttcaacacaggacgaaaagggcgttacacaaaacggacggctcataacagccaaccccatcgtcactgacaaggaaaagccagtcaatatcgaaaccgagccacctttcggtgagtcatatatagttgtcggggcgggagagaaagccctaaagttgagctggttcaaaaaaggatctagcataggaaaaatgttcgaggccaccgcacgaggagcgaggaggatggcaatacttggcgataccgcatgggatttcggctcaatcggcggcgtatttacgtccgtcgggaaactagtccaccaggtttttggtacggcatacggcgtcctgttctctggagtctcgtggacgatgaaaatcggaataggtatcctactgacctggcttggcctcaacagcaggagcacgtccttgtcaatgacctgcatagcagtaggcatggtaacactgtacctgggcgtcatggtccaagcagactcaggatgtgtaataaactggaaaggcagagaactgaaatgcgggtcgggcatcttcgttacaaacgaagtccatacatggacggaacaatacaaattccaagcagattcacctaaacgcctgtccgctgccattgggaaagcttgggaagagggagtttgtgggataaggagcgcaaccaggcttgaaaatataatgtggaaacaaatatccaacgagctcaaccacatcctcctcgagaacgacatgaaattcacggttgtggtcggggatgcaaacgggatcctagctcaaggcaaaaaaatgatcagaccgcagcccatggaacacaaatatagttggaaatcctgggggaaggctaagataatcggggcagatatacagaatacgacctttataatagacggtcccgataccccggaatgcccggatgagcaaagggcatggaacatctgggaggtagaggactacggattcgggatattcacgacaaatatatggctgaaactgagggactcctacacacaaatgtgcgaccaccggctcatgagcgcagcaataaaagacagcaaagccgttcacgctgacatggggtactggatagagtccgaaaaaaacgagacctggaagctggcccgtgcgagttttatagaagtaaaaacttgtatctggccgaaaagccacaccctctggagcaacggcgtcctcgaatcagagatgatcataccgaaaatatacggcggaccgatttcccaacacaactacagacccggatactttacacaaacagcggggccatggcacctaggtaagctcgaactggacttcgacctgtgcgaaggcaccacagttgtggttgacgaacactgtggaaaccggggaccaagcctaaggacgacgacagtgacagggaagataatacacgagtggtgctgccgaagctgcacactcccgccgctccgttttagaggagaggacgggtgttggtatggcatggaaatccgaccggtgaaagagaaagaagagaacctggtacgcagcatggtgtcggcgggctcaggtgaagtggattccttctcactgggcatcctatgcgtctcaattatgatcgaggaagtaatgcgatcacgatggtccaggaaaatgctgatgaccggaaccctagcggtctttctgcttctaataatgggccagcttacatggaacgatctcataagactgtgcattatggtcggggcaaatgcctcagacaagatgggaatgggcactacgtacctagcactaatggcgacattcaagatgcggccgatgtttgctgtaggcctactattcagaaggctggcgtcgagagaggtgttactccttacgatagggctgtccctcgtcgccagtgtggaactgccaaatagcctagaggaactgggagatgggctcgcgatgggaatcatgatgctgaagctactgacagaattccaaccacaccacctttggactaccctactctccctcacctttataaagacaacgttatcgctggactacgcatggaagacgacagctatggtcctgtcaatagttagcctatttccactatgtctcagcaccacctcgcaaaaaacgacatggctgccagtgttgctggggagtttcggatgcaaaccacttacaatgttcctcataaccgaaaacaagatatggggcagaaaatcctggccactcaacgaaggcataatggcaataggaattgtttccatcttactatcaagcttattaaagaatgacgtcccactagcgggcccgttgatcgctggcggaatgctaatagcatgctatgtaatcagtgggagctccgcagatctatccctagaaaaggccgccgaagtgagctgggaagaagaagcggaacactcgggcacgtcccacaacatattggtcgaggtccaagatgacggggcgatgaaaattaaggacgaagaacgggacgatacccttaccatactattaaaagctacgctactcgcggtaagtggtgtctaccccatgtcgattccagctacattatttgtctggtatttttggcaaaagaaaaaacagagatcaggggtgctatgggacacaccctccccccccgaagtcgaaggggccgtgctcgacgacgggatttatcggattttacagcgtgggctgttagggcgtagtcaggtcggcgtcggcgtgttccaagacggggttttccataccatgtggcacgtcacccgaggtgccgtgcttatgtaccagggaaaacgactagagccaagttgggcgtcagtgaagaaagacctaatatcatacgggggagggtggaggtttcaggggtcatggaacacaggagaggaagtacaagtaatagcggtcgagccaggaaaaaacccgaagaacgtgcagacaacacccggaacattcaaaacaccagaaggggaggtaggcgctatcgcgctagattttaaaccgggcactagcggctcaccaatagtaagtagggagggaaagatagtagggctatatggcaacggagtggtgaccaccagcgggacctatgtcagcgcaatcgcgcaggcgaaggcgagccaggaagggcctctccccgagatagaggatgaagtgtttaagaaaagaaacctaaccataatggacctgcatccaggaagtggcaagaccaggaggtacctaccagcaatagtcagagaagccataaagcggaagctaaggactctgatcttagcgcccactcgcgtagtcgcctccgaaatggcagaggcgctgaaagggatgccgataaggtaccagactacagccgtcaagtccgaacacaccggacgtgagatcgtggaccttatgtgtcacgcgaccttcacgatgcgcctgttgtccccagtgagggtgcctaattataacatgatcattatggacgaggcccatttcacagacccagcctctatcgcagcacgcggatatatctccacacgagtcggaatgggtgaggcggcggcaattttcatgacagcgacgccaccgggcagcgtggaagcattcccccaatcaaacgcagtaatccaagacgaggagcgggacatccccgaacgctcatggaacagcggctatgactggataacagatttccccggaaaaacagtgtggttcgtgcccagcattaaatccgggaacgatatagcgaactgccttagaaaaaacggcaagagagtaatccaattatcacgaaaaacattcgataccgaataccagaaaacaaaaaacaacgattgggattatgtcgtaacgacagacataagcgaaatgggggccaactttcgtgccgaccgagtgatcgacccacgacgctgcctgaagccagtcatcttaaaggacggaccggagagggttatactcgccggaccaatgccagttaccgtagcatcagcagcacagagaagagggaggatcgggaggaatcagaacaaggagggcgaccagtacgtttatatggggcagccactgaacaacgacgaagaccacgcacactggaccgaagcaaaaatgctgctcgacaatataaacacacccgagggtataataccggcactcttcgaaccggagagagagaaatcggcagcaatagacggcgggtaccgccttcgcggtgaagctagaaaaacattcgtagaactaatgagacggggagacttacccgtctggttaagttacaaagtcgcgagcgaaggtttccaatacagtgaccgacgatggtgcttcgacggagaacggaacaaccaggtgctggaagagaacatggacgtggagatctggacgaaggagggagagagaaaaaaactccgaccccgctggctggacgctagaacatatagcgatcccctcgccttacgcgagttcaaagaattcgcagcgggaaggcgaagcgtctcaggcgacctaatcctcgaaataggaaaactccctcaacacctgacgctaagggcgcaaaacgcacttgataacctggtcatgctacacaacagcgagcaaggcgggaaggcatataggcacgctatggaggaattgcctgacaccatagaaaccctaatgctgctggccctaatagcagtgctcaccggaggagtgacattgttcttcctgtctggaaaaggacttggcaagaccagtatcggactcctatgtgtcacagctagcagcgcgttactctggatggccagtgttgaaccccattggatcgccgcgagtatcatattagaattcttcctaatggtactactcatacccgagccagaccgacagaggacacctcaagacaaccaactagcatacgttgtcataggactgctattcatgattctaactgttgcagcaaacgagatgggactactcgaaacgacaaagaaagacctaggcatagggcacgttgccgccgaaaaccaccaacacgcaactatgctggatgtagacctaagaccggcttcagcctggacgctatacgcagtcgcaacgaccgtcataacaccaatgatgcgacatacgattgagaatacaaccgctaacataagcttgacggcaatagccaaccaagcagccatcctaatgggactcgacaaagggtggcctatctcaaagatggacataggagtaccattactcgcactcgggtgctactcccaagtcaatccacttaccctaacagcagcagtcctcatgttggtagcccactacgcaatcatagggcccggattgcaggctaaggcaacccgtgaagcacagaagcgaactgcggcgggcataatgaagaaccctacagtagacggaatcgtagcaatagacctagaccccgtagtgtatgatgcgaagtttgaaaaacaactgggacaaatcatgctcttaatactgtgcacgagtcagatcctcctgatgagaacgacgtgggccctgtgcgagtcgataactcttgcaactggaccgctgactaccttatgggagggctcaccaggcaagttctggaacaccacgatcgcggtgtctatggccaacatttttagagggtcctacctcgctggggcagggctagcattcagtctgatgaagtcacttggaggtggaagacggggtaccggggctcaaggcgagactctaggggagaagtggaaaaggcagctaaaccaactttccaaatccgaatttaacacatacaagaggtcaggtatcatggaagtagacaggtccgaagcgaaagaggggctaaaacggggagaaacaaccaaacacgcggtcagtcgaggcacggcaaaattgcggtggttcgtcgagcgcaatctcgtgaagccggagggaaaggtaatagacctagggtgtgggcggggcggatggtcatactactgtgcaggactaaaaaaagtcaccgaggtcaagggctacaccaaggggggacccggccacgaggaaccagtacccatggccacgtacggctggaacctagtaaagctacattccggcaaagacgttttttttatgccacccgaaaaatgcgatacgctactgtgtgacataggagaatccagcccaaaccctaccatagaagaaggtcggacactgcgggtactcaaaatggtggaaccctggctacggggcaatcagttttgtattaagattctaaatccgtacatgccgagtgtcgtggagacactagagcaaatgcaaaggaagcacggtggcatgctcgtcaggaacccgctgtccaggaatagtacccatgaaatgtattgggtgtcatgcgggacaggcaacatagtatcagccgtgaacatgacttcgagaatgctgctaaacagattcactatggcccatcgcaagccgacgtacgaacgtgacgtggacctaggcgcgggaacgcgacacgtagctgtagagcccgaggtcgcgaatctggatataattggacaaagaattgagaacatcaaaaacgaacacaagagcacgtggcactacgacgaagacaacccatataaaacatgggcctaccacgggtcgtacgaagtcaaaccaagcggcagcgcctcgagcatggtaaacggagtagtccgactgctgaccaaaccttgggatgtaataccaatggtgacccaaatcgctatgaccgacaccacaccattcgggcagcagcgagtatttaaggaaaaagtagacacccgcacaccgcgagcaaagagagggactgcacaaatcatggaggtgactgcgaagtggctttggggcttcctgagccgcaacaaaaaacctcggatatgcactagagaggagttcaccagaaaggttagatcaaatgcggccatcggcgcagtgttcgttgacgaaaatcagtggaattccgcaaaagaagccgtagaggacgaacgtttctgggatctagttcaccgcgaacgggaactacacaagcagggaaagtgcgcaacgtgcgtatacaacatgatgggaaagcgcgagaagaaactcggcgaattcggcaaggcaaagggcagtagggcgatctggtacatgtggctaggagcccgattcctcgagttcgaagcactaggattcatgaacgaagatcactggttcagtcgcgaaaactccctcagtggtgtggagggcgaggggctgcacaaactaggatacatattgagggacatcagtaaaatacccggcggaaacatgtacgccgacgatactgcagggtgggatacccgcataacggaagacgatctgcaaaatgaggcgaagatcaccgacatcatggaacctgaacatgccctgcttgcaaccagcatattcaaactgacttatcagaacaaagtcgtgagagtccaaaggcctgccaagaacggcacggtcatggacgtgatcagcagaagagaccagcggggatctgggcaggtcggaacatacgggcttaatacattcacgaacatggaggtacaactcatcagacaaatggaaagcgaaggcatattccttccgtcagaactcgagacaccgaacctggcagagcgggtgttagattggctcgaaaagcacggggcagaacgcctcaagcggatggcgatatcgggcgacgattgtgtggtaaaacctattgatgacaggtttgccacggcattgatcgccctgaacgatatggggaaagtcagaaaagacataccccagtgggagccttcgaaaggatggaacgactggcaacaagtgccattctgcagccatcacttccaccaactcataatgaaagatggtagggaaatagtcgtgccctgccggaatcaagatgaactggtcggccgtgcaagagtgagtcaaggggcggggtggagcctcagagagactgcgtgcctgggaaaatcatacgcacagatgtggcaactaatgtactttcatcggagggacctcagattagccgctaacgcaatctgcagtgccgtacccgtagattgggtccccacctctaggacaacttggagtatacacgcgcaccatcagtggatgacgaccgaagacatgctctcagtgtggaaccgcgtatggatcgaggagaatccgtggatggaagacaaaacccacgtctcgagctgggaggaagtcccctacctgggaaagagagaggatcagtggtgtgggagcctaatcggcctaactgcacgggccacatgggcaaccaacatacaggtagccatcaaccaagtgcgacgcctcatagggaacgagaattacctcgattacatgacctctatgaagcggttcaaaaacgaaagcgatcctgagggcgcgttatggtaa

SEQ ID NO: 24647 - RNA, 9879 nt, synthetic construct
  misc_feature 1..9879: note = derived and/or modified CDS sequence (opt11) from DENV-1__KC759167__SS-prME
  source 1..9879: mol_type = other RNA
tcggtgaccatgctgctcatgttaatgcccacggccctggccttccacctcacaacccgaggcggggagcctcacatgatcgtgagcaagcaagagcggggcaagtcactgctgtttaagacctctgccggggttaatatgtgtacgctcatcgccatggacttgggcgaactttgcgaagatacgatgacctacaagtgtccacggatcactgaggccgagcccgacgacgtggactgctggtgcaacgccaccgacacgtgggtcacgtacgggacctgcagtcagaccggcgagcacaggcgcgacaagagaagcgtggccctcgctccccacgtggggctggggctagagacgaggaccgagacttggatgtcatcagagggcgcctggaagcagattcaacgggtcgaaacatgggcactccgccacccggggttcacggtgatcgccctgtttttagcgcatgcgatcggcacaagcgtgacccaaaaggggatcatctttatactcctgatgctggtcacgccctcaatggccatgcggtgcgtgggcattggctcaagggatttcgtggaaggactttccggcgccacatgggtcgatgtcgtgcttgagcacgggtcttgcgtcaccaccatggccaaggacaagcctacccttgacatcgagctcctaaagacggaagtgaccaaccccgccatcctgaggaagctctgcatcgaggctaaaatctccaacaccaccaccgacagccgctgcccgacccagggtgaggcgcccgaggttgaggagcaggacgccaacttcgtgtgccggcgcaccttcgtggaccggggctgggggaatggctgcgggctgttcggcaaggggtctctgattacgtgtgccaagttcaaatgtgtgacgaaacttgagggcaagattgtccagtacgagaatctgaagtacagcgtgatcgtgacggtccataccggcgaccagcatcaggtgggaaacgagtccactgagcacggcacgacagctaccataacgccccaggcccctaccacggagatccagctcacagactacggtgccctcacgctggattgctctccgcgcactggcctggacttcaatgagatggtcctcctcacgatgaaggagaagtcctggctagtacacaagcagtggttcctcgacctgcccctgccgtggaccagcggggccagcacctcccaggagacctggaaccggcaggacctgctggtgacgttcaagaccgcccacgctaagaaacaggaggtcgtggtattgggctcgcaggaaggcgccatgcacacggccctcaccggggccacggagatacaaaccagcggtacaaccacgatctttgccgggcatctgaagtgccgcctcaaaatggataagctcactctgaagggcatgagctacgtcatgtgcacggggtccttcaagctggagaaagaggtggcggagacccagcacgggactgtgctcgtccagatcaagtacgagggcaccgacgccccctgtaagatccccttcagtacccaggatgagaagggggtcacgcagaacggacgtctgatcacggccaacccgatcgtgaccgacaaagagaagcccgtgaacatagaggctaagccgcctttcggggagtcctgcatcgtgataggagcgggcgagaaggcattgaaactgagttggttcaagaaggggtccagtatcggcaagatgtttgaagccaccgccaggggggcccggagaatggcgatcctcggcgacaccgcctgggacttcgggtccatcggcggcgtgttcacgtcagtcgggaagctagtccatcagatctttggcaccgcctacggggtgctgttttccggagtcagctggaccatgaaaatcggaatcggtgtgctcctgacctggctaggactaaactctcgcagcacgtccctgagcatgacctgcatcgcggtagggctagtgacgctctacctcggcgtgatggtgcaagcagactccggctgcgtcataaactggaagggccgggagctgaagtgcggtagtggcatatttgttaccaacgaggtgcacacgtggaccgagcaatacaagtttcaggccgacagccccaagcgcctatcggccgcaatcggcaaggcctgggaggagggggtctgtggcatccgtagtgccacccgcctggagaacatcatgtggaagcagatctccaacgagctgaaccacatcctcctggagaacgatatgaagtttactgtggtggtgggggacgtggcgggcatcctggcccaggggaagaagatgatccggccccagccgatggagtacaaatatagctggaagtcctgggggaaggccaagatcatcggggccgacgttcagaacactacgttcatcatcgacggacctaacacccccgagtgccccgacgatcagagggcgtggaacatctgggaggtcgaggactacgggttcggaattttcaccaccaacatctggctgaagctgcgggatagctacacccaagtttgcgaccatcgcctgatgtccgccgccatcaaggactctaaggccgtgcacgcagacatgggatattggatcgagtctgagaagaacgagacctggaagctcgcgcgggcctctttcatcgaggtcaagacatgcatctggcccaaatcccataccctgtggtcgaacggtgtgctggagtccgagatgataatcccaaagatctacgggggccccatcagccagcacaattaccgccccggatacttcacacagacagccggcccgtggcatctcgggaaactagagctggacttcgacttatgcgaggggaccaccgtggtcgtggacgagcactgcggaaacagagggccctctttacgaacgaccaccgtgaccggcaaaatcatccacgagtggtgctgccggagctgcaccccaccgcccctgcgcttccgtggcgaggacggatgctggtacggaatggagatacgccccgtcaaagagaaggaagagaacctcgtgaaatctatggtgagcgcaggctctggcgaggtcgactccttctctttggggttactctgtatctccatcatgattgaagaggtgatgcggagccgctggtcccggaaaatgctgatgaccggcgcccttgcggtgtttctcctgctgatcatgggccagttaacctggaacgacctgatccgcctgtgcatcatggtcggcgcgaacgccagcgaccgcatggggatgggcactacgtacctcgccttaatggccacctttaagatgcggcccatgttcgcggtgggactcctgttccgtaagctgacgtcccgcgaggtgctactcctgacgatcgggttgtctctcgtggcctccgtggagctgcccaacagtctggaggagctcggggacggcctggccatgggcatcatgattctcaagttgcttacggatttccaatcccaccagctgtgggccacattgctgagcctgaccttcatcaaaacgacttttagtctccattatgcgtggaagaccatggccatggtcctgagcatcgtgagtctgtttcccctctgcctgtctactacctcccagaagacaacctggctgcccgtgctcttgggcagcttagggtgcaaacccttgaccatgttcctgatcgccgagaacaagatttggggtcgccggtcctggcccctgaacgagggcatcatggccgtcggtatcgtgagcatcttactgagctccctgctcaagaacgacgttccgctggcagggcccctgatcgcgggtggtatgctcatcgcgtgctacgtcatcagcgggtccagcgctgacctgagcctggagaaggccgctgaggtgtcttgggaggaggaagcggaacactccggcgccagccacaacatcctcgtggaggttcaggacgacgggaccatgaagatcaaggacgaagagagagacgacacgctgaccattctcctcaaagccaccctgctggccgtgtccggcgtatatcccctcagcatccccgcgacgctgttcgtctggtacttctggcggaagaaaaagcagcgctccggggtgctctgggacaccccgtcgccgcctgaggtagagcgcgcggtcctcgatgacggcatctaccgcatcatgcagagggggctgttggggcgctcacaagtcggcgtgggggttttccaggagaacgtgttccacacgatgtggcacgtgacacggggcgcagtcctcatgtaccaaggcaagcgacttgagccctcgtgggcctccgttaagaaggacttgatcagttacggcggtgggtggagacttcagggctcctggaacaccggggagggcgtgcaggtcatcgccgtggaaccggggaaaaaccccaaaaacgtacagaccgcccccgggaccttcaagacccccgagggcgaagtgggggcgatcgccctggactttaagccaggcaccagcgggagtcccatcgttaaccgcgagggcaaaatagtgggcctgtacggtaacggtgtagtgacaacgagtggaacctacgtgagcgccatcgcgcaagcgaaggcctcccaggagggccccctgccggagatagaagacgaggtcttccggaagcggaacctcaccatcatggacctgcatcccgggtctggcaagacgcggcgctacttgcccgccatagttcgcgaggccatcaaacgcaagctccgcacgctcatcctggcccccacgcgggtggtagcgtccgaaatggccgaggccctcaagggcatgccaatccgctaccaaaccaccgccgttaagagcgagtacacggggaaggagatcgtggacttaatgtgccacgctaccttcaccatgcggctgctctctcccgtgcgcgtccccaactacaacatgatcattatggacgaggcgcacttcaccgacccttcttccatcgcagcccggggatacatcagcacacgcgtggggatgggagaggccgctgctatattcatgacggccacaccgccaggatctgtcgaggccttcccacagagtaacgccgtaatccaggatgaggaacgggacatccccgagcgctcttggaacagcggctacgagtggatcaccgatttcccggggaagaccgtgtggttcgtcccctccatcaagagcgggaatgacatagcgaactgcctgcggaaaaacggtaagcgcgttatacagctgtcccggaagaccttcgacaccgagtaccagaaaacaaagaacaacgactgggactacgtggtaacgaccgacatcagtgagatgggggctaacttccgtgcggaccgggtgatcgatccccggcggtgcttgaagcccgttatcctgaaggacgggccggaacgggtcatcctggcggggccaatgcccgtgactgtcgccagcgcagcccaacggcgcggccggatagggcgcaaccacaacaaggagggggaccaatatatctatatgggtcaacccttaaacaacgacgaggaccacgcacactggacagaggctaaaatgttactagataacattaacacgccggaggggatcatccccgccctctttgaacccgagcgcgagaaatcggcggccatcgacggcgagtaccgactgcgtggagaagcgcggaagacctacgtggagctcatgcgtcggggagacctccccgtgtggctgtcttacaaggtcgccagcgagggcttccagtactcagaccgccggtggtacttcgacggcgaacgcaataatcaggtgctggaggagaacatggatgtggagatatggacgaaggagggcgagaggaagaagctccgcccgcggtggctagacgcccgcacctactccgaccctcttgcgctccgggagttcaaggagtttgccgccggccgccggagcgtctccggcgacttaatcttggagatagggaaattaccccagcacctgacgcaacgcgcccagaacgcgcttgacaatctcgtcatgctgcacaacagcgagcagggcgggagagcctaccgccacgccatggaagagctgccggacacaatcgagaccctcatgcttctggccctcatcgcagtcctgaccggtggggttacgctgttcttcctctccgggaggggcctaggcaagactagcatcgggctcttatgcgttatggcgagcagcgtgctgctgtggatggcgtccgtcgagccacactggatcgccgccagcattatcctcgagttcttcctgatggttctcttgatccccgagcccgaccgccagcggacgccgcaggacaaccagcttgcctacgttgtcatcggactcctgttcatgatccttacagtggcggccaacgaaatgggactgctcgagaccacgaagaaggatctgggcatcggacacgttgccgtgggtaaccaccaccatgccgccatgctggatgtggatctgcaccctgcatccgcgtggaccctgtacgcggtggcaactaccatcataacccccatgatgcgccacaccatcgaaaataccaccgcaaacatctctctgacggcgattgccaaccaggctgccatactaatgggcctggacaagggttggccaatttccaagatggacattggcgtcccgctcctagcgctggggtgctacagccaggtcaatcccctgactttgaccgcggccgtgctgatgctagtcgcccactatgccatcatcggccccgggcttcaggcgaaagccacccgcgaagcacagaaacggacggccgcaggcataatgaagaaccccacagtggacggcatcgtagcgatcgatctggatccggtcgtctacgatgcgaagttcgaaaaacaactggggcagatcatgctcttgatcttatgcacgtcacaaatcctcctgatgcgcaccacttgggccctgtgcgagagcattaccttagctaccggacccctgaccacgctctgggaggggtcccccggcaagttctggaacacgaccatagccgtatctatggcgaacattttccgaggttcttatttagccggcgccggcctggccttcagcctgatgaagtccctcgggggtgggcgccgtggaaccggcgcccagggggagaccttaggcgagaagtggaagcggcagctgaaccagctctccaagctggaattcaacagctacaagcggtccgggatcatggaggtcgaccgcagcgaggccaaggagggcctgaagcggggggagaccaccaagcacgcagtgtcccgcgggaccgctaagctccgatggttcgtggagcgcaacctggtcaagcccgaaggtaaggttatcgacctggggtgcgggagaggcgggtggtcgtactactgcgccggtttaaagaaggttacggaggtcaaggggtacacgaagggcgggccgggccacgaagagcccatccccatggcgacctatgggtggaacctcgtgaaacttcattccggcaaggacgtgttcttcataccgcccgaaaagtgcgatacactgctctgcgacatcggggagtcctcccccaaccccacgatcgaggagggccgcaccctgcgggtcctgaagatggtcgagccctggctccgaggaaaccagttctgcatcaaaatcctgaatccctatatgcccagcgtggtcgaaactctggagcagatgcagagaaagcacggaggaatgctcgtgcgcaaccctctctcacgcaacagcacccacgagatgtactgggtgtcctgtggcacgggcaacatcgtgagcgccgtaaacatgacatcacgcatgctgcttaaccgtttcaccatggcccaccggaagcccacctacgaaagggacgttgacctgggcgccgggacccgacacgtcgccgtggagccggaggtggcgaacctggacatcatcggccaacgcattgagaacattaagcacgagcacaaaagcacatggcactacgacgaggacaacccatataaaacctgggcctaccacgggtcctacgaggtcaagccaagcggttccagctcgtccatggtgaacggggtcgtgaagctcctgaccaaaccctgggacgtgatccccatggtgacccagatagcaatgactgacaccacccccttcggccagcaacgggtgttcaaggagaaggtggacacaaggacgcccaaggccaaacggggcacggcccaaatcatggaagttaccgcgaagtggctctgggggttcctgagccgcaacaagaagccgcgcatctgcacccgcgaggaattcacgagaaaggtgcgctctaacgccgccatcggagcggtattcgtcgacgagaatcaatggaacagcgcgaaagaggcggtggaggacgagcgtttctgggacctcgtgcacagagagcgggagctgcacaagcaggggaagtgcgcgacctgcgtctacaacatgatgggcaaacgcgagaagaagctcggggagttcgggaaggctaaaggctcacgggccatctggtacatgtggctgggggctcgcttcctggagttcgaggccctcggcttcatgaacgaggaccactggttcagccgggagaactcactaagcggggtggagggcgaggggctgcacaagctcggctatatactgcgcgacatctccaagattcccggcggaaacatgtacgcagatgacacagccggctgggacacccgcatcactgaggacgacctgcagaacgaggcccgaataacggacatcatggagcccgagcacgcgttactggccaagagcatcttcaagttgacctaccagaacaaggtggttcgtgtgcaaaggcccgccaagaacgggaccgtgatggacgtcatatcccgtcgtgaccagaggggctcaggccaagtggggacctacggccttaacaccttcaccaacatggaggcccaactgatcagacagatggagtccgaggagatattcagcccctcggaattggagacccccaacctcgccgagcgcgtgctggactggttggaaaagtacggcatcgagcgcctcaagcgcatggccatcagtggtgatgactgcgtcgtaaagccaatcgacaaccgtttcgcaaccgccttgaccgccctgaacgatatgggaaaagtgcgcaaggacataccacagtgggagccgtccaagggctggaacgactggcaacaggtccccctctgctcacaccacttccaccagctgataatgaaggatggcagggagatcgtggtgccctgtcgcaaccaggatgagctggtcgggagagcccgcgtgagccagggagcgggatggagtctccgggagacggcctgcctcggcaagagctacgcccagatgtggcagctgatgtactttcaccgtcgggacctccgcctggccgcgaacgccatctgctctgccgtgcccgtcgactggatcccgaccagccgcacgacctggtcaatccacgcccaccaccagtggatgaccaccgaggacatgcttagcgtgtggaaccgagtgtggatcgaagagaacccctggatggaggataagacgcacatctcctcgtggggagatgttccttacctcggcaagcgcgaggaccagtggtgcggctccctgatcggtctgaccgcccgggccacctgggccaccaatatccaggttgccatcaaccaggtgcgacggttaatcggcaacgaaaactatctggactatatgacgagcatgaaaagatttaagaacgaatccgaccccgagggcgccctgtggtga

SEQ ID NO: 24648 - RNA, 9879 nt, synthetic construct
  misc_feature 1..9879: note = derived and/or modified CDS sequence (opt11) from DENV-1__JQ048541__SS-prME
  source 1..9879: mol_type = other RNA
agcgtaaccatgctgctcatgcttatgcccaccgctctcgctttccatctcactactagaggaggggagcctcacatgatcgtctcgaagcaggagcggggcaagagcctgctgttcaagacctctgccggggtgaacatgtgcactctcattgccatggacttgggagagctgtgcgaggacacgatgacatacaagtgcccgcgaataaccgaggctgagcccgacgatgtagactgctggtgcaatgcaacggacacgtgggtgacgtatggaacctgcagccagaccggcgagcaccggcgcgataagcggagcgtggccctagcgccccacgtaggtctcgggctggagacccgcactgaaacctggatgagcagcgagggggcctggaagcagatccagcgggtggaaacctgggccttacgccatcccgggttcacggtgatcgcgctgttcctggcgcacgccatcggcaccagcatcacccagaaggggatcatcttcatcctcttgatgctggtgactccctccatggccatgaggtgcgtaggcataggctctcgcgacttcgtggagggactatccggagcaacctgggtggatgttgtactggagcacggtagctgcgtgaccaccatggccaaggacaagcccacactggacatcgagctccttaagacggaagtcaccaacccggcagtgttacggaagctatgcatcgaggcgaagatcagcaacactacaacggactcccgctgccctactcagggagaggccaccctggtagaggagcaggacgccaacttcgtctgccggcgaacattcgtggaccggggctggggtaacggctgtgggctatttggtaagggatcgctcataacgtgtgctaagttcaagtgtgtgactaagctggagggcaagatcgtccagtacgagaacctgaagtatagcgtgatcgtgaccgtccatacgggtgatcagcaccaagtggggaacgaatccacggagcacggaacgactgctaccatcacgccccaagcaccaactaccgagattcagctaaccgactacggggccctgaccctggactgctctccccggacgggcctcgattttaacgagatggtcctgctaaccatgaaggaaaagagctggttagtgcacaagcaatggttcctggacttaccactcccatggaccagcggggcctcaacctcccaggagacgtggaaccggcaggacctcttagtgaccttcaagaccgcccacgcgaagaagcaggaggtggtagtgctcggcagccaggaaggagccatgcacaccgcgctaacgggcgcgacagaaattcagacctccggcaccacgacaattttcgcagggcacctgaagtgcagactcaagatggataaacttaccttaaaagggatgagctatgtaatgtgcaccgggtcctttaaacttgagaaagaggtggctgagacacaacacggcaccgtgctagtccagatcaagtacgaaggtaccgacgccccctgcaagatacccttcttgacccaggacgagaagggggtgacacagaacggccggctgatcacggctaacccgatcgtgaccgacaaggagaagccggtcaacatcgaagctgagccgccgttcggtgagtcttacatcgttattggagcgggcgagaaggccctcaaactgtcctggtttaaaaagggcagctccataggcaaaatgtttgaggccaccgcccgcggggcccggcgtatggctatcctaggagacacagcctgggacttcgggagcatcggcggcgtgttcactagcgtcgggaaacttgtgcatcagatatttggcaccgcatacggggtgctctttagcggcgtctcctggaccatgaagatcgggatcggcgtgctgctcacttggttgggcttaaatagccgctccaccagcctctctatgacttgcatcgccgtggggctggtcaccctatatctgggcgtgatggttcaggcggactctggatgcgtcatcaattggaagggcagggagttgaagtgcgggtccggcattttcgtaacgaacgaggtgcacacctggaccgagcagtacaaattccaagcggacagcccgaaacgcctgagtgcagccattggaaaggcctgggaagagggagtttgcggtattcggagtgccaccagattggagaatataatgtggaagcaaatcagcaatgagcttaaccacattctcctcgagaacgatatgaagttcacggtggtggtaggtgacgtggcgggcatactggcgcaaggtaagaagatgatccgcccccagccaatggaacataagtactcatggaagtcctggggaaaggcaaagataatcggggcagacgtgcagaacacgacttttattatcgatgggcctaacactccggagtgccccgacgatcagcgggcgtggaacatctgggaggtcgaggactacggcttcgggatcttcaccacgaacatctggctaaagttgcgggactcctacacacaggtgtgtgatcaccgcttaatgagcgccgcgatcaaagacagtaaagccgttcacgccgatatgggctactggatcgagagcgagaagaacgagacctggaaactggcccgcgcgtcgttcattgaggtcaagacctgcatatggccaaagtcacacacgctttggtcaaacggcgtgttagagtctgagatgatcatccccaaaatctacgggggcccgatatctcaacacaagctgcgtcccgggtactttacgcagaccgccggcccttggcatctcgggaagctggaactggactttgacctctgcgagggcaccacggttgtcgttgacgagcactgcggcaatagagggccctcactccgtactaccaccgtgacaggcaaaatcattcacgagtggtgctgccggagttgtaccttgccgcccctccgtttccgcggggaggacgggtgttggtatgggatggagatccgccccgtcaaggagaaagaagagaacctggtaaagagcatggtctccgccggaagcggcgaggtagactctttctccctgggcctcctatgcatcagcatcatgatcgaggaagtgatgcggagccgctggagccgaaagatgctcatgacagggacgttggccgtcttctttctgctgattatggggcagctcacctggaacgacttgatccgctcctgcatcatggtgggtgcaaacgccagcgacagaatgggtatggggaccacatacttggctctcatggcaacgttcaagatgcggccgatgttcgccgtgggcttgctgttccgccgactcacgtctcgcgaggtattgttactcacgatcgggctaagcctagttgcttccgtagagctccccaattcattagaagaactgggcgacgggctcgccatgggcatcatgatactaaagctgctcaccgactttcagagtcaccaactgtgggccaccttgctcagcttaacgtttattaagaccaccttctcgctgcactacgcctggaagaccatggcaatggtccttagcatcgtgtcccttttccccctgtgcttgtcaactaccagtcagaaaacgacttggttgccagtgctgctcggctcactagggtgcaagcctttgacgatgttcttgattgccgagaacaagatctggggcaggaagtcctggccattgaacgaggggatcatggcggttggcatcgtctcaatcttgctcagctcccttctaaagaacgacgtccccctagcagggcccctgatagcaggagggatgctgatcgcctgttatgtcatctctgggtcgagcgcagacctatccttggagaaagccgccgaggtatcttgggaggaagaggccgagcactccggtgcgtcacacaacattctcgtggaagtccaggacgacggaaccatgaagatcaaagacgaggagcgggacgacaccctcacgatcttactgaaggccaccctcctggctgtgtccggcgtgtatccgctgagcatccccgcaaccctgttcgtctggtacttctggcagaagaaaaagcaacggtctggagtgctatgggacaccccctctccgcccgaggtggagcgcgccgtactcgacgacggaatataccggattatgcagcgcggactcctcgggcggtcccaggtgggcgtgggtgtgttccaagagaacgtcttccacactatgtggcacgtcacccggggcgctgtgctgatgtaccaggggaaacggctggagccgagctgggcgtccgtcaaaaaggacttaataagttacggcggaggatggcgccttcagggctcctggaacacgggggaggaggtgcaggtcatcgcggtagagcccgggaagaatccgaagaatgtgcagacggccccaggtaccttcaagacccctgagggagaagtcggcgctattgctttggacttcaagcccgggacatcaggatctccgatagtcaacagagaggggaaaatcgtgggcctttacggcaatggggtcgttaccacctcgggcacctacgtctcggccattgctcaggcaaaggcgtcacaggaagggccgctgcccgaaatcgaggatgaagtctttcgcaagcgcaatctcactattatggatctccaccccgggagcgggaaaaccaggcgttacctgcctgccattgtgagggaagccattaagcggaagctgcgcactttgatcctggctcccactcgagtggtggctagtgagatggcggaggccctgaagggtatgcccatacggtaccagacgaccgcggtcaaaagcgagcataccggcaaggagatcgtggacctcatgtgtcacgccaccttcactatgcgcctgctgtcgccggtacgggtgccgaactacaacatgattattatggacgaggcccacttcactgaccccagctccatcgcggcccgcgggtacatcagcacccgagtgggaatgggcgaggccgccgccatatttatgaccgcgacgccgcccggctccgtcgaggcgttccctcaaagcaacgccgtgatacaggatgaggagcgcgatatacctgagcggtcctggaactcagggtacgagtggatcactgacttcccaggtaaaacggtgtggtttgtaccgtcaatcaagagcggaaacgacatcgccaattgcctcaggaagaacgggaagcgggtgatccaattgtcccggaagaccttcgacaccgaatatcaaaagaccaagaacaacgactgggattatgtggtcaccaccgacatcagcgagatgggggcgaactttcgggccgaccgcgtgatcgaccccaggcgctgcctgaagcccgtgatcctgaaagacgggcccgagcgggttattctggctggtcccatgccggtgacagtagcctccgctgctcagcgccgagggcgcatcggcagaaaccacaacaaggagggggaccaatacatctacatgggccagcccctgaacaacgacgaggaccacgcccattggacagaggccaagatgctcctggacaatatcaacaccccggagggtatcatccccgccctgttcgagccggagcgcgagaagtcagcggcaatagatggggagtatcggctcagaggggaggcccgaaaaaccttcgtggaactgatgcggcgtggggaccttcctgtctggctttcctacaaagtcgcgagcgagggctttcagtattcggatcggcggtggtgtttcgacggcgagcgaaacaaccaggtcctggaagagaatatggacgtcgagatctggacgaaggagggggagcgtaaaaagctgagaccccggtggctagatgcgcgaacctattccgaccccctggccctgcgcgagtttaaggagttcgccgccggccggcgcagcgtgtccggggatctgatacttgagatcggaaagctgccgcagcacctgacccagcgggcccagaatgccttggacaacttggtgatgctccacaacagcgagcagggcggcagagcgtaccggcatgccatggaggaacttcccgacacgatcgagacattaatgctgctagccctcatagccgtgctcaccggaggggtcaccctattctttctgtcaggcagggggctcggtaagacatccatcggcctgctgtgcgttatggcctccagcgtgctcctgtggatggcgtccgtcgagcctcactggatcgccgccagcatcatcctggagttctttcttatggtgttactgatccccgaacccgatcggcagcgcacgccccaggataaccagctcgcgtacgtggtcatcggtctgttgttcatgattctcacggttgccgcaaacgaaatgggcctgctggagaccaccaagaaggacctcggaatcggccatgttgcggtcgagaaccaccaccatgccaccatgctggatgtggacctgcaccccgccagtgcctggactctctacgccgttgcgaccacgatcatcacacccatgatgcggcatacgatcgagaacaccacggccaacatcagcttaaccgcaatagcaaatcaggctgccattttaatggggctcgacaagggctggccgatctcaaagatggacatcggagtacctttactggccctaggctgctattcgcaggtaaacccactaacgctgactgccgcggtgctcatgctagtcgcgcactatgccatcattggcccggggctgcaggctaaggccacccgcgaagcccaaaagcgaaccgccgcgggtatcatgaagaatcccacggtggatggtatcgtggccatcgacctcgaccccgtcgtctacgatgcaaagtttgagaaacagctcggacagatcatgctgctgatcctgtgcaccagtcagatcttgctcatgcggacaacctgggcgttgtgcgagagcatcactctggcaaccggccccctcaccaccctgtgggaaggctcgccaggcaagttctggaacacgaccatcgccgtgagtatggcaaacattttccgcgggtcatacctggccggtgcggggctcgcctttagcctgatgaagtccctcggaggcgggcggcgcgggactggggcccaaggagagaccctcggcgagaagtggaagagacagctgaaccagctgtccaagagcgagttcaacacctacaagcgctccgggatcatggaggtagaccggtcagaggccaaagagggcctcaagagaggcgagaccacaaagcacgctgtatctcgcggtaccgccaaactccgttggtttgttgagcgcaacctagtcaagccagaagggaaggtgattgatctgggctgtggcagagggggctggagttactactgcgctgggctcaagaaggtgacagaggtgaagggctataccaaagggggcccaggacatgaggagcccataccgatggccacctacggttggaacctggtcaagctgtactctggcaaagacgtgttctttatgccacccgagaagtgcgataccttactttgcgacatcggggagagctcccccaacccgacgatcgaggagggccggaccctgcgggtcctcaagatggtggagccctggcttcggggaaatcagttctgcattaaagtactgaacccgtatatgccgagcgtcgtggagaccctcgaacagatgcagcgcaagcacggaggcatgttggtgcggaatccgctgagtcgcaacagtacccatgagatgtactgggtgtcgtgcgggaccggtaacatcgtatccgccgtgaacatgacaagtcgcatgttgttaaaccgatttactatggcgcaccgcaaacccacctacgagagggacgtagacctgggggcgggcacccggcacgtggccgtcgaaccagaggtcgcgaacctcgacatcattggccagcggatcgagaacataaagcacgagcacaagagcacgtggcattacgatgaagacaacccatacaaaacctgggcgtaccacgggtcctacgaggtcaagccgtcgggctccgcgtctagcatggtcaacggggtggtgaaacttctgaccaagccatgggacgtgatacccatggtgacccagatcgccatgacggataccacccccttcggacagcagcgggtattcaaggaaaaggtcgacacccgcacgcccaaagcgaagagggggaccgcccagatcatggaagtgaccgcccggtggctctggggctttctctcccgcaacaagaagcccagaatatgcacacgggaagagtttacgcggaaggtaaggagcaatgcggctatcggagcagtctttattgacgaaaaccagtggaactccgccaaggaggcggttgaggatgaacggttctgggacctcgttcaccgagagcgggagctccacaagcaagggaagtgcgccacttgcgtatacaacatgatgggcaagagagagaagaagctaggggaatttggaaaagcgaaggggtcccgcgccatctggtacatgtggctcggcgcccgcttcctcgaatttgaggcgctgggcttcatgaacgaggaccactggttttcccgggagaactcactctccggagtggagggcgaggggttgcacaaacttggctacattcttcgcgacatctccaagatccccgggggcaacatgtacgcggacgataccgccggctgggacactagaataacagaggacgatctgcagaatgaggccaagatcacagacattatggagcccgaacatgcactacttgccaaggccatattcaaacttacctaccagaataaagtagtcagggtgcagcgcccggccaagaacggaactgtgatggatgtcatatcccgtcgcgaccaacggggctccggccaagtaggaacgtacggtctgaacacctttaccaacatggaggctcagctcatccgccagatggaatccgaaggaatcttcagcccctccgaacttgagaccccgaatctggccgagcgggttctggactggcttgaaaagtacggagtggagcgccttaagcggatggcaatctccggcgacgactgtgtggtcaagccgatcgacgaccgattcgcaacggctctgacagccttaaacgatatgggcaaagtccggaaggacatcccccagtgggaaccctccaaggggtggaacgactggcaacaggtgccgttctgctctcaccacttccaccaactaatcatgaaggacggccgcgagatagtggtcccgtgccggaaccaggacgagctggtgggtcgcgcccgggtgagtcagggggcaggctggggcctacgtgaaaccgcctgcttgggcaaaagctacgctcagatgtggcaattaatgtacttccaccggcgcgacctgcggctggccgcgaacgccatctgcagtgccgtacccgtggattgggtgccgacaagtcgtacgacctggagcatccacgcccaccaccagtggatgaccacagaagatatgctgtcagtctggaaccgggtatggatcgaggaaaacccatggatggaggacaagacgcatatttcatcctgggaggacgtgccgtacctcgggaagcgcgaagaccagtggtgcggtagtcttatcggtctgaccgcacgcgcgacctgggccaccaacatccaggttgcaatcaaccaggtgcgacgcctcattggcaacgagaactacctggactacatgaccagtatgaagcggttcaaaaacgagagcgacccggagggcgcgctgtggtga

SEQ ID NO: 24649 - RNA, 9879 nt, synthetic construct
  misc_feature 1..9879: note = derived and/or modified CDS sequence (opt11) from DENV-1__JN697056__SS-prME
  source 1..9879: mol_type = other RNA
tccgtgacaatgctactcatgctgctaccgacggccctaacgttccatctaactacgcggggcggcgagccccacatgatagtaagcaaacaggaaagggggaagtcattactcttcaaaacgtcggcaggcgtaaacatgtgcaccctgatagccatggacctaggcgagctttgcgatgataccatgacatataaatgtccacgaatcacagaaaccgagccagatgacgtcgactgctggtgcaacgcaaccgagacctgggtaacctatggcacatgctcgcagaccggggaacaccggcgagacaaacgaagtgtagcgctggcaccccacataggactgggcctggaaacacgaacggaaacctggatgagcagcgaaggtgcgtggcgccagatacagaaagtggagacctgggccctgcggcatccaggattcacagtcatagccctattcctagcacacgccattggtacgagcatcacacagaaagggataatcttcatcctcctcatgttagtaactccatcgatggcgatgagatgcgtaggaataggaaatagagacttcgtagaagggctaagcggggcaacatgggtagatgtggtactagagcatgggtcgtgcgtcacgaccatggcgaaagacaagccaacgctagacatagagctcctaaaaactgaagtgaccaaccctgcagttttacgcaagctgtgcatagaagcgaagataagcaataccaccacagacagccgatgccctacacagggggaggctacccttgtcgaagaacaagacaccaacttcgtatgccgccgtacattcgtggaccgtgggtggggcaacggatgcggccttttcggtaaaggctccctaataacatgcgcaaagtttaaatgcgtgacaaagctcgaaggcaaaatcgtccagtacgaaaacctcaaatattcagtcatagtaacagtgcacactggtgaccaacaccaggtcggcaatgagacaacagagcatggcactatagccacgataacgcctcaagcacccacgagcgagattcagctgacggattacggcgccctcactctagactgtagcccccgcacaggcctagacttcaacgaaatggtactactcactatgaaagaaaagagctggctcgttcacaagcaatggttccttgatctaccactaccatggacatcaggtgctagtacaagccaggaaacgtggaatcgccaggacctgctcgttaccttcaaaactgcacacgccaaaaaacaagaggtagtggtgctcgggtcgcaggagggagcgatgcatacagctctcacaggcgccactgagatccagacatccggaaccacaacaatcttcgccggccacctcaagtgccgactgaaaatggataaacttacgctgaagggtatcagctacgtaatgtgcacaggccccttcaaactggagaaagaggttgcggaaacacagcatggcacggttttagtccaagtcaaatacgaaggaacggacgcgccctgtaaaatcccattcagcagccaggacgagaaaggcgtgacccaaaatggaagactcgtcacggccaacccgatagtgacagacaaggagaagccagttaacatcgaggcagaacctccgtttggagaaagttacatagttgtaggagctggggagaaagcccttaagctgagctggtttaaaaaaggcagcagtatcggcaaaatgtttgaagcgacggcgcgcggcgcgagacgaatggccatactgggagatacggcatgggacttcgggtccatcggaggggtattcacgtcggtaggcaaactggttcaccagatattcgggactgcgtacggggtactgtttagtggggtatcatggacaatgaaaataggtatcggcatcttgctcacgtggttagggctaaattcccggagtacgagcttatccatgacctgtatagcagttggaatgataacgctatatctcggggttatggtacaggcggactcaggttgtgtcatcaattggaaaggtcgtgaacttaaatgcggatccggcatcttcgtgaccaacgaagtgcacacatggacggaacagtacaagttccaggctgactcacccaagagattaagcgccgccataggcaaagcgtgggaggagggagtctgcgggattaggtctgccaccaggctcgaaaatatcatgtggaaacaaatatcgaacgagctgaaccacatcctacttgaaaacgacatgaaattcacagtagtcgtaggggacgtgtcgggaatcctagcccaaggaaagaaatccatacggccacagcccatggaacataaatacagctggaagtcctggggaaaggcaaaaataatcggagccgacgtccaaaatacaaccttcataattgacggaccgaacacaccagaatgtccagacgaccaaagagcgtggaatatctgggaagttgaagattacggcttcggcatcttcaccacaaatatatggttgaagctcagggacagctacacacaggtatgcgaccacaggctcatgtccgccgcaatcaaggactcaaaagccgttcacgccgacatgggctattggatagaatcagaaaaaaatgagacatggaaattggcccgagccagcttcatcgaggtaaagacatgcatctggcccaagtcccacaccctatggagtaacggcgtcttagaatcagaaatgataattcctaaaatatacggaggaccaatttcccaacacaattaccggccaggatattttacacagacagcgggcccctggcacctggggaagttagagctcgacttcgacctgtgcgagggaacaactgtggtcgtagatgaacactgcggaaaccgcggaccctccttacggacaacaacagtgacaggaaaaatcatccatgagtggtgctgccggtcctgtacactgccaccgctcagatttaagggagaggatgggtgctggtatggcatggagatccggcccgtcaaagagaaagaggagaacttggttaaaagcatggtctcagcaggatcaggcgaggtggacagcttctcgctcggtctactctgcatatccatcatgatagaggaagtcatgagaagccgatggagcaagaaaatgctaatgaccggtacgctagcagtcttcctactactaacgatgggacaactaacttggaatgacctcatccgtctctgtatcatggtaggggcaaatgcctcggacaatatgggaatggggaccacatacctcgcgttaatggctacattccggatgagacccatgttcgccgtcggacttctatttcggagactaactagtagggaagtactcctgctcactgtcggtctaagcctagtggcaagcgttgagctccctaactcactagaagaactaggagacggcctagccatgggtatcatgatcctcaaactactaacagattttcaaagtcatcaactgtgggccacgctcctgtcactaacctttgtaaagactactttctcccttcactacgcatggaagacaatggcaatgatcctctccatcgttagcctactacctctgtgcctaagcaccactagccaaaaaaccacttggctacccgtgttactcgggagcctcggatgcaagcccttaacaatgttcctaatcacagaaaacaaaatctggggcaggaagtcatggcccctcaacgagggaatcatggccgtaggaatagtatcaatccttctatcctcgttgctcaaaaacgacgtacccctggctggtcccctgatagccggaggtatgctcatcgcgtgttatgtcatcagtgggtctagtgcggacctcagcctcgaaaaagcagccgaggtctcgtgggaagaggaagcagagcacagtggtgcctcccacaacatcttagtagaaatccaagatgacggcacaatgaagataaaagacgaggaaagggatgacacaatcacaatcctcctgaaagccacactcctagcgataagtggagtgtacccaatgtcaattccagcaacgctatttgtatggtacttctggcaaaagcgaaagcaaaggtcaggtgtactatgggacacgccatctcccccggaggtagaaagagccgtcttagatgatggcatatatcgcatattacagagagggctgctggggaggagccaagttggcgtgggagtctttcaagagggggtctttcacacgatgtggcatgttacacgtggagccgtactcatgtaccaaggcaaaagactggaacctagctgggcctccgtgaagaaagaccttatatcgtacggaggcggctggcgattccaagggagctggaacactggcgaagaagttcaggtcatagcggtagaaccagggaaaaacccaaaaaacgtccaaaccgccccggggacctttaagaccagtgaaggcgaggttggtgccatagcactagacttcaagccggggacgagcggaagtcccatcgtgaaccgcgaaggaaaaatagtcggattgtacggtaacggagttgtcacaacatcggggacatacgtgagcgcgatagcgcaggccaaagcatcgcaggagggccccctacccgaaatagaagacgaagtatttcgcaaacgaaatctcacaataatggatcttcacccaggcagcggcaaaacgaggaggtacctgccagccatcgtacgagaggccatcaaacggaaactccgtaccctggtcctcgcccccacccgggtagtggcttcggagatggccgaagccctgaaaggtatgccaataaggtaccaaaccacagcagtaaaatcggaacacacgggaagagaaatagtggacttgatgtgccacgccacgtttacaatgcgactccttagtcccgttagggtcccaaactacaacatgatcataatggatgaagcccactttacggaccccgcaagtatcgccgcacgcggctacatttcgaccagggtaggaatgggagaggcagcagcaattttcatgacagccacaccgccgggaagcgtagaagcgttcccgcagtcgaacgcggtgatccttgacgaggaaaaagatatcccagagcggtcctggaactccggctacgactggatcacagacttcccagggaaaacggtctggttcgtgccttcaataaaaagcgggaacgacatcgccaactgcctacgaaagaatgggaaacgagttatacaactcagtagaaagacttttgacaccgaataccagaagactaaaaataatgactgggactacgtagtaactacggacataagcgaaatgggagcaaattttcgagcagatagggtcatcgacccccggaggtgtttaaagccggtaatactcaaagacggcccagagcgcgtaatactggccggcccgatgccagtaacggtggcaagcgcagcacagcgtcgtgggcgcataggccgaaaccagaacaaagaaggagatcaatacatctatatgggccagccgctcaacaacgacgaggatcacgcccactggactgaggcaaaaatgttgctggacaatatcaacacaccagaagggatcatcccggccttatttgaaccggaaagggaaaagtccgcagcaatcgacggggaatatagactcagaggggaggcgagaaaaacattcgtagagctcatgcgaaggggggatctgccggtgtggctctcgtataaagtcgcaagcgaaggattccaatactcagaccgccgatggtgtttcgatggcgaaagaaacaatcaagtgctggaggaaaacatggacgtagagatatggaccaaagaaggggaacgcaagaaactaagaccgcggtggttagacgcgcgcacctattcagaccccttagcgctacgcgaattcaaggagttcgcggccggccgccgcagcgtctcaggggacctgattttggagatagggaaattgccacaacacctaactcaacgtgcccagaacgcccttgacaatctggtgatgctgcacaacagcgagcaaggcgggaaagcttaccgccacgccatggaggagttgccagacacgatagagaccctaatgctgctggcgttaatcgcagttttaaccgggggggtgacgctgttcttcctgagcggaagaggccttggaaagacaagcataggcctcctctgcgtcatgtcctcatcagcgctcctatggatggccagcgtagagccacactggattgcagcgagtataattctagaattctttctgatggtactgctgataccagagccagaccgacaacgcacgccccaggataatcagctagcatacgtagtaatcggacttctttttatgatcttaacagtcgccgcaaacgagatgggcctactcgagacaaccaagaaagacctaggtatcggacacgcggctgcggagaaccaccaccatgccgcaatgctagacgtagatctccacccagcgagcgcttggaccctatacgcagttgccaccacgattatcacaccgatgatgaggcatacaatagaaaacaccacggccaatatatcccttacggctatagcaaaccaagctgcgatactcatgggcctagataaggggtggccgattagcaagatggacatcggagtgccattgctcgcactcggatgctactcacaggtaaacccgctaacattaacggcagccgtcctgatgctagtcgcccattacgcaatcatagggccaggcctccaggccaaagccacacgcgaagcacaaaaacggacagcagccggtataatgaagaacccaaccgtagacggaatagtagcgatcgacctcgaccccgtcgtctacgatgctaaattcgagaaacaactaggccaaataatgcttctcatactgtgcacgtcgcaaatcctccttatgaggaccacctgggcgctctgcgaatcgatcacgctcgcgaccggacccctgacgaccctgtgggagggatcgccaggtaaattctggaacaccacgatcgccgtatcaatggcgaacatatttcgtggatcttaccttgcgggggcggggcttgcgttctcactaatgaaaagtctaggcggcggaaggagaggaacaggagcacagggcgaaacattgggagaaaagtggaaaaggcaacttaaccaactatccaaatccgaatttaatatatacaagcgctccggcattgtagaggtagacagaagcgaggctaaagaaggactgaagagaggagagactaccaagcacgcggtgtcacgaggaacagcaaagctaaggtggttcgtggaaaggaatttagtcaaaccagaggggaaggtgatagacctcggatgtggtcgaggcggttggtcgtattactgtgccggtctaaaaaaagtaacagaggttaaaggctacacgaaagggggtcccggccacgaagagcctatcccaatggctacgtacgggtggaacctagtgaagctatattctggaaaggacgtcttcttcatacccccggaaaaatgcgatactctgttatgcgacatcggagagtccagtcccaacccgacgatcgaagagggtaggaccctccgcgtcctaaagatggtagaaccgtggctccgaggcaaccaattctgtataaaaattttaaatccctacatgccaagcgtcgtcgagacgttggaacaaatgcaacgaaaacacggcggaatgctcgtcagaaacccgttatccagaaacagtacccacgagatgtactgggtttcctgcgggaccggtaacattgtctccgccgtcaacatgacatcgcgaatgctattgaatcgattcacaatggctcacaggaaacccacctacgagcgggacgtagacctgggagcaggcaccagacacgttgcagtcgaaccggaagtagcgaacctcgacatcatcggacaacgcatcgagaacataaagaacgagcataaatcaacttggcactacgacgaagataatccatacaaaacatgggcgtaccacggttcatacgaggtcaaaccgagcggttccgcaagctctatggtcaacggagttgtcaggttattaacgaagccatgggatgtgatcccaatggtcacccaaatcgcaatgacagacacaacaccgttcggccaacaacgtgtgttcaaagagaaagtcgatactcgaaccccaaaggcaaagagaggtacggcgcagatcatggaagttaccgcaaaatggctgtggggcttcctgagccgtaacaaaaagccacgaatatgcacaagggaggaatttacacggaaagtgagatcaaacgcggctatcggagcagtattcgtagacgaaaaccaatggaactccgcaaaagaggccgtagaagacgagagattctgggatttagtgcgaagggagagagagctacacaagcaaggaaagtgcgccacgtgtgtctacaacatgatgggcaaacgagaaaaaaaactcggagaattcggcaaagccaagggatcaagagcgatatggtacatgtggctaggtgcgagattcctagagttcgaagcactgggattcatgaacgaagaccattggttctcacgagaaaactccctatcaggcgtggaaggtgagggccttcataaacttgggtacattttacgcgacattagcaagataccgggaggaaatatgtatgcggacgatacggccggatgggacacacgcataacagaagacgacctccaaaacgaggcaaagataacggacataatggaaccagagcatgcgctgctcgccacaagcatattcaaacttacttaccagaataaggtcgtaagagtacagcgacccgccaagaacggaaccgtcatggacgtgattagccgaagagaccaacggggctcaggtcaagtgggaacatacggactgaatacattcacgaacatgggggcgcaacttataagacaaatggaatcagaaggtatcttcctaccctcagaactagaaacaccaaacctagcggggcgcgttctagattggctagaaaaacatggaatagaaaggctgcgcagaatggcaattagcggcgacgactgcgtggtaaagccaatcgatgacagatttgccaccgccctaacggccttgaacgacatgggaaaagtccggaaggatattccgcagtgggagccgagcaaaggatggaacgattggcagcaagtaccgttctgcagccatcattttcatcagctgataatgaaggacggacgtgagatcgtagtcccctgcaggaaccaagacgaactggtcgggcgcgctcgggtgtcgcaaggcgcggggtggagcctgagagagacggcttgtcttggaaaatcatacgctcagatgtggcaactgatgtactttcacagacgagacctccggctagcggccaacgcaatatgtagcgcagtacccgttgactgggtaccgactagccgcacgacatggagcatacacgcacatcaccagtggatgacgaccgaggatatgttgagcgtatggaaccgcgtatggattgaagaaaacccatggatggaagacaaaacgcatgttagttcatgggaagacgttccctatctaggaaaacgagaagaccagtggtgtggcagcctgatagggctcacggcccgagcaacctgggcaacaaacatacaggtggcgatcaatcaagtgcgccgactcattggaaacgaaaactacctcgactacatgacctccatgaaacggtttaaaaatgagtcagacccagagggtgctctatggtaa

SEQ ID NO: 24650 - RNA, 9879 nt, synthetic construct
  misc_feature 1..9879: note = derived and/or modified CDS sequence (opt11) from DENV-1__JN697057__SS-prME
  source 1..9879: mol_type = other RNA
tcggtaaccatgctgctcatgctcatgcccaccgctctggccttccacttaaccacccgcggcggggagccccacatgattgtgagcaaacaggagcggggcaagagcctgctgttcaagacctcagccggtgtgaacatctgcaccctcatcgccatggacctgggcgagctgtgcgaggacacgatgacctacaagtgcccgcgcatcaccgaggccgaacccgacgacgtagactgctggtgtaacgccacagacacgtgggttacctacgggacgtgcagccagaccggcgagcaccggcgcgacaaacggtccgtggccctcgctccccatgtgggcctggggttggagacgcgcaccgagacctggatgtcttccgagggcgcctggaagcagatccagcgggttgagacctgggccttgaggcaccccgggttcacagttatcgccctattcttggcgcacgcgataggcactagcatcacacaaaaagggatcatcttcatcctcctcatgctggtgaccccctctatggccatgcggtgcgtcggaataggcagccgcgatttcgtggaggggctctcgggggccacgtgggtggacgtcgtgctggaacacggaagctgtgtgaccaccatggccaaggacaagcccaccctggacattgagctcctaaaaactgaggtcacaaaccctgcggtgctgcgtaagctctgcattgaggcgaaaatctccaacaccaccacggacagccgctgcccgacccagggcgaggcaaccctggtggaggagcaggacgccaatttcgtctgccggcgtaccttcgtggaccggggatgggggaacggctgcggcctattcggcaaggggtccctcatcacgtgcgcgaagttcaaatgcgtgaccaagctcgagggcaagatcgtacaatacgagaacttaaagtatagtgtcatcgtgaccgtccacaccggcgaccagcaccaggtggggaacgagtccacggagcacggcaccaccgctactatcacgccacaggcccccacgacggagatacagctcaccgactacggggccctaaccctagattgttctccccgcacgggcctcgacttcaacgagatggtcctgttaaccatgaaggagaagtcctggcttgtgcacaagcagtggttcctggacctgcccctcccctggacgagcggtgccagcacctcccaggagacgtggaaccggcaagacctgctggtgacattcaagacagctcacgcgaagaagcaggaggttgtcgtgctcggcagccaggagggcgcgatgcacaccgccctgacaggcgcgacggagatacagacctccgggacaacgaccatcttcgctggtcacctgaagtgccgcctaaagatggacaagctgaccttaaagggcatgagctacgtcatgtgcaccgggtcctttaagctggagaaggaggtggcggagacgcagcacggcaccgtgctggtccaaatcaagtacgagggcacagacgccccctgcaagatccccttcagcacccaagacgagaagggggtgacgcagaacgggcggctcatcaccgccaacccgattgtgaccgacaaggaaaagcccgtaaacattgaggccgagccgcccttcggagagtcgtacatcgttattggcgcgggcgagaaagcactgaaggtcagttggttcaagaagggatccagcattggcaagatgttcgaggcaactgccagaggggctcggcgcatggcgatcctgggagatacggcctgggactttgggtccatcggcggcgtctttacaagcgtggggaagttagtgcaccagatcttcggcaccgcctacggagttcttttctccggcgtctcgtggacaatgaagatcgggatcggagtgctcctgacgtggcttggcctgaactcccgtagcacctccctgagcatgacctgcatcgcggtcggactggtgaccctatacctgggtgtgatggtgcaggccgactcggggtgcgtgatcaactggaagggccgggagctcaagtgcgggtcaggcatcttcgtgacgaacgaggtccacacctggaccgagcagtacaagttccaggcggatagcccgaagcgcctctccgccgccatcggcaaggcctgggaggaaggggtctgcggaatacggtccgccacaagactggagaacatcatgtggaagcagatctccaacgagcttaaccatatcctcttagaaaacgacatgaagttcaccgtcgtggtgggcgatgtggcgggcatcctcgcccaggggaagaagatgatccggccccagcccatggagcacaagtactcctggaagtcctggggaaaggccaagatcatcggcgccgacgtccagaacactaccttcataatcgatgggcccaacaccccggagtgccccgatgaccagcgcgcgtggaacatctgggaggtggaggattatggcttcgggatttttaccactaacatctggctcaagctgcgggacagctatacccaggtgtgcgatcaccgcctgatgtccgccgccatcaaggacagcaaggccgtacacgccgacatgggctactggatcgaatccgagaagaacgagacctggaagctggcgcgggccagcttcatcgaggtcaagacctgcatctggccaaagagccatacgctgtggagcaacggcgtgctggagtctgagatgatcatccccaagatctatggcggcccgatcagtcagcacaactaccgcccggggtatttcacccagaccgctggtccctggcacctcggcaagctggagctcgactttgacctctgcgagggaacaacggtcgtcgtggacgagcactgtgggaaccgggggccatccctgagaaccaccacggttacgggtaagatcattcacgaatggtgctgccggagctgcacactgccgcctctgcgtttccgcggtgaggatggctgctggtacgggatggaaatcaggcccgtgaaggagaaggaagagaacctggtgaagtccatggtttcggccggttctggcgaggtcgactccttcagcctgggactcctgtgcatttccatcatgatcgaggaagtgatgcggagccgctggtcccggaagatgctcatgaccggtaccctggcggtcttcttcctgctgataatggggcaactcacgtggaacgatcttatccgcctctgcatcatggtgggcgcgaacgccagcgaccgcatggggatgggcaccacctatctagccttaatggccacctttaagatgcgaccgatgttcgcggtcggcctcctgttccgccggctgacgtcccgcgaggtcctgctcctgaccatcgggctgtctctagtggcgtccgtcgagctgcccaacagcctggaggagctcggcgacgggctggctatgggaattatgatccttaaattactgaccgacttccagtcccatcaactgtgggtgaccctgctgagtctgacgttcatcaagactgccttcagtctccactacgcctggaagaccatggcgatggtgctgagtatcgtctccctgttccccctctgcctgagcaccacatcccagaagaccacctggctgcccgtgctcctgggcagcctgggttgcaagccgctcaccatgttcttgatcgcggagaataagatctggggacgcaagtcctggcccctgaacgaggggataatggccgtgggaatcgtcagcatcctcctgagcagtctgctcaagaacgacgtgcccttagcggggcccctgatcgccggcggcatgttaatcgcgtgctacgttatcagcgggtccagcgccgacctgtcactggagaaggccgcagaggtcagctgggaggaggaagctgaacactccggcgcgagccataacatcttggtggaggttcaggacgacgggacgatgaagatcaaggacgaggagagggacgacaccctgaccatcctactcaaggcgacccttctggccgtctcgggcgtttacccgctcagcatacccgcaacactgttcgtctggtacttttggcagaaaaagaagcagcgttccggcgtcctgtgggatacgcccagcccgcccgaggtggagcgcgccgtactcgacgatggcatttaccggatcatgcagcgcggcttgctggggcggagtcaggtcggcgtgggggtttttcaagagaatgtgttccacaccatgtggcacgtaacccgtggcgcggtgctgatgtatcaagggaagcggctcgagcccagctgggcctccgtcaagaaggacctgatcagctatggcggcgggtggcgcctgcagggctcctggaataccggagaagaggttcaggtcatcgcggtcgagcccggcaagaaccccaagaacgttcagacggcccctgggaccttcaaaactcccgagggggaagtgggcgccatcgcgctcgacttcaagcctggaacctcaggttcccccatcgtcaaccgggaacgcaagattgtgggcctgtatggcaacggagtggtcacgaccagcgggacctacgtgtccgccatcgcccaggcaaaggcatcccaggagggccccctgcccgagatcgaggacgaggtgttccggaagcgcaacctcaccatcatggacctgcaccctgggtcgggcaagacgcggcgctacttgccggccatcgtgcgtgaggccatcaagcgcaaacttcgcacactgatactggcccccacccgggtggtggcctccgagatggcggaggccctgaaggggatgcccatcaggtaccagaccactgccgtcaagagcgagcatactggcaaggagatagtggacctaatgtgccacgccacattcaccatgcgactgctctccccggtgcgcgtcccgaactacaacatgatcatcatggacgaggcgcacttcacggacccgagctccatcgcggcccggggctacataagcacccgcgtggggatgggcgaggccgccgctatcttcatgaccgccacgccgcccgggtccgtggaggccttccctcagagcaacgcggtcatccaagacgaggagagagacatccccgaacgctcctggaactctgggtacgagtggatcacagactttcccgggaagacggtgtggttcgtgccctcgatcaagagcggcaacgacatcgcgaactgccttcggaagaacggcaagcgcgtcatccaactgtcccggaagacctttgacacggagtaccagaaaacgaagaacaatgactgggactatgtggtgaccaccgacatcagcgagatgggggcgaacttcagagccgatcgggtcatcgaccctcgccggtgcctcaagccagtgatcctgaaggacggccccgagagggtcatcctggccgggcccatgccggtgacagtggcatccgccgcgcagcgacgcgggcggatcgggcgcaaccacaataaggagggcgaccagtacatctacatgggccagccactcaataacgatgaggaccatgctcactggacggaggccaagatgctgttggacaacatcaacacccccgagggcatcatccccgcactcttcgagccagagcgcgagaagtccgccgcgatcgacggtgagtaccggctgcgcggggaggcccggaagaccttcgtggaactgatgcgccggggcgacctccccgtgtggctgtcctataaagtggcgtccgaggggttccagtacagcgaccgtcgatggtgcttcgacggcgaacgcaataaccaagtcctcgaggagaacatggatgtagagatctggaccaaggagggcgagcggaaaaagctccggccccggtggctggatgcccgcacgtattcggaccccctggctctccgggagttcaaggagttcgcggcagggcgcagaagcgtgtccggcgacctgatcctggagatcgggaagctcccgcagcacctgactcagagggcccagaacgccctggataacctcgtcatgctgcacaacagcgagcaagggggacgcgcgtacagacacgccatggaagaactacccgacaccatcgagaccctcatgctgctggccctcatcgccgtgctgaccgggggcgtgaccctgttcttcctatccggacgtggcttagggaagaccagtatcggcctgctctgtgtcatggcctcaagcgtgctgctgtggatggcgtccgtggagccccactggatcgccgccagcataatcctcgagttcttcctgatggtgctgctcatccccgagcccgaccgccaacggacgccccaggacaaccagcttgcctacgtggtgatcggcctcctcttcatgatcctgaccgtcgccgcgaacgagatgggattgctcgagacgaccaagaaggacttgggcattgggcacgtggccgtggagaaccaccatcacgccgctatgctggacgtcgacctccaccccgcgtccgcctggaccttatacgccgtggccaccacgatcatcaccccgatgatgcgccacaccatcgaaaataccacggccaacatcagcctgactgccatcgcgaaccaggccgccatcctgatgggcctcgacaaggggtggcccatctccaagatggacataggcgtacccctgctcgctctaggttgctacagccaggtgaaccccctgacccttaccgcggcggtgctgatgcttgctgcccactatgctatcattgggccgggcctccaggcgaaggccacgcgtgaggcccagaagagaaccgcagccgggatcatgaagaaccccactgtggacggcatcgtcgccatcgacctggaccccgtggtatacgacgccaagttcgagaagcagttggggcaaatcatgctactgatcctctgcacctcacagatcctcctgatgcgcacgacatgggcactgtgtgagagcatcaccctcgccacaggccccctgacgaccctttgggagggtagtccgggcaagttctggaacacgaccatcgccgtcagcatggcgaacatcttccggggctcctacctcgccggggccggcctggcgttctcactgatgaagtccctcggcgggggtagacgggggacgggcgcgcagggggagacgctgggcgagaaatggaagcgccagctgaaccagctgtccaagagcgagttcaatacatacaagcggtctggcatcatggaggtagaccgtagtgaggccaaagaggggcttaaacggggcgagacgacgaagcacgccgtgtcccgcgggaccgccaagctccggtggttcgtcgagcgcaacctcgtgaagcctgagggaaaggtggtcgacctggggtgcggccggggcggctggagctactactgcgcaggactgaaaaaggtcaccgaggtgaaagggtacaccaagggagggcccgggcacgaggaacccatccccatggcgacatacggctggaacttggtcaaacttcactccggcaaagacgtattcttcattccgcccgagaagtgcgataccttgctgtgcgacatcggcgagagctcccctaacccgacgatagaggagggccgcaccctgcgtgtgctgaagatggtcgagccgtggctgcgcggcaatcagttctgcatcaagatcctcaacccatacatgcccagcgtggtggagacgctagagcagatgcagcggaagcacgggggcatgctggtcaggaacccgctctcccggaacagcacccacgagatgtactgggtgtcctgcggaaccggcaacatcgtgtctgccgtaaacatgaccagtcgcatgctcctgaacaggttcaccatggcccaccggaagcccacgtacgagcgcgatgtggacctgggcgccggcacccggcatgtggccgtggagcccgaggtggcgaacctggacatcatcgggcagcgcatcgagaacatcaaacacgagcataagagcacctggcactacgacgaggacaacccctacaaaacctgggcctaccacgggtcatacgaggtaaaaccgagcgggagtgcctccagcatggtgaacggcgttgtcaagctgcttacgaagccctgggacgtgatcccgatggtgacccagatcgcgatgaccgacaccacgcctttcgggcagcagcgagtcttcaaggagaaggtggacaccaggaccccgaaggccaaacggggcacagcgcagatcatggaagtgacagcccgctggctctggggattcctgtcgcggaacaagaaaccccgcatctgcacacgggaggagttcacgcgaaaggtcagaagcaacgctgcaattggtgctgtgtttgtggacgaaaaccagtggaactctgccaaggaggccgtcgaggatgagcgcttctgggatctcgtgcaccgggagcgcgagctacacaagcagggcaagtgcgcgacctgtgtgtacaacatgatggggaagcgggagaagaagctgggcgagttcggaaaggccaagggctctcgcgcgatctggtacatgtggctcggtgcccggttcttagagttcgaggcgctgggcttcatgaacgaggaccactggttctcccgtgagaacagcctctccggcgtcgaaggtgagggcttacacaaactggggtatatcctcagggacatcagcaagatacccggcgggaacatgtacgccgacgacacggccggctgggacacccgcatcaccgaggatgacctgcagaacgaggctaaaattaccgacatcatggagcccaagcacgcactgctcgctaaggccatcttcaagctgacgtatcagaacaaggtggtgcgtgtccaacggcccgccaagaacggcaccgtgatggacgtaatatccagacgggaccagcgcgggagcggccaggtcgggacctacggcctgaacacctttactaatatggaggcgcagctgatacggcagatggagagcgagggcatctttagcccctccgagctggagacccctaacctggccgagcgcgtgttggactggctggagaagtatggggtggagcggctgaagcgcatggccatcagtggcgacgactgcgtcgtgaagccgatcgatgaccgattcgccaccgccctcaccgcgctaaacgacatggggaaggtccgcaaagatatcccccaatgggagccctccaaaggctggaatgactggcagcaggtcccattctgctctcaccacttccaccagctgatcatgaaggacgggcgggagattgtggtcccatgccgcaaccaggacgagctcgtcggccgggcccgcgtgtctcagggcgccggatggagcctgcgggagacggcctgcttaggcaagtcgtacgcgcagatgtggcagctcatgtacttccacaggcgggacctgcgcctggccgctaacgccatctgttccgccgtgcccgtcgactgggtgcccacgtcccgcaccacctggtccatccacgcgcaccaccagtggatgactaccgaggacatgctaagcgtttggaaccgcgtatggatcgaggagaacccctggatggaggacaaaacccatatctccagctgggaggacgtgccgtacctggggaagcgcgaggaccaatggtgcggctccctgatcggtctcaccgcccgggccacgtgggccacaaacatccaggtagccatcaaccaggtacgccgcctgatcgggaacgagaattacctggactacatgaccagcatgaagcgcttcaagaacgagtccgaccccgagggcgcgctttggtga

SEQ ID NO: 24651 - RNA, 9879 nt, synthetic construct
  misc_feature 1..9879: note = derived and/or modified CDS sequence (opt11) from DENV-1__HQ624984__SS-prME
  source 1..9879: mol_type = other RNA
agcgtgaccatgctgttgatgctgatgcccaccgccctggccttccacctcactactcggggcggggagccccacatgattgtaagcaagcaggagcggggcaagagcctgttgttcaagaccagcgcgggggtgaatatgtgcaccctcatcgccatggatctgggcgagctgtgcgaggacacgatgacctacaagtgcccccgcatcaccgaggccgagcccgacgacgtggactgctggtgtaatgccaccgacacgtgggttacctacgggacctgtagccagactggcgagcaccgaagggacaagcggtccgtggccctagccccccacgtaggcctggggctggagacgcgcaccgagacctggatgtcctcggaaagcgcgtggaagcagatccagcgggtcgaaacctgggcactccgccacccgggcttcacggtgatagccttattcctggcgcacgccatcgggacttcgatcactcagaagggcatcatcttcatcctcctaatgctggtgacccccagcatggcaatgcggtgcgtcgggatcggctccagagacttcgttgagggcttgagcggtgccacgtgggtggacgtagtactggaacacggctcctgcgtgacgaccatggccaaggacaaacctaccctggacattgagctcctgaagacggaggtcaccaacccggcgatcctgcggaagctctgcatcgaggctaaaatctcgaacacaaccacggactcgcgctgtccgacccagggcgaggccaccctggttgaagagcaggacgccaacttcgtgtgccggaggaccttcgttgatcggggctggggcaacgggtgcggcctatttgggaagggctctctcatcacgtgtgctaaattcaaatgcgtgacgaagctggagggtaagatcgtccagtatgagaacctgaagtattccgtcatcgtgacggttcacacaggcgaccaacatcaggttggtaatgaaagcacggaacacgggactaccgcgaccatcacgccccaggcccccacgaccgagatccagctcaccgactatggcgccctcaccttggactgcagcccccggacggggctcgatttcaacgagatggtgcttctgaccatgaaagagaagtcctggctcgtccacaagcagtggttcctggacctcccccttccctggaccagcggcgcctccaccagccaagagacgtggaaccggcaggacctgctggtgacctttaagactgcacacgcgaagaagcaagaggtggtcgtgttggggtcccaggagggcgccatgcacaccgcgctgacgggcgccacagagatccagaccagcgggaccacgaccatcttcgccggccacctgaaatgccgtctcaagatggacaagttaaccctgaaaggaatgtcctacgtgatgtgcaccggcagcttcaagctcgagaaggaagtcgccgaaactcagcacggaaccgtgctggtgcagataaagtacgaaggcaccgacgcgccctgcaagattcccttttccacccaagacgagaagggcgtaacgcaaaacgggcggttgatcacggccaacccgattgtgaccgacaaggagaagcccgtgaacatcgaagccgagccgccgttcggcgaaagctatatcgtgatcggtgcgggtgaaaaggcccttaagctatcctggttcaaaaagggcagctccatcgggaaaatgttcgaagcgaccgccagaggcgcccggcgcatggcgatcctgggggacacggcctgggacttcggctccatcgggggtgtgttcacctccgtaggtaaactggtccaccagatattcgggacagcctatggcgttctgttcagcggtgtgtcatggaccatgaaaatcggcattggggtcctgctgacgtggctcggtctgaactcccgctccacctcactgtccatgacctgcatcgccgtcggtctagtgaccctgtacctgggagtcatggtgcaggcagacagcggatgcgtaatcaactggaagggacgggaactcaagtgcggcagcggcatcttcgtcacgaatgaggtccacacctggaccgagcaatataagttccaggctgattcccccaagagactgtcggccgccatcggcaaggcctgggaggagggcgtttgcggtatcagatcagccactcgcttggagaacatcatgtggaagcagatcagcaacgagctgaaccacatcctgctagagaacgacatgaagttcaccgtcgtggtgggcgacgtcgcggggatcctggcccagggtaagaagatgattcggccccaacccatggagtacaagtactcctggaaatcctgggggaaggccaaaatcattggggccgacgtgcagaataccactttcatcatagacggccctaacacaccggagtgccccgacgaccagcgcgcgtggaatatctgggaggtggaggactacgggttcggcatcttcaccacaaacatctggctgaagctacgcgactcctatacccaggtgtgcgaccaccgcctcatgagcgctgctataaaggactccaaggccgttcacgccgacatggggtactggatcgaaagcgagaagaacgagacctggaaactggcgcgggcctccttcatcgaggtgaagacctgcatctggcccaagagccacaccctgtggtccaatggcgttctcgagtcagagatgatcataccaaagatctacggcgggccaatctcccagcacaactaccgccccggctactttacccagacggccgggccctggcatctcggcaagctggagctcgatttcgacctgtgtgagggaaccacggttgtggtcgacgagcactgcggcaaccggggcccttctctgcgcaccacgaccgtgactgggaagatcatacacgaatggtgctgccggtcctgcaccttaccgcccctccgcttccgaggcgaagatgggtgttggtacggcatggagattcgccctgtgaaggagaaggaggagaacctggtcaagagcatggtgagcgccgggtccggcgaggtggacagcttctccctcggcctgctgtgcatctccatcatgatcgaggaggtcatgcggagccgctggagtcgtaagatgctgatgaccggaaccctggccgtgttcctgctcctcatcatgggccagctaacgtggaacgacctcatccgcttgtgcatcatggtgggggcgaacgcctccgaccggatgggcatggggaccacatacctggccctcatggccaccttcaagatgcgtccgatgttcgcggtcggactgctgttccgcaggctcacgagccgcgaggtgctgcttcttactatcggcctgtccctggtggcaagcgtcgaactccccaattccctcgaggagctaggggacggcctggccatgggtataatgattctgaagctgctaaccgacttccagagccaccagctgtgggccaccctgctcagcttaacgttcatcaagaccaccttcagcctgcactacgcctggaaaaccatggctatggtgctctccatcgtcagcctgttccccctgtgcctctccacgaccagccagaagaccacctggctgcccgttctgctgggtagtctgggctgcaagccactgactatgttcctcatcgccgagaacaagatctgggggcgccgcagttggccactgaacgagggaataatggccgtcggaatcgtcagcatcctcctctcaagtctgctgaagaacgacgtgcccctggccggccccctgatcgccggggggatgctgatcgcgtgctacgtgatcagcggcagctccgccgacctcagcctggagaaggccgccgaggtcagctgggaagaggaggccgagcacagtggggcgtcccataacatcttggtggaggtgcaggacgacggaaccatgaagataaaggacgaggagcgggacgacaccctgaccatcctgctgaaggccacgctcctggccgtcagcggggtgtacccgttaagcatccccgccaccctcttcgtgtggtacttctggcagaagaagaagcagcgctcgggcgtcctgtgggacaccccgagcccgcccgaggtggagcgagccgttctcgacgacgggatctaccgcatcatgcaaagggggctcctgggccgcagccaggttggggtgggggtcttccaggagaacgtcttccacaccatgtggcacgtgacccgcggggcggttctgatgtaccagggcaagcgcctggagccctcctgggcctctgtcaagaaagacctcatctcctacgggggcgggtggcggctgcaggggtcctggaatacgggggaagaggtacaggtcatcgcggtagagcctgggaagaatcccaagaacgtgcagaccgccccaggcaccttcaagacgtccgagggggaggtgggcgctatcgcgctcgacttcaaacccggcactagcgggagccccatcgtcaaccgcgagggcaagattgtggggctatacggcaatggtgtggtcaccacctccgggacgtacgtcagcgccatcgcgcaggccaaggcgtcacaagagggccccctcccggaaatagaggacgaggtgtttcggaagcgcaatctgacaatcatggacttgcaccccgggagtggcaagacccggcgctatttaccagccatcgtgcgggaggccatcaagcgcaagctgcgcacccttatactggccccgactcgggttgttgcctcggagatggcggaggccctgaaggggatgcccatccgctaccagacgaccgccgtcaaaagcgagcacaccggcaaggagatcgttgacctgatgtgtcacgcaacgttcacgatgcggctgctttcccccgtgcgcgtgcccaactacaacatgatcattatggacgaggcccactttaccgaccctagctcaatcgcggccaggggctacatcagcacccgcgttgggatgggtgaggcggctgcaatcttcatgaccgcgacgccgcccgggtccgtggaggctttcccccagagcaacgccctcatccaagacgaggagcgggacatcccggagcgctcctggaacagcggctacgagtggattaccgactttcccgggaagaccgtgtggttcgtgcccagtatcaagagcgggaacgacatcgccaactgcctgaggaaaaacggcaagcgtgtgatccagctgtcgcggaagaccttcgacacggagtaccagaagaccaagaacaacgactgggactacgtcgtgaccaccgacattagcgagatgggggcgaatttccgcgcagaccgggtaatcgatccccggcggtgcttaaaaccggtcatactcaaggacggccccgagcgcgtgattctggccgggcccatgcccgtcacggtcgcgtccgccgcgcagcggcgcggacgaatcgggcgcaaccacaacaaggagggcgaccagtacatatacatgggccaaccgctaaacaacgacgaggaccacgctcactggaccgaggccaagatgctgctggataacatcaacacacccgaggggatcatccccgccctcttcgaacccgagcgcgaaaaatccgccgcgatcgacggcgagtaccggctgcgcggggaggcccggaagactttcgtggagctgatgcgccggggcgatctcccggtctggctgagctacaaagtggcctccgaagggttccagtactccgaccgccggtggtgcttcgatggcgagaggaacaaccaggtgctagaggagaacatggacgtcgagatctggacgaaggagggcgagcggaagaagctcagaccccggtggctggacgcgcgcacctactctgaccccctggccctccgggagttcaaggagtttgcggccgggcggcggtctgtgtccggcgacctgatcctggagattgggaagctcccgcagcacctgacgcagcgcgcccagaacgccctcgacaacctcgtgatgttacacaactcggagcagggcggccgggcgtatcgtcacgccatggaggagttgccggacaccatcgagacactcatgctcctagctttaatcgccgtccttaccgggggcgtgaccttattcttcctctccgggaggggcctcgggaagacgagcatcggcctactctgcgtcatggcctccagcgtcctgctgtggatggcgtccgttgagccccactggatcgcagccagtatcattctcgagtttttcctgatggtgctgctcatccccgaacccgaccgccagcggaccccgcaggacaaccagctggcgtacgtggttatcggactcctcttcatgatcctgaccgtggcggctaacgagatggggctgctcgaaaccaccaagaaggatctgggcataggacacgtcgccgtggggaaccaccatcatgccgccatgctggacgtggacttacaccccgcaagcgcgtggacattgtacgccgtagccacgaccatcatcacgcccatgatgcgtcacaccatcgaaaacacgaccgccaacatttcactgacagccatcgcgaaccaggccgccatcttaatggggctagacaagggttggccgatctccaagatggacatcggcgtgccacttctcgctctggggtgctattcccaggtgaatcccctgactctaactgccgccgtcctgatgctggtggcccactacgccatcatcggccccgggctccaagccaaggcgacccgcgaggcccagaagaggaccgccgctggaatcatgaagaacccgacggtggatgggatcgttgcgatcgatctggaccccgttgtgtacgatgcgaagttcgagaagcagctgggccagatcatgctcctgatactgtgcacgtcccagattttgctgatgcgcaccacttgggccttatgcgagagcatcactctcgccacgggccccctgaccaccctgtgggaggggtcccccggcaagttctggaacacgacgatcgccgtttccatggccaacatctttcgggggtcctacctcgcgggcgccggcctggccttctccctgatgaagtccttggggggggggcgccggggcaccggggcccagggcgagaccctgggtgaaaagtggaagcgtcagctgaaccagctctccaagagcgagttcaacacctacaagcggtccgggatcacggaggtggaccgcagcgaggcgaaggagggcctgaagcgcggggagaccacgaagcacgccgtgtcccgcggaacagccaagctgcggtggtttgtcgagaggaacctagtcaagccagagggaaaggtgatcgacctcggctgcggtcgcggcgggtggagctactactgcgccgggctgaagaaggtcacggaagttaaggggtacaccaagggcgggcccggccatgaggagcccatccccatggccacctacgggtggaacctagtgaagctccactccggcaaggacgtttttttcattccgcccgaaaagtgcgacactctgctgtgcgacatcggggagagctcccccaatcctacgatagaggagggccgcaccctccgggtgcttaagatggtggagccgtggctcagggggaaccagttttgcatcaagatactcaacccctacatgccctctgtcgtggagactttagagcagatgcagcggaagcacggcggcatgctggtgcgcaatcccctcagtcggaacagcacccacgagatgtactgggtctcctgtggaaccggcaacatcgtgagcgcggtgaacatgacgtctcgtatgcttttaaaccgtttcaccatggcgcaccggaagccgacatatgagcgcgacgtcgacctgggggccggcactcggcacgtggccgtggagcccgaggtcgccaacctggacatcatcgggcagcgcatagagaatatcaaacacgagcacaagtctacttggcactacgacgaagacaacccctacaagacttgggcgtaccacgggtcatacgaggtgaagccctcgggcagcgccagcagcatggtgaacggggtcgtaaagctgctcaccaagccgtgggacgtcatccccatggtgacccagatcgccatgacagacaccactccgtttggccagcagcgggtgttcaaggagaaggtggacacccgcacgcccaaggccaagagaggaaccgcgcagattatggaggtgaccgcgaagtggctttggggcttcctgtctcgcaacaagaagccgcggatctgcacccgcgaagagttcacgcggaaggtgcgcagcaatgccgccattggcgccgtcttcgtcgacgaaaaccaatggaactccgcgaaggaggccgtggaggacgagcggttttgggacctcgtccaccgcgaacgggagctgcacaaacaggggaagtgcgccacctgcgtgtacaacatgatgggcaagcgcgagaagaaactgggggaattcggcaaggccaaggggagccgggccatctggtacatgtggctcggcgcccggttcctggagttcgaggccctgggctttatgaacgaggaccactggttctcgcgggagaacagcctctctggggtggagggcgagggactgcacaaactgggctacatactccgcgacatctcgaagatcccaggcggcaacatgtacgccgatgacaccgccggctgggacacccggatcacggaagacgacctacaaaatgaggcccgcatcaccgacatcatggagccggagcacgcgctgcttgctaaaagcatcttcaagctgacctaccagaacaaggtcgtgcgcgtgcaacggccggccaagaatgggaccgttatggacgtgatctcccgtcgcgaccagcgcggctccggccaggtgggcacatacggcctgaacacctttaccaacatggaagcccagttgatccggcagatggaaagcgaggggatcttcagtccaagcgagctggagacccccaatctggccgagcgcgtcctcgactggttagagaagtatggcgtggagcggctgaaacgcatggcgatctccggggacgactgtgtggtcaagcctatcgacgaccgattcgccacagccctcactgccctgaacgacatgggcaaggtgagaaaggacattccgcagtgggagcccagtaaggggtggaacgactggcagcaggttcccttctgcagccaccacttccaccagttaataatgaaggacggccgggagatagtcgtgccctgccgcaaccaggacgagctcgtcgggcgggcccgcgtatcccagggggcaggctggagcctgcgggagaccgcttgcttggggaagagctatgcccaaatgtggcagctcatgtacttccatcgccgggacctgaggctagcggcgaacgccatctgtagcgccgtgccggtggactggatccctacctccagaactacctggagcatccacgcgcaccaccagtggatgacgacagaggacatgctctccgtctggaaccgcgtgtggatcgaggagaacccctggatggaggacaagacgcacatcagctcctggggcgatgtgccgtacctggggaaacgcgaagaccagtggtgcgggagcctgatcggactaaccgcccgggcgacatgggccaccaatatccaggtcgccatcaatcaggtgcgccggctgatcgggaacgagaactatttagactatatgacctcaatgaagcgcttcaagaacgagagcgatccagaaggcgccctctggtga

SEQ ID NO: 24652 - RNA, 9879 nt, synthetic construct
  misc_feature 1..9879: note = derived and/or modified CDS sequence (opt11) from DENV-1__HQ891314__SS-prME
  source 1..9879: mol_type = other RNA
agcgtgacgatgctgctgatgttaatgcccacagctctggcctttcacctgactacccgaggcggagagccccacatgatcgtgagcaaacaggagcgagggaagagcctgctgttcaagacaagcgcgggggtgaatatgtgtactcttatcgccatggacctgggtgagctatgcgaagacactatgacgtacaagtgcccccggattaccgaggccgaacctgacgacgtagattgctggtgtaatgccaccgacacgtgggtcacctacgggacttgctcccaaaccggcgagcacaggagagacaaacgatccgtggcccttgcgccacacgtgggcctgggactggaaacgcggaccgagacctggatgtcatctgagggcgcttggaagcagatccagcgggtcgaaacctgggccttacgtcatcccgggttcacggtgatcgccctttttctggcgcacgctataggcacatcaataacgcaaaaggggattatcttcatcctactcatgctagtaaccccctccatggccatgcggtgtgtaggcattggcagcagggacttcgtggaagggctctccggggccacgtgggtggacgttgtgctcgaacacgggtcgtgcgtgactaccatggccaaggataaacctaccctagatatcgagctcttgaagacggaggtcaccaatcccgcagtcctccggaagctctgcatcgaggccaaaatatccaacacaacaacggacagccgctgccccacccagggggaagccaccctggtcgaggagcaagacgctaacttcgtgtgtcggcgaacgttcgttgaccgaggctgggggaacgggtgtgggctattcggcaaagggtcccttctcacctgcgcaaagttcaagtgcgtgaccaagcttgaaggtaagattgtccagtacgagaacctcaaatactccgtgatcgttaccgtccataccggtgaccagcaccaggtgggaaatgagtccactgagcacggcaccacagcaaccatcacacctcaagcccccacgactgagatccaactaactgactacggggcgctgacgctggactgctcgcctcgcacgggcctagacttcactgaaatggtactgctcaccatgaaggagaagagctggctggtgcacaagcagtggtttcttgacctgccgctgccctggacctcgggtgcctctacgtcccaggagacctggaacaggcaggacctgctcgtgaccttcaagaccgcccacgcaaagaagcaagaggtcgtggtgctcggcagccaggaaggcgccatgcatacggcgttgacaggggccaccgagatccaaacaagtgggacaaccacaatattcgccgggcatctcaagtgccggctgaagatggacaaactaaccttgaaaggcatgtcctatgttatgtgcacggggagcttcaagctggaaaaggaggttgcagagacccagcacggcaccgtgctggtacagatcaagtacgagggcaccgatgccccatgcaaaattccgttctcgactcaggatgagaaaggggtgactcagaacggcaggctgatcacagccaacccgattgtcactgacaaggagaagcccgtcaacatcgaggccgagccgcccttcggggaatcctatattgttataggcgcgggcgaaaaggccctcaaactgtcttggttcaaaaaggggtccagcattggcaagatgtttgaggccaccgcccgtggcgcacgacgcatggcgatcttaggggacaccgcgtgggacttcgggtccatcgggggggtgttcacctctgttgggaagctcgtgcaccagatcttcggcacagcgtatggtgttctgttctccggcgtcagctggacgatgaagatcgggatcggggtgctgctcacctggcttggcctaaactcccgcagcacgtccctcagcatgacctgcatcgctgtgggactggtcacgctttacctcggtgtcatggtgcaagcagactccgggtgcgtcattaactggaagggccgggagcttaagtgcggcagcgggatcttcgtgacgaacgaggtgcacacatggaccgagcaatacaagtttcaggcggacagcccgaagcgactgtccgccgccatcggcaaggcctgggaggagggggtctgcggcatccggtccgcgacacgcttggaaaacataatgtggaagcaaatctccaacgaactgaaccacatcctactcgagaatgacatgaaattcacggtggtggtcggggacgtggctggcatcctagctcaagggaagaagatgatcagaccgcagcccatggagcacaagtacagctggaaaaactggggcaaggccaaaatcatcggcgccgacgtgcagaactccacctttataatagacgggcccaacaccccggagtgttcggacgaccagcgcgcgtggaatatctgggaggttgaggactatggcttcgggatcttcacgacgaacatctggctcaaactccgggactcctacacccaggtctgcgaccaccgattgatgagcgccgccatcaaggattcgaaggccgttcacgccgatatgggctactggatcgagagcgagaaaaatgaaacctggaagttggccagggccagtttcatcgaggtcaagacatgcatatggcccaagagtcatacactctggtctaatggagtgttggagagtgagatgatcatccccaagatctacggaggccccatttcccagcacaactatcgcccgggttacttcactcagacagccggcccctggcatctgggaaagctcgagctggacttcgacctctgcgagggcactacggtagtcgtggatgaacattgcggcaaccgggggcccagcttgcgcacaacgaccgtaacgggcaagatcatccacgagtggtgctgcaggtcctgcacactgccgcccctgcgctttaggggcgaggatggctgttggtatggcatggagatccgccccgtaaaggagaaggaggaaaacctcgtcaaatccatggtcagcgccggttccggcgaggtggacagcttctccctgggtctactgtgcatcagcattatgatagaggaggtgatgaggtccagatggagccggaagatgctgatgaccggcacactggcggtgttcttcctgctgatcatggggcagctgacttggaacgacctgatccgcctctgcataatggtcggcgcgaacgcttcggaccgcatgggtatgggcacaacctacctggccttgatggcgaccttcaagatgcggcccatgttcgcagtgggcctgctgtttcgacggcttacgagtagggaggtgctcctgctcacgatagggttgagcttggtcgcgagcgtggaactccctaacagtctggaggagctcggcgacgggctcgcaatgggcatcatgatcctcaaactattgacggacttccaaagccaccagctgtgggcaaccctgctctccatgacgtttatcaaaaccacattctctctgcactatgcttggaaaaccatggcgatggttctatccatcgttagcctcttccccttgtgtctgtctacgacaagccagaagaccacttggttgcccgtcctgctgggctctctagggtgcaaacccttaacaatgtttctgatcgccgaaaacaagatctggggccggaagtcgtggcctctaaacgaggggatcatggccgtaggtatcgtcagcatcctgctttccagcctactgaagaacgatgtgccactggctggtccactcatagccggcgggatgctaattgcatgttacgtgatatccggcagctcggctgatttgagcctggagaaggcggctgaggtttcatgggaagaggaggcagagcacagtggcgcgagtcataatatactggttgaggtccaagatgacgggacgatgaagatcaaggacgaggagcgcgacgacaccctcactatcctccttaaggcaaccctcctcgcagtgagcggggtgtaccccctctcgatcccggccactcttttcgtctggtatttctggcagaagaagaagcaacggagcggcgtgctctgggacaccccctccccacccaaagtagaacgcgccgttctggatgatggcatctaccggatcatgcagcgcggcctgctagggcggagccaggtgggcgtcggggtctttcaggagaacgtctttcacaccatgtggcacgtcacacgcggcgcggtactgatgtaccagggcaagcgtctggaacctagttgggccagcgtgaagaaggacctgatctcatacggcggcggttggcgcctccagggtagctggaatacgggcgaagaagtccaggtaatcgcggtggaacctgggaagaaccccaagaacgtgcagacagcccccggtacattcaaaactcctgaaggcgaggtcggcgccatcgccttggacttcaagccgggcacatccggtagccccatcgtaaacagggagggaaagatagtgggactttacggcaacggggttgtgacaaccagcggcacctatgtgtcagcaatagcccaagcaaaggcgagccaggaggggcctctcccggagatcgaggacgaggttttccgcaaacgaaaccttacgattatggatctacacccggggtccgggaaaacgcgccggtatttgccggccattgtccgtgaggcgatcaaacgcaagatgcgtaccttaatcctagccccgacccgcgtggtggcttcagagatggcggaagctttgaaaggcatgccgatccgctaccagacgacagctgtgaagtccgaacacaccggaaaggagatagtagacctaatgtgccacgcaacctttacgatgagactgttatcacccgtccgtgtccccaattataacatgatcatcatggatgaagcccacttcactgatccgtcgagcatcgccgcgcgcgggtatatatcaacccgggtgggtatgggcgaggcagctgcgatcttcatgaccgcgacgccccccggcagcgtcgaggcgtttccccagtccaatgctgtcatccaggacgaagaacgcgacatcccggagcggagttggaactctgggtacgagtggattaccgatttccccggcaagaccgtgtggttcgtcccgagcattaaggccggaaatgacattgctaactgcctgaggaagaacggaaagcgggttatacagctgtcccgcaagacctttgatacagaataccagaagacaaaaaacaacgactgggactatgtggtgaccacagatatcagcgagatgggtgccaacttcagggccgaccgcgtgatcgaccctcgacgttgcctcaagccggtgatcctgaaggacggaccagagcgggtaattctggctggcccgatgcccgtaacggtcgcctccgcggcccagcgacgggggcgaataggacggaatcacaataaagagggcgatcagtacatctatatggggcaaccgctcaataacgacgaggaccacgcacactggaccgaggcgaaaatgctgctggacaacatcaatacccccgaaggaattatacccgccctctttgaacccgagagggagaagtcggcggccatcgacggggagtatagactgcggggcgaggcccgcaagaccttcgtggagttgatgcgtcgaggggatttacccgtgtggttatcctacaaggtcgccagcgaaggtttccaatactcggaccggagatggtgttttgacggcgaacggaacaatcaagttctggaggagaacatggacgtagagatctggactaaggagggagagcgcaaaaaactccggccccgctggctggacgcccgaacttactcggaccctttagcgctacgcgagtttaaagaattcgccgctggccggcgcagcgtttccggggacctgatattagagatcgggaaattaccgcaacacttaactcagcgggcccaaaacgcgctggacaacctcgtgatgctccacaattcagagcaaggcgggcgcgcctaccggcacgctatggaagaacttcccgacacgatcgagacgctaatgctcctggcactcatagccgtactgaccggaggggtcaccctctttttcctttctggcaaggggctgggcaagacctcaatcggcctcctgtgcgtgatggcgtccagcgccctgctgtggatggccagtgtggagccccactggatcgcagcgagcatcatcttggagttctttctgatggtcctgctaatcccggaacccgaccgccagcgaaccccacaggataaccagctggcgtacgtcgtcatagggctcctgttcatgatcctgacagtggccgccaacgaaatgggtctgttagagacaaccaagaaggaccttgggattggccacgtcgcagtggaaaaccatcaccacgccgcgatgctggacgtggacctccaccccgcctcggcctggaccctgtacgccgtggccacgactattatcacgccgatgatgcgccataccatcgaaaacacgaccgcgaacataagcctgaccgccatcgccaaccaggccgcgatcttaatggggttggacaagggctggcccatatccaagatggatataggcgtgcctttactcgccctggggtgctacagccaggtcaatcccttgaccctaacagccgccgtattaatgctggtggcccactatgctatcatcggccctggcctccaggccaaggccacccgggaggcccaaaaacgcacagctgctggaatcatgaaaaatcccaccatcgacggtatcgtagctatcgacctcgaccccgtggtgtatgacgctaagttcgagaagcagctgggacagatcatgctcttgatcctttgcacatcccagattctcctcatgcgtaccacatgggccctgtgcgaatccatcacactagccacaggcccccttaccaccctatgggaagggtccccgggaaaattctggaacactaccatcgcggtctccatggccaacattttccggggatcctacctcgccggcgcgggcctcgctttcagcttaatgaagtccttagggggtggtcgccgcggcaccggggcacagggtgagacactgggcgagaagtggaaaagacagttaaatcagctgagtaagagcgaattcaacacctacaagaggtccgggataatggaggtcgatcgaagcgaggcaaaggagggtctgaagcggggggaaacgaccaaacacgccgtgtcccgcggcactgccaaactgcggtggttcgtagagcgcaacctcgtgaagccggaggggaaggtgatcgacctgggatgcgggcgcgggggttggtcttactactgcgccgggctgaagaaggtcacagaagtgaaggggtacactaaaggcgggccaggtcatgaagaacccattccgatggccacgtatggttggaatctggtgaaactccacagcggcaaagacgtgtttttcatcccgcccgaaaagtgcgatactctgctttgtgacatcggagagagctctcccaaccccacgattgaggagggtcgcacgctacgggtactgaagatggtggagccttggctaaggggcaaccaattctgcattaagatcctcaacccttacatgccctctgtcgtcgagacccttgagcagatgcagcgtaagcacggaggcatgctggtgcgtaatcccctctcccggaattccacacacgagatgtactgggtgtcctgcgggaccggcaacattgtgagtgccgtgaacatgacctcccgcatgctgcttaaccgcttcacgatggcacaccggaagcccacctatgagcgcgacgtagatctcggggccggcacgcggcacgtggcggtggagccggaagttgctaaccttgacatcatcgggcaacgcatcgagaacataaagcacgagcacaagtcaacctggcactacgacgaagacaatccttataagacgtgggcctaccatgggtcctacgaagtgaagcccagcggctccgcctcgtcgatggttaacggggtcgtcaagttgctcactaagccgtgggacgtgatccctatggtgactcagatcgctatgaccgacacgacccccttcggccaacagcgggtattcaaggagaaggtagacacccgcactccaaaagcgaaaaggggaacggcccagatcatggaggtgacagcacgctggctgtggtccttcttaagccgcaacaagaaaccaaggatctgtacccgggaggagttcactcgtaaggtgcggtccaatgctgccatcggcgccgtgttcgtggacgagaaccaatggaacagtgccaaggaagccgtcgaggatgatcgcttttgggacctcgtccatcgggagcgggagctgcacaagcagggtaaatgcgctacttgtgtctacaacatgatgggtaagcgcgagaagaagttaggcgagttcgggaaggcaaagggctcccgcgcgatctggtatatgtggctaggggctcggttcctggagttcgaagccctcggattcatgaatgaggaccactggttctcccgggagaactctctctccggcgtagagggggagggcctgcacaagttggggtacatcctccgggacatttccaagatccccggcggaaacatgtacgcagacgataccgcgggctgggacacccgtattaccgaggacgacctgcaaaacgaggctaagattacggacataatggagccagagcacgcccttctagccaaatcgatcttcaagttgacctaccagaataaggtcgtgcgcgtgcagcgcccggccaagaacggcactgtcatggatgtaatctcacgcagggaccaacgcgggagcggccaagtgggaacctatgggctgaatacgttcactaacatggaggcgcagctcatccggcaaatggaaagcgaggagatcttctcgcccaatgagctggaaacccccaacttagctgagcgcgtcctagattggctagagaaatacggcgtggagcgtttaaaacgcatggcgatatctggcgatgactgcgttgtcaagcctatcgacgaccggttcgcaaccgcccttacggcgctgaacgacatgggcaaggtgcgtaaggatatcccccagtgggagccaagtaaggggtggaacgactggcagcaagtccccttctgcagccaccatttccaccagttgatcatgaaagacggccgagagatcgttgtgccatgccgcaatcaggatgaattggtcggccgggcgcgcgtaagccagggggctgggtggtccctgcgggagacagcctgcttaggtaagtcgtacgcacaaatgtggcagctcatgtacttccaccgccgggacttgcgcctggccgcaaacgccatctgtagcgccgtcccggtggattgggtacccacctcacggaccacttggagcattcacgcgcatcaccagtggatgacgaccgaggacatgctctctgtgtggaacagggtctggatagaagaaaatccctggatggaggacaaaacacgagtgagctcttgggaagacgttccctacttgggcaagcgcgaagaccaatggtgcggcagcctcatcggcctcacggcgcgcgccacatgggccaccaacatccaagttgccatcaaccaggtccggcgcctgattggaaacgagaattattcagactacatgacaagcatgaagcggtttaagaacgagtccgagcccgagggcgcactgtggtga
